United States Patent 11,001,841 (CCCTC-BINDING FACTOR (CTCF) RNA INTERACTOME) - sequence listing, part 31

SEQ ID NO: 75367 - DNA, 2640 bp, Homo sapiens
atggtttagctattgtaaaaatttttaagactgattcctttacattgaaatatgagttatgttaccattttagtcacttttttcctcctacctagaaaatattttaaaaatactaaggattttggttaaaaggttgcctcagtaattatagacatagcttacaaagggcaagtatttacccagatgttataatttataagctaaggcttgaaatcacacaaattataaaaataattatgtttaatgccctactttggcagaaacttaccagatttcagtaaatgcaatcctgtcttccaaaaaaggattgaaagtttgaatctctactaaaaactggagactagtaataggacaggtaattttacagttgctaatctatgactgtaatggaagtaaaatatcctatttccccattctatcactgtgtcactatcactatgtcactatcatttttggcaaagcagctgaaggacctcattttccccctttgttttaaaaggaaccaaaaaactggagtgtacactacctgatggaactggacggcgtgtcattcaaaacaacctcaagtaccccttcagcatcgtaagctatgcagatcacttctaccacacagactggaggaggtgagccccacaaattctggacaagcctgaaaaggccaactgttccagaggacacaccacttgttttaccaaaagtcagtacctgacttgactcattaagccctctgaggcttttgtttcatcacctcctcattggcagataagatccttcaaggatgtttttcatcctttcatgtttttgaaatcatccttttacttcacccagaaatcgaatggtattgctcacatatagcttaaaaagtagcaaagctattggataatgtctcaaaagggagcatattaatctaaatatgttctttagagaataagactacccttgataccatgagctatattacagggcttaagttggcttttgacactgtggacatattgtctgagggaccgaaaaatactatttagactagttctcaaatgaggaactgtggaacattaaagtctaagccctttacaccatgccctacaactctgatttgatagctcatcatgtgattctaacatgcagctagagatgagcaatggatttagagcaatggtcttcaaacttcagtatggctttagcaccagccctgggacagagaaggctgccagaaattttcctctattgcaactgattttctgtggctgactgacttctttatctagtaaatgactgtccctgaattcactcttcctttctgttaccagggatggtgttgtatcagtaaataaacatagtggccagtttactgatgagtatctcccagaacaacgatctcacctctacgggataactgcagtctacccctactgcccaacaggtaaaaagtatgctttaggatgctcctttaaattagcagggtagagaagggatatatatggtatttgattacccctgctgcctgtgacactgccaccattgccttcttcctgccctgagggccagtctttactaccttaaatctacctagtttatacacaaaatgcaaagacttgctgttgcaacttggttacaatatactcacccaccaccctgtcccacccctgctcttctctcacaggaagaaagtaagtacagtaatgtaaaggaagacttggagtttacaatcagaacctggaccctaaagaacagtgactgcaaaggcaaagaaagtaaaaaaggaattggccattagacgttcctgagcatccaagatgaacattttgtagtgcaaaaagacttttgtgaaaagctgatacctcaatctttactactgtatttttaaaaatgaaggttgttattgcaagtttaaaaaggtaacagaattttaactgttgcttattaaagcaacttcttgtaaacatttatcattaatatttaaaagatcaaattcattcaactaagaattagagtttaagactctaaacctgatttttgccatggattccttctggccaagaaattaaagcacatgtgatcaatataacaatataatcctaaaccttgacagttggagaagccaatgcagaactgatgggaaaggaccaattatttatagtttcccaacaaaagttctaagattttttacctctgcatcagtgcatttctatttatatcaaaaggtgctaaaatgattcaatttgcattttctgatcctgtagtgcctctatagaagtacccacagaaagtaaagtatcacatttataaataccaaagatgtaacaattttaaaattttctagattactccaataaagtgttttaagttttcctatgacttaaggatctatattgtctctaggacaaagctgggggttggcatatatgccttaaccacaaaggagaaaggtgatttatgcaaacatacagtacataataaaaattctactttcctaaactttattaaagaaaaaagcaataagcaatggtggtaaatctctagaacatacccaattttctgggcttcctcccccgagaatgtgacattttgatttccaaacatgccagaagtgtatggttcccaactgtactaagtaggtgagaagctgaagtcctcaag

SEQ ID NO: 75368 - DNA, 1128 bp, Homo sapiens
cagtttctgtgagtcaggaatccaagtgtgtcttcaccgagctccctcaggcatggagtctctcacaaggctgcaatcaggtaatggccaaactgcagtgatcacaaggctcagctcggggaagacacagcccaagcatgctcacatgggctacaggcaagactaatgtctctggccaacagccctcaaggacatcagttccttggcacatgttcccctttacagggtagcttgcaacatggcatccagcttccctcaaagggagcaagagagagcccctaaggcagaaaccagttttttgagaccgaatatcggcagtgatagcctatcacttctgctatactctatgcactagaagaagcaagacactactaatgcagcccaaactcaaggggattgcttaaggctataatacatgaggagatggagatcactgggggctgcttagatgctgcctaccacaggctacatggctattcttttacaatcttgatttttaacttacagcaacttgtactggacagactggaatagagaagctcctaaaattgaaacgtcatctttagatggagaaaacagaagaattctgatcaatacagacattggattgcccaatggcttaacctttgaccctttctctaaactgctctgctgggcagatgcaggtaatactactgatggaatgcaaatagataacctctcatcacagtgaatgtgagcactaacagattttactacaaaatgaaatcccatcacttagatctcctttctttggtctgtaaacttttaagtactagtaaatttaagtactagtaaatgagtcttaaaatgaactttctggggtttgggtggagggaaggatatatcaagcagtaagtttgtactgcttgcctgaccatgagtgcctggcatatttttaacagttaaaagaattagccattgttgaattgacaaacttaagtgaagttattcttatgcggggagagggtcactataacttacctataaacatctgttataatgctaaggacattctttggaaagcattgtagcagggtagcttccttcagtaataacatgggtattagcaacctacatttgtttgcttttatcagcacaactgaaaaa

SEQ ID NO: 75369 - DNA, 1074 bp, Homo sapiens
tcttatccagacagcaaatataaatgctaaaggacttgaatttttaataaaaagaaaacccaccttgaaccaggttgcaatataacacatgtaattacatctccttcaactgcgtaacagaatggttgtcaagccttcctgcatatttctcatttgctttctatagatttcacctttacaactttcttcctctggcaatccccaaataatttacaccaaatatctgtgtgagcttgtttcagacttattgttgttgatgatattaaatcattttggggaggagactgatcagaagcgatgaagcaatgatatgcatgctgtaccctctggccacctccaccttagcgcaaagtggaaactgctttctagcttttgctctcagcttctctctgcttcatctgttgggcataagggatgaaattcgcaacaggggaaacctatggtttcttcctctcctctcactgaggttctctgtagcccaactgatttattcaaagcttctatagcttttataaaatagtattttataaaaagtgctttcaacattatttctgctctaacgataaacctgtttgtttccttataacctatttccacttaataggaccatatttcctcgttagtatctgttatgaatatatttcatttttaacgtggcatttaaaaggtaaagtgcttaacttaaaatgtttccatccctgggtgccaggtaccccttcaagtaccaaattgtatttttggcagaagaaagaacagtttccttctcaaatccctggtccacatctcttcaagttccatagtttgtatcgaagccattcctaacagctgtatttgtttctattctaaaacccaagatccaattcaagacttcaacaaacggagggttttggggcagttgagtcaaggggtatcttggaggcagggattctgatagtaacttagtaatgacttctcccacatagtgacaataatcagaaaaccttgtgatacaggtaaaagtggaatatggctgtgtattagttacctactgctgtgtaagaaattgcccaaaccctcagcagtgtaagataacat

SEQ ID NO: 75370 - DNA, 1766 bp, Homo sapiens
ggaaaagattcagtttttacccagtaaaatattaaaaacttattttgcttaaggccatgtcctctaattactgaaggggctgatttttttttttttttaaatcatcagtcataatagcacctattgaagggcttactgtatgccaattactgattaggacactttacaagcacttatagtattaatttttatagcaaccatatgaggcaggtacactattggcctcattttgcaaatgagacaaacgcatagaggttaaatgcccaaagccacatggctactaagtggctgagcctagatttcacccgagtgcccacatgtccagctactctgctctgttgcctgcaggatcacagtgcagtgttgctcactgcagctgtgcatgagcaaggcagctgagtgtgaacaaaggggaaatgtaacctaattcttctaattctatgatttgatgcacaaagggctccataatcgtgggaattgattacgactgccgggagaggatggtgtactggacagatgttgctggacggacaatcagccgtgctggtctggaactgggagcagagcctgagacgatcgtgaattcaggtcagcagcttcactcagcagtctgcatttcatttgattctacaaagtcacttgtctactttacgccgaagtctcccctcgatttttctccattaggggaggttaagttctaggcaagtcattttattgagctgtataagactagccccctctgtaagcaaacaccttcatacatacggaatgaaataggtgattcctactgtgcgcacttcttaaaagaattcatggtaagaattcagggtgacgccttcgtttattcagcctggctctggcactgtggatgccggttgtcatcaaactggtaggtctgctggtctagaagctagaggtagtggaatatgtaacaaaagtacttgtttctctattaacctggttcttggggacttggagacacttgggctttgctttcccctgctgacccccctgcccacccgaccgttggagggcttcaggtttgccctccatatcctgcaaacactccagtcctgactttgctttatttccaggtctgataagccctgaaggacttgccatagaccacatccgcagaacaatgtactggacggacagtgtcctggataagatagagagcgccctgctggatggctctgagcgcaaggtcctcttctacacagatctggtgaatccccgtgccatcgctgtggatccaatccgagggtcagctgggcttccctaattcttctcttacctgtagatcctgatgtgaagcccttgggttttaaatacaatgtggggaaggtcagaacaagagagtgaaagctcaaatgcattcatgtaacaaagatttactgaggatctaagaggtgtcaggacctgttctaggaaaagacaaggtctgttctttcatggcacttatattttattaggaggaaacaagactggtataaacaatattagtctgtgatgtgatatgtagaaaattcagatagtgttgtgagaactagggctactctgaatcaaatgatcaggcgaggcctcagctgacacttaaactggaagtgaagtgggattcctccagcagcacatttagaaaccagggttgacgctcacagtagggctgacctacatcaagtgacattagccaaagctcagacacctctggcttcagtgttgctgtagcagaaatcaagataaacattttccctgtctgtataatt

SEQ ID NO: 75371 - DNA, 1086 bp, Homo sapiens
ctttttaagattcgagtttgttgggtcctgtcccctcccccaagaaaactctcacattgttttgtaaaactttctctggaagaggtagagactaagaagttgacatcactttaagctaaccctcttttattcaagtcatagagcttgattgcctttctgaacatgcccctgaccaggacagggtggtgatggtagtggtagtggaactgaaagaaatgggacgtgggttatttgcacattttaaggaaatttacttaaactgggactttttctctaacctgaggttatgacatgggtttatgaatcccatgattcccgggttaatggaagctcatttgaatgtgtactcttgcctgggacaaacgacttttcaattttcaaataaaagtgtagttgaccttaggcccgccccccatataagctgcctgtttttccactgaagccaaatcccgttttgtacaatctttcttggctgactacgctcccagggggcgtaagtgaagccaagccccaggaggctgttaggcaaggcaggaacttgtatgacctcagggacagccagctaacccctgaatgttggctttgcacatctgctgggcttctcagagcaggagcctggattggaaactgaatgaagcaagttctgcatggagttgaggaaaaatatcagactcagcattttttttatttttattatttttttaaaagacttgtcatttatttagcaatgaggaggagagacctcactagccagaggttggataaccactactccctagttccttaacccaataaattagattttttccttcttttgagacagggtgtagctctgtgttgcccaggctgcagtgcagtggcaccatctcggcttggtgcagccttgacttcctgggctcaagcgatcctcccaactcggtctcctgagtagctgggactacaggtgcgtgccaccatgcccagttcatttattttttgttttttagacggggtctcactatgttgctcagtctcgaactcctgggctcaagcaatcctcctgctttggcctcccaacggacagggattacaggcgtgagtcactgt

SEQ ID NO: 75372 - DNA, 2118 bp, Homo sapiens
tgggcctctcctggccagaaggagatcatgccccttcccaggctgagtgagctgcactgctgatcttacctcctcttgttctttcttgatgtggctgggccttgatgacagaccctcctggcaagaaagaagcatcacatgatctatttctgattcccatggtggagaagtacttagaacacatttgcttcccaagtttggtgtccacgggcttggctgagacctggacagtaggagaaggaaggccaggaggccaggcatggggtcttgagctacattttgcattctgtccttgactcacaatcaaaggtttttcttcttccctcttccccatctgctcagagcccacccagaggcccccgaccatctgtgagcgctggagggaaaacctgctggagcactacggtggcaccccccgggatgaccagtacgtgccccagtgcgatgacctgggccacttcatccccctgcagtgccacggaaagagcgacttctgctggtgtgtggacaaagatggcagagaggtgcagggcacccgctcccagccaggcaccacccctgcgtgtaagcacctggccgcccccgctcccctcagctgtatctaaggcctttgctagggatggtgcctgctgtggtgaagtggggggacatgtggggtcaccaggtctaatgaaagaagtcactatgtgctatgttgatttataatctggtccacacaagatcccaatttgcgtttggtgtctggtttttgtcattagcagcttccataattggaacatctgcaactcggttcagcaggcagttactccccctccccagcccagggtgacaggggacacgtgtcactctggagtcctaaaaggaagctgacacaatgctggctctgttttttttttctcttgaaaaaaaaatctgttctgctttgttctgagggaagtgttttgctgtcttcttccctagtaaatggcagatttacataattgatccttaaaaaaaccctagaaattagaatttcttttgaagaacatctggagcacatctgcgtagggcgaagaacttttgatatttttggaggctctggtatgtggtaaagtaacttttcttcccatctccctgcctgcccttgttccccttcctgctctcccaccctctctcccacaggtatacccaccgtcgctccacccatggtccggcccacgccccggccagatgtgacccctccatctgtgggcaccttcctgctctatactcagggccagcagattggctacttacccctcaatggcaccaggcttcagaaggatgcagctaagaccctgctgtctctgcatgtaaagtggatttctcctgtagggggcagggctgcgtggctttcccagtgggagccacctcacaggccctgttgcagtgaggtggactggtgcagggaagtcctggagggtttctgagctgcagcccatcggcatgggcccgatgccaccaccataggaccagggctctctcttgctgggagtcacctgtcactgaccaaggctgtgctctctggttcgttcatggagtttcagataatatggaaagggaactttagagttgtcagcacatggaggctgtatggtgatccaagggaaaatggaccgactcttaccctaagtccccagggttgtatgtcataacatctccatggaaatcctggaaatcaaagtgacaggacaactagtcacaaggtgtgatctctgcggtttgttggggactccaagtggaagtcagttaatgactgtctcaccgttgcagcccttccctttcactttggttctgtccctttgacccacttctttcctaaccttccctgactccatagatgaaaacttgaggagtgtgtgatgctgggagaggagtggatggagccttccccaggggatgtttgatgcttcctgagccagcagcctccctaatgcaaggcaccccattttggggagcgggttttctcaaaaatggaggaaaaaaaagggtggctgtctcgaatggcatcgacacagtggaaaatcatctgattccattgttgaacttcacactccaggcacttgctcatccctgagaaagaatagtacggcattcaag

SEQ ID NO: 75373 - DNA, 1090 bp, Homo sapiens
tcactgtcaatgaaacatgctgtaagatgtgttgtttttttctgtgagcgactacccatttgatttctacactgaacacgtttagtctagtgtgttaactcacatgttccttgattttttttcttcctttctattaagcttacctttaggtgtcagcatttttctgctcatgctcaaaggtcttctgaagctgacacctcactgggtgttgatccacatatccaaagcccatgcagtcgcacagattgtgtgagtgaagtcatagtgttctttgcttctttcttctgtttctgacctctgcagatgtagatgaatgctcagaaaacagatgtcaccctgcagctacctgctacaatactcctggttccttctcctgccgttgtcaacccggatattatggggatggatttcagtgcatacctggtaagtttcagagggccagattaggcacatgaatctcttagctccttcaaggatatttttctatgacagcccactcttgatttagcctggtctggagccttggtggattttccaagctgtggatttttttccttggttacctcctgctgcctagtttactgatagttcactgattcgtaacatttctggaggcctgcgggagacgacccacccatcgtcctacctcatagcccctctggttaactgccctagtgatctgcttgaccttgatgagtgcaatttggatgaagtgttgagatcaagcttattaagcagagccttatgcgccggtagccagggttaagcccgtggcgaccgtgttagaggagcttggctagcttggtgcagtctcgtgagtggtgagtgccgttggcttgcagcttctcagacttaacctgtgggcctcagggcatgaatgagctttggcttgttttctccagagtctcttgggatgttgggcagatgccaccgctatccctcattttccccagatgacaatagggaggggccgggctgctttacacttagagccagctagggacctataggatgaactagaagaactggagagaaatgaggtaaatagtggcaaggtattataaaataagaatctcgggctccaaaatcc

SEQ ID NO: 75374 - DNA, 1006 bp, Homo sapiens
aactcgaaggatttttaacacattttccaaacaggttctttactagcttaatagagtgtaggattgcactgagattaagctacctctcattacctgagtgataaaggggctctacgacttcttgaacgtttttgtctttatagcagtccctacaggcccctgctagtaatgactaagcataagcagtggcctccttctccttctccaataaagttcctcccttgccagggggctgaaagtctttccatgttttctctcttgacatctgatgtcctgtgcatgcccaggtcccgggactctagtctctatcatggtgtgagaggccctccaaggaggagtcaggactgcgaattcagggagtctcaatctttggggcaggaatttctcacttgtgatatcttcagtctctttggggactttctcctccttgttggtcatttctaatagtttctgtctacccagaactttagtatctttgatgatgccaacagtatctgtggggaggaaggctggtctttcagattgagtcagaattcttaggctgaaggttctaagcacaccgttgatttatttggtagctctggggaatcccctctctcttgagttcaaaagtaacaataagaaactgctccatgggctccagaaataggccctgtgtctcaggaattcctgcttcctgtcattgcttggggttcctgttaccattagaagtacttttagcatgcgtattgtgaatagctttaatttcctgcattcggctgaatgttaatttttacaggtttagttttacagccagttttacagcctattccaggtccaaggtattggatggtcaccagttttgcccagctgggcatttgaattgtcctgttgaagaggcagagccaagctcagggataattatgacaacattggttgatttcagggtaactgaggagccaatctggtttgtttctacccttgcagatgaattgatatctgctttcttgcctttataggcgaaatg

SEQ ID NO: 75375 - DNA, 1011 bp, Homo sapiens
gaggctgaggcaggagaatcacttgaaccagggagttggaggttgcagtgagccgagatcacgccactgtactccagcctggcgacagagtgagactccatctcaaaaaaaaaaaaaaaagaaagaaaatgcactctttaattcagtgggatgagggtaaaagtgacaggagaaactgcgtgtgtgtgtgtgtgtgtgtgtgtgtgtgtgtgtagcaattgctctggagtgttataaactttaattgaggactgcttaggtgatgggtttttgtgcttagtattttaacagcaaattcataccagtacttgaactttaatagcatacaaaccatctaggaatcttattaaaatccagattctgaatcactggaccttgggtagggtctgagaacctgcattccctggtctgttgctgttggtctgtggatcatgccatgaggagtgaggctcatcctttgcaggcctaaactctggatgcccttatcttcttctcttttcagtgatcaccccacctgccaacccctgtgaggatggcagtcatacctgtgctcctgctgggcaggcccggtgtgttcaccatggaggcagcacgttcagctgtgcctgcctgcctggttatgccggcgatgggcaccagtgcactggtgagtaactgcaggtcagcctcaatgactggaaagttgctttggatgcacatccccacatagatggagctctcccagaaaagacaaaggacttcctttgactctaacagccttgtggctgccaaaatagtgagaaaaaagcgtcctttgagttagaaaggggagccaagggtgatttcctctggactagatgggcgagcatatatggcttccttggcggagacgttcctgtagcactcgggagcttctaaccttggttccttggagccagcgcaggctggaggaatttagggaaagttgcataccttcctgttaggcggtctccaccttaattcaacacttatggttgtgctcttctgctttaa

SEQ ID NO: 75376 - DNA, 1983 bp, Homo sapiens
attaattggatttacctataaaaattgggaattttagtaagagatcaacagatttagaaccaggaagttggagtctgagtctttgctgtgccacttcctgactttgtgagcttgggcaatttttcccatgtctcacttgatttccttatctgtgaaaattacacataatggggaaaacaactcaccacatagaatcatcccaagaatcacaggaaataatagagcaaaagcacttttaaacagatgttttgggcgtttttattccctggatgcaaacctactgaaagcaagtaaaggtactagttgtctatagggtaggcaataggaagccatgctggagtttaaaactgaagtgcagaaaatccaccctagcttcagatatggataatttagtaaggtcttccggtgtgtcacaaaacacagacatgcagtcagttccgaggactcctctatctccgtgacatttgcttaccaatagccagattgtgcttttatttcccctctactcatgcagaggattcagaccccactccggggaatccttgctatgatgggagccacatgtgtgacacaacagcacggtgccatccagggacaggtgtagattacacctgtgagtgcgcatctgggtaccagggagatggacggaactgtgtgggtaagagccatgttctcgtgtctccttcttgtagcccttgtttttcctctgccctccccagccttatgtctgtagaagacaagtatctgtcacctttacaacctccattgtcaatgattttagcagctgttaatctgaatatagttatttaaaaattaaagcatagctgtttatgtttgaaaagatggtttggagtggagtggattttgcaccggggctgtgaaaagaaaacatctgttgcagttcctggatgttttgagttaagttttgtaattttgagcttttgtagtaagtagttcttagacttaccaaaaagcacattttctgattttctttaaattttagacagacattgtgtgtcttatatccccaaaaggcaacggtagaaatttcttgatattaaaaaaaattgttggttttcttccaagtatccattctttttaaaacagttaaagaattcttagaatattcacttaaaaatttatcttcctgtggtgtttacttgaatggcatgaaatttttactatttctgattatctgcaacatgcattcatatctgatttttaaaaattctacatctgccaaccatttgtcccattgaagcatcatactagtgagaaaacattgagtttttagaccctccacttctgggacccttgaattaagcagaatttttctcttctcatttcttcttagatgaaaatgaatgtgcaactggctttcatcgctgtggccccaactctgtatgtatcaacttgcctggaagctacaggtgtgagtgccggagtggttatgagtttgcagatgaccggcatacttgcatctgtgagttccaaaatcattttcctgtgtggccaaaatggtgctctttaatcttgctctttaatctgtcagtgttttgacttctgctattcagaggctctgctatatggttttcttaagaagacagtttacatcaaaataacccaaagctggctggatgtggtggctcacgcctgtaatcatcgctttggaaggctgaggcaggtggatcgcttgagttcagaagttcgagaccagcctgggcaacatagcaaaaccccgtctctacaaacaatacaaaacattagccaggtgtggtggcacacgcctgtagtcccagctactcaggaggctgagataggaggattgcttgagcgcaggaggcagaggttgcagtgaactgacagcatgctagtgcattccagcctaggtaatagagtgagactctgtctcaaaaaaacaaaaaaaaaaacaacaaaatctctcaaagctatggctcagtttcagccctgtttattttcact

SEQ ID NO: 75377 - DNA, 1067 bp, Homo sapiens
aagacatgcaggaaacttaaaagcatgttgctctgtgaaagcagctagtctgaaaaggctacatacagaatcattctaaccatgacattctggaaaaggttacactatagagacagtaaaaagatcagtggttgccagtggttcaggaggaagaaggagaaggatgcataggtggaacatgggatttttagggcagtgaaactattctgtatgatattgtaatgttggttataggccattatgcgtttgtcagtctatagaactgtccaacaccaagagtgagccctactgcagactatgggcattagttaataatgtgtcagtattgattggggataacaaatgcaccacactaatgcacaatgttgataataggggaaactgcacattttgggtggggggatatgggagctcgtactttctgctccatttttctctaaatgtaaaaccatcctaaaaagcaaggtcttaattattaaaaaatgtttcaagcaagccagaggatgagcttgtgaagtcagggaactctacagatgggaagtggctttgtcagatcaaggggacattttaattctgaaaaccaggtcatgttttcccctagaatgtaagagccacaccaggagaaaaaaaccatcttcctcaattcagccactgtattgaaactgttgagcccagagttagctcctcagtgaggtgaatctgtaagtgatacgcggttctgtgctttgttattggagctgagggctccttaagcctcagcaggctcaataaagaagtgttgcttcagcaatatgacaagattaaggtacaaggactagactcttttctaggatgcgaaagtgacttgtaatgagaatcccgaggtgctttggttttaagaaacttggttgggaatgtaggcattaggtgcccagatattggattgtaaggtagcaaatgaacacatgaaaatgtgagttgattttagaggaacatgtaaattagaaagggaaagattgctgtagtagatttctcaaagagagatttaaacctactggggagaatggtctttacctttaaatgtccag

SEQ ID NO: 75378 - DNA, 1359 bp, Homo sapiens
atgtagggaagacaaggggaagcagagacctgggctgtgaacaaaatggtcagtgtccggatcactgacctgagcttgactcctagactcagatggtgagagacaaccctttcccttctctggaatccttcagatttactgaagtgcgaggtgttggaagtcgtcacttctgtgaaatgtagaagatggattggtttaaaatttagggtgtagagtcaaaccaatgtgagtttcagttccagctctaccatgtggcagcattgcatcttaggctacttaacctttgtgagcctctgatcacatgatttagtgcccacctcaccaggctgttgtgaggaataaatgaggcagtatgtagagagcactgttggcatggctggcccttagtaacacttattctttgtgtataataacatggacaattgtagtgccttctccctctcagcactgtggctttgcatccactcaggtttttgggatttccttacacattttttcatataaactcaggaggttcccaagggaacacactccaagaattagatgaaaaaaactgcagaaaaatccacctcacatgaaaatctctgtatttaatatttttaaaaaattaccactgtgtttgttgcagctgtgacctctacaagttccagagactactctctgacttttggtgcaatcaaccaaacatggtcctaccgcatccaccagaacatcacttaccaggtgtgcaggcacgcccccagacacccgtccttccccaccacccagcagctgaacgtggaccgggtctttgccttgtataatgacgaagaaagagtgcttagatttgctgtgaccaatcaaattggcccggtcaaaggtaaggtttccttttttgttgttgggtaaaaatgacatccttttaagtagagttagaatgattcacagaggttactaagggttacctagtgccatgctgtgttatgtgctaggtataaggatgaatagagcagatccttgcccttgagttggaaacagaggcagaaaagagttttagggcagggaacagtgtccctgccaaagtcaggaaatagagcatagtatgtgaagctggtttatagcaatacccaactgtgcgtgccaatcaggaatatacctgtgaacaaggcagactggaattaggagggagagtgatgctgacaagtatttgttacaagtgtgatgagagcagggcactgtgagtctagtttgaagattcagaaaagatgtccccaagaaagtgacattttagctaaaacagatgagaagaatttcatccaaaactaaggtggagcaaagagctagtatctggaaaaaccaaacatcatagaacttgatgta

SEQ ID NO: 75379 - DNA, 1071 bp, Homo sapiens
acatatttcatgagacatacttatctgaaattcaaacaaaaccctgaatgtcttaggtggtagtttatttgtttttgtttttttgttgttaggtttatttgtttgtttgttttttgctaagtctagcaaccttagagaaaagtcaaggacgttcccaagagtatttctcacagaatacaagcttgttcaaagagaagctgggtgaggtaaggcaggatgaaaccatattcttcaatggaaaagtttgggaacttatggaatcaacagctgatagtgcttactctcagatatcagataatctccttaggcacgatctccaacagcagtagaaattgggagcgggcagtatatactggtaactgtttaagcaagacctcttttcatccctgtgctgaatgtttttcatctccaggtgctgcctttacccatgacatggaagttacattctacccgggagaggagacggttcgtatcactcaaactgctgagggacttgacccagagaactacctgagcattaagaccaacattcaaggccaggtgccttacgtctcagcaaatttcacagcccacatctctccctacaaggagctgtaccactactccgactccagtatgtataaccagtcttcacatctgtaaaatggggattatgcccatctcacaagatagatacaaggcttaaatgacttacatggcatgtccttagaacagtgcatggaacataaaatgagctctattatgttattactcttattgttaccatgaaatatatcgtgtaagtgagcagaatggctgctatacataagaatatctatatccctacatagtattttcaaataataaaatcaatagcaacattgtccatggggtgggtagggatggtataattatatacagtttttaaccatcctactttctgcaacatggaaaaatagtgattattggaatttatatttatctcaaccttgtttcagctgatgagttcaggctgctttaaaaaaaaaaaaaatcacagaaagaggccaggtgcaatggctcatgcctgtaatcccaccactttgggaggcc

SEQ ID NO: 75380 - DNA, 1494 bp, Homo sapiens
tgctacctagggttgttgtgcaaattaagagttgttggccgggcggggtggctcacgcctgttatcccagcactttgggaggccgaggcaggtggatcacgaggtcaggagatcaggaccatcctggctaacatggtgaaaccctgtctctactaaaaaatacaaaaaattagtcaggcgtggtggtgggtgcctgtagtcccagctactcaggaggctgaggcaagagaatggcgtgaacctgggaggtggagcttgcagtgagctgtgatcgtgccactgcactccagcctgggcgacagagcgagactccgtttcaaaaaaaaaaaaaaaaaaaaaggttgttaaatgtaaagcttgtatatgttaagcgcgattgaagtgttaactttgttatatttttatttgctgatggaggtctttatcttggtgacattgtacctataatgctatgtctcattagctcctttactttctgttctccctgggaatactgggtaaagattgatctttggatttcttcctcccctcctgtctcctcgtttccagatagacctggaacacaactaccacttggtttttcctaagagtagggtgggtgtcctccttcatgccagcatccgtgtctcacactagaattccatgccatccctgctcaacagcatgctcctggagtctccagccaactccacctcctggggatgtggaggcagaggtgtgtgcagccgcttggcctcctggtggccatgcttgggattggcatatttcctagtgccccggagaaagcaccctcctgtccatccacaacccccgccacaccctacccccttggctatttcctttatgaactatggcatttgctccagtttccccatttctttgcagcacagatggccctcttcttttaatgggcagaataagtaggaaatggaagaaacagctgccagagcactgaatttatcctagtcctccataatttcttggaagatctgcgagtggggcccaagctgtctgctactgcgtggaaatcatgcttgtaccatacccatcatagttaaaccctgccaagggcatagggcattttaatagcttgaatccctgttgttttgccctcctctgtccccttctccccatgccttttctttgaggtaggtgcgtgtgttctttaagacccttccctcaaaacaatcttggtagcgagaccagctattatcttttttaagttcagtgttccctaaaagaaggatggttagacataagacatttgttagcttctctattatgtcttcctctcaggatgtgtttaggttgaaccatataaaagtgctgatatttagccctttttgacccacaaaaatagtggtttcatgaagttcaacctaacatgtacttactggtttgctttcattttactgcactcaaacccacgggtgcagtctcatcttagttcaccaactctgcaatgggacccagccgggagcagtaagcaattct

SEQ ID NO: 75381 - DNA, 1111 bp, Homo sapiens
ctactcgggagactgaggtgggaggatcacttgagcccaagagttccaggctacagtgagccatgattgtaccactgcatagcctgagcaacagagagaaatattgtctgaaaaaaaaagttgtcctgtagggtaggtacaatcatccttcccattttacagagatggaaactgagcttggaaatacttagtgacttgtctagcaagggcaaagactgcaacaaagtcatgaagaaattagagaaagctgtagggtgacagagagtcaaaggcactgtccaggagtgtcactgctgttggggaagtctttgtgaggaaggaggggcttgagccaggcctggggtcaaagtctgagagggagaatgtgtgaaaacattatgaacagagaagtgacaagagcggagttgcagagatgggaatgaggagggaggaaaggagggagagagacagagacaaaggttgattaaggcagtggggtgagagagttgccagtgagggcttcagctgcctgggaccatgggactgcctgtgttgtgagtagaaaggaatgaggtttactgataggggtcttagttattcttaagcctgctgaggcagtgctatacgcagcttaatttaatctcaatctgcatgatgagttaggaggaaggacacctggctttcagaaacctcatgtagtcccactccacttttggccttgtgaaaggctgcaggagtgtgttgcaagctcaacttccaccctgagaagaatttaagcaggttctgctgccagtgcaaccctccaggtgccaaagaccatcccctgggtgcacctccaggttgcagagggtctgtgaccaggagccgccgccccccgatgcctgtgaagacacctatatgaggagattccatggtagggcccctctcccttcaccagaagtggagagagcctgttagtgtcatgccagcagttgtaaaaggccacccccagggtcgtgatcactgccaccagcatcattacatgccacacacatcaaaattaaacaaacatgaaaactggacgaaaaagcattccactgtttgttataaagttggatatggtttttctaactagtctgtcattctgagagat

SEQ ID NO: 75382 - DNA, 1229 bp, Homo sapiens
acctctgataggaagaaagaggtcagaggtgactgctttgttctgaatctccatgtttttccaccttttctgtttcctgtcactgttgtggcaaaaacatggctgacctagcagagagggccttctgggttctgctctggtattatctgcaggctattgcatggagaggtactaatttcaggagggaagaaaatattttctgactaatgtggcattgtgtaaggattcgagggagtacattggtgtcggcttcgagtttgaatcctggctgccaagcttgctgggtgacctgaagtaacttatgtaacccataagcctctgatttctcaggaattacttgggaggattcaatgagacagcgtatgtgaagttcttggcttcgtgtctgcactcactggttcttaataaatagtggctgctgttactaattttagaagatttaaaacagtgggaatggggtggaggatgggtagagaatgaagaatgtgcttattaaagagtttcacattaatttgtgcctaagggaccacatttccatgaagttgaagatgtaaattttattggaagtctttagaaccttcagatccttctgagaatctccagaatttacagtatgagtttcctctaaatacattttaaggccaagtatcaaagattttcacaaagggatttgaggtaaagacgcattcctgaatggccttctcatttgtgggttgtgatttccttccctgggaagagcgtgggaatattaaaaagcagatctatggagtcatgtattaaagggttaagaagggactgcacaccctgctttgggctctgagagcttgagatcactggagtaaagtgcaggaggcttcaggaaccagccatagagtagaacagaggcacagctataacccttgtggggcatgaactatgatatttatcagctgccggatgcagtctactatagacatcctggtaatggcaaaaaacgcctgtgaaaaagctggttaatacgcattttggaggaagaaatctagaagtgtttgaaacttagacaaaaaaaatccagtttttgttttaaaagaatttacggggatgtatgaagtatagaagcatgcaattgttaaatacttttgaggggatgcagtgactgtttctttcacataaaacattggaggctcagaggtctgtctggtaagtgtgggcttcctccgggaagctgtggggtgggagtggcagagaca

SEQ ID NO: 75383 - DNA, 1457 bp, Homo sapiens
ggcatgtggcaccatgcctggctaagttttttagaaaagggttttgtagaggcagggtctcactatgttgcctagactggtctcaaactcctgggcttaagtcatcctcctactttggccttgcaaagtgctgggattataagtgtgagccaccatgcccagctgtctttccgttttaaaataagttgttcaccttctaggaaggtgggtgaatggacacttttgttacatttgttacaatgactgtttcctttttatttagactaagcaacctggggatccctggagtgtgggctttccatatcggcagcacttccccgttggacaatgtcaggccagctgcagttggagacctttccgctgcccactcttctgttcccctgggacgttccttcagccatgctacagccctggaaagtgactataatgaggacaatttggattactatgatgtgaatgaggaggaagctgaataccttccgggtgaaccagaggaggcattgaatggccacagcagcattgatgtttccttccaatccaaagtggatacaaagcctttagagggtaggatctcccctccagattctgatctgtcctcccccttgcatccaacacctacttattggccattctatcctgaaacagaatcttccaccttggatcctcacaccaaagaaggaacatctctgggagaggtagggggcccagatttaaaaggccaagttgagccctgggatgagagagagaccagaagcccagctccaccagaggtagacagagattcactggctccttcctgggaaaccccaccaccgtaccccgaaaacggaagcatccagccctacccagatggagggccagtgccttcggaaatggatgttcccccagctcatcctgaagaagaaattgttcttcgaagttaccctgcttcaggtcacactacacccttaagtcgagggacgtatgaggtgggactggaagacaacataggttccaacaccgagggtgagtgcattagaaaactgggtgctaaggtttcatcttaaccatgctggttttgcatagcgttgtgatttttctcttaagtgggtaggtgaaaagtttagcaaaaagaagattggatctaatttttaatccctgtgtttcaagagatagagtaaatttcctttgccaaataaatcttggcaggcagattctgttcggaatctcttgatcattaataatgtttttttaaaatatgggcctcatgaagtgagtgggggaaaactgggtttgttatgccagctacgctctcaagtgtaatgaactatttcagtttgaaagttcagcaaaggtaaaacattttgcggcttcatacacattccagtgatggacgggtttgtgctttttaaagtggtgagttgtgctggctcagatgaacatgccagattcatactctgttgtgagacaagcctagc

SEQ ID NO: 75384 - DNA, 1196 bp, Homo sapiens
actagggcagtgactgcaggatggacaagttaattttgctgattgctcttagctctgaaagagtttacatgagagaagtttgaaaccttacaaagtatatattttttaacctatgttttaccaatgcgtatttcaactattaatctaaattgacaaatggtatttgcaataataaataatattgcttatgaaattatattgttaacttgaagaggaaattttaaagaaggttatgtttaaaaacaatttggaggaatcctgaaaaaggggaagttctttgcacgttatgatgctttgcttgcattctgtttctttcttcttttatttgttttttacaggatgtttctctctctctctctctctttttttttttttttcctcacagctgaacactttccaggcagttttggcatctgatgggtctgatagctacgccctctttctttatcctgccaacggcctgcagttccttggaacccgccccaaagagtcttacaatgtccagcttcagcttccagctcgggtgggcttctgccgaggggaggctgatgatctgaagtcagaaggaccatatttcagcttgactagcactgaacagtctgtgaaaaatctctatcagtaagtaacattgagctgaagccctttcctatttgaatataaggacttttaggaagtacctgaacacaagtgaccataagaccattacataatatattggtggcttctaagtaaggcatcaagtcaaaaccaaggaactagattcaaccctggaaggatcaagttcaccaaaacataaaaggtcctttatttttcctgctctattgggtatagatactggaaacagaacagtatgtgtgtgtatttgtagagccactgaggcttgctatgaaaaacattgctcttggaaccacataaaaatatccagtcataaactgcccagtttgaggttttccagattaatcatttcacaggaggaaacattgtgatttagtcttttggacagatactgttaaacattaaattgagcaatgtaatttgcaggaaaaataactaagatttataggtttccagaagtctgaggatgtctctctggcttcattacctaaaatgaattgaacccattccttagactcatcagtgtctgcccataatgggcatttaataaatagatgggtgaatgaatgaatgatccagag

SEQ ID NO: 75385 - DNA, 1044 bp, Homo sapiens
gttaattaaatgaattgaaaaaattagaaactcttagaggggtgtatgttgcatgcatcagcctggctctgatgagtgtcacttcaacattgattgggatgtcctgtacctgggagggagagtcaggctctggtttctgcagagggctctggcttttctctctttctgataacagggcctgcagccactcaccctgatcctctctgtgctgctcctctccctgtggaggcccctctctcctctctgggatcctgggggagctgggaaccagtgactcgtttgtcaggtttggcagcccatctgagggcttctctttggagacagagcctgtgcggctcttgcaaaagcttgtatctaggaatgtgaggacctttcctgtttggaagccagtcaaggagttttttgagagggggagcccttcaagacttcatgaagtgggctctttagcaattagatgtagaattttgtagaactgaccaagaactttacaagtgatcatttagtgtgtgggtggcttttaaacagccaaactcttttggcgtgtactttgggatcataaattctacttaaaaggaagttgtttccttcctctgatatttgcctattttggtggagacaaagaaattaaatacttgccacccataatgagtgctcatctcaagaacagtatatagaagatgttgaataaattttaattgaaatgaatttgttggctggttgaatgaatgaatgaataaaataaagtgctaaatgcccagagttcacagcaaaaagtcagactctcctcttcacagctctgtttactactctcttccccccttccccatccccttcaattcttcacagtctctacaacctccttatcttatggaatttctctaaatttagaaccaggattctctcctatctcacatttattatggcagatcaatgccaggagctttgaaagcttagctttttgaaatggggttttttctccttcctctagtacttttctttccctagttgatttttctttattctgactaatgtataactctgaag

SEQ ID NO: 75386 - DNA, 1506 bp, Homo sapiens
ccagggcagggagcaaagctcataccgcaaccccgccacccgcccgcgccctgccagcctgttggggccacagcgcgcaggccagcagccgcactcgccgctgcggggttccctttgcgctgagctcatctcctgcaacgccgctgccccaaaccttgcgggccatttggtcccgggggtggggctccttgggggccgcggggcagcccggatgagaggatgacccgggagctccctgggggcggagtggaaggggcagctccaggcagccctggccaggagcttttaccccgccagccccgctgctccagcggccgctgccttagaaaagttaacgagaaccagatgtggtggccactgccgaactttctcagagccggtgattggtccccagccgagggcctcagccaattagcttgctgggtgggcctggagtcccgccccgcccaggcgcccgcggagatccaggttcgaggctggcgcggcgcggagagtgggctggaggccggggcgggacgcgttgtgcagcgggtaagcgcacggccgagcgagcatggagggggaccgggtggccgggcggccggtgctgtcgtcgttaccagtgctactgctgctgccgttgctaatgttgcgggccgcggcgctgcacccagacgagctcttcccacacggggagtcgtggggggaccagctcctgcaggaaggcgacgacgaaagctcagccgtggtgaagctggcgaatcccctgcacttctacgaagcccgattcagcaacctctacgtaagttcagccccctcctggcacttttcccgcagcttcttccctggggtcggtctcacggaaaccctgcctccagaggggaggaaacagaccccactcctggagccccccagcacccttgcggtggtacccggccagagagcgatgccgctgcctgccccgctgctgtaggggagcaagaatgacctggaggggagagcaagaattgttcgcagccacgtacgcgtcccaggcagaaaaggtggcgttgctagggcggccagcgggctttgcagttaggaccgcgagaaggctgtgcccgtctgcggagctggggtgttccctcttcagacctggaggcttcctctccgaggacatggggctccggggttgtgaggggagtgagaagataggtgaacgagttttagggcccctggacctactgcagcgcggagctgggacagtcgcaaaagttgcgcttgtttccctgaatccagactccctggccagtggggaaggagagagaggctttttgcctaagtcagttcccttccctccctgcgcgaaagggtagcgtccttgggcttgagcgactgtcacctttttgtccctctcctctcccaggtgggcaccaacggcatcatctccactcaggacttccccagggaaacgcagtatgtggactatgatttccccaccgacttcccggccatcgccccttttctggcggacatcgacacgagcca

SEQ ID NO: 75387 - DNA, 1083 bp, Homo sapiens
ggcagtaagttttatggttaaaaagtcaatatgtggtcggccccatgtgtgcaagttgctatggtggaagtcaaaggggaaacaacaattcacaggaaagagtacaaaggcatcacaaaaaaataaaactgatttcataaacacggtgattctggttcttcaaagacatttccaagaaaagttgctaaggaaggtgaatctaaagccacatctaagaactttgagaaaagtgtcacaaaaccaggggaaagggtgcgaagcagttgaagaataagcaacaatgggacaaagcaccaaggaacaaattccagccagcaaataaattcaacaagaagaggaaactccagccagatggcaaaagtggtgaatcagcagccaagaaacccaaatgggatgacttcaaaaagaaaaagaaagaactgaagcaaagcaggcaactcagtgataaaagtaactatgacactgttgtgtgggcaaagcagatttggaagactttaagaagaaaagactgacaaagaaaaaagagtaaagttaatgaatgacttgcagaagttgattcaagggaaaattaaaactattgcatttattagctggacatgttggcacattcctgtaatcccagctactcaggaggctgaggcatgagactccttgagcctgggaggcagaggttgcagtgagctgagatggtgccactgcattccagcctaggggacagagcaagactctgtctcaaacaaacaaacaattgcatttgcaaatgattcaactcatgtgatccagtgttacattcagtgtggtaatgaagaacagtcaaaacaggcttttgaagaattgggagataatttggttgaattaagtaaagccaaatactccagaaatattttaaagaaatgtctcacgttgtgaacatgtaccctagaacttaaagtataataaaaaaaaaaaaaaaaggaaagtatcttgcacaagctcacgtagctggtaagttacatagttgggatctgaattcagttgtggcttcatgcctgagcttttaactactactactaaactgagaaggcacttgcttgagtaaattat

SEQ ID NO: 75388 - DNA, 1180 bp, Homo sapiens
ttaaagttcagacagatttcagtgcattcatcagcaatatttcctagtatgttttctagatgtatggattgtgttacatttaatgtctgtgaacaaaattcacaaataatatactgccccttgttcagattcatcagatgaaagacatatttattctttaaaatcatttgaaaaataacagaaatggggcagtgtacatttttgctgtgaagagtttaacagtgcattctactgcttgaggcaacattttcccaggcaattatcattacaggtatctaagagtaaaatagtattttataaactgtagaatgtgttacattaggaaaactaagtatctttaacttagagtttccttgtatgaacataattatttctacttctttaatttgaaattaatgccttttcctgagaaaaggcacaattctatggaaaagaagtatttataaaaataagtatcttgttatcttctagttatgtaatcatttaatttttgagctgatgtatgatcagatacttggccaaatgttggaaggaaactactggttgcgtcaagcctaaattgacaagcctttgggctatgcctgcttttcattaaaattgtcattggctgccgcttttctcccaagtgaaacaaagtgccccatgttaaaaagaaactttaaaagaatccggttactaataacatgtcgtagacttcttggtttttaggacatcttttcataaagtgaacttactggcatgatactacttaaaagtttaatgttctacgaattactattttcattattttgttgtagaaagaaatattaatatgttcaattgttcccttttgcagaaagaatactccagtggggagaggaatcttgagggcatattttgatcctctgcctccccttcctcttcttgttttggtgaatctgcattcaggtggccaagtatttgcatttccttcagaccaggctataattgaagaaaaccttgtattgtggctgaagaaattagaagcaggactagaaaatcatatcagtaagttttctgttttgtttaatacatgtagttctgcattttgttccataaatgttaaactctaaatatagctaaagaatggtaggatgagttattaaaatgctggtagcatcatccatgtggacagtctctgactgggaggccaaaggtgcaa

SEQ ID NO: 75389 - DNA, 1034 bp, Homo sapiens
ttgagagatctttctggtggatgtgagatatgtctatggggtttgagcacatgtataaaccattctgtgaccgttgtataatctagggaggtagagtagatacagcaaaggggggattttctttttaatgcttaggaggtaaaattagctggacttggtaatggttaatttggtaacagtaaaactacaaacttgttaattcttgatctcttctttcctacctcatgctacccagctctagtctgatcaccatctgaaataggcaaggaagaagagcaaatttacagaatatgagtctactttagcaagtggaaagtccatcatgcctcagtcaggcatctataggagtttgagccccagagcattgtacatccaggtgttgtcaacatataggtcagccagggagcatcctagggcaataccaccatttaagagaagaaactgagagaaaaaaaataaatatcaaggaagtagaattccaaagaggcagtgtcctcatttttgtttaaaatgtgagaaaatgacttatgtaatacagtgttttataaaatttcccagtaacgatatttacaatgttaaagaactatgccaaacagtatgctgtcccttagctgtaccttgcaaattgccatgaggaacaacctatcttcttacttttggatgctaaaaccatcagtttgaaatacccagttcctggctagcagttttttttttctgttgtactcttacagttgcatactactcataaaaatagatttgaactggctgggtgcggtggctcacgcctgtaatctcagcactttgggaggccgaggtgggcagatcacgaggtcaggagattgagaccatcctggctaacacggtgaaaccctgtctctactaaaaatacaaaaaattagccgggcgtggtggcgggcgcctgtagtcccagctactcggaaggctgaggcaggagaatggtgtgaatccgggaggtggagcttgcagtgagctgagatcgcgccactgcactccaacctgggtgacagactgag

SEQ ID NO: 75390 - DNA, 1050 bp, Homo sapiens
tctactacttggttctactatgagaacttttcaaatctgaccacttcctataccttcatttttacttcttcctgccatctcttctcattggggaaaccacaatagcctcctaataattggcctttcttccttcactttgtcccatgacagactcttctccatatgtagccagatgtatcaggatacatcactaccatgctgcgaaagtcctttcattccaattatgatcaaatagaaacttttgagtgttgtggacactggctttgtctctgatctcattttctgaccctccactttgttcagttcgttcttaatacatagtggtcatctttctgttatttgaacctgctggaggtgctgttaaccacagggcctttgcagatattttcccctctgcttagaactcatctcttatacttatttgtatacttttatgcattactgcatttcttcagttctttgtgcaaatgtcactttttcagagaagccttccttgattacctctctaaaatgccctatcacatgctattcccttacaatttttttatttataggacttaacactacatattaattagttttcaacttgtctctaccttacattgttctaaagctaaatatttttatttggaacttacctgtacccaaagtgactagaacagtgactgacatggtagatgttcaaatatattttgaattgatgaatgaatggacacatctattgtcataataccaaccatccttatgctgtaacttaaaaaatttttaaaattacatatattaaaatttactttttggttatggctatagtctgactttaattctgattctctatttctcgtttcttagtgtcagttcctgttttgtagccttttaaacaaacgttgcttccccagttcttcttcttcttcctcaaatcccattaaaattaaattgaacaacaggaaaaccccctcttaagagaaacaaaagccttaccaaatgcaaaacaaaataactattcttctagccttagttttggttagttaacattggtggctctccatttgc

SEQ ID NO: 75391 - DNA, 1081 bp, Homo sapiens
acacatttctgttggctcccttattataattgtgattagaaaatgatattttaaaatcattttgaaagtttttgtatgtgtacatgtgtgttgtgtatatggtattaaacttggaggaagaatgccaaatgttaggtttaaacgaaacatttattatattgttgttttaggaagtttttaaggtccatttacaaagttaaagtacatcatgataaaaacagaaataagaataatgaggcaatagtaaaataagggtgtgaaaatatgtaatgagatatgtttagttatttgttgttgcatgctagttggacaaatgaatctattctgtgtttgcagattttaaaattcatttttaaggggcaattcataaacattcatgaaacatttgttgttttagattccccaagaacatctgtatttcttgaagaactgaatgaggctgttagacctctgcaggactatggaatttcagttgccaaggtagaaagatatttatgttactaaaatattagtgacgaacatcttacaactttatggcttaagattgaatatcttaaaatacttccatttcatatctttttccaaactggaaatatatttttttcataagaataaacagaagcccagaaagatagtttcaggttattgcataacatactgcatatagaggggacaaaaagctgtttaaaaatttttagcttagaatttaactttatgttataaaccattctattgggcccatggtatcatttttcaaacctatagttaggtttttgttctgttttgttttgcctaatgaatatttcataataggtagccacaattcagctgtttttaaatttttattagcacaaactgaagtaacaaaatggaggtaaacaaataatttttttctgttcttctaagtctttataattgtttatgtttcactttttcgcatttatttttagaacaaagttataacgactcaacattacatacttaatttttttctcaaaaaatgttcaaatttgccatagagtattatagaaaatttccacatgcatcatggattagatagatatgtaagcctttcatttaa

SEQ ID NO: 75392 - DNA, 1051 bp, Homo sapiens
aattagtaactgcaaggagaactagaactatagtaatgaactatcacaccgaggtaacaaggccgcatttctctgaaggtactcatcacttggttctgatatctagatttttgtagtattaagtttttgtttgttcgtttgtttgtttgttttgtttttaggcagggtcttcctctttcacccaggctggagtgcagtggcatgatcatggctcactgcagcctcaatcacgatcctcccgacttagcttccctggtagctgagactacaggtgtgtgccaccatgcatggcaattttttttcttactttttatagagacagggtctctgtgttgtctaggctgctcttgaactcctaggctcaagtgatcttcctgcctctgcctcccagagggctggaattgtaagcgtgagccaccgtggctggccaagtattgtttttcattcccttttctaattactggaggtaaaaaaagaaaaaaaaaagtcaccaagtaccttttgtatctttgttttcactctgctcttgctgatattctttttccccacccacattcccttgcctttagttaagatctttttatgaggacagcatgtctctgagcaaatgcattttattttccatgcatgtgaaatgtccactcttccatggtcctacaaggtacatatccttcccctactccctttcccctctttcttcttccttagagccaattactttcaactgctcactgtttgttttggcattgaccgtcctattttcaataaacttggtttttggttttgcgaaagttgaaaatttagttctctttcatttattttcccaccctagctgcatgtttccttattttctatcttccctttctctcaacagttgttatggttttggttaaatcattattcagtatttatttcattatgaagacataaattctacttctagctgacccgtgcggtattctttgctttaagtaatttttaaaataatcaaatcttaccatagatggaacaaactacagagattattactgagttcctaactctaaacatg

SEQ ID NO: 75393 - DNA, 1035 bp, Homo sapiens
ggtgcgcggggccgccgggatcaactcccgctgaggaccagcgggggcggggggtgggcagcgagaggcggactggaaaccagcctggggaaactgaggcacacctggagtgtgagccagtgttttcgccttaaacttaagtggctgattggcttgattactgaggggttcgggctagggggtgagtgagtgagtgtgtgtgtctgacaacttaaaacagcaacggaacgaaccctttgttcggtgttctggccctccgaggtaaggcgttggtggcaccaacaaagtggcatcgcaagaagtagcagccccggtggctctgccgaagccggactgtgttgagggaggttggatgctgaggtagcagcagctctgctgaagctggactgctgccagccattacgtcaccaggcagagctgttcctctgctattgttgctgcgtttcttttattagaagcttatattccctcctgcatctcctttcctgtggctcgataagcctcacataaatttcgttcgatagttccccagcagggttgatgatcaataaccaatgctgaggatcaggataaggacctccataaagcccttaatgtttgccccagttgcttcgtgctttagcggtttatcctacctcctattagcatagtcttttttggagctaattaagagaaaaaaatactagcttaacctgtgcctattgcagaaacaaaaccaccaaactgtttttgcaataacttgcttaatatctggaacctaatcacaccccctttctcttttatggggaattgctggttggattgcattgttctgcagcgcttaggtatttgacccatttcaaacaggtttgggagtgtaaggttgtcaatcatgtgtgtcagcttgtggtatttaagccataatattttaagactttcccccaaaaaagtcctccttcccaccaaaagaaaagcttgaggaggggaggaagcaaggtgacatcatatgcttaatacagactaatatagaataatattggcctatgcagctaatcc

SEQ ID NO: 75394 - DNA, 1024 bp, Homo sapiens
aacatcatgtttttgttcatgagctccatatctactctctctaagtttattaaggatagttttcctgttttagtttttaaatctgtattttttttgcattgatctcttttattaaagacttttgagctatctggttatccttggctctctgctaataattaagagtggaggccaggcatggtggctcacacctgtaatcccagcactttgggaggctgaggtgggcggatcacctgagcacctgagatcaggagttcgagaccagcctggccagcgtggcaaaaccgtgtctctactaaaaatagaaaaattagccaggcgtggtggcacgtgcctttagtcccagctactcaggaggctgaggctggagaatctcttgaacctaggaggccgagtttgcagtgagctgagatcgtgccactgcactcctgcctggtcaacaagagcgagactccgtctcaaaaaaaaaaaaaaagaatggaaactctgagcttatgggtgagatatgtacgctctgagctttgctgtagggtgatctggctgaactatttgttacagaacccccgttgctagtatgtttagatctttcttcttgggctgctaagattcctcagagaaaaaaaaatattctaatctttcaaagagtaaaggtctattccagcattttgagaacctagtcagggaagagggttggggtgggggagaatctttatgcttggtgtataccagtcatctccattctcagtgtggtgctaaactatcaactgtgcctggcatttaactttcatgctttagaccaaaggctttttggtggcctctccagagaataaatacccagatatctgccaggatgaagaagaggcatttgcccagggtatggactagggaaagagagatttaactgctcttaaacagcttttatctacccgttttagccacccccacttctcagttctctctgattggtacctgattctcctggtaccttttgaagattctgaaatcacgttgttctcaacccttc

SEQ ID NO: 75395 - DNA, 1069 bp, Homo sapiens
ttcagtgacttcaggaactttcaggagaaagccaaactcctctgtttggtgtacaaggtcttctgatgtgtttcctccaccgaatgttctggtgaaacagacttacacttcttcagaagccacatttggccaggcctcccgccttggtaaatgctgtactctttgcatcaagtatgctagtcatccttccccacttggaaaattcctatgcatcttgcaggcctgacataagcatttcctctgtgaaacctcctttgctccactcaaggagagtcatctaacttccactttcgtgtcaccactgtaattacaacctacctctattgtatgtcacttaaatcgtactgtattgttttatttttcaaaagtctttactagaatgtgagctccttaagggcaggaaaaggaacctttttattttttgcatctccatagcatagtttttggcatatgaatgtttaataaatgtttgttgaataaattgattttaaagtgacatctttattatattagaggtcctacctatattccaaatactttcactcccttcactttacagcaagggtcagtagagtcccaaggatttgtagactttagggggtcaataaagctgaaattgtattcaagatttggtgtggtttttggtgggtcatgaaaggggtctattcggggaaaaaaaggaacttctttcatgggaaaaggcagcatcattgaggaatttcttgaataatcaaataataccttcctaggattataaggtagataaatggattcctgtttaagattctgaagggaaggggagaagtgttataaattatttcatacaacaatttttcttagcttaatgtttgaataaataaaaatgttggtaccagtaccatgctgttttggttactgtagccttgtagtatagtttgaagtcaggtagcgtgatgcctccagctttgttcttttggcttaggattgacttggcgatgcgggctcttttttggttccatatgaactttaaagtagttttttccaattctgtgaagaaagacattggtagcttgatggggatggcattgaa

SEQ ID NO: 75396 - DNA, 1759 bp, Homo sapiens
ttgcccaggctggagtgcagtggcatgatcatagctcactgtaaccttgaacttctgggctcaagcagttctcctacctcgggtttccaagtagctacgactacatggcacacacagccatgcctggcaatttttaatttttttttgtagagaccaggtctccctgtgttgtccaggctgttctccaattcctggcctcaagtagttctcccgtcttggcctcaaaaaatactgggattacaggagtgaatcactgcacctggcatatgtatttaaatacttttaaaataactaatttctagacattaatatcttagttttaccttgtcgaattaagaactaaaatatattaaaatacattaaatggtttatgcaccttaaatttattgaaataaattactttaaaaatgttttaaaatgcaaagtgaataacttttacagataaaatttatctaagatggtttctgagtgaaatattttttggttacagaatttctacaagtgtgaaagaattagaaaacttcaggaacttgttacagaatattcattaaagaaaacaagctgatatgtgcctgtttctggacaatggaggcgaaagagtggaatttcattcaaaggcataatagcaatgacagtcttaagccaaacattttatataaagttgcttttgtaaaggagaattatattgttttaagtaaacacatttttaaaaattgtgttaagtctatgtataatactactgtgagtaaaagtaatactttaataatgtggtacaaattttaaagtttaatattgaataaaaggaggattatcaaattcatatatgataaaagtgaatgttctaagtctctcaaactagcgttttatgtaataatatgtaatataaataaaactatggtaaatgtgacaagcatttaataggaaaatgctaaggaggcctcataaatgacccataattaccaacgtagaatttttcagtacatttagggttgctggatttagcaaataaaaataaagattgcccagttagatttgaatttcagataaacaattagttttttaatattttacatggaatatttggaaaatacttatactaaaaaattatttgtttgaaattcaaatttaactgggagtcttgtattttatctggcaatcctaaaatacattggtatgaaacaaatcacttttagaagtatattgctattttgattgggttgtttttgtgtgtagaaacgtacaataacaactcaaaggcacaggagatttctaaacattgtgaaaagttgaatagattatatatttattctcataatactttcactaatactaaataaaatttggggaacactttttatttttatataatttccaatttacagaaaagtttcaaaaatagtacaaagagctctcttacccagattcactaattgttcatacgtgctttatctttcatgctttctctgtacacacacacacacacacaaatttttcctcaatcatttgaaagtcagttataggcatcatgccccttaaaccctaaatacttcagtgtgtaatactgaataattactaaaaatgattttctcagaaaaaaaaactcccacaattctggaactataatactgtaagccttagaataaataatactttcaagttccaatctaaagttctttttgagttttgttgcccgttttatgcttgatgtgtatagtaatagggtaggctatttattttattaaaattttttttagagaca

SEQ ID NO: 75397 - DNA, 1087 bp, Homo sapiens
gattttttttttcctttccattcctgccttctctcattccctccctccattccttctggtaaatgatgctctctaaccctgtctcaccctcctttctccacctattgacatatagttaatcacctacaatggacaccttgacaaagttattttgtatatttttgcagatagtttagctttggagtcagacaggcctggtttctaagttttttgtttactagatgtgggaatttaggcaagttacctaaacactctgaatcttgttttttacattcattaggtgtagattataataataactacctttggatttgtggtgaagattaaatgagattgtgtatgtaaggatctggtatgtagaatcaatgaatattagtgctgttctcatttttggtaccccatagtaccttgcacagtgttaggcacatagaacctgctcagaaaatacttactaattgactgtatattacatcttaataaaatcttgttaaattgttttcaggaggactttcgactgcattttagaaatatttcaagaattatggattgtgttggttgttttaaatgtcgtctgtggggaaagcttcaggtaagcaaatttagtcattcctatttctcatttaccctttgcatgaataattttctaatttttcttttttccttatttctattacagactcagggtttgggcactgctctgaagatcttattttctgagaaattgatagcaaatatgccagaaagtggacctagttatgaattccatctaaccagacaagaaatagtatcattattcaacgcatttggaaggttagtttgaatgtactgaaatgcttctggtagccaagtaagtctaatgcaacatatatgctctcagaaaaaactgggtaaggaatatcctttttattttatttgtttatttatttttgagacggagttttggtctgtagcccaggctggagtgcagtggcgtgatctcggctcactgcgacctccaccttctgggttcaagcgattctcccaacttagcctcccaagtagctgggattacaggtgcgtgacaccacgcctggctaatttgtgtgtg

SEQ ID NO: 75398 - DNA, 2018 bp, Homo sapiens
tattatacccataaaaatgaccctataatcaatagcaacttaattgtacattttaaagtaactaaaagtgtagagttgatagaaatttcatttgccctgatgtgattaatacataaattatatgcctgtatcaaaagatgccatatatggcatcaatataagcagatactatgcacctgcaaaaattaagaatgatttttattattaataagacttgctttctcagtaaaacattgaatttgttttaaggatgggttctagaaaataaaatattaatataaaactattaaaggctaaattgtgaaaaaccattttcttggttgttattatataacttaaaatgcaaaatgaaattaacttctataggcatgaataacctaatataattaaagtaaaaattgtcaaattcagtttttaatatttaattcttcttccttcttagagacctggttagaaaagaaatggggacacaacattacagaatttcaacagcgatttgatggaattttgactgaaggagaaggtccaagaaggcttaagaacttgtattttctctacttaatagaactaagggctttatccaaagtgttaccattcttcgagcgcccagattttcaactctttactggaaataaaattcaggatgaggaaaacaaaatgttacttctggaaatacttcatgaaatcaagtaaattatatattaaactttatacattaatagaagagtgacaattaatgtacaagataaatttttttttttttgagacaggctctccctctgttgcccaggctggagtgcagtggcacggtcatggctcactgcagccttgatttcctgggctcaagcagtcctcccatctcagcccaagaagctgggactatatgtgcaaaccaccacaccgggctaatttttgtattttttgtagagatggggttttgccatgttgtccaggctggtctcgaactcctgggcttaagtgattgatccacccaccttggcctcccaaagtgctgggattacaggtgcaggccactgtgctctgcctgaaatttttaatattcatttagagaaaggaaaactatttagaacataattaaaagttaattttgcttgtaggtcttttcagattgaattttgcttttgtttttattttgatttgggtactgagaggcacacatttttagttttaagagccattcttttagtatttgataatgtattattttcatgtttatttgaacaaattggatttggggtcaaatttctgtattacgcagttagaatcaagatttgaggtttgaggataagaatttgatttggggcatcggagtgttggttttactatgttttctcctctttatttatcatgaccagtaaaatgttgtattagcaggacttttaatatttataacacatgaaaatgaatattctctgttttaaaacgcaggtcatttcctttgcattttgatgagaattcattttttgctggggataaaaaagaagcacacaaactaaaggtaattactttatacttaactgttagatacaaactgattaacacttatgcagatatgaatatatagtactcatagaagtagagagtaggccatagaagtagagagtaggccaggggcagtggctcaggcctgtaattccagcactttgggaggctgaggtgggaggattgcttgagccctggagttcaagaccagcttgggcaacatcgtgtgaaaccctgtctttaattaaaaaaaaaaaaaaaaaaagtagagagtagaatgatggttaccacaggctgggggtggggagtggatggggaaaacggagatgttgatccatgggtacaaagtttcagttagggagaataagatttagtgatctactgcacagaatggtaactatggtaataatgcattatatattgcaaaattgccaaaagtgtagattttaaggtttccactatacaaaaaatggttaagtatgtgaggtgatggatttgttaattagcctgattta

SEQ ID NO: 75399 - DNA, 1716 bp, Homo sapiens
gtctgcccccaggcctccgagaatgctgggattacaggcatgaaccatcgtgcccaccctgggaccgaccatcttttttgttttgaagttataacacattataaatgataaataagtaacagggtctggattctagcctgggtgttctggctccagagcccatgctctggctgttctgtgatgttggatgtttaggttgcttccaattttcccttttataaataatgttgacacagaatcatgctgcattgtaacttttgcttttggccagattggatctgctggtggtcatctaagaagaaagtatttggtaacacgcagtgtacaatactaacactccttcatttactgtagttattgatgaactgctgtggttaatgtggagggaaatgtatgttatattctttgtctgaatagcttatgataattgaattaccatgtttctttgattctaaaattcacgtattcctatttttacaattcctaaatcataatgtttttgtagccagtgtgtacaattaatgtggctgtgtgtgtttctctctcttttccttcctttcttttctgagacggagtctcgctctgtcacccaagctggagcacagtggcgcaatctcggctcactgcaacctccgcctcccgggttcaagtgattctcctgttgcagcctctcgagtagctgggactacaggcgtgcaccaccacgcccggctaatttttgtatttttagtagagacagggtttcactatgttggccaggctggattcgaactcctgacctcaagtgatccgcccaccttggcctcccaaagtgctgggattacaggtgtgaggcaccacacccggcctccttcctttgtttctcctgaaaagttgttttaaaattcctgacacattgttatatttgtggtgcgttagaatcaatggaatacagtcttgtgtagtagctttttaaggtaactgaggataagaaaggtttaataagacattttattttacagacattcagtcccctgaagctgaatatgtagatttgcttcttaatcctgagcgctacactggttacaagggaccagatgcttggaaaatatggaatgtcatctacgaagaaaactgttttaagtatgtgtcattttcatttagaaaaattcctataagatgtggtgatttctctttataaacaaaatcataatgatttaaaattaaaaatcaaattcactttgttaaaagatgtgtttgtacaaggaaacatgactattcattaatccagtttccttctggggaaatatatagacgtgagtttccacagatttttcctttagacctttatgggagtattgtaggcccttgacaaatgttccttgagtcgattataggatctcattttatagttaaggtaacctagagctggagaggtttgcttcatttcccaagatcacacagtggcagtgtagagaaaagaatatacaactcttaattctctttttggtgctctgtacacccttgtctgtggctttaattattttacagttaaattgatttcagagaacaattataataggtatcatttttgagcactcactgtattctaggcattgtggtaagcatgttatatacattttcttcttcagtccttgcaataaccctgtgttgcagtcatcactgtattatagacagagaaactgagacttagagaggttaaatgatttgttcagt

SEQ ID NO: 75400 - DNA, 1032 bp, Homo sapiens
gaaaatatttgggctaaagtatttccacatatttacctaaagagagaatgttttttctttttttttgagacggagtcttactctgtcgcccaggctggagcgcagtggcgtgatctcggctcactgcaagctctgcctcctgggttcactccattctcctgcctcagcctcccgagtagctgggactacaggcgcctgccaccacgccctgctaattttttgtatttttagtagagacagggtttcaccatgttggccagcctggtctcaaactcctgacttcaggtgatccacctgcctcgggctcccacagtgccgggattataggcgtgagccaccgtacctggcctgattatgggcaattttatgaaaaattaaaagcaataagaacatattggaaaaataaaaaaaataaaaagagcttcagataacttctaaattttaaacaagttttaaaaatgcaataagttattatctatttattccctttttcattttagtattctgaagaagccaataatctcattgaagaatgtgaacaagctgaacgacttggagcagtggatgaatctctgaggtttgattttatttttcagcagtatttcatgtttctttatgttacatattaacttaaaaataataatgttattttttttctttgtttgaagtgaggaaacacagaaggctgttcttcagtggaccaagcatgatgattcttcagataacttctgtgaagctgatggtataatatttttgatagtatgcattgtgtttaaaattatacctaagaaaaaaaaagtttttaattattttaatctgggcatggtggtgtgcctgtagtcccagcttatctggaggctgaggcaggagaatcactggagcccaggtatttgaatccagactgggcaacatagtaagacccatctcagaaaaaagttattaaagaaaaaaactcagtttctaacggtttggcggttcttcaaaaacctaaacgtagaattaccatatgacataacagttccttttctaggt

SEQ ID NO: 75401 - DNA, 1021 bp, Homo sapiens
gattaattcattacctcagagatggcaccaagcggttcatgagagatctgtctccatgacccaaacccctaggttccaagaatctagaatatctggccatcacagaaaacaaaaacaattctactaaggaccactggagtaatagcaaaaggacacaggtgtcaatatcaagtcagcactcagtggatctcctagtggccaaatacgggacaatttgaacatcaaaagggataatggctaaatgattatttttacatctccttgctgtaatatacataatgtatgctcagcaatccatagaataatttgttcttgaatttttatttacttttaagcaatcatatgaatactacctattctgttaaaaaatccaacttcgataatttgttatatgaatttttctcataaatcacagaaatttaagatatgttttaagaagatagaataaatgccaactaaaaacatatttttttctttttcaggatgaagttcctgatggaattaaatctgcgagctacaaggtgtgtacgtatacctattgatgtgtccagtatcttaatgaaaaacttgaaaaacccatttccgttgtacctactatcccatttatctgcttccagtggtgaaaccccttgagaggtatttatgctgaatggctctctttctgtttgtttttgtttaacattttattttttatgtattttattttatttatttttttgagatggagcagtggcgtgatcttggctcactgcaacctccgcctccccggttcaagcgattcttgtctcagcctccagagtagctgggattacaggcactcaccaccatgcctggctaatttttatatttttagtagagacgggttttctccatgttggtcaggctggtctcgaattgccgacctctggtgatccgcccgtcttggcctcccaaagtgctgggattataggcgtgagccaccgcgtccggcctgtttagcattttattatagaaaatatcaaagataaataaaaatagagga

SEQ ID NO: 75402 - DNA, 1033 bp, Homo sapiens
ggtggcatgaccttggctcactgcgcccttcgactcctgggttcaagtgattctcctgcctcagcctcccgagtagctaggattacaggcacctgccaccaggcctcgctaatttttgtatttttagtagagacggggtttcgccacgttggccaggctggtctcaaactcctgacctcaggtgatccgcccccctcggcctcccaaagtgctgggattacaggcataagccactgtgcccggcccagtctgtgtctttctaaccaagtctaccaatttacttataccagcctcacatttatgcagttgttataaactggcaacagataggtggaagaaatactgtatttgcacctgataacatgaccaagttatagcaccataatttgtaactgtcaattataattttgggattctgatttttataattttttttctattattattttacaggtaaacctgaagaggccgtgtcctttctggaatgacatcagccagtgtggaagaagggactgtgctgtcaaaccatgtcaatctgtaagaaccatgtatacatttaaaaactgttacatgttttttcattcattataactttttgttttgttttatttaagaatttttttttgaaaaaatagagatgaggtttcactatgttgcccaggttggtcttgaatttctgggctcaaacaatccatctgccttagcctcccagagtgctgggattacaggtgtgagccactgcacccagcccattacaactttttaaaggcagccaataaaactaaaataatcgtgcagtccttagtttaaatataacattcaatatttatatgttaaaaacccaaacttataaaacctattttgaattacactgccttcataataatagaattaacattttgtggttaatataatcctttgacttattagggagattgataataattcttttggcctgatatttgattttcctcttacatcttttctgaaccaagttatatatatagcataataaaatgaaattaatcgaagt

SEQ ID NO: 75403 - DNA, 1062 bp, Homo sapiens
ggacaatcaagctttgtgtatcttttaaaaacttttcctctctttgccaactggatcatgtgctcctcagttcacatgatggagtatttgttttactggtctagccacagggagacatctttccctgttattctcaattctaggatcctggagaggggaccatgacctggtttgagttggatgcctacccttggtcaggtcaactatggcctggagggcagagttacaaaataaaggttgccagggggccaactctctctgtgtgtgtgtgtgtgtgtgtgtgtgtgtgtgtcatgagctctgcacaccttccattcctcggtatatagcaagagcagcagtattactagattattgtcataccccatctcaagaaactatgtgggaggagggaggataaggactggttgagtagggggctgtttcctaacaaccatgtgaggaaaaagaaccctgttgcatttaggacatttcaatttaatatttcattttctttgtaacaggttagtggttacttggatgattgtacctgtgatgttgaaaccattgatagatttaataactacaggcttttcccaagactacaaaaacttcttgaaagtgactactttaggtattacaaggtatttttaattttaattttttatatatgaatactttaaatggataattagattttcttaagaattactgagcttcaaaattgtagttgttatttaaaattgatataggctttattaagaaaattcagttcataagagtgaagcatgtgattctgaaaccatccattggataattttaataactgaattttacactctagagttagaatctagttggttaaattgaagttaggacagaaattattatatattgttatcaaaatggtgagatcataattttctaaaacatcagattggctccaattaattaaaataattaaatattttttgtagaatcatgactttatcctgacctatattatttaaacaaatcacttgtgctgttttatcttgagatatctactagaagagtttagaaaacctgatcaatggagtattt

SEQ ID NO: 75404 - DNA, 2120 bp, Homo sapiens
tttttccagtgcattttcattgaaaagcatgagtagtttaattaaatggaggaccataattacatgattctgtggagaactgcatttgttgactttatttagggtagaatgtcagagaacaatccacgtgggtaggtgaagaggtgaggaagggtctaagtgattatcattcggatttgtagtcgcaaatcctaagtgtcagggtgtcaatatcttctaagactataacttaagatgtgcttaaacaagtattgccgatcaacaaagtaaaagtatggtgctttctctgtaacattttgttgttatacatgccacctactcattacaaacagcattatttcttttatggtttgaaacagtggatgtgaaacttaggtaaagtgaagtagacttacgtaaacagtaaagtgagacgtagcgacttaaacacactaagattactgttcaattaaaaatgttcaaattgtattatttcagtaagggaacaattaaaagaacttaccaagcagtatgaaaagtctgaaaatgatctgaaggccctacagagtgttgggcaggtaggtgatggagtttggggaatagggggtgatggtaatttgcttttttatttagctgttgccaaaaagtaatgctttttattttcttccttagatcgtgggtgaagtgcttaaacagttaactgaagaaaaatgtgagtgatgaattagcttattaattagtaaagaaacagtccacctctctctcacttttgaaatgcttattattttaatgacaataatgcagagagagagagtatttttgaatagacttaagttttccttcaactaatgtctccttggaggacagaaatacaactaaaccctctgtcaacgtgggtatgtatttttttactttctatttttcaattagttcttttatgttttttcttctagtcattgttaaagctaccaatggaccaagatatgttgtgggttgtcgtcgacaggtaatactttatatttgtatagtgcctgatgattgacaaagcagtttcatgtaagttattgtctctaattcttgaggcaagcaggtggagcatttatgcccataactcacaaggatgatttgttcagacatagctagttattaacaaagcctgaattcaaaccatgggctttgactcctggcattccgtactttctactgtattacattgtctcagtcagatctgttaatagccacttagaaataaaagtattttagaactggaaaacagacattttattttaatgtcatttttaaagaggacttaaaagtgttagatatcatcagttacctgtgtttatatttagacattcagaactgttacttatggactgtaccatggcctaagttaattttgtatgaggtcatttagattagggtagggcaagttgaaataattctaaattttattttacagttatcaaagatgccaacaaatgacctcaagtcattcagtagtgtctgaaatcaatttatgtattattctttaggaagtgtccttagataattcttttaaattcattggaagagttttctctgtttaattgtcatttcaggttcaggttttaaaacattcacagaacatggctgtaagggagaatttaatccaggaactataaatctcctattaggattttgcctagtatataagcggttgacattttctaagtcaaaatattagatacctaaactgacaagggattttcatgtccctttcagggctctgtggatgccgaaagttggcatttctaagatatttcaggttgcatgaggacaagactgtatttgaagactaaaaaacattagaaaagccgaagtatatataagttgagtatcccttatccaaaatgcttgagccagaaatgtgttttagattttggctttttttttttcaggttttagaatatttgtgttgtactggttgagcatccctaattaaaaaaaatcaaaagtttgaaatgctccgatgagcattttctttgagcatcatgtcagcattcaaaaaatttcacattgtggagcattttggattttcagattaagaatactcagcctgtatttcctatagatgtaaacattgaaatagcttcatattg

SEQ ID NO: 75405 - DNA, 1505 bp, Homo sapiens
aggcagatctagtagattctaattttagccagataagccaagaaattatttagtatgattcaacctaatgtgtaatgtgttcagcatgtgcctgtcatgtagcaaaggcatgagtgatggttgctgggttttggggctttaaatttaaagcattttaataaaaatctctaaggggaaaccgtgcatttttctctactctcatgagcatttaacacattcttcccagaagctgtacatttcaaaataaatctgatgagcacacctttaaaatgcttccctttcctttccctaaaatgttcactaagggatttttctataaatgctttggtagcaattcccaaagtcactgtaccattgctgcctcaagctttgtgtgttagtcatttcacattttacactgagattacacaaaggggcatgcttttaaggagcaggtggaaatcactttgaattacttattttataagccattttgttagcatagagtttataatctgatatttgtgttctctctggagggtaaaaatgagtgtttggcttctaaatattaaactctcgttagagtgttattccgtttttaagtgttgatgtaatatcttttgttttacaaaactagcttgacaaaagtaagctgaagccaggaacaagagttgctttggatatgactacactaactatcatgaggtgggtttcttattctatttagttcaccttttattttcacaaagggtggtttttatctgagatatatgcttcttgagatcactgaatattttggcactttttcccttttactagtttctaattaagcacatctttatgagatcagctacaggtgcttgcttgagcaagttatttatatgctatctgtaggctaagagaaaatatatctttcaaaagaaaaatacataccttttcattctagatatttgccgagagaggtggatccactggtttataacatgtctcatgaggaccctgggaatgtttcttattctgagattggagggctatcagaacagatccgggaattaagagaggttggtactgtgtgccttgttctctgaacttagctaataaatactactagttttaggattcttaacaggagaaacaggatgaaaaagtactttttgtctaaatggtagttaagaatattatgtatttactattcttgctaagaagaatagcactgaatttctagctgtgaaaattactgtttttttttatttggagataatttggtgttagaaaaatcctgctctttttgtggcaaaggaacggagaaaaagctaaaaataattgatgtaatctgatatcctgtggttttgattatcataataagttacttgggtcagagcatatttggataatgtgtgtgatgagttttttccataacctcattaatactagcttcccactcttacagaagagtagggtacctgttccttaaatattttattttgttaaagctgtttgctgccattccagaaaaccactggctt

SEQ ID NO: 75406 - DNA, 1426 bp, Homo sapiens
ctctcggtcaggcatggtggctcacgcctgtaatcccagcactctgggaggctgaggtgggtggatcatctgaggtcaggagttcaagaccagcctgccaatacagtgaaaccccatctcttctaaaagtacaaaaattagccaggtgtggtggtggcgcctgtagtcccagctactcaggaggctgagacaggagaatctcttgtacccgggaggcagaggttgcaatgagccaagatcatgccattgcactccagcctgggcaacagactctgtctcaaaaaaaaagaaatttctctcttaagttactggtactataagtaatttaaattggactttcagatcttcaatttctctagtctctacttttcttccttgaatcagtcttgagagcagaacatactgttctttaaaagctgccgtggcaaaatgccaacagataaaaattgtatataccttttctcttggtatgttgtcaaatccatcccccattttagaattattttgtgttgtattttcaaatgcaaactagtatagatcttttgagttgtgttttttgtttatatgttcatttgacttaactgatttttttgtggtataatttttcattgaggtataattacattaaaaaaatgtagattcttaagtgtacatttcaaatatgtttggacaagttatatatctgtgtaaccatcaccccaatcaagtgtgtggtttatttaaaaaacattatttgaaattttttagatttaagagatcttaaatctacctggagcaaaacctcttaatataaatggttttacctagcatggaagtctaggtctattaagaattatgatgtgtacacctaactaaggtgatatttgacttagagtatttgaaagtacattaaaaatcttgactaactttttaagaaagatttaacttcttttctaggtgatagaattacctcttacaaacccagagttatttcagcgtgtaggaataatacctccaaaaggctgtttgttatatggaccaccaggttggtattgaattatttctactccaccaataagataaatgaattaaggaattaaaaaaaaaaagacaatttttttatttttatttttttgagacacggtctcactctgttgcccaggctgtagtgcagtggcacaatctgggctaactgcaacctctgccttccgggctcaagtgattctcccacctcagtctcccacgtagctgggactgcaggcgtgcatcaccatgtctggttaatttttgtatgttttgtagagaagcaattttgccatattgctcaggctatctcaaactcctggactcaagcgatctgcccaccttagcctcccaaaatgttgggattacaagcataaaccactgcgcctggccataaggtggaaatttgatgtgggcagttcca

SEQ ID NO: 75407 - DNA, 1075 bp, Homo sapiens
acaatgacacaaaacaaaaaactaaaatgttgtttggctcttccactgtgttgacatttgtgctgatggtgcaagagcaccatgggtaaaattaaattacttgcactgtagtgtgaatcagcattagtggcatgaaacggtgctagttagtagccattgcgttcttgactgccacatacttgcagtgtaaaaaaaaaaaaagtcagtttcactataaagtccttggtgaaacagtaaaaattattaattttgttaaatcttcatctttgggtaatattttgtgttcttcatgataaaagggaaaataaatataaagtactgctgcatattgaataagatagttgtctttaggaaaagcacttgtgcagttatttaagttgccagctgaattcattgctttttatggaatactatttttgcttgaatggaccatttacagatatgctgtgattatcagactggttattggttattagttattgattactcaagactggtttttggttatttggcgcacattttttccaaagcgaacaaattaagcctgtcatgttaaacaactgacaccatctattgccattgataaaatatgaaatgtcaagtgaaaattagaatttttagaaacatatatctggcactatgtggttgaagctttttctttttttcttttcttttcttttttttttttttgataaggtgttactctgttacccaggctggagtgcagtggcgtgatcatcctggctcgctgcaacttctgcctcttgggctcaggtgattcttccacctcagcctcctgagtagctggtactacaggtgtgtgccaccatgccaggctaatttttgtgtttttagtagaggcagggttttgccatgttgcccaggctggtcttgaattcctgggctcaagcaacccgcccacctcagcctcccaaagtgctgggattacaggcatgagccacaatgtccagccacggcagctttctaatatattaatacttaaagacttttctgatgagataagtggtgagaataacaaaaattttttataatgtgtggtggaaaatgtcaacat

SEQ ID NO: 75408 - DNA, 1956 bp, Homo sapiens
agtgctgggattacaggtgtgagccaccacacctggccaagtactttggaattttaaatgaaaattctatttaggatttagctttcattttggaaaatttacttgccaaacgattatattcttaaaaggattttaaaaatttgtttcacataggccgggtgcggtggctcctgcctgtaatcccagcactttgggaggctgaagtggcaggatcacctgagcccaagagttcaagaccagcctgcgcaacacagagagaccccgtctctgaaaaacaaacagacaaacaaaaaacttagctgtgcgtgatggcacatgcctgtcatcccagctacttgggaggctgaggtgggaaaatcgcttaggtctgggaggtcaaggttgcagtgagctgtgatctcgccacactccagcctaggtgacagagtgattgcctgtctcaaaacaaatttttttctaccttaccatctaattaagacttcttttgtcattcttaggtacgggaaaaacactcttggcacgagccgttgctagccagctggactgcaatttcttaaaggtaaagggaagattattttgtacttattgaaatttaattttacttgaattatcttatatttaccttactgtttttcctttaatcaggttgtatctagttctattgtagacaagtacattggtgaaagtgctcgtttgatcagagaaatgtttaattatgctagagatcatcaaccatgcatcatttttatggatgaaatagatgctattggtaagaataacacccttgttgaaagttttaggacttttttttaaatgtaaaagaacctttttccctctcttaatctgtaattgtgacttgtatgaagtagataccacaatgaatcagatgttagtttaaccaattttaataaataacctttcatggccgggtgtggtggctcatgcctgtaatcccagcactttgagaggccaaggtgggcagatcaccaggtcaggagatcgagaccatctggccaacatggtgaaaccctgtctctactaaaaatacaaaaattagctggatgtggtggcacatgcctgtaatcccagctactgaggaggctgaggcacgagaatcgcttgaacccaggagacgtaggttgcagtgagccgagatcacaccactgcactccagcctggcgacagagcgagactccgtctcaataaataacctttcactttaacaaaatgagaaatgttacaccaaaatcaagtctaactttgtcagcataattcttgctctttaattttcatcttaatgttttaagccacagactgttatgttctgttttcttaaatgatggttgtagaggaaaagagtaatgcatataaatttccaaatctactatcttaggtggtcgtcggttttctgagggtacttcagctgacagagagattcagagaacgttaatggaggtaatatttggtaaagggggtttataaagaaaccaatgtttattaaatgaagaactgaacattgcatatttgatagtcaaaatatatagaacattttaaatgaaatatgaaatttgaaaatattgtcaggaacaaacatgtttctctatcacaaactctaagaaaatgactactggaaaataaggctatctgccaaattccatttggtatacacctgtactattctgtgtttttttgagtagatcagtcattcatatatttaaattcttatgaatgtgatcttgcggtagttttatgaagacattttttgtaatggtcatattaagactgttggcaataaatgagctataattatgtatgaagctgctctaaaaattatttttttctctcactttattgctgagactgaggcaactaaaatagttttgataattgaagaggatagatgacagaatgaaagaatgcacataaagccttcctccagttttacctttccccact

SEQ ID NO: 75409 - DNA, 1077 bp, Homo sapiens
ttcggatggctttaatggagcagatctgagaaatgtttgtactgaagcaggtaagggtttaaagtacagttttactattgattttgatttttaaaatttgctgaaactgttttgagtttatctgaaagcggagcatagactttgcaaggatttgggttcatgctgttcttttaggaatcgattccaggaaataggagaagcagggcaagtgagatggaaagagggaaagctaatatgagggtgcaccattgaggtaggtgctgtaggaaagggaggttagatctcagagaagcatacagaatgccttccaggatcacccagctgaaagttgggagactagaacattgatttaccagtactcatcccccattggatgagatttgtccttggtagtgttgactcctttgcacttctacctgccttagggcagaatgtggaaggagaggcatgtaatagaacactggccccctaaagtaagtctgaggtgctacagaattgcctaccacacctgtggctggaattagaatgggccagcaccagaggtatctgctgcaaaatgaattgtgtatgttgtctaatactagtctgtgagcagtgttttgaaagattgatttatgaattatgtgatcatgccatttgtgtaaaatgtagtatttaaatataattctctgtggattgtgtgatactatttttttcacttctacatggtatgtaaaaattgtgtgatgctatttttatttccagtaccaagtagctttaataccctacctagaatcatttagtttttgtcttccatacagaatctttaaatagaaaaaataaacttctacagtatagttactgactttataggttatagattttcttaagtattagaatatgtgatttcctcttgcttttcatatcatgtttagccttagtaaattcaacacagtgtttaaagtggctgctcagggagggcttctcagtacaggtatcttcatgggtattgggtatgctgtgagtcagtatctgcatcagatatgcaggtcagatacttctgttcacgtctagaaatgctgtcaatgcaaattaggg

SEQ ID NO: 75410 - DNA, 1050 bp, Homo sapiens
aatcacaacaccgctatggatttttttttttttttttttttgagatggggtctcgctctgttgccaggctggagtgcagtgccactatctcagctcactgcaacctccgcctcctgggttcaagccattctcctgccttagcctcccgagtagctgggactacaggcgcgcgccaccatgcccagctaatttttttttttttttgtatttttagtagagatggggtttcaccgtgttggccaggatggtcttaatctcttgacattgcaatctgcccatcttggcctcccaaagtgttgggattacaggcgtgagccaccgcacccggcctgtggattttaattgaaaaaagatagtggtttttagcaaattacaactactggctcagaagtaataaatctaagcttcacatttattccatagaattatattgtttttcttataatgaacatataattcatatgtgatatatagcagtcatgttgttttattctctacaggtatgttcgcaattcgtgctgatcatgattttgtagtacaggaagacttcatgaaagcagtcagaaaagtggctgattctaagaagctggagtctaaattggactacaaacctgtgtaatttactgtaagatttttgatggctgcatgacagatgttggcttattgtaaaaataaagttaaagaaaataatgtatgtattggtaatgatgtcattaaaagtatatgaataaaaatatgagtaacatcataaaaattagtaattcaacttttaagatacagaagaaatttgtatgtttgttaaagttgcatttattgcagcaagttacaaagggaaagtgttgaagcttttcatatttgctgcgtgagcattttgtaaaatattgaaagtggtttgagatagtggtataagaaagcatttcttatgacttattttgtatcatttgttttcctcatctaaaaagttgaataaaatctgtttgattcagttctcctacatatatattcttgtcttttctgagtatatttactgtggtcctttaggttctttag

SEQ ID NO: 75411 - DNA, 1852 bp, Homo sapiens
aaaaaaaaagattaaaaaaatagataatagttccaatcttgttgtatcttgtgctgcttttgatttggccaaataaggtttgtcttatttatatagccttatagatttaaattgctgatggtaaatacctcaaatttttttttttctaggaaattttacctggattgttcttaggcccatattcatctgctatgaaaagcaaggtatgaactttgttagattcatcaagagagacttttattaaccaacttttcttgggtaagttttttagtaataaagagttttattttagggagcatccacaaatactgtctgttaacagtaattgtcactctggagtaccttcctctttccctattttactagaccagtagttctcaagtgtttcaccacaaatcagagtttttgttttttcctcatgaaatttgtatgtttgaaagatttaccaaataactgacctttaataacttatttactctctaaaacactagacatctgtaattgctaatcatagcttcagaacaatatgagatgtagttaaagcccaaaataaggaatttcaatgtttagttaaaccttccttatcaagggtaagactgtgtgtgttaattgaaagtcattcaccttagttctgttttgccagccagactttagagagctagttggtatccccgctctgaaatttgaaactttttgagcaccagtatgtcactcgaaggaaatcctcactggagtatttcggatttcggatttttggattagggatgctcaattataagtataatgcaaataggcaaaacaaacaaatccaaactctgaaatatttctggtccctggcattttaaataagggatattcaatccgtatagatattctacatagtcaaactttaatggacttactcagttgcagttaaaataggtagatctcattttaataaatatagcaatgttcttgccacttctaaaagattcaatgctactaattctctttgagttacaacgtggaacatatcatagatgtctttccccaatactttgcctattcagaagtcagtatacttaaattgtgtttgatatatccataatttaatttgatgttcttaggaatttaaccggttttaaaaggtcattgattttgaaactggaagatttttttgacagttgagacatggctaagagtaaacctggtcatcttgatgatttttgcttagttggaaagatagggagttagtaaaaataagtactagggaaaggatagggcaggtaactatagacatagccgtaatttattttgtaaaagacagatgtaaacaaggttattgtccatataatttgctattcaccaagtactagtcttccagatggttttagataatttacatttttgaaattcccactgtactttataaatatacatacagtatttatcacattaaattaaagtatttgtttaaaggtctatctcctcaatgggaggctgaggcaggcggattacatgaggccaggagttcgagaccagcctggccaacatggcaaaaccccgtctctactaaaaatacaaaaattagctggttatggtggtacacacctgtaatcccagctactcgcgaggctgaggcgcgagaattgcttgaatctgggaggtagaagttgcagtgagccaacatggcaccactgtactccagcctggttgacggagtgagactttgtctcaaaatgaaacaaaaacacgcacaaaaaaaggtctagttcttcaaaacttcttttcttgaaatgtcaccatggtcttattagacaggaaaagcctctgtggcagtttatttcccaccctaggtaaccataatatagcc

SEQ ID NO: 75412 - DNA, 1055 bp, Homo sapiens
aacaacaaaaaataataatggagataaacctaaatggataaactcctttttaaacactcatttactgttattattttgtgggagaggagtggggtcttgctctgttacccaggctggagtacagtggcgcgctctcatagctcactgtaacctcaaactcctgggctcaagctgtcttcccaccttagtctcccaagtagccaggactacgggcacacaccaccatgcctggcttaattctcaaagtttttgtagagatggagtctggctatgctggccacatttacttaagtatatctttttattaaattcaaatacagtttaaataaaagggacaaatttagggcctttgtaattagtaaacggtttgtttttgtaaagtttttctactgtttttaaatgtgaggtaaggtcataatttgcttcatattaggttggtgcaaaagtaattgcagatctgcctctgaaaagtacaaaatctattcgctgttacgttagggctctattttgatagtttatttttatttagtagtagtctattgggccttcaaaacttgtttaagcatatttatacataattatgtgcatcgtcttgtgctttctcacattcataaagtagataggaaaactccataggcatcaagtgtaaacgaaggacttaatgttgaatttgttgtggaaattggcacaaatctcaatatagaacattggttaattattaatcttaccaaatgcttatctcactttccctaactcaagttatactcaagaaatacaaagataattgaattctaatctatgctgacataaaacttgctgcagaaattaacacttaaaacttgcaaattatattgtcttagcccaggctgctcaaacaaaataccatagacagggtggcttaaacaacagacgattatttgagttctggaggctggcaagtccacagtcatggtccggctctggtgaggaccctcttgctggctcgcagatccctcccttcttgctgtatcctcacacggccaagagaacgagttcttgcctcttcttacaagggt

SEQ ID NO: 75413 - DNA, 3215 bp, Homo sapiens
cagggtaatggatgtttcctagtttcatcaaatgttttccttgttttcagaaaagagagaaacaaaaatgcctttattcttctatctataactggaagcagaggactattgagattgccaatttaagtttttggtgttttttggggtttttttaaacagatgaagtcagagatcattatagctaatgccatactgactggcagttcagcatgcagtaccctagcacaaactattagccgggcttgatttatagttatcagtagttctgaatttatgagacaggaattttaaacttccatttctcttcaaacaatatggcactagatttttcaatacagatgaagaataccaacagtgtatacattaatcactattttgggtatccaagaatgtaaatatataattaagttaattaacttattttttttttaggaatatgaagccatctacctagcaaaattaacaatacagatgatgtcaccactccagatagaaaggtcattatctgttcattctggtaccacaggtaaggatttttttctttttggagaaatttgggaagaaagataatgaaaggtggagaacttgctacaagttacactgaacaatttaaattgtttagaaaacttgttaaactattgagctaattccagaaggattcattttataatgaataaatgtgtactataataagcttaagtctttcaagtagtagtacatccgtgttgtaaagattaaaataatacgaatctggagaaggggccctaaacacgcttaggtgatcttattaaaagtagagggcggttaatacagcgtgtagcatggctaatgtgagcttctttctcttgccatcaatatttccatcctttcctccctctgttgctatttcagaagtaccctaagccccttattttcaaagttaatccaagcatgctcttaaaatcttcctttcccaagaccttgctacctgtgtttatcacctttgtttctctcccaacaaagcacacaaggcatttttactttatttccagtttttcctaccctgcagttcacttcaatctttgaaccaacagttatataaggtagtaagaacagcttatatacttagcactgacctggaaattgaggacaggtgatctgatccacaagtatagaactctttgcactctactgcactgcccatagtgagtaatatgactgtatattcatccccaaggctcaacttcctaattgtcattgactttttcatttcctttgccacatctgtctaataattgctctccacatcctatagggtccgttttgtcagtattgttaacattccttcctttttttaatagtgaccttaatctagttcaggtccggatttgcctcctttccaaactcttgttatttggtctgttctgtacattgtggccagacttattcccatgaaagatatttctaatattgatatttttcctttgccaaagcctcctttggcttcattcctacaaaagtttatagaatgccatatgcccttctgattttttggtttctttctctcattgttcttctttatgtctgcatttcagaaaacaactgctgatggtttcctgtgtgtgtcttcttttccccacctaaaatgcatcacatttagtctccctattcttggttcatatgtcatctcctcaggaagacatgatgattaatgcactcttcctttaacccctagtcatttggagttcccatagaagcacagcacttcatctgaaacttaatcacagtatctgggtttagcctgagggctaggatattttatctcattcaattgtattgatactatatttttatctttatgaattttatagtgaaacattcttcaattagaatatgccctctgaattaacattattattaccatgatataacagtcctgtagggcataagtttaaggtcatgccattgttaggcaaaaaacacagcagaccctctgctggtttaactgttccctaaagttttcctccattgagagtctaatttcttgattataacttttggggatacagagatagctttgattctatgtgggagatttctgtactagcagatgctggtatgaagaatagataaaagaaaatctctttatatgctacatgccttcctttctcccaacctagacttcgatagcttgagtggaaaaatattttcagctgctcttcataacagcctctgtgaaagcaaaaagattatctacaaaaaattatacaaatacaagattaatttcctaaattttatgccctaagtcacatgtttatggtgcctaaaaaacaattaacttgataactaaacatttatgtattatctcttgaaaaggtctattttcacactatttcaaaaattatttattttatatgcaatacctaagacataatacttgagaaggaaaatatatcctgtcatgaagattaaaaagttataatatttaggtaatttatcacaaaggaatttactaaattttgctatatcagttgtggaattttcatagtgtatacatgatcacttaataacaaaattttacttgctgtaaccttttaacatgaatttattttagtgcccttttaatcttcatgcaataacttttaggcagtttgaagagaacacatgaagaagaggatgattttggaaccatgcaagtggcgactgcacagaatggctgacttgaagagcaacatcatagagtgtgaatttctatttgggaaggagaaaatacaagagaaaattataatgtaaaatggtaaaaacataagtagtttttttttcaattacatgttgcttccagacatacttctctgcaacttgttgagcaacattttaagatgttggacttctgcaatagatgacactgatggttttactcctttttttaaaaacacatgcgcgcgcacacacacatgctttacaagttttattataaaccaagaattttggacttgcaaagaggtattattgcaataatgcacttttcatacttgaaatttatttgtatgatataaagttattactttaaacaaaatgcaagtatggggggattgtttataaagtttgggtaatttataacaaaatttgctaaggtttgctaaaaattcatttttctgttctatatattacatttttaacataattttacagttcaattttatgatggagcctcttacagaaacattaacaaaatg

SEQ ID NO: 75414 - DNA, 1128 bp, Homo sapiens
tgcatggagggaaatccaaaatccagatgacgtggtgtgagtcaatgggatgagaaacactggtattttctttacaatttcattttacaaagagcacattaaactaaaattttatgaattatgacttaatctaatagttcaacagcagactcaagaaaagcacagatgtgattctaacagaagactactcatataaacaggtttaatgcaacatggaatgcaaaagattagaaccattaaaatatttaattcttcaactttaaaaaattaaataaaatcaaaataggataatgaccagaatagtgccattataatcacatcaaaaagcttccattaacattttatgaatttggcaatctagtacaatacattaagtattgtgtttcactcaattttgtgatactccatttttgaaaaaacttagaggcttcagatacccatgaaaagaaaaaaatcagggtagaaacacataggctgaggtttgctaattcactgtttacagaggaccttagatgtcccactataattgctcttaggtatttttaacaaatgaatagtcataattcacagaaaagacaagtggtactttttatctacatagactatactatataaactttcagtaaaacatttaaattgttttacttttaatcttgtcaagtaattttcatttcttctacttcaaaaggttgaccaggttgtttgcctgtattgggatcaacgaatgttggactatactatgtttagttataataactaatttatccaccctgacttaatatgtgggaaacaatacacccctaagtgtattgagatgtttctttgaaacaaaaatatttaattttatgcatgtgataaacagccttattcaatgtatactttttttaaatgagcaacacagatagcagacatataactccttattacccatactcttgactaccaagaaaggaagccaaacttttagaaaaatacaatgcaagaaaagattcaagttaaaaatatattcctttggttaaaaatcatcccctttataatattcatttgtaatctaaattcacagcatgtcccaccagcccaaagtaatcttctaaatgtcattatacttgtagtattacaatgtttttt

SEQ ID NO: 75415 - DNA, 1259 bp, Homo sapiens
ttggtcatttttttttttaaaggttgagtttttagtgttaacatgcatcttaaaattcgtttttctttttcaagacagagactcactctgttgcccaggctggagtgcagtggcacaatcactactcaccgcagccttgacctctctgggctcaggtgatcttcccccctcagcctctggagtagctgcgactttaggcatgtgccatcatgccctactaatttttatattttgtagagatggggttttgccgtgtttcccaggctggtgtcaaacccctgggctctagcgatcgcctgcctcggcttcccagagtgctaggattacaggtatgagtcactgcacctagccttaaatttcatttttaaagagggcttagggtgagttttgtatttgtcctgtttattagtgagctggagattactagataaaagtatatttgactctaagtaaaaatgctttggtgatttaaatgcttatcaacttacatgaatgcagtgggaaaagccataatctaaacctgtttctaaggaaacttaagttttataacattaattcatattgttactagaatcaatttttattaataaatgctatctcctcaccctaccccctttttaaatttcaggttattatcaacccttactttgctaagcaagaaactgaactgttacaagattacccttgaatgtctaccacaaaatgttggtttctataaaaagtttggatatactgtatctgaagaaaactacatgtgtcggaggtttctaaagtaaaaatcttgtaagaaaattgtcaaaggggctaatgctacaaggctacactcttcctagagttgaaatattttgttgctgcagccgagtgacctccataaatactggactgaaaaaacattgtaatactacaagtataatgacatttagaagattactttgggctggtgggacatgctgtgaatttagattacaaatgaatattataaaggggatgatttttaaccaaaggaatatatttttaacttgaatcttttcttgcattgtatttttctaaaagtttggcttcctttcttggtagtcaagagtatgggtaataaggagttatatgtctgctatctgtgttgctcatttaaaaaaagtatacattgaataaggctgtttatcacatgcataaaattaaatatttttgtttcaaagaaacatctcaatacacttaggggtgtattgtttcccacatattaagtcagggtggataaattagtt

SEQ ID NO: 75416 - DNA, 1050 bp, Homo sapiens
tgtaaaaatattttgaaagcaaaagactaaaaattctagaattgagccatgtaaacatgctcttgttaaaatgtgcaaaggttatatttgaatatctattgagtataaaagttaaagagatctatttaaagtaaatgaagaaattgaagttttcattagtcatggaagtggcaacatcagccatttacttgtattttaagtgttgttcatctaaaatagctatattagtctttattttgctagcagatattttgaatgtgtaggttatattccaattgatactaattgctgatatttcaactacttggtaatattttctttagaaatggaaggtaaattactatggtaaaacagctttaaacatttagtaattaagtcagctaatcctaatatttttctggctccccataaaattgaatgtctactatgtaacactttgttatccaatttccacagaatcttttgagcatatgaagaaatctggggattattatgttacagttgtagaagatgtgactctaggacagattgttgctacggcaactctgattatagaacataaattcatccattcctgtgctaaggtatgtgctgcttataaataaaatggacagctgttttctagcacaactgactttgagtttccattagacaaatctgttttctcattgattttcagtgcctcttagaaatcccttttcccagtgtgttctgagagctttaagaaagaaaatgtataacagtatgaattgtatgctaaaattgttctgtaaggtggatcaatttggtataggcatagagaaaccaaacaacttagcagtaatgcacaaaatccctaatgttactcttttaaaaaaaacaactctgaatataccacgttagcataaatttgtttccacatggtaaagggttcagattattccgttctaattatgatacatctaatgcatgtagtgccctttcatccctcaataactcacataaaatagtaaataaaaaaagagggagagaaaaccttaattcaatgagaataaggtaggaacacttggg

SEQ ID NO: 75417 - DNA, 1050 bp, Homo sapiens
tcaaaattccaggtgcactgttcacatcaatttccggtaacactaatgaaattcactagaaattacaattttaaagagtgtaatctcaacagtgttacttatactttaatttacgaatattgtatttagccatgttgcacctttaagtaaaaccaaatcacatatttgggaaaatctggcaccctttgcattgaacttaatgtaaaatataatacattgaagaatgtatgttctgggtctataaatactggatattaaggtcagcactatttaaaacatcttatgcaggcagaagcactggtaaaacctgttatttttgttatatgtagtgattatagaagaatagggttcactttattctaataattaaaagattatagaaagttctgaaaaaataattgcctgtaagcccacctgcttaatatattgcttattttcatactgtcttccttttgctattctcgtaatttgaaatctgtttttcaaaactaggtttttttaaggtattgggtcagctaacagagactggagttgtcagccctgaacaatttatgagtaagtactataacctctttttcctgaaataaagggaaacatgatttcatttttgtttagagctgttcagtgcccacttctgtttttgttcaaatagctggaaattattcaaagaacaaattagctgttttatacaaatgtttaatgtggctgagttgttctagaatccaaatgtaccagtaactttgtttttgcaaactatctgactactttattagataattattgtaccataggacctaggtgttagctctagaggtttttcgtttttttattgtagtatttcccttactgtggttatttacagaaatttcattaccaaatcaaaaaagcaagactatacgctttaaatttattttggggtttatttgtattgaagtttaaggttagcaggcatcttaagagttagtccacccgtcccctgcccctcttcttttagacataggagaaaataggaatttagagagatccaaagacttgcccaagatcacaggt

SEQ ID NO: 75418 - DNA, 1597 bp, Homo sapiens
cacctccgcaccgagtaggtcggcgctttccccagggtacagagggacattctttgtctctttttcctaggctcctacccctagaaataccgagtactgtactgtgatttctgttgcgggagctgatgtttatgtaagccaaactaatttaaaattttcatacaaaattgaacgggcgattataggattcgttttgttaggataatccctcatgaacgaatcctagaatggatcttaagaaattaatttaggcaggatttgctaaataggggagagagcgctagctgtatggtatgatgatgtaaagattggggtctgttgaggatggtaatcgagctcaagatgcgaaaacgaggattctagccccaagtcacttacttgctgtgttacctaaggggcaagtcttgggagttccaggtgctccagcttcctcatcggtagactgggaataacgcctagattgtaaaggtcaaactatcagaaaatacttttgaacattcatgcagttacacaatttaataaatatggccaggtgtgttaaaaatctttaacggaatagattcagaatggattcttgttatcgaaattgttataaaatgaatataaaggaatccgaagtccgcccctcccccattcacctgtacttagaaggttccccaggagctcttgagaaatacataggctggtttagatttggccttagattgtattttttaaaatttgtagatcgacttttaaaatcttcatctccggtgtctattacttgttgctctccgttggttgcttctagcagcagcctctctccccattcgtattccaacctgatacagaggctcagacgccaaatagttgaagttttgtttaaaaaatattcaattgagtgaaaaaatattcaactgatgtgatgactagtaaaaatgaatttggtgtatgctttccgcgatattgtggcagtttgggaatttttttttttttttttttttttgtccttctggattttctgaaatgtgacctacaggtaagtcttattcgttattcattcactaggcattattgggctagggttaggcttaaacgggtcttctaaacgcctgctaatttagcagttaatcagaaaaggttctgaggaatacttaaggaggattagtgtttaaagttcatctaaaaactttaaagaacctaatgatatgatgagattccgcttcacacaactgtgcaattttattcgcagaaatttcctagttttgcaatatctgggcacctgaagatgctaaaagattatttatataaaattacttatttaattatgttctaaacccccttggaaccaggtttcaagtcatatcttgcttcactttgcccagtaccttagttgggcaccagcagaattttacggtttgaggacagagtgagctaaagtgggccttcagtatggctctgttttgtagaatagctcataaaaaaatttttgatgttaatttctgattgcctggttaatagattcttatttcaatctgtaatgctttgtttaatgtattttgactagtctgattcccattttccaaatgtaggttctaagtgctgcttatgacttaat

SEQ ID NO: 75419 - DNA, 1142 bp, Homo sapiens
gcaaaagaccaaaacgagagtttagatgaagagatgttctacaaacttaccagtggttgggtgtgaataggaatactgtttaatgaaactccacggccataacaatatttaactttaaaagctgtttgttatatgctgcttaataaagtaagcttgaaatttatcattttatcatgaaaacttctttgccttaccagaccagttaatatgtgcactaaacaagcacgactattaatctatcatgttatgatataataaacttgaatttgtcacacattccttagggccatgaattgaaaactgaaatagtgggcaaatcaggaacaaaccatcactgatttactgatttaagctagccaaactgtaagaaacaagccatctattttaaagctatccagggcttaacctatatgaactctatttatcatgtctaatgcatgtgatttaatgtatgtttaatttgatatcatgttttaaaatatcctacttctggtagccatttaattcctccccctacccccaaataaatcaggcatgcaggaggcctgatatttagtaatgtcattgtgtttgaccttgaaggaaaatgctattagtccgtcgtgcttgatttgtttttgtccttgaataagcatgttatgtatattgtctcgtgtttttatttttacaccatattgtattacacttttagtattcaccagcataatcactgtctgcctaaaatatgcaactctttgcattacaatatgaagtaaagttctatgaagtatgcattttgtgtaactaatgtaaaaacacaaattttataaaattgtacagttttttaaaaactactcacaactagcagatggcttaaatgtagcaatctctgcgttaattaaatgcctttaagagatataattaacgtgcagttttaatatctactaaattaagaatgacttcattatgatcatgatttgccacaatgtccttaactctaatgcctggactggccatgttctagtctgttgcgctgttacaatctgtattggtgctagtcagaaaattcctagctcacatagcccaaaagggtgcgagggagaggtggattaccagtattgttcaataatccatggttcaaagactgtataaatgcattttat

SEQ ID NO: 75420 - DNA, 1047 bp, Homo sapiens
gtaccttaaagctgctaacaaatattcctgctagaaacatgtattccaggtattcattctgattatagacatagtgctaaatttaattaaaactcgtgtatatgtggattagaatgtgctgttctgtaatagtagtaccgttaggtgtatgcatttggaatatgtctcaagtgtggcaactatgtactcctaatagtactttttgttgatatatgaaaactgaaattaagacttattttgaaaaatccttatacattacattattacagtgtccaaatgtagcttcagatattttgatttcaactcttacaatatgattttggggtacggggtgcgtaattcaatcttttgatcttttgtctcagttctcccatgagagaataatgttcaatggtaaaggtgatgtttactcatgtttagataacagcgagaatcttggaggcccatcagaatgtagctcagatgagtctaattgaagccaagatgagatttattcaagcttggcagtcactacctgaatttggcatcactcacttcattgcaaggtcagtggttctaagcatctatgtgtaaaccttaatctgcatttttgcttaatctacctcatgtaattagatattaaacatctaaagcatacctatgtagacccattaactcatattacaatagaattcaaagactgttagaatgtattttgtaagcttttaatttctacattaaaaattcaagataattgtgtttgttttactactaagagaatagcactcttggccaggcacggtggctcacgcctgtaatcgcagcactgtgggaggccgaggtgggtggatcacgaggtcaggagatagagaccatcctggctaacacggtgaaaccctgtctctactaaaaatacaaaaaattagtggggcatggtggtgggcgcctgtagtcccagctactcgggaggctgaggcaggagaatggcgtgaacccaggaggcggagcttgcagtgagctgagatcgcgccactgcactccagcctgggcaacagagcaagactccgt

SEQ ID NO: 75421 - DNA, 1016 bp, Homo sapiens
ctccacagtgaacaaaatgttccccagaataatttgctttctgattacatgtttgtatggcaagttgcagtaataacactgaaaaataatcggtagttccgccttactttaatgtcatcaaattagatttcttatgttaaaggctataatgtctagtggttatttccctgaaaaataacatacagaatctactttttaatactgtacaatcaattattctctgtcatattttaatgtcatttttaatggaaaattagatgtgggcatatataggcatgtctgaccccataggtatccttctaataatacttgattgtaaataaaaattcttgcttgtaaattaagatcccaggaaaaaaagcattaaatttttcttgtcaattgaatattcagagtttgaaatttttcaatggtaaaggttatatattacaaaagaactatttctcttgttgcagtatgatgcaatcagaatcaatcagctttacgagcaggccaaatgggccattctcctggaagagattgaatgcacagaagaagaaatgatgatgtttgcagccctgcaggtagttgaaaggtctagtaaatgggacttattccggtaaagggtagggaggtatttttaaacagtaaagtggaatagtaattccagtaacatttcacgagacagaatttttgccatgaagaaagtgagtagacacttaggaaagcaaaacaaatacattttagtttgattttttatcttttccaagagttcagtggtatacttaagtacttttctctattttgtaggaaaaaaattatcctattttgtaggaaaaaaattatcctctcacccccaaatataaatctgctcaaagctcctcagtttttccttggaaagaaaatatttattaaaaatcagatttctgaaatctaatctgaagcttacctgtataatttcataaatagccagggatgatacaacacactataaaatgggctgtagcaaagcgatgcttttaggtgataagatttag

SEQ ID NO: 75422 - DNA, 1026 bp, Homo sapiens
ggtttctccatgttggccaggctgatctcgaattcctgacctcaagtgattcaaccgcctcagcctcccaaagtgctgagattacaggagtgagccaccacacctggcctagattttacaggttttttttagtactaacattggaagaacacatgtcagggacataaaatcaaatatcctgtgtccagcaagagattacatattttcagtaaaaactttttttttttaactttgcttcctagactaggtcatgacagctacaaaaatctctagcattagcaccactttttcacaggcagtgtttctatcattgcatggggagaagagttaaaaatagtaggaaaggagatggatttctaagcttaaccctaaatttagggaatggaaaagccattttctttacattaacagtgttatgcccattgcacattttcttttgaaaaattatgacaacaggacaaaatataatttaacagagctaggacttgggggagctgcttgtccttaatgtcattctgaacatttttagatgccttaaattcatctccttaatttttgtagtttaaataaaggagcacataccatctgttgactaatgtaacaaattgttatttacgtaacctctactatatgtctagccctaatactaagaaatcagaagataaataaggcaatatcccttccttttgagatttgactattaaatatatctctgtttagactctttctagggcagacttttatctccccttttacattaatactttatttgttgtaccccagaacttaaaaattaaaaaaaactttatttgtaaaattgttgaaacctgtttattcactgagaagactttactataaaattattcttaatctatatgaattcagttctattgtgttaccttcaaattgtatggatttcaaatggtggtaaaagttgtagacatatttgtcactatatacttgactacagcacaacttcattcttttaaattgaacaaaaaaaaccgttttacttaggttgtagct

SEQ ID NO: 75423 - DNA, 1160 bp, Homo sapiens
actatatttctctttattctgccctttgatagaattgttggatcaaaaattatttttctctcagaatttggaagtcattgttaaattatcttttggcttccaatgttgctattaatagtcctggtagtgttttttttttcttttttcttttatttattttcttttcttaagagacagggtcttgctctgttgcccaggctggactgcagtgacacaatcacagctcactctaatctctaactcctggcctcaagtaatcttcctgcttcagcttctccagtagctgagactacaggtgtgcaccaccatgcctgcctaatttttaaattttttgtagagatggggtatcactatgttgcctagactggtcttgagctcctgacctcaagcagccctcccaccttcgtctcccaaagtgctgagattacaggcatgagtcaccatgcctggcctcctaatagtgttcttgatttttatttttaatcttctttgtagactgccttttctcactggaaacttttaggatcttttcttttccctgccattttgaaattttgtaacaatgtgccctgcctggttagggttttattttcattcattgtgatggagacttctgaccaggggatatttcttgtatttatgcagagttgtttcataatattatttccttggtaatttcctcctctttgttttctctgttctcgctgttactgttagtcagacattgttcttggatcgatccacttgcttgactttatattggattttttttttttttttggtggctatcacattttaattttcagtgttttggggtttttttttttttttttttttttgagacggagtcttgctcagccacccaggctggagtacagtggtgtgaccccagctcactgcagcctccacctcctgggttcaagtgattctcctgcctcagcctcccaagtagctgggattacaggcactcacaaccatgcctggctcatttttatatttttagtagagatggggtttcaccatgttgcccaggctggtctcgaattcctgactttgggtaatccacccgcctcggcctcccaaagtgctgggattacaggcatgagacactgtgtctggccagttttcagtgttttatatttctatctggatgtttgtta

SEQ ID NO: 75424 - DNA, 1159 bp, Homo sapiens
gatattggtctctgttcactttggttccccatcttttcaccacccattattcaccttcacacatttctgcaacttcataaaccacagtctgttcagtttctcatcagaatgttattgtccattcctataggacgagttccaagcccaccaactccttgtctttattaatccttcctattctagccctcaggattctgttttctgagaataagagggtactttctctgtcatccatgtgtcccattttgtagttgactcaaacattcttagttgccctatatattctgcctcagctgccttgtgtactggcttttcaggacagagcgtgttttctcagctgttaatgtttcttttgtacctgtcacataacagtaacttagtagttaattattgctgttaaatacccaattatctagttttctgcttttaatttctcaaaatcaccttggtgatttttaagtgatttgtttattgtttgttttttatagatgtaaaaaaagattggtctgaccatgctctctggtgggaaaagaagagaacttggcttctgaagacacattggaccttagataagtatggtattcaggcagatgctaagcttcagttcacccctcagcacaaactgctccgcctgcagcttcccaacatgaagtatgtgaaggtgaaagtgaatttctctgatagagtcttcaaagctgtttctgacatctgtaagacttttagtaagtattacataaattcttcttaaaatacgagttatgtgatgtacagatgaccgatgactgacatagcttatcccaagggatggggcatgggctgaactatctgtatatatgtatgtgtgtgaaatttctacttcattaaagtttttatattaagataaatgctgggttaaggtggaacaggaagaacctagtagagattctttccttactagaattgtatctgatatttaatactttatttttatggagaggttaaaggaacaggcactattttcaggggaacatacatggctttgcaatgtttccttcacataagtcactatttgattttagtgattcaggcagattgtgtcacttcctccattgaaggcctgacacagctcctaaggaaatgactatgagtgttgtcttccttcaccagtctacaatttgaa

SEQ ID NO: 75425 - DNA, 1241 bp, Homo sapiens
ctgaaagaagtctggtgatgatgggggagcaatcctagggaaccagtggcttgacgtgaggctcaagaagaaataatgctaaagtgctttctgaaccaggtttaaaagatttagcattatccccagagctgtgagatgcccataaaagactttaaatagggggagacatcagatttttacacattggaaattcatcagtttcatataaaataacttgcagataaggtgtaagcaatgataatcctcttggatttcaagaaataatttttccagtatacattgaagttttatattagaatttgttaatattttctgagataagcttacaacataaaagccaattaaatattcttactaaattgcttttcttttgaactttagaatagctagtgtcattgatcacatttaaaacacaaacacaactaatacttctctaagtccaatactaactggtgaattttgtcctgatgttactctcttagaatttgtcagaccttttcattgcatggactccgagccctgtcttctaggaatgaagccaggttgaaccaaattagcaataagccagccttcaggattggatagaaagttacccaccctctggaaattaataattggcatactttctgtttatgcattctgtaactgcttgcatggcttatgtgatctgaaaaaaacttcttaactgctttgagttagtatgtcttatagtatcggataatagattgaaattgatagacattatctcagattcgtaacttcaaaaggctatttgtaaacttagttgatctctttattttgaagagtgaattccccagttttcaactagctatgtagaagaaattgcaatttgtcacttttcgttagaggtttagtttctgtcttagtctgcttgggctgccataacaaataacatatcctgggtggcttaaacagtaagcacttatttctcacagttctggaggctgccagatctaagatcaggatgtcagcatggttggtttccagtgaggaccctattcctggtttcctcacatggaggagggaaagaaggagagataggaaaccagctgtcttctgtctcttcttctaaggataccagttccaccagaagcactccacctccatgacttgatttacctccccaaggccccatcttcagataccatcatattggggattaggatttcaacatatgaatttggggggacacaaacatttagtccatagcagtttcccat

SEQ ID NO: 75426 - DNA, 1217 bp, Homo sapiens
ctttggacaatgaatccaacctgagtgggttttgacttctataaaatagaaattgaaaaaaattttcttggggcgggcggggtggctcacgcctgtaatcctagcactttgggaggccgaggcaggtggctcacgaggtcaggagatcaagaccatcctggctaacacgatgaaaccccgtctctactgaaaatacaaaaaattagctgggcgtggtggtgggcgcctgtagttgcagctactcgggaggctgaggctggagaatggtgtgaacccagaagggggagcttgcagtgagccgggatcgcgccactgcactccagcctgggtgacagagcaagactccatctcaaaaaaaaaaaaaagaaaaagaaaaacattttctcacaggttttggtgagaattaaatgagataatacatatatattgatactacatgtatatatactttatataaactatttgtgttatgcaaatgagagtggatacttctctgtggcattgagtctctgagtatatgaaagtaggaaggaaaaaaaggaaaagtaggttaaaatataatctagtatatttaataagttccagctttactggtggggaattgcactcctcaaaaaaagcttagtttaggattgctttctgttcccaccctctaaacaacaagaaaaaatagctgtcattttactttcccgccaacttccaaacacacacctgcctctgcagtgtaagagagctatttaagtaccattttaataagatttctgaaatgcaggggaccaataagtggatgatggtattccaggtatttgaaaaatctaaaaccatgaaagcatcagtagtaaattaattctctacttaatatattctataagagcagtgtttttagttcatttatagcaaaggcacatgaaaacattgggcctatttagaaactaatgaaagtagtttcagaaaaaagctaatgtatgcagtattcctatttaaataattattttactgacaaattaatgcttatgccatggaacatttaaaattggtatatatgcccagtgagaagtaaacaaatacatctgaaagtgtatttttaaataattcttttattttgtaattaagaagtgtgacttctgcacttgggtttgtggttacaaattcatattcgttataattcattctttaacaaattagttgcataattactatataattgtttttcctgt

SEQ ID NO: 75427 - DNA, 1063 bp, Homo sapiens
cagttgaaatccttagtttttccccttgagggctcacaactgaattcatggaaattaatgcctacatgatgcatcctcattgcattcatagtgaaatacattaacattataagaaatttttttaaatcttgggggtggagtaggaaacaatgttaaaatcttattaaagtgaattaagttttggttaaatctgatagtaagtttactcagtgtttaaaacactgttcatgatccataggaagtgaattaaattgtatcagtttcttagcaaattttaagttctttaaaagtggaggacagtactcaagttttactgtaatcctgtgacagctaataaagtatgagctattccttagagtatgtgctatttgctgccttttgtttttgttttgctgctatgttttatacccagttttttaaagtaaaaaactgtttgtttccaactagagttaacttatttatagagatgctaaaaatatgtttattcaattacttataaaaggccttgttggaaatgtctaatcgctcgctattgaagagaatggaaagaaaatatgtaaaattttacctgttatctttggctcttaatttttaaaagtttcaaacatctaagttcaagagtaattgagtgaacactgcgtaatcttcatctagacaccagttagtattttgccatttgaattttctatacacacaaacatacacatgttggggagcagttggatgaagtttcagacttactcataacctttgattcctaaatatttaaatatgtatcacctaagaacaagaaacttctcttgcataattacagtatagtgatcacattcaggaaattcaacattgattcacttctgtcatctaatatgcatccattttcaaaatttgccagttgtcccaataatggcctttgtttttttcccatccagaatctcatttcgcatttagttgaaagggcctcttaatctcctttgatatacagaacagccaccaagtgtggagctacaggagattatataataaatggcttattgacattacattaagatacatgtaaaatgat

SEQ ID NO: 75428 - DNA, 1032 bp, Homo sapiens
aataacaagccaaggaaagaactttgtgttaaaaagcagactttgttaaactaatttgaggttgacggtgtttgcttgagtacaaatatgtattggattgatatccgatttaaaataataaggtatcttacagtatgaagtgtgtgaagagtgtgcagtacacatttttgtgatgaatgaaaccattttcatctggaagagtcagctaaatagatgatttgatcataagagaaatgctcagagaactatcttcctgagctttaaagagccttttgtacataatacagttgtgataagatgattatctgtgtggcattgtctttttaggctggaattgttttttgttttggtgaaggggggttggggactttctgggggtttttttcgtctttttttttttctttttttttttaaacacagcattcgttttcaagctacactgggaaagtagagaagtgcttatttgtcaggaaatctatttcttaccaaaggattattgtatgtaaaggtactgaaatagcactctgatgcattttgcaaaataaggcaggattcatttgggtggacctgctttgtacccctgcaggaagttttattattgaaggaccaaagtgaagctccttacaaggtagcctcttccttaagactgcattgtttggctccctgagatacagctcaggaaagaaaatcctcctaggtagcccagtgaaaattagattttgctgtattgattaaccatttaactggcagttaacagtatttttatctgatttgaataaatcagtcactgtttgcaaaatatgtatgaaccttttttgtccagctctggtatgagattatttaagaaggaaaatagcaaatatttggatattttgttttcaaagaaaacaagcatttttgttagagcttttctaatttatggtaaatggaccatattaatacattggtctcaataggagatattttttatattgcaaaaaaaggagctgttgaaggtgactgagacaacttgtagttctcgaaagccaggct

SEQ ID NO: 75429 - DNA, 1174 bp, Homo sapiens
gatttttattttatttagatagcggcataagttgttagcagtacttcataaggtccttcctagctaggtaatgtcttctaaaaaccttgatgtacatagatctcctcgtcaaaagagatggcaagcattgtcagttggcagaggctggctgtgtcatttttacctgttgatatgctccaagtatacttgtcagttcctgtatataactagtcatagcatcgaattgttcacttaagtctccataatggttcactcaattcaagaatagaaggcttagagataccagtaggcatagaacaaccaagtattgtttccaaaggggtaaattcatgccttctatttcaagtattacaggttttatgtatttaggggaacgcttctggccatttcagtgcagtctcttgatagaattttcctaaaattttttgtttctacctagccaatattttaataatccacaatattagctgattcataaaaagtgcttttacaacctgttaccatctaagataatgcatcatacaattttcaagaatgtgttgattttgagcctctgttctgtagaattccctgtgctgcagccggtacatgctcctttttgatgactccacatttattctcacaggcatttgtcctggactcttctgctaatcaatgaacaaacagtaagtcattcagatgggccagtaactcaccacttgtctccatatgaaggtgaggcttctgttacttgaagacttgattaagtaagcgtgggagactgtgcatggtggctcacatgggcatgtaatcccaacagtttgggaggccgaggcagcaagagttcatgaccagcctgggcaacataacaagacccccatctgtataaaaaacaaaataattagctgggtgtggtggtacgtgcctgtagtcctaattattgggaggctgaggtaggaggatcatttgagcccaggaggtcaaagtcacaccactgcactccagcccgggtgacagagcaagaccctatctctaaaaaatttttaaataaaatctttttttaaagatgtgggggaacttatactttatctgctttttctggtggactgtggttcccccacccccaccaagcaccagctgcctcagctcctaaagccctccccacaccacacacaagctcatgctcactagggca

SEQ ID NO: 75430 - DNA, 1109 bp, Homo sapiens
tagggcgatggtaagaaggacctcccagtttataacggtttggctgacccttggtgagtgcccatttgtcaaatgaggcattaaagatagattttaatccactcgatctttttttaaagacttgaagatcctccagctgaaatgtcagtgtgcccaagtatgcaactcactattcacaaaagaactttctttcaagatctctgccttccataagcaattcacaaactcctcttcctctttgcaccctgtgtcaaggcttcctgagtaccatttcaacagagaacttatttataactgcaatatatctaaaaatcatagtccaaaatctttcaggcagacaaatgccattgatctcaatgtcatattcaggaagtcactgatccaagtgccatattccacaaattcccaggcataatcgaacttgctagaaaaccaaaaagggaaaacctgggaagtgggccaagatccttggtgtcattgtacaacattcaagccaactctggtttcaacattcttttgagattgttaatccctgattggaatgcattccacagtgcttggccacagattgtcacacaagaagtacactgcagaattgtacttgcatattgctggctttttgcaataggaaaatagaacccttagtaggaaagtctgttttgtctttttaatttgtatgaaatctctgtggaagtattacaatgtagtagacataaaactggattaggatggtctatcatatataatcttgagctaatgcctaatcttctaactaccctacctgtttcccaaggtggttataaagaattaataagataacattttatgtaaggcatcactgttgtgataagcataaggaagatgtaactcaaaatatatggacaaatggtaagcttcaacagtaagctttaccaagtgagtaatagtatctgaaataatctgttcatatgatacaatctcaaaaatgcaacaggatcttttttggaactgggcaagctgtgtcttaaaattgtatagaaaaaataagaatattcaggaaatttccaagggggaaagaagagtaatgaggacaattagcccactagatagtaaaacatagtataatgcta

SEQ ID NO: 75431 - DNA, 1012 bp, Homo sapiens
aagaagaagaaatacaaaacaacaaaaagaaaatcaagaaaaaaataagatatccaggaaatattttgttagttttctattctggtgacaaatgcaaacttaaggaaacaagttgcacagtgttaactaatgtttaacattcctttccatagtgtttatgtgggccttttatcaattcatgacaaataggtcacctccaaaactgttccaacataggttaactcagaaatttaaaatttaagtactatcctttttggagactatgagaagagtttttactattgtgttttgttttgttttttggtgtgtgtgtgtatgtatgtgcattccccaaaaatagtccattggcagattgttagggtgaacttttcctctgcctttgtgtttgtataagggcgggtgcatgcttagtattgtctgctaccttatggtttttcatttatatgtaacatggtacaacttgcttcctccccacccaacagttgtcaggatatgttggggaatattctttaggaagattacatctggtcttctgttggagtaagatgaaaaacaagtatgttaacacttgacctttactgctttctcctggaagacattgaatatctaggagcgtcactcataccttcccttgactgtacccacacccactgcggtccctgcttgatctctcaaactttttgtttccctttgagcttcatgacaaaaaattataaccattttctggttctaaggctgccataatcccaactttgccagtaagaagatggagaatttttgctcatagggacatttctcagaagcagctggcaccataactctcctgagacccttgtttcctttctttcagctcctatgacttcttatgttcactctctctaacactactaaatgttgtcaatgactgcaatcacaactctttgaaggcaggctttttcttttcctttgttacctcttattttcaatagccaaagcaggttagttttctcagaatcttcagttttactgaagc

SEQ ID NO: 75432 - DNA, 1055 bp, Homo sapiens
ggtatttctatcttctcagctaattaatgagtaaggcatgtggacaatcgagaaaactaatttgagtgtatgtattaaaattgctcttctaaaaacacgtaaaatattaaagatcaaggcagagcaaaaaagaacgtagcaatcatatactagaaaaagaaactaagttttgctaaactatgtttgggttagttgacctctgtagctattctaaagttttctatcccttatctgtattccgctgtcattcctgtgcctcaagcctctgccaggaatctgatggtactctggctgaacttaaaacataagaatctcaaaggtctcatttagtaaatgttagtgctaagttggtgacagcctgggttatatgctttctctttcagtcttcagtagatgcttgtgatagttttcaaagaactgtaaaatttccgggtctgtacagatttttagagatcatttaatccaaccctgttacagtatcatgtcagcatttaaatagcagtaaaggtcatgaaaagtgaagtgaaaggcagcaaactccatgaaaaactaaatacagtgacaactgagggaagtggtaaagtaaaaaaatattaatgatggaattttaaagctggaaggggcatagagaccattcttttctcaataatattctgcaaatattaacaggtgtcatgtcagaaactaagtttaggaattgacaaattcaaaaatctcccttacagcagggctttgagagcctttgctacactaaatgctctgtgaatctatctggtgctgcgtgggggcctccaaatttatttaaccatattttttaatttggcatttacctagagaaatgctatcacatttaattccttcgttttacagtttcacctcctcatgtgattccttcattttgtaagtgaccgattccaccctatacaatcacatggccaatgaatgacagtcagaattagaacctagtcccctgattcccaaccatgtcttataccagactgtttcccctaatcgataggaaactactcctaaagggcagaaactgcctctctttg

SEQ ID NO: 75433 - DNA, 1044 bp, Homo sapiens
gcttggattgagctagtcaccgtggttcacgcctgtaatcccaacacttcgggaggccaagatgggaggatctcttgagcccaggatttcaagaccagcttgggcaacatagtgagaccctcttctctgcaaaaactgacaaaaattagccacttgtagtggtgtacacctgtagtcccagctactcaagaggctgaggtgggaggatcacccgagcccagaagttcaaagctgcagtgagctctgatcacaccaatgcactccagcctgggtgacagagccagaccctgtctctaaaaaacaaaaaagaaaagcttgggttgaagccaggccatattcttttatatgctgttcaatgacttgattcacatgtgaccttttagtagtttgcaaacaataataacagaagttgcaattcataattcagagaaatgaccatgaagccggtgtttccctgcttgatttctatgttcttggattctcacacaaaagaggagttacctagaggggatcagtagccatccctgttgcacacaaccctcacttctgagtggtttccactaggttccacttaaggtgctgtcttttcttaacttgcaaggaattgcttagcttcccaataatcattgtcaaactgggagcaaagttggtcagctgtatctctcacctcctcctttcttcataagatagtagaatctgtggcttacttgtaggttttacttagtgcttcagtactgttggctgttttggccttttgctgaatttgcacaacaacataaagcacttctttttaatgtttaaaaaaaattccaaggctccatgaccaagtatgtgactcactaagaaacccttgctataaaaggcttttgatgaaatcttagcaaagctaaattatctctaacttagagattcctatgaactcaggtcattttcatagcctgtttattttgtaggtctaatttagttctcaggaaaattaaactcatgctatatgactgtatcgttaaaggtacttgagcgtatgttgctgtaggtggtatgaca

SEQ ID NO: 75434 - DNA, 1166 bp, Homo sapiens
aatggcctaaaactgattttttttttttccgttaaaatgtgtgtgtcaagatacggagatttcagggttaaagtatatttcagttttctttagggcaacatatatttgaatttaaaagcactttatttaaaaaaaaaagaagttttcagttctgaagaagtcatttacagtttgcatcattttaattatgagtctgacaaaaccttctccagagaatcaagcaagacctggatgtgaagaaggtttgggtaaactgcatgtaaaggctacaaatcacaatctgattcctcccaaatataaaggcatatggaacataatgtattaaccaaagtatgttataaatcaaaaatggtcaaggttcagcatattctatatgaagatcacaaggtggtatcgttttagatttctatgaaggctttcatttgtacatccctttgaaaaaatataacagatttaaaatgttttgaatttaacttgtttagaaaaactaatgcttaaaacaatatttgaactactgtatttataatttattacctctaattgctttatttcagtgtatgagacattactgttttaatgtttgctttgaacataatttaagaaccagatttattttctatagtgataaacccttttttctcagaactccatctttgtactcttcagatgaatatatagacactgtggcatacattttttttcattaaaaacttatggcttcatacaacactagttcaattttttaaataaactttttattatgttacatgtacttcagagaaagctaaagtttctctaaacttgacacggagtactccataatgggtacatttcattagctttattagaaaactagtaaatgcttttgaataggtagtatgacagctattttaaatgtataaacatttgtgtgccaaacaacatatatgaagggatgtgatgccactaactagtgcacattgtttctcaatgtgccattgagacacaaggcacagtaagtcaggattctgaggcattggaagggttttcttcagctgtaattgtttccacagtgcttttcatctgaggggctcaaagtttaagagtgcattcaataacccatgtactagcttcttgaggtaagtaaataaatcttgttctcatgttacatgttaatacaccaaggc

SEQ ID NO: 75435 - DNA, 1036 bp, Homo sapiens
agtaatttcaaaataatagagaaacccccagttttttcttccagaacagcagttagtagaggtgcatagctgtattgcatctttttattttgagagcttaacaaaatacatactatgtcattcttacacataaattctttgatagtccgaatggtaaaatagtcaacaagactcaatatgaggtaattatgagtcttacacatattcacatattacacatacttatatattatacatattacacatattcacctctagatatagatataactattaaaattggactattataataagattctgccttttaaatcctattcccaagatttgctttactaattatttggcttgcttcaataatgtaatctgtgtaatcgtcataatttctcgtcgttaagtgctgtcttggctatatcgtgcaaatcataaaacttttcttcattaaatcttctttctgaaatttggtcattgtgattaggtgattctggcttccctcctttcttccttctacttacattaattgcctcagttcttctggataacctttattctgaagctaccgactttgattcacttgctatttgagggtaaaatggggcacaggcttagaattcatgatctgtctgtttctttatgtgaagaactagtgttgtcaattgaaacctattttattttcatccagttgaagcatcttacctagctattcttcttttgaaaagtctagacttcttttctaacatataatgcaaagatctgtttcttttagcattgttttgcatctaggttaggaactaaattagctatgaatttggggactatctgggtgttaacagattatgagattatatttcaagttagttatgcttacattttccatgaaagagctccttacaaaaattaagatgtgtactactttatgtatgctagatttagtcagtttatttgggagtattgttctaacttttggccactacatcattgaaggccatttttaatcatcagccaaccctttacagcatcttgtgtttttttttca

SEQ ID NO: 75436 - DNA, 1058 bp, Homo sapiens
atagctattgttttttaattaaattccttctcggaggtttacttaacatgcagtagagtaagaacagtttactaaaatccaagcattgtgatttaacactgtgtttctttgaatttttttttttaaatcaaggcttatagattagaaccattaatactgaaacactacagcaacatttcacctgtccagatccactggtacaatacttcaaatcctttaccttatgaacatatgaagccaagctttctcaacccagctaaagaacctacctcagtttcagagaatgaaggcatttcaaccataccaagccctgtgacctcaccagttttgtcccgccgacactatggagaatctataacaaatataggcaaagcaagcatattaggtaatttctcttatgtattccttatctatgcatataagcactttcctagacataagtttgggggactagaagtattctatgtattaggaaactcccagcagttaatccctgtgtctagaattaactaccctcccaatgttcatatttgaggcccaaaaagctctaaagttctctgattagatcagatcttatagttttagaatataagatagctggatggaccagaaaaagctgttatgagaatcaagtccctcattttaatcttggtcctaccacttgctgtgagatcttgagtaaataatatagtttttaatgctctacttgctcatctgtgaaatgagaaagcacttgtgtcagagggtgctccctgtcaaccagttctctgatctattctaaaagtctctcaaactgtgtgattcctgagggcaacaaggatgtttaatttttctttgaatgatctccagtactggcacaatgtttgctgtatcactggaactcgattatgtggtatttgaatctgtccattgcctttggttacaagttgccttaatgtaaaataccacaaggtggcactataaataggctttatctcctggactcattggctgttttactttctcatgttaatacattgtttattgatggctttttcttacatgtccatttaaattca

SEQ ID NO: 75437 - DNA, 1811 bp, Homo sapiens
agatactcattttctaaaacttactgactaaaaactacaaggtacaaaaatttagaattgcatgtgggtaagttacaacaaaaaagaaatttgcgggggtctttgaaaatcttattggtatttgcatagaactttggttttttttttttttaatctatggaactgctggcttatacagttggtttaaggactacagaaggatctatgtaggtagtatctgcctatgttcttagtgatgatatggattataatagtatgtataccttacttcattcctgcaagattttgaaagacctaagttaattttaataacctaggtatatttgatcggtaatgtatgtttttctaccttaatgtatttgagtttagaataagtgtatagtagtcagtgacaagtctaatatgataatgttttcttatttcaaacagctagttaaaggccttcagcaagagctgaatcgattgtattcccttttctgttctcggaatccagactttgaagaaaaagggggtaaagtctcaatagtatcacattccttgggatgtgtaattacttatgacataatgactggctggaatccagttcggctgtatgaacagttgctgcaaaaggaagaagagttgcctgatgaacgatggatgagctatgaagaacgacatcttcttgatgaactctatataactaaacgacggtaaaatatcctcatcttttgaaaaatttttaaatgtctttatggaattactggacctcttacgagaaaactaagaatttcatgataaagaaataatgcattgttcaagatacaaagattactatatagcatgcctaatcaagctggagactgttgattttcatgctaattacatgcattttcctgtagcataaaataaattcttttgttattctccttgttttcctttcatcgtttcttcacagtttgttaggagtgaaatttaaaacttattccaagcttagtcactgcatagaatccttattgaaaatgtttaccagtttataatcctttgtagttttactgaccttttgaggtgggtttctacctttcttattattctgaaaataatttttaagtgctttttttaagcaaatatatttttttacatgttatatgtataaacataattatatgtgttatataattataagattttattatttaatcatttgtggccctcctgatactatcttttaattctttgctgcattcctatcttcatctctagttacatgccttatcttctttgttctctttatatgattaattctaatataaaaatgaaaaatcactcattttgataatttactagcatattaaaacaaatgtgctaattgactaaaatttttactagttttgtttttgtcttacagatgttaactaaggatttcatttagaatcttattaagtaccataggctagacacacaaatattatagtgtcaaaataattgacaggtttgaaataaaatgtcatgtttggcaatactcggagcagcattttagatgtataaatccagtaaaactttaaaaaaagaaaaaaaaagcatggaaaataacaaatttttttttttttttttttttttggagacggagtcttgctctgttgcccaggctggagtgcagtggcacggtctcagctcactacaacctcttgtcttccaggttcaagtgattctcctgcccctgtctccccagtagctgggattacaggcaactgctaccacgcccggctcatttttgtatttttagtagagatgagatttcaccatgttggccaggctggtcttgaactcct

SEQ ID NO: 75438 - DNA, 1062 bp, Homo sapiens
tttgtagagacgaggtttcaccgtgttagccaggatggtctcgatctcctgacctcgtgatccgcctgccttggcctcccaaagtgctgggattacaggtgtgagccactgcacctggccacttagtgaaatttttacaaatcctttgatatttttagtaaaatcagtagaagaaactgaaattaagttgctctgtcaaagctattgagggcttgaggtatatatgccttagacccagtgaagagtcagccacatcacccgggaaagcagttaattatcaaaacacatagaagctgtatattagaggttaaaattatgatagttaagtaactcaatggtttaaaaagttgccattccctgtagcaggattaatcatttataaaataaagtccctatccattacttgcttcacataactttttttatgtgaaatagtgttttattgaattaagttccatatctgagttttttagataacatattgattttaaaatctgagtgttataattcttcaaacaaataaagtttgtcttggagaccttcaaattagcttttcctttttgcaatagctgttcatagtttcaagttgagtcgaaaccatgtggactggcacagtgtggatgaagtatatctttatagtgatgcaacaacatctaaaattgcaagaacagttacccaaaaactgggattttctaaaggtaattgttaaatattactagagcttatcaaaattttgggaatctgactttctctcatattcaaaatagacaattcatattctgtttttagtatgttttaagtatattaaatttagtgacagattcctttttaaatgaaacttttattaagttgattgagttgacatgtgttcatcaaggaataattattatatatttagaatgatttgacaaaattaataaatatcttttatacttctaaaagcacaaaagctgttaaacctaaaatgtggcagttgaaatatagtgtcaaggaagatgaggactgaaagttttccattgtatttagtgatctggaggtcactggtgacttagatggattgat

SEQ ID NO: 75439 - DNA, 2502 bp, Homo sapiens
aaaaaaagaaaattaaatagtgctttctggcacttgaattttctttaacagtgatctttgtttggatcgatagtaaactctttttttcctctactgtacttatcatagtacccctaattctgtgctttgggttgaaaaagttaagctctgtatgctacaggatgtgtaataaataaagcaaatgactttcaagtgaaaataagaattacatttgaaaagaaagaaccatgtctgtttaattttgtgaaaatgttttaaatatgtttctctggaggatgaaaaaaatttttttctttgtttctctgtgtataggggtgtttgtctttttattaatccttaaattatactattcttttagaaaagaaagccttcatttgtgtatcttggctagctttccgaaagcgtttacataattttaaaacatggtcaaatggtccatacatttcccatttcgttctcgtttaatatttaataatatggaattggttcacgttagttttactaccagatctacaaaatctagtttttgtttcaagcagtaaagtctcaagtttgtgtcagtttgatttactttgatatattagcatctttttcctaatgaattttttgtttaaaactgtttcctggtctaagtggtacatctgctcctcagtaactgaccagaaggcacatgaaagaagaaacattttcagtgaagaaaattgcatcagttgtcattttttacctctctgtgacaaggaaatgttgttataatcctgacgtagcacagcttttagttccagtttatagttttgtagccatctaattacatatagatatagttattgtgtcttgtaagcatttctcaattacttttattacacaaatctttgcatatactacatctgcatattcaacagatttgttacatttctagtattataaaacaggaattaaatatttttgtatttgagcagtatttaacctttgaatgtcacattaatatagaagggagtgaggatgaaaatcaaatgtatttgaacatgaatttgagctaatcataaagatcctgtaatttattaactggtgagaaactaatttgtaaggttcaagttcaagtgaacttttaaataattgcttacttaaaatataaagaaatttatataactaccaaaatttgacagggaaaatgttgactttaaggttatctactgatttgccaaatatcaagtctgtgcctagctttactctatgttgtctgtttagtgcttacaagttgtcacagcatacatttttactaatgacttttttcattattttattacagtcttttcaaaagcaaagttaaaagcagagcttccagtttgatttttgttttttagtaaaagttttgttttttaaagtcttttaagaacttgaatggagttgagaaaagaatttttttttttccctaagggaaggttccattatacttcagcagtggaaagcatctagtagaatgtatgctgtggtatcttctcaggaaggttgcattagatatgtaaaatgttatttattgcattttcaatttgtacatcagctgttggctgtgtcagtcacaaatttggtgagagtaaataaccttagtgttgtaaagatggagtttataaatctcttggcatttgaaaatgttatgttcttttttaaaaattctttctatgcaaagacattaaacatgataatcagttgtttttaataaatttagatattatttgccttttttctttcagtaacagcagctatttgataaacattatactaatgttttgctttactgattcttagaaatcatataaatgaagcatttagaataatgtttttcaaatacaactcattttttaaagttaatactagaacaaaaaggcaaaatggcaaatctcatttaaaatttactttgaagctcagtgtttttgctttcttagttgtctaccacctccctcccttctccctcccttctctgttcaaatggagaagatataaggagagtacagatgcgacaggtcttaaacgaaagcattcccaaggtacagtaattgtagttttatttctccatgtagttatattcctggcttatagtattcagttgcatttaaagcatagaaattattagttttttttaaatgtgtccattgtattagtttgtttactgctactttattatgtgtataaatattggtaaacagtgtgtatagtccagtaacaggatattcagatgttccccaacattaaaatggtttaagatgatatatggatgatttaaagaggaaaataatttttctggcttaacactcatctctaaatatcttgatctcatagtttaacgttttaagcatctgttgctcacaactattttaacaaaaatgtggtttagaaacatataagagcttgaagtagtggcatggatcagatatgtaattagaaaagtgattgttaaacccttgcaaaagattttttttagtttatgaaaagctcttttatttaaaa

SEQ ID NO: 75440 - DNA, 1982 bp, Homo sapiens
acactccatattttttctctctgccactctttgctctctcttacctctctgaacatatgtatacatttgtcacaagcaaggaaactgtgtagtttagcttatatcaaattaaaatatcatttgcatctagttgattaaaagtctatataactgaggaaacttgtgacttctgaataaattagcaattaaagctaacaaatttatataataatagttgtcttttatgtgccagataccatactctggaaattctaaatatattttcctaatcggtagaatcaaatatgtccttatttcactgtaaaatttaaactaaaggttcttacatatcaataaataaggagcagcccagtgtaagagctctaggtatgtttctacagattgccatgtaatactttgttctccttatagtaaaaatagcaagttttatatatctgtgatcttatggtagtgactgaaatatttcataacttctcatcactattggtcagaataatttcaaaagtctacttcatagtatttgaaggatagaccttttatcataaaataatcttattgccattggagaagtctgagttccagatttttttttccttctgttaattcccctaagtattctgcctcaaaaatgtcagttcaccatcacaaacccagtttagccacctgaatttcttattattaacacatgaaaaaaatccaggagcttggaggagaaagaggatgagtatgaaaaatacaagtagatggttcccctttctcattctgtgttcagaactttttttttttccatttgctaagtcaccctgtggagattaataatcagctctgtttcttctctagattctgcctgtttctaatcttgtttttactacaataaaaattagaatttaatatgtactttttacttctgcttcctgcctaaatgctaaatgtagcaagatacttcagtttttctcaaagtgtttgaatttaaataagactgatgtaagaagatggtttatttgtgtgagtacattttttagaatgtctttgcgtatgtgtatgtgtgagtgtatatatcagttctagggtagcaatctctaggatatcgtaatattttttgttatctttatggatatacatggagtagtaaaattttaattagtaatggaaaattattaaattattagaacacttttgcattgtaatctttcaaaaatgatgattctttgaggttcattagaagaaaatttgtttttataatgtactgtggcatataagattcagcatgttctgttattagcaaagatgtgttcaactgaacatatctttgtcataatttttggtcactttatttttattcaatattaaacatatatttatatcttgttacatttggctttgaaaattatgggaaattgtgtagtacatttgaaaataataacaagtcttaaggaaagaacatttgctatccaaaaagctaccattgtcgggaaaatcattcaaatttgtaactacaaagactaaaaaatattataatctttttaatttactgttagctctaagcttctgaaattttatacttcattagtttgagggaggaaaataccctttccacctaaattttctcatgtataaagccttgactattcatattgtcagattttgaatgatgccatgtatagtaatgtggtaggcacttttgtgaaagaaatcgacaaggtttctaccctcaaggagttttaagcctgttagagtagacaaagccaacagatgaaaacagttacaaaagagtaagtacaagaagacatagtagtagacagtcaatattacatattctgaaaagatatttggaataaagtgagtagataatcacaatgcagtggaattattcacataaggctttctggaaaaacctcatttaataatttaaaacattttaaaatactatattcagggatgtttattaaatgctctagggaatatcaaagaaactaatagtt

SEQ ID NO: 75441 - DNA, 1059 bp, Homo sapiens
tacctttattttatttaataatggctccaaagcgcaagagtggtgatgctagcacattgttataattgttggattttattattagttgttgttaatctcttattgtgcctaatttataaagtaagctttatcataaatatgtatatattgcaaaaacattataaggttcaatactatttaaggcttcaggcatccagtgggggtcttggaatgtatcccccacagataaggggggactactgtatattaattacaaggtgcccgtggagaatagattcaaataaaaatctaataagagccattgataaaaggaaggaaaacaaccaagagaatgtaaaaagtagtttaaattcaatacaggcaaaagaagacctaacatacttaaaattggagtccctaaagaagaaaagcaaatcactagaacagaactaattaaaccataactcaacacttttcagaaataataggaaatttcaaattttacatattaaaaggccccatcatggacagattaatacagaacagctctgagtcatagcctagtaaaactattagattttaaagacttttttcctgggcctcttgagaggggaaaaaagattatattattaataaaatcaggctgacatcagattccttaagaacaatatatttttttttggtctcactctgtcacccaggctggagtgcaggggcatgatcttggctcactgcaacctccgcctcccaggttcaagtaattctcatgcctcagcctcctgtagctgggattataggcatgcaccaccatgcccagctaatttttatatttttagtagagctggggttttgctgtgttggctaggctggtcttgaactcctggcctcaagtgatccacctggctcggcctctcagaatgctgggattacaggcatgagtcactgcacctggcctagaacaatattcaaaggaaggctacagtagagcaccatttttaaaaactcaaagaaataaagcacaagctagccaacctgtctttagagtatcagataaacagtttgaacacacaagaatttagg

SEQ ID NO: 75442 - DNA, 1014 bp, Homo sapiens
ggtgcacccctatattcctggctactctggaggctgaggcaggagaattgcttgaacctgggaggtggaggttgcagtaagctgagatcacgccactgcactccagcctggatgacagagtgagactgtgtctcaaaaaacaaaaaaaaagtgaaagtcacgtttaaattattacatatttctttaccaagtgactgtaacatatcttttttttatattcaggcactcttcatgattttcagtatcatgaatagcatgcagccagttttgttaaagtcaagcagggcttagtgataggtgtgaagaacgtctaccattgtcttgcaataataaagaatgtgtaggctccacaaattatactggtatagatgatagatgctgtaaagactattccacatgttacttacacaaataggagtagaaaatagtcaataaggacatagatgtttttaagcagattataagtatatttttaagcagattgataagtaagttatattagtaatgtagaataagagatataggtgttgaatatcataggcatggagagcatgcaaaaaacttagtcaccatagaaaatggttttatttatggtaatttgagaaaagacctgtttgaaaaggctttgatatagcaattaattttacctagctcaattcatgtcacattaaactgtgtaactttttttttttttttgagatggagtctcgctctgttgccaggctagagtgcagtggcacgatctcagctcactgcaacctctgccttctgggttcaagcgattcttctgcctcagcctcccaagtagttgggactacaggagtgtgccaccatgcccagctaatttttgtatttttagtagagacacggggtttcaccatgttggccaggatgttctcgatctcttgacctcatgatccgcccacttcggcctctcagagtgctgggattacaggtgtgagccaccacgccaggccctgtgtaacttgttatattcatctaagactgatacag

SEQ ID NO: 75443 - DNA, 1064 bp, Homo sapiens
gccaaggcaggcagatcacgaggtcaggagttcgagaccagcctggtcaacatggtgaaaccctgtctctactaaagatacaaaaaattagccgggcatggtagtgggtacctgtaatcccagctactcgggagactgaggcaggagaatcatatgaacccaggaggcggaggttgcaatgagccaagatcacaccatggccctccagcctgggtgacagggcgagattccatctcaaaaaaaaaaaaaaaaatccatcttttaatttaattcctcaggtgattctgactataggccaggtttagaaaccacaggtttaaatcatggaaaatatgtagagtagaaagagaaaatagaaaagtttgaatgacactgtgctgatattaaaagtttcaactatgttaatacatattcttttgattttaataatctgatagaatggctataatcagtgtggaattgattgtatctactaagctaaaatcaacactgaaaattcagacaactgttttacggttgtatactccattttatttagcaaggtttttcttccatatctatgcaggttatatcaaatattttttttcttagctaagtacctagagagaaatttttccctaagcatataaaattctgcattgcctagatccaccaaaatattaaacttggaagagttgatataaaatggcctgtgatttaaagtctcttctccaaattgagatgcaaagaattgagaatatataaaagctacctccatgaattaaaatttgcaaaaaggctaagagtcttatgttggagtccttgccctgatacctcagattgtgacagtatttgaagataagacctataaaagaggtgataaagttaaattgagacatttagggtaggtcctaaacttccctaatccagtctgactggtgtcttcacaagaggagggaatttgggcacacagagacacgagagacacacccacacacccacacacgcagaggaaaggccataagaagacacagcaagaagatgaccatctgcaagccaaggagagaggccttagatcaaaccag

SEQ ID NO: 75444 - DNA, 1530 bp, Homo sapiens
aaccattagatctcgtgagaactcactgtcagaatagcatggggcaaccacccgcgtgttctgttcacctcccatgaggttcctcccccaacacgtgaagattacaatttgaattacagttcaagatgagattttgggtggggacatggccaaaccatgtcattccacctttcttattctgtcttggttcatacaactatacaactcaatgtaaaaacagactcttaaggatctattttcacataaaaagacctaccttttactaataacaccaggaagtaaatcagagcattgagttagcttgccagtcattgtgtgtctgtagcgatcttaccttcaggtcttagtatgtatttgttttttgattctctgggcttccttctccagctgtcatggcataaggtttttattttagaagacttggtggggaaaatggtgtttagttctaccaaatggctgaggattcttcacggttagtcttgatgtagctgtgtgtaactactgcatgtggatttagaaacttcaaacaatattccacaaattaaaataatgccataatttggcatgagattttgtagtttacaaagtactttcacatacattattttattaatccccattgtaaccctgcagtgagacaatatcttcatgttatagatgataagctgaggctcagagaggttaaggggtgaactggaattttaggctaggcctcctgagtccttaacccagttctttttctactgttgtacagtctgcaacttcactgtttacacgatttgagcagataatgaagcttaggttgccaataatacttaatatcctggattattttgtaacctgtgtaaaatttcctcactcaactttattgctatgtattcctcctgtttgatgattttctaaataaatttctcaattgtctggtaactttagtttcttaagtgtttcttctgcttttttaaaaaaacatatgttcaagcgtttacatctgtgcttgttagcattatgaattttgactacacaaatctttttctcctttttctctgttcttttttaaaaaattttagtttctcttttgatttcaacccgttagagcttaaattctcacgtgattgttttatttatagctagttaatcctcctgactagtaactattttgacagtctgacatttgtttgccatcttctaaacgctgtgcttctcttttgtaacgtgaattgttttctttcaatacattttttcaaaactttaatttcattaattcaacaaatagttaatatttactaggtaaaaaaaaagatgggaatgaccacttctacgtcaagtaaaaagctttccagagaaattgatgcttgatatgagtcttaaagaaagatgttacatcagccgggtgggtggctcatgcctataatcccagcactttgggaggccaaggtggatggattgcttgagcccaggagttcaagagcatcctggataacatgatgaaaccccatctctactaaaaatacaaaaaattagctggggatg

SEQ ID NO: 75445 - DNA, 2795 bp, Homo sapiens
aagcattaagtcatagcctgttcctcttccttatttgaaggtgtttttacttttctcagcattccacaagttacttcctccttcctttgttgtcctctgcctttgcttcttttaaaaagttctaagtcgctagccaatcaggacagatacagaatatgaggtcccgttccagccagtagaaaccagacacagtagtaaggtggacgcgtcagattataaatgaccctgtctcctttgtttggtgcactctcatggcagaactgctggcaagtgtaccctttctgcagaaagtaaaaatggccttgctgaggaaattaaatttgtgttcaagagctatttctttactgcaccgaggaacaagcatttctaacaaacatggtttacagcatttgttttcaaatcaccactcaccttaccacagctcatcagtttcatctctgccacctccatttcaattcttactggtttttctagggaggcaacattgtttagtgtttcaagaatgttaaggaccactggatccagacttggctcaaatcccagctctgctgtacactgtgcccctgagcaactgaaattccctgtgtcttagtttcttcttctataaaacgtggataatactatctacctcttgtgattgtttttaatagttaaaatatttaaagatcttaaaaatatcccatgatgaatagtaagttctataaaactgttagctatgattgtttctccatcttcctgcctattcttccaaatttccaacccgcttgacattcttggctctcctgtttcaatttgtagtctgtttcctcacttggcatattcttggcctgccatcttgataatcaactctcaaatgggcacagccctagatcctctgtaactgttgcctgcctttatgagaagctgtgatttttgtctggtttctcaggccccagaaagattggtgctgtcttgagttctcctggcttggacctgggagaagttcaccagtcattcttttacaaatctattgcctatgggagaggaggaattttttcccataaaagcattctaaattcttgagcatctgcttttgttggtatgcagatcctgtcaccaaatgtgagagataccaactttatccccagagctcatttagacgactctcccagctaccaggatttttgataaaatagagaactttacagttttctaaaagactgctcagttttcagttaaggcaaagccagtaatgttcctgttttttttttttttttgccatgccggcaagaaaaaaatggcccacaattcttcttatgatggagaccttagcatgaaaactatgagagaatcctcttaattgatctgcagttaaaccagcagtagtggggatggcagctaggttctggcacttagtgtaaaatctaacagtataaaataatcttgaatctctccttagtcaatggacgtgacagccattccttatccagcattggcaataaaaaccatgtgggaacagatacacagatctttgttgtcaaattcccttagtttgaatccttgatttaccatagttatatgcctttgggcaagttataatctctgtggcctaatttatttctcctttgtaaatggggatcattcctgcttccaagagttatcatcaggtgattattattatttagatttaattgaagtacatatatgcagaatgcttagcacagtacctaggtcaataagtgttagctaagccaggctggtatatttgctctttaaatagaagcctatcttctgggaattaaaaaaaaatacgtggtaaacctgttgtatttggggttggggggaagggtggaaagctttgactctatcaaaattacttcagcctatacttgataaccatatatacacgtacatacacacatgtactatatatattttcatgtactcgtcttaaaactacttaatcactccaagagttctgggagtcacagtgaagtttcacacttcaccttaattccttctttgaactctgagtttgaagaaaatgtagaactttctagctaagatgaagacaacggaatactcttcagcttctgattgcctctgttggattctgtagtctgcagaatggcaacctgtgttgttaatttctaacacttttgtgtgaccagtagtttgcagatttaattgagtgtaacagttactgggaagattgttaaaatacagattctcagatcttatccctggagatttggtacaagagatctgagctaggtccagacaatcttcctctttaatagaagaaattctgtttacaaggggttcgaagaccttactttggtaattctgttagttcataaaccccctagtctaaatggccagaagctgcctcatcttcactcgttttcacttacactctgagaattaccagttcagtcaatccaaggatgcatttcaagagattctaggggagttaaccttcttctggcaaattggtagttttatttaatctcttttgttctttctacctatgtattgccactctgtccttctaatttaaaacttctgtatcttattgatctgtattattttgtcagtgaggagaaggataaagtctccactataattgtggatatagttagcctggataaagttatattggtttttgcttcatgtattttgaagctctgtttttagatgtgtatacatttaggattattacatccttcgatgaaatactgcctttatcactttgaaatatccccctttatctctggtaatgtttcttttgttgaagtctactttatttgatacta

SEQ ID NO: 75446 - DNA, 1020 bp, Homo sapiens
tcacccaccttggcctcccaaagtgctgggattacaggtgtaagccaccgcgcccggcctttttgtttgttttgagatggagtttcactcttatttgcccaggctgaagtgcaatggcgtgatctcagctcactgcaacctctgcctcccaggttcaagtgattctcctgcctcagcctcccaagtagctgagattgcaggcatgcgccacaatgcctggctaattgtgtattttcagtagagacagggtttcactatgttggtcaggctggtcttgaactcctgacctgaagtgatctgcctgcctcggcctcccaaagtgctgggattacaggcatgagccaccataccctgcccattaatgtttattttaatgtcttactacattaagctatctctagataatatttataatcattgctctgtatgtttaaataaactcttcaatgactgctgggggtcaggtcaccctttggaaatgacattgttattggtacttctgtattccaagacctcagatactggaaaatccttgagaaatacaaattccatctgaatggatggcttttccaaataatggagagttaagcttttatgtgctagaatgtaatattaactatatgaatggaaatctctctgatattactaattgtctctggctccttctcagtggactatctttctgaacattgatgcaggatatcctttgagaaacatgatatgggacaaataactagttgtactatgttaaaacttttttttttttttttttttttttgagacaaggttttgttctgtcgcttaggccagaataatgtggagtgatcatagttcactgcagccttgacctcccaggctcaggcaatcctcccacctcagccttcaaagaagctaggtccataggtgcacgtcaccatgcccagctaatttttaaaattattacttgtagagacatggtcttcctatgttgcccagggtggtctcaaactcctgggctcaagcagccctcctgcctcagcc

SEQ ID NO: 75447 - DNA, 1040 bp, Homo sapiens
gcgtggcattttaaggaagtgaggtctacacctgcaggcactgtgacacatgaggtgggtttgggctttgaccaaccacagagaccaaagtatgtgagggatggtgtttggtcagggacaggatggagattgtgaagggagcacctgcacatgaatggcgcatttgggacaatagctggaaaagagacagggtagatatgcagtgctaaggagtttggcctttatcctgcgagtaatgaggaaccaaacagtagaaggttctttatacttacatgtgattaatgacaatgcaaaagttgagctggagagttggaagcagaatatcagtagaatgctagtgtcataaatcaggtgaaaactggtgggagcctacagaagttaacctaaaggtaatgtggacttccctttctccaaccttctttcctaaagcaaatagccattaggccaattatagcttataactagcataagagcaacacctatttttatctatattttagcattttctaaatagttctctacaagatacaatcctgtggatgtccaagcccttgtataagctataataaaaacacagtagtgctttttgtctatcctgtaatttgccatttctcacaaaatctcatataactttaattggtttcttaagtctctgtgtgtaagttttcacactttctaggagggtccagtccccgtatgggttcttcagcctttcttcaaatagaaaaactcatactatacgttgcagcttttgaccttgcccccattttacttttcctttttagctgttttggaaactgtctggttagtggtaataaaagtgtttgaaaaaaaatgtccagtaagttcctatgtagaatggtggtatgaatccattggccatttagatttttgtggcctaatttagcccactgcatctgggtgtcaaggccaacaagttagctatacctattctaaaagaaagattttattttattcttccttttgaacttgactagcagataaaatttgaactaatttggggtacatgaatcagaaag

SEQ ID NO: 75448 - DNA, 1929 bp, Homo sapiens
ctggaaccgtgagtagcgggccggggttagggcaggacgggctgcccctgcatgggccgatgcgcaccggtgtgggtttgggactggtcgccgcgaagagggaggcgcgtgaggcctggcgtttggctggggcaggatggagattgagcagggagcgtcggcagctgaagggtaaacgagcagatggcaaaacccaagctgcctggggtcaggaggactggataccttcgggggtagcgcctcctgggtgagccgggtgctgctgccatcccctggaagtgatccaggaccggatccgcagcccgaggtttaatttcgtgatcctaccagctttgtccacctggggatctggttctgtctcatttaccctaaacagcctatgatttaaatagcggcacgtcttctggagtaggaaggtttgagaggatctgctcgagaatcaacagcttagttatgggttcaggaaaagtaaaagaatccctggagggaaaggagataggttgttcccactgggtgtgttcggagaggtggaaagcactgcgtgaagcagctctggcaagtggctccgctccctcggtggaatactggattctgtctcttaggtcctcatttacatatttttgtgtttgcatcttaaccttgaaaaattaccatttctatgcctcgtcttcctcatttgtaaaaggggagaaattgtacctacctcacgggattgttgtgaaagtaaattagaaaatatacttcaagggcttggaactatggttggtacttacgtgtgatatgagtgttaacagtatttattagacaacaacacagacgggtttatagttagaataggaggaaggtgaccgtaaatatctgccagtgcatgcagcaaatattacgtatgtaatatataggagatattcaatagtcacagaagttactgaccaccagtattataatatgtaatatacacttttaattttcgtgggcccaatgccctaacttagatgtcttcattgattgtgacaacctttagatcctccatacaacactctgccctctattagatggattgatgacagcttcctttctgtatgttaggaccttaccatcggcagagcccgtcacctttatctttgtactctgatagggcctagtgcaatatatattcaataactaggtattgaattgcatcagtgattctgataatgttaaaacattcatatgttaagcatgacttactaagatagcaattccaacatgtgtcaaatcaccaaataaaataatagcaggaaatttaatttcttactgcacattaagatgatactaaaggcattcattaccatttttataaggtcagatttagtgagatctgttacatcattcacttttttagattatatactcactaaaggcagggtatgtttatattcattcagttctttcatattcagaatatttatatgtgcataacggtactcttgtgaaggcattaagaaagatggggaaaaggaaaatccttaccctttcagagcttcccactcggtgtttccttcaaatgacttaaacataatcatagattttttttcctgaagatagaagtaccaagacttagtggagtcagaaagttggataaaaatacagggtatccttggagaggggacggaaaccaagagatgaatcttacccttagattaaactgaagtatattcaccaagaatactgtgtgctctcttggtttttgataaaattgttaatgcctgcgtggtacttcactgtttacaaagtgatttttgacattgattattttacagtgatagcaaattaataccaacattatatacatgaagaaatgggctcagcgaaattaatgaacttgtccaaggccacttagctagaaagtgatgaagcagttcattcattagtctagtgggggaatacagt

SEQ ID NO: 75449 - DNA, 1061 bp, Homo sapiens
ttaagtgcctctcggtggtgaggctttgggcgggtgagactttcccgacctcgctcccggccccacttaagccgggttcgagctgggagacgcagtcccttcagtgcgccccaaatcctctggcttcaggtggcccggcgcgggggcccagcacgacgcaccgcgccgagaaccgggttctccgtgcgctgcgccagtagccctgggagcgcggcggccgcggggcaccggccgagggctctgccgagcgccgccgggagctcctcccggaccgctgaggctcgggcggcgggcgcggaggttggcctcgcctggaggggcgggcccgcgaggggcggggggctgtggaggaggggagggcgcgcaagccctttcgccgcctgccgcgggaggggcctcggcgctcacgtgactccgaggggctggaagaaaaacagagcctgtctgcggtggagtctcattatattcaaatattccttttaggagccattccgtagtgccatcccgagcaacgcactgctgcagcttccctgagcctttccagcaagtttgttcaagattggctgtcaagaatcatggactgttattatatgccttgttttctgtcagtgagtagacacctcttccttccccctccccggaattcactctgccctcaccacccctgctcgccggctgtcccttccgtcggacctcctttacaatatccacactctgctccctggcagcactgtcgctcccttcttggcccggcagccggggcgctggaagcgtacgggttccttttaaagtgctgctagcgcgcactcgccctctcagcgttgcaagaaaggggagcgcgagggagctaaagagatgaaagcccggggttgtaccttgagggctaaccactcccttcccctatccaacttgtctgggagagcccccagtgtctccgtggcgcgttcccactctcttgtcaaaactcacagaggtctctccggaatcgtctctcaccccttccctggggatgagcgggcacgatcaggcacttttggctgaatatttcaaactcatcggcc

SEQ ID NO: 75450 - DNA, 1047 bp, Homo sapiens
caccccgagttacattcctttcccccaataaaaagctctggggatgaaagttcttttggcttttatcttttcgatttaaaaatttgagaagaaaaatgtgactagagatgaatcctggtgaatccgaaattgaaacacaactcccccttccccttcctatcctctcggttttagaaccgcgctctcccgccccaggagattccttggggccgagggttttccggggaacccgggcgcccgccccttctactgtccctttgccccgcgggcacagcttgcctccgtctgctttctctacttctggacctctcctcgccgggctttttaaagggcttctgcgtctcaaaacaaaacaaaaaaaccctttgctcttcccaaccctttcgcagcccgccccagcggtggcgcgggaccagcaaaggcgaaagccgcgcggctcttgccgggcgcggacggtcgcgcaggggcgcccgcggcctccgcacccggacctgaggtgttggtcgactccgggcatccacggtcgggagggagggctgagctgttcgatcctttacttttcttcctcaaagtctacctgccaatgcccctaagaagaaaaccaagtatgtgcgtggagagtggggcggcaggcaacccgagttcttgagctccggagcgacccaaagcagcaactgggaacagcctcaggaaagggaggtcgggtggagtgggctttggggcaggagtcatggggcccgggccccggggacgacctggcgctcccggccctgctgaacgctgagttgcgcctagtcgggttttcgaagaggcccttgcgcagagcgacccacgcgcgcggcagcatcttcgattagtcaggacatcccagtaactgcttgaactgtaggtaggtaaaattcttgaaggagtatttgctgcgtgcgactctgctgctggtgcaacggaggaagggggtgggggaaggaagtggcgggggaaggagtgtggtggtggtttaaaaaataagggaagccgaggcgagagagacgcagacgcagaggtcga

SEQ ID NO: 75451 - DNA, 1405 bp, Homo sapiens
acaaaagtggatgcctttgttttcctctggggatctttcagtatatcctggaaaatgtagttttctcaaaccatttttattcaggaaatttggaaaatttttttttttttttttttttgagacagagtcttgctctttcacccaggctggagtgcaatggcgtgatctcagctcaccgcaacctctgcctcctgggttcaagtgattctcctgcctcagccttgtgagtagctgggattacaggcatgcaccaccatgcccggttaattttgtattttttttagcagagatgtggtttctccatgttggtcaggctggtcttgaactcctaacctcaggtgatccccccacttcggcctcccaaagttctgggattacaggcatgggctaccgcgcctggctggaaaataattttttaaaatcataaatatcaccgactttcagcagggctgcggctaccatgttctctcatgcgggcatcactgggctgttggcctggaccttgcagccacaatggattcaagttcgaaatacagcaacttcgaaagatgttaccaagcgactaaagtccatcaaaaacatccagaaaattaccaagtctatgcaaatggtagcagcagcaaaatacgcccaagctgagagagagctgaaaccagcttgaatatatggattgggatctttggctctggagaaaaagctggtatcaaggtgcctgaagacaacaagaaacacctccttattggtgtgtcctcagatcgaggactgtgtggcgctattcattcctccattgctaaacagatgaaaagcgaggttgctacactaacagcagctgggaaagaagttatgcttgttggaattggtgacaaaatcaggggcgtactttacaggatgcattctgaccagtttctggtggcattaaaagaagtgagaagaaatccccctgcttttggaaatgtgtcagtcattgcccttgaattactaaattctggatatgaatttgatgaaggctccatcatctttaatcagttcaagtctgtcatctcgtataagactgaagaaaagcccatctttttccttaataccattgcaagtgccgagagcatgagtatctactataatattgatgctgaggtgctgcaaaattaccaggaatacagtctggccaacagcatctactactctctgaaggagtccaccactagtgagcagagtgccaggatgacagccatggacaacaccagcaagaatgcctctgagatgattgacaaattgacattgacattcaactgtacccgccaagctgtcatcacaaaagagttgactgaaattatctttggtgctgtagctctggattaatgaaaatcaagttccatcctcagacaaggggtaaagaaggaaaattcag

SEQ ID NO: 75452 - DNA, 1032 bp, Homo sapiens
aatagacaaacttctgtttccagaccatatgttcattttgtattaaaatggaaccaagcaaaatataagtttgctaagactcaaaggattacttaaggccctaaacatggtgttccctggaaagcttgggtgggagtgggaggtattttcagcattgttctggaggattctggcaaaacatcatttacaagtcttaacacctgcattcttattttttaacattttttgatgttcttcctgtggaggtgttataatagagtaacttccaaatagtttccatgggtaactatttatgaataccaaagttaattactatatgttaatttaaaaaatgttttaatgtactaagaaaaacaaaaaagagttcgtgaaatgccacactggagtagtagttatttttttagtgttggatgatatcaaaattgaaagcttttgtgtttcaaagaatactatcaaaatgacaagactacccatagaatgggaaaaaatatttgcaatctatatatttgataagggatttgtatccagaatataaaaagaactcttacaactcagtaataaagataggccgggcgtcgtggctcatgcctgtaatctcagcactttgggaggccaaggcagaaagatcacctgagtttaggagtttgagaacagcatgagcaacatggtgaaaccccatctctacaagaaatacaaaaattagccaggcatagtggtgcatgcctgtagtcccagctccttgtgggactgaggctggaggactgcctgggcccaggaggtcaaggcaccagtgaaccgagtttacaccactgcactccagcctagatgacaaagtgagatcgtctctctcaaaagaaaaaataataataataaacaaacaacataactgaaaaatgggcaaagtatccgaataaacctttctacatgcaagatacacatatagtcagtaagcacatgagaagatgctcaacatcatcagtcatcaggaaatgcaaatcagaaccacagtggataccacttgacaccaattag

SEQ ID NO: 75453 - DNA, 1026 bp, Homo sapiens
tccaaccctgggaagatgggctctcaagtctagggagctgcctaacagccaggattctttggtgcccactcctctgatgagcggattctaatgctgagagggcacgcttctgaaaagaaggcacattagctttacagatctacaaaatgaagtgacatctgcagaatcttttcagtaacatgattaatgcaatatccttggcattgctagtgcagtgttttgaagtgttaggggaatgtacatgtggaagatgtccccagttatctactgcaaaggataattagcactgctttccattttttgtattatagtcattcatctgtctttattaaatgttttggtgatataacaagatcttccatagattttttttggccaagaatctacccaagaacgtaccaagtttgtattaacaataaccatctcattgtcctaggtgagaggatccattcccaaaacggactggggcaaaaactgagaagtaggtagatcctggaaaagtaaaccaggaagttcaaattttcattatcttgtttgaaatcctgtgtgcttttttagactacctggattatatttacttgtaaatttttaaaaactaaaagcataagcaagtggtatttgaataacagagtgctttggattttcatttcactgcccttttggattttcatatgtaaccttttggttacacatgaatctgtatttgtaacaacgaccccaaccacaaccaagcaagcaccgcccacctcctcaccttgatggtctgtattgccccggatcctcttaggtctcgcaggctgtctatggcttgctctggtgatattgtgtcagacaggtatagtaggagacaagcagctactaatggaacatgacagaaaaataatatgttattaaataactagtgacagggtacagcattttatatttaataagacttctgttgatacagaagactggtgtaattgttccaaatgaattaaaagactgagacttttagtgtgtgtttttgacagttaaattatgatc

SEQ ID NO: 75454 - DNA, 1580 bp, Homo sapiens
cctaaaagttgctattgcttagatcctttctgtaatgggaaagatccttgattgatcattcctttctatacaatggggatacacatggtacctgccttctaggactccttgaaggattaagcaaggtaatgtatataagagacctaacagggcctggcgtgaagtgagccctccagagatactcattctattattagacacaactccagagtgtgtgatgtttggatggcttctctaagctctgatccgccattaagctttcagctgtgccgttctacttgctaaaattggaagggaataggggacaactacagcatatgcactgagccaagtcatatgttaggcaaaagtccataaatgcaaattaaaatcactgtgaacttgtcattagtcttgtcattttctgtgatactagtttgctatataaagcatactctctcatgctctgagtttttttttaataattagtaatgttcaaattaacatcttttttcttcttttcagcatgatctatgttttggtgagctcttagaacaacacacagaagaattggtccagttaagtgcatgcaaaaagccaccaaatgaagggattctatccagcaagatcctgtccaagagtagcctgtggaatctgatcagttactttaaaaaatgactccttattttttaaatgtttccacatttttgcttgtggaaagactgttttcatatgttatactcagataaagattttaaatggtattacgtataaattaatataaaatgattacctctggtgttgacaggtttgaacttgcacttcttaaggaacagccataatcctctgaatgatgcattaattactgactgtcctagtacattggaagcttttgtttataggaacttgtagggctcattttggtttcattgaaacagtatctaattataaattagctgtagatatcaggtgcttctgatgaagtgaaaatgtatatctgactagtgggaaacttcatgggtttcctcatctgtcatgtcgatgattatatatggatacatttacaaaaataaaaagcgggaattttcccttcgcttgaatattatccctgtatattgcatgaatgagagatttcccatatttccatcagagtaataaatatacttgctttaattcttaagcataagtaaacatgatataaaaatatatgctgaattacttgtgaagaatgcatttaaagctattttaaatgtgtttttatttgtaagacattacttattaagaaattggttattatgcttactgttctaatctggtggtaaaggtattcttaagaatttgcaggtactacagattttcaaaactgaatgagagaaaattgtataaccatcctgctgttcctttagtgcaatacaataaaactctgaaattaagactcactttcagtgcattgtttgagattaaaaatagtatttcttaaacttgcttaatccatgataaagacatgttgctgtcatttttaaaaagtgacgtactacattatgggttttctgaaaaataccatgcctagatctaaaaaggaaaatttttaaatgccgagc

SEQ ID NO: 75455 - DNA, 1086 bp, Homo sapiens
ggtaagaccctgtctcaaaacaacaacaacaaaaaaacaaaacaaaaaaccaaaaaaaaccagtactcagaatgagaaagagaaggagaaagcaaatatagtaaaaatggacatttggaatatctgggtgaaaggttcttgtatcttttctgtaagtctaaaattatgccaagataagtaaaaacaaaacacctattttctttttacagttcttcctatttttcatggatttctgaaaaggcagagactagaagaaacttgtttagctatctcattctgctcatttaggggctctacttttaaaattaagatggtaaaaggaaagcattttacccataagtaaaagaatgcttccctttatggaccacctctcgtaacagatgttttagaagaaagacctgctttcttatctgaacatttactgccctttctgaatgcctaatagactgtgtttattccaggtatatgagtagaccagtgatgagtggcccaggactctatgaccctacaaccatcatgaatgcagatattctagcatattgtcagaaggaaggatggtgcaaattagctttttatcttctagcatttttttactacctatatgggtaagttgaaaaggtaaaatgaaatatgctttcactttgctgctttaaaagtttgcaggcattatggttttcacacctcaaaatccatttgaagaataacttagtgtcttaagtgtgcatggtgcacaccagcaaattcgcacacattcagtgtggcccacactggtgcttgtcaaggcagtaaaccagcctgccatcagaggcagaaggtttggtcagggatgctgcttcataagttttcagacacattcagtcagtaaaggatggtcctcattctccatggcaaagtgatgtcattgaaggatagggatgtgtgagtttgcagaaatttctgcttgtcttcagggtctctccagacattatgtttcattttttccttatcattcttcataagtggtgtgctctgccctttattttctgatttgcttgatttgagtggtatgaatgaaagaagtagttctaccttacagggtggtgcagt

SEQ ID NO: 75456 - DNA, 2008 bp, Homo sapiens
ttttctttctttgtcacctgaaatgatgccacaaagtggtgcagagtccctattttgactcttaatgtacattctagtgacccttgaggttgaagccacattcctccagagtgtggacaaaagcatccttacaaatgtatgtgtttgggcaccaatgggaacacattgaagagttcgaatccatctctagtgtcccactgagcactgtgccaagggaggaggagcatgcacagataaataaaaatggtccttctccctgagagtgtagaggggcagacagacctgtgtgtaaataccacactccagggtgagaaaagccatatcgatggcattatagagtcccatgctgtgtggagatgtgggcaattacttctgcccaaaggagttaggaaagcctgcagaaagaagttgacctaggaaggtttgttttttttttaggataaagaggaatttggataaacagttgaaattatttttctactcagaagattatttcgagtagagataagttgaaataacttgagcagaggcattgacgaaattgaaaattgaaggtatttattacagtaataccaaattttagtgatactgagataagagtgttttcactttaaatcgcattctggttctttttgtcatatatgagtttactgtaaattggtatttgggatcttggtgtacttttgttcttgttttattaactttaataattatttgaagatggggcaggtttgttgctgcttttaattaaagtgagtggtcctaactgttttaattttattttagattatagcatttgatgagctgaagactgattacaagaatcctatagaccagtgtaataccctgaatcccgtaagttataatataggatttatctttagattttaaaaatatgtttgtttttaacttgaagtaatttgaaaatggccagtattctgagtagcataatatatttgtactttttgaagtaggcagaatttaaaaaatcttctttttcctgtcgtgcttgactattctattattaatctgctggtgatcttgtcagctgtcatactaacattcttccaatctgctttttacattgtcggccaaagacagttgaaaaggtcaaaaagattaaaagagtcaaaattgcattaaaggtgtgtactgctttttagttaaatgttttaatgctatattcatttcatggggagggttagggcatttgtatttgtaacgttttgttcagtgtgctcgttcatatgcctgttgaggtttatgatttcatgaaatttcatattttatgcaaatatatgcttgctggcccagtcaagtagggaaagctgttaaatgcgtatgcgtttttttatgttatagccataggcacttctatgtgaaattatttggtgtagtacttgaaagttggttaacataaaatgactaatagatggtgagatgattctcgggttgtgacttattgtgaggtagtatgtgagtgaaatctttagtatggacttatctgccatatctagttttatctttggtttgcatattctggaataaatgagtcattctttcagctgatgtttattcagagcctgttaggtggatagctctgttctgggggctctgggatctcgcagcaatgccattctttggacttagggtgccataattttgtagataacaatttgtatacaaatgtctatgtggttatttctagtgtgtatctactttctgtttctaaaacaggcctgaattacactgagttctgagccatcatgaatttagtgataatgtagctccattgtgcttagggtttttgaaaaaatatatatgtatgtatttttaaattttcttttgagatgggggtgtctctatattgcccaggctcttatcaaactcctgggtcaagtgatcgtcctgcctcaatctcctgggtagctgggattacaggcacacaccagggtacccagtttgtttttttgtatttttgcctgcatttaggaagatactcttttag

SEQ ID NO: 75457 - DNA, 1050 bp, Homo sapiens
atgcttgtcagtaggagcagtaatttgaagagcatcttcagccctgctttgatggaagaacaatacctaagataatttgggatacagactagctcaaccttagtaggcctctgatgaaaatgtgtggttccatggccgggcgcggtggctcactcctgtaatcccagcactttgggaggccgaggcgggaggatcacgaggtcaggagttcgagaccagcctggccaacatggtgaaaccccgtctctactaaaaatacaaaaaaattagccgggcatggtggtgggcgcctgtaatcccagctactcgggaggctgaggcggaggagaatcacttgaacccaggaggcagaggttgcagtgagccgcgatggcgccactgcactccatcctgggcggagactccgtctcaaaaaaaaaacaaaaaaaaagaaagaaagaaagtgtgtggttccattccatctgtagatgtagctttaagtcattctgcttgatgggtattccttttttctgggatgatggggattcttagagtggtggggtaggctttttcacatttttacgttttgaaccaggttgtgtttggcttaaggaaaacctgaaccgcactttcaaaaaatgggtaatttcagcttaaacaaatgcgtgtctgggtgaagtaaataattttaagtcgtgttatacaatgaaaaaaaaattataccgcagattcgtggagagcttttatgcttagggatttcttcattcagagaattagtatccttttggaaacaattctaaataaatagatagttttaatttttctattacccatataaccttatgtttatcatcttaggtagtatcttagtccattcctttatagtgtttatagtgttgctatacaggaatacgggaggctgagtaatttacaaagaaaaaagaggtttatttacctcaggattctgctgactataagactgggcatctggtgaaagtctcagcctgcttccactcatggtgggggagtagtgtgtggagatcccatagtgagagaaagcaaaggaaaaag

SEQ ID NO: 75458 - DNA, 1390 bp, Homo sapiens
agttgtgtgtggtgagcaaaaaatttgggcttatgggataagaagtctgagctccgtaatgaagcattataaggccctctatgatctgatcccttgctaattcatttctaagtctcaccactgtcttgcacttaggttccattaatacagaattgctgctggtttcacctgagacacgaagctttatttttcttttcttttttccatctctgttgcgtttcctcattctgaactgtttccttggactgccagttctaccttctttttgcctggagaacttatcatcatctaaggccaacttaggaaacacctacagcaggaatcctgcctaaatgctccagggcgggctggctgtccttctttgacctttcagagcatcccacacacatccgtttacggggttataataacgtaattatttatttaggtgttcatttccggcactatactaagttctttcagtgcaggtactatcttattcatctttgtatctgaagcgagaagcgcggtacctgtaacaaactaggcattcattcaataaatatttgttgaaagaataaacgcaagaaggaaggaaaaatcaatcaacaactgtgcggacaatgtcagtgcaacgcagactccggccatcagagggcgccggggcggctgggctggtgcgcaggcgcgctgagagggctggcgccgcggcggtagcggtggcggtcgcggctgtggccgggggaagtgaatggttttacccagagggccctgcgccgcctttctccgctggcaacggcgccgctccccgctcctcctccccagccatggcgttcacgttcgcggccttctgctacatgctggcgctgctgctcactgccgcgctcatcttcttcgccatttggcacgtgagtagctggggctggggaaaggagggcgaggcggcaacacagcctcttttcgccccgggcccgcggtccgggccgccacggccgccggggctttgcgcgtcggggatgcggcccggctggcacgggccgcgcggcgaggggtctgggggccgcgggtactggaggagccggggcgcgcagtcgccaggtggacgcgcccgcgttgcctcggcacaggccgcgcgcaccgctactcctcccctactggatggggcggccgcggtccaggcgggcgcccgcggttccgcgctgcgttcgcaccgacctctgccggcccgcggccctgcattcccggggaggatgtcgacagcgcggtgggacggccgtagtgtgaatgaagttttccgaatttttgttaatacagattgactttcttttagggtttccacagaactgtggccaaaatgtaacctacttagggtgaatttccaactctacttttcagcacttgttcggtgctc

SEQ ID NO: 75459 - DNA, 4169 bp, Homo sapiens
gtcttgattgctgtactttggtaactgagtacttagcatttaaaagaagtgaagttctacctaaaaggtatatctcatttacacaggttaagtcatgaacaatatgaaaggaagcagaatttggtatttaatactcaaatatataaccaaaaatagtttggtgtataatactcaaatatattttaaaaaattcaaatatttgactttttttttggagtgtcaaagtatgacccaagttttttttttttttaaaggtatttgaaataagaaataccgaagacctaactgaagaatggttacgtgagaaacttggattttttcactaatgtgaacttctgtgtttctaaagtatttatgtattaacctgaccatactggaatcagacataaatacttatttatgcctaaaaatgcactgttacttacagtttgtttcctgcagtaaagaaaaattcttcatttgtgcaaaatttgaacaaagaggaaatcatcttcatagtaatgaaactttgtaaagtgtttccttatattggtaattgttaggtggactacttttctccagggactttttgcactcttgtgactaatttctataacttatggttcggaatttgttactatttacagacaccattggaaagtggatatattagattgtgagagacaacagttgcctccttttgacaaatactggatattagcagtttatttatgaaaatagcgtattatcacttgtcaaatcattgaaattcatttggggtcaaagacttgagtgacccagtattgagccatgaataatttagtgtaacctgtattacaagtacattgatgaattctgtatcttctttggtttcctgtatctttttaatcaagtctagaaactatgttcatcagtcactcatttttaaggtcgggagttagattttatgatagaattatgactgttagcttttctccttatagcatcttagtcttagaaattggtgggttgtaataatcaagggcttcattccttttatgtcatttctagacagttttgaatctaggttaataacactttatttataaagcacctcaatgtcctgtgaacactaattattttaaatgtgttaatactgtgcctttgatttgttagctttaaagttagtttaagacttttacactgccagtattccacatttggtgaaattaatacttttttaaagggtccaaataaaataattttctaatgtgtatatctgaaatttgtaataaaatcaacttcatattttaaaaattccaactatctgcttgcattggtgaatatatggcagtcgagagttataattttgggtatacttgtggttagttttgtgccataggaaaaaattatcttaaaactttggccatagttaataacattaacacttcaatagcaatcacatcttatatcctaaatgtcagaagatattctgaactggatgcctgaatagttaactaaaccagtcttgttagatgatggtactcttggcataaagcgaggattctgatatttggcatacttgtaaaaacaaatacataagtaaccattgaacattaatttgataataggtctagagactctaaaaactaaccaaacttggtgagtgtattcttatattaagaatatcttagtcatctcaaaactagcaaaatttaaattttggcatgttttccattcatatgttctttgcattttatttttgaggtttctgtgagaagtaaagatagttggaatttttgcgatattgaatagaacatcttctgttcccaacactgtttggcttcactaatttagaagtcaggaagcaatagaaagttggagatgaggaagtgctagagtaggtgtttgttttggttcttggagggaaaagattctttattccaatttccagagagaagagaaaactcacccaggaagtttaaaaattctttaaacaggtattttgatattggagaataacatgcatataattctgtaggaatgcacatgtaatccaagtgagtggagagtgtttttaatgtttttgaatgaaggaaatgaggttttgtttcacctgttttgcagcagtaagagaaactagtgctgcaagaatgtattttttaatgaagttccttattttgtcttgcatgttttagttttgcttatttttaaatttggaggtcctccataatgtcagataatattgacctgccatacgttagcactcttagttccgctactgtctttaacaggagcaaagagctgtgataaaccatgcttttttgagcttgtctgactcctaattaataacatgtttttggcaagacaacagattgaggttagaggatcagtaggacatttttattccatctgtcctatggggaaatttacaaatcccgtgctctaaaatgttctcaaacatttatatagatttccctttcatcttactaaattttgcattgttcttttcaagtatgtttcgtatttactgtctttttttctgccatttcccaaataataactccagatttcataattccagtttttacattccgttatctttctggtacaaccattcccattcagccttaaatctgagtcctttttagcagcaacttttttcctgggatcctccttcgtggtcttctaagtcagtgttagttttgaaatttttggccctgcataagttctgcatagcatctaatgtcaaaatagaaccaactggtaatcacagtattatttagtgtggtttccatgacaacaaaaatacatacgaagaaaacttctcaggttactatgctgaaattccaaaatgtctgagttttgaatagtgatcactttgttctggtattgacgcaattatattaggaaaaaagttggttgactgtttttgtttaattgacttctaaaatgttcaaattgtctagttctaaaagtttactaaatgcctagtgcagttaaacatactcttgtttaagtgtgtgttgctaaattttttactgtcattactaaataatctgtgtggcaaaatgtgtgtcagcacttttccctccttttttatctcctattttcaggagtcaaatgtagccataaactgtatccttgtctgacactttagctaaaaatttccagttaggggagtttattgccaaattaaatttggctgttccccccaacccatatagatattaaggaaggtgtacttaaaaaatgtttggactgcttttaaaacctgagcaatgtcattaatccatatgtggactagtgatgaatagatattttcataagagtttaaatgctgatatttggtggaagtagagagtaactcatattctatcaattcaagtattcttactatggttgctttccctatttgttcaatagactgataatactggaatttatagagtttgagccattacaacttttgtgaggatgtgtttcaaacatttctggacaaatcttattttgtatttctggaagaatgtagtaatcttctagaccgcttaaaaccaatgctcccaagctgaatattcttgagaaatttgtttttattatgccatttgacatttcaaatcagtgctcatatacagtaaacttgtgatagaaattgtattttattgctttttggattataattcatataaatataattacttgaatattgtttgagatcattaacatgccagggcagttcccactgatttagatggtccaagataatctcattcaggaggcttgaaacattaatggtttagtcttgtgaattttaacagttctctgtcatcgtttaacaaaaccaacaactgacacaactccttaagctgtggtttcagtctctgctagttcatattgcatgtttattttggacagtcttttgttaagcatggtgcttgtactggtttaaataaaatgttaacattaaaagacttccagcttttctttttttactcacctctttccccctttggagttactggtatgtacctggctagatttgtgtgagccataaactttatctggacaaactgagaggcaaaataaacaagtcatttggcagcttggtggaaggagaagataatcaagttataaaaatttctaaaacttggtctgatgctaaaatgtagaaaatgtcagtaaacagtagtagggacagacagagctatttc

SEQ ID NO: 75460 - DNA, 1145 bp, Homo sapiens
agtagaatgggtgcttggtgtatctcttaaggacttatgggtaagaaaatgtttaaaagttgcttttctctgtggtgccagggcatttcaccagatgaacttaaagatgaactacctgaacgacaacctcgatatccttttcttagtgctttaaaagatttattttctttagtggtcagacctgtttgtgagctcatttgttaaacatctaaaagtatccttctgtgtcatgatgacagccaaattaaaatatgtgtgcatatactagactaagaaaaatgaaaagttggtttattcgtgggatgaataattttctttttaaaactatttcctttattataacgtgtacaataaaaattgagaaaataatctgtattaaacttgtactttaaaaagttaaattttttgagagattatgtgattttataacttatccttggaacccatttaattttgtggaaagataataatgaaggtgtggcctaaaagaataggacagaaacttgcagctcagtagctccccaggtgttggtaaatacctgtctgagagcagtaactttagtttctttaacttgagaaaaaccttcattgtgtatagttataaatatcaacatgatgatggaagagtttcatatcctctgtgctttattttctccagtcctgttggtaagtgaatttctttaaataacacatatttggcttagatccaattaagccattttatactagacaaattttctgctgtttttaaagatgaacattgttgaataacctaaattgaggagggtctgtgtctatgtgtgtccatgtgcctgtgtgcatgcatccctagaaagaatgaagcatcatctcttagaacttattttcttaggataaatttctagacgtgtaattgttgactcaaatcatacatgtattttaaggattttgaaacgtgatgacattctaatatagcagaagtattttctttttatattttaatcatataaaaatgtgaacttcacatataattgcatatatttgtgtttcttttaaatagtagttaacagtgatatgcttataatcttgagaatggtcctagagtaatttacattgggtattaaaatgggttactggtatttaaggaattcattatcaccagaact

SEQ ID NO: 75461 - DNA, 2539 bp, Homo sapiens
taacacttttgttgcttatattttttttcccctgtaattgtgaggacaaaaaataatttattaattctaagtataatcagattattttcttgttcttccttcactgtgtaaaaatagtatgcttgactccctttctaacagcagacagtgattcttgactttccccatattcttcccttcctctccagttctgatgacattgcacattattatgtgtgtggtttttgagacattcattagccaaagagaaagttaaaatataccttacatatatgagatgaacaaatttgtaggattaagcaatgtagatccaaaggttggttgattttaaagttcttttaagtgttcatgtatttaatgctttcacttaattgacatttgtgaatgtcagtatgcattataaaggtattaggtttcataactttaacatgtacatatattgaagtcatggcattttatgtgtgttttttttcttttatagagtgagtctttggttgtttgtgatgttgccgaagatttagtggaaaagctgagaaagtttcgttttcgcaaagaaacgaacaacgctgctattataagtaagctaaaagtgattgcctcaaagttacatggtcttaatttgtttttaatcttgtagctacattgaatgaactgaaccgttggaaagcaatgttacttcctctgtttcatttccccaccaccacctttagatcactttaaaaaataagtaacagctaattctaatgtcacagaacagaggtggattgtcccacctcccccatagtccttttatcagctgcctgtacagctctggagaaggcggtcgtcttggtccttgggtaatgaggattcccatctgcagtgacccatccaacccatccttcttgggggactaaaaatagcctggccattcatcctcaaatagaaacctttgcctacacctaaaatgacaaagttcagcattgtgtacatagtgactttgggcattattccagttgtagatttgaactctggtttcaggaagagtacttttaagtggcactggcactatcttctgaaaatggaaaaagtgatttgcatattgctcctcccactgtgagctatatctgacattatgcagatttcccttgtattcataggcagtatttaatatgtaggtagtgatttagaaagatgaggaaaggatgagggggtgaaaatgtaaaactctagagaccatgcttaacagagatgcatctggcagatgtgatttaatcagaggtcatgacaacttgtcatgaattctgatttcattataaataaatactgcaatgtcgacatatggttcttaaaagtgaaaaaaaaataaaagtgaaaatgtgtgttagtgccatttactgcaaaagctgaaactatttgagattacattatatctcacaagatttactatcaaattggtgcaaaaccaaacatggtcaactttgccagactaacaggaaaggatagaggcatagagtatctaaacttattttgatttagctttggattacattagatatatttgaatgtagatatcacttctatttggttattcactttcttagaataatgataccgtgccatgaaatcctgaccttggagaagccaggaattttgaggtttctctattttgatccccgatcaggcactttttcccttgcagttctgaccatgttgcatatagaccaatcagttacagttaccctttcaggctttttcttattatctagaagttggatttgagttacaaagttctttcatatacacaggaaatgtaagaaattaacagcaagttctaaataagcaaattaggtactgggaattatgggtaaaagcttttaaaagctgacagcttgaaaagcaaagctagctaataaaccgtaaactaaaactgtgaattagttatatgcttctgtttcttgatgttttaattttagatgtccgaaaaaaaaggctgagattgtgtgggttgggcagatcagggtcacattagaatcccagcttactcatacttgatttttattttagtgaagattgacaaggataaacgcctggtggtactggatgaggagcttgaggtttgttcaatgaactaaatacaattttatagttaagtaattattatttctcaaaagatgctatattagttacatatgcttctaaaacgaatcttgaacctcctttaaatacatgctcattatgcataaaagcatgtgctaattgtgtagtttgtgatattgctaatttaactaccttgtttaaaagcattagtgaagtccagtgtaataagtggtataagttggggtcatatactgagtaagaagtgagtcaactttgtaacttgcttctaagttgcttgactagtacttaaaacctgaaaccctacaatttaaatatctggtttgtcaaattaagtaactagagtaaaaagaattcaattcttttttctgaaatcagacattgtttctttccgctaagatactggcttatgtcattcagtatttcctgacagctgggacat

SEQ ID NO: 75462 - DNA, 1382 bp, Homo sapiens
gagggcttcagcttctgagctgtaggttggagggaaaggggtctgccccatcggagggctccctcaattcctgctttccctgccagggccgtggccaggttccaggggttggtgggccccgagcatcttccacctggcggcgttttgggggaggactcgaattccgattgaattctctcggcctcaccttagcttctttctctctgctcctttccctagcttcctacagaggatttctccttatctttgctttcctatggcagttggaaacctttcgacccaaagctttggcactgggccttaaagtaattgtcaataactttagttttgttggttctgggggctgtggcttctgttcttacatgggatggaccccaagcataaaaataaagtggaaaattaaataaatcgccatcaaggatcttttggatccatcccattaggttttaaaatatgggtaaatttcattagaaacaacaaaacactgctctctgtgaccatccactcaattctcagcccactttcatcgaatagatcttgtcatggtcactgaatcgaatggattcttttcagttttcgtcttctctgaccttttagctgcattccagagtgttatactctcttgtttttgaagcattctcttccttcattcttcccctttggcttctgggatacagagctcctcctacttctcctattggtccatctgtttccctttcagactattctcctttccctggacaatgctcgaaggagtcccaggtttcatcctaatccttcattttccattctgtattcttcatcctaaactatggcttcagttaccatctatattcagatgacttgtgaatttacagctcagaagaccttgcttctgagatccaatccagatctgtatgtacttttttttctttgagtcggagtttcactcttgtggcccaggctggagtgcaatggcgggatctcggcccattgcaacctccgcctcccaggttcaagcagttctcctgcctcagcctcccaagtagctgggattacaggcatgtgccaccacgcccggctaattttgtttttttgtttgtttgttttgagatggagtctcgctctgtcgcgttggttggagtgcagtggcgcgatctccgctcactgcaagctccgcctccctggttcacgccgttcgttctcccgcctcagcctcccgagtagctgggactacaggctcccgccaccacacccggctaattttgtttttgtatttttagtacagacggggtttcaccgtgttagccaggatggtctcgatctcctgacctcgtgatccacctgcctcggcctcccaaagtgctgggattacaggcgtgagccaccgcgcccggccctaa

SEQ ID NO: 75463 - DNA, 1026 bp, Homo sapiens
attttggtataaattattttgatataacatgttcttttgtagatggtaggtaatagatggcagttgtttgcttttgtacttgcttggaaaaataagttgtctgcaggaccatataggaaccattagaattgtaaagaaagagatgcttaaatttgttaaggtgaagaggcatattcaggaaagccttcataaaaaagaatatgctgagtctctcttactttttttttctttattccttcctccttttttttttttgagtagaatcttggaagataggtgtttacttcgtggatgagaaatggagtgatacattaaagaaacagtagttatggctaaagcataggatgggacaggtaacagaggagtctaagaagactcaggttcttcctatgggtcctccatagccagatcctgttagaaaaatgaggagtacagaaagaatagcaagtttccaaagaaaggcaatgaattcaattttgaacttttggactttgaaattctttcgtgacagttcaatagaaataaagagtaggcagtcctagatacagttctgtagctttttttctgggccgagaccctgtcccttctatacttgcttacatttctggtttcttgaaaacaaataagccagatctttctctgcttttcatcctagtctagctactgccgtatttctcttcttcccctcacagccagcttcttagaagctgtttgcattttccttctcttagcctgcttcatttttactcctcagtgcagtgcagtctgacttttccctgtatccctttactgaaatggctttctctgaggtcactaattacgacttctgccctgcacttttgacccccagcagtcatcaaatccagtgggagcctttcagggctgagttaatgctctctctctagtattttacagagttgaccttcatttgcaacgtcctgctcccttgcgtctatggaccattcttgtctattcatctttcctgcctctaactctcagaatctaataactggtcagaaatcagtt

SEQ ID NO: 75464 - DNA, 1003 bp, Homo sapiens
ccaggcccgcttcctccagctctgcctggagcactcgctggccgactgcgccgagctgcacgtcctcgaacgcgaggccaacagccccggtaagtgtgcggcggccgccgccgccgtcccgcctgcccaacccccgctcctccctccgcttctctgcctcgggccaggccgaggccagtccctgccagccgcgccgggacctggacggcgtggccccgaggccctcggaatccaccccctccgggtgtccccccactaccgccccccacctacttacctccgccggccgctttgggattttgcccactgtgaactccgtcagccctttccgtgtggtagctacggtagcatgaatgattgatttttctctcatgcagtttcctgggaaataagtaagtcaggtcacgtagagtctggattttctgggtgtgtgtgttttttccttcctcctccttcttttgggcaacgtggctcgctggatttcagcaacacatgatagatgcccgggactgcccttcagaagccaagcttggataaggctgtgtgaggagtacatgaaaatccaattttattattcatttttccccacagatattctggttttagagcttcgtcttcagaataatatgcaggtgacgctagagactagtaaaatgacatttgcagcatatatatatatatatatatatatatatatatatatatatatatatatataatgcggttaagcttactgctcgtgacattatccatattgatacggatcttgtagaaaaaaagggtcttggagaaaggacaggcatgaagtgggttacttaatgcttttcgttaggaaactttactgaatagaacagaatcgtttcatattaccctgctagtatttacagacacctcaactagtatggaaagtgaatatagtcgaaaggtccagcagtttcctatttgctagcgtgggtggtgacagactgaaattatatcctggagggtaggaggaggctggggg

SEQ ID NO: 75465 - DNA, 1032 bp, Homo sapiens
gtattgggggtaacacatttagaatggggtgagggactgctgtaatcagtagtaaaaagtgacccctgacagcctgacaacttggaaagagacagaaaaactgtaactttagacaagaattggggcagaaactttgaaggcttgggaatattagggtgggaaccctcaattgaccttgtaggcaccactctataataacataaacaaataattgctatttactgttgttaacggtgaactatggaaataatacatttttagatacactctttaagaagagaaggaaatgttcaatatactttggaaatgtttacacccagaataattaacctctgagctgttttgatgtgtaaggctcttaccaattcagaaaactaggctgtgcagaatgactcattcattggattgctgagatttcctgtaccgaagtcatcttgtatcactttattttgtaatcatcaatttaaaaaaccctcacattttgtctagtgtttagagattttaaaacttggtaaatgggaaccaaattcatatatgggactcgatctcagtataataaaaaaaaattactagtaatagtatgaatatatctctcgttttatgcaggactgattttaaatagtgagatatcctgcgcattaaacatgatttatttgagatttgtgggatgtaatttggtgctttcattctcttaaatttattgagaatctagtgattcactggttcatcctttgcctcaggctcatggtcattggagattccaagaaatgattgaatcagtccctatggatttatttgtatgtgtttttcttttaacagatatggtcatgatcagttctctagtacagtcttgttcccaggatccttataaccttagataagtctcttcagctactgctccagttgaacattgagacttctggccagtctcagttccaggactagcaggtcatttgatacctacaagtagcaaaaatgcaacccactgactttacctgaagtttccaaaagaaaaatagactttgtggcatt

SEQ ID NO: 75466 - DNA, 2616 bp, Homo sapiens
ttagtcagagagtatgctagtagtgcaggtgtgtttcatatgatggaattattgacttaaaaatcttttcaagttttacttacgcatgtaagcactgaaatactgacgctttttagtttggtagtgtggtcactcattaaattatttgagcattttatatactgctctcagcaataattctctcaccggctctttgaactacctctcacagcctgcactgagtttgggtttgaagaaggccggagaatttccccgagctttttgaatatgctgaaatttccaggcactctagcgatcagtgtcttatggaaaatgaggctccaggaaagatttctttctttctttctttttttttttttttttttttttttttttttttttttgctgatgctatgggctgtaaagttgagctggaaagagcaggaatgttcattccagagactggatgggagagttctcttccccctacttccccagagcactcccataaagtgcagtcactggaatttctgaagcagtttatcctgatctgtcatagaatccaagcgtctgtgtgtgcagcataaatacatacacaacattgactttcattgtatacatttctatctgtgtatgtgcaccaaacatgtgatttaaacacagttaaaatgcatgagtaaaatgtcaatgctgaaccagttttgaaattttgaagagtggtaaatgaatgggagaaacaaactgtctgacttcagaaccactccatgtgcctcaagataaataaacttgtctccgtttgaaaaaggaaaaaggagggagaaaccaggttttgcacattgtaggcatctgagaggttaatattgggcctgtgcaagataccagaagaatatttaaaacatgatctatgagcgtatggatgaagaaataggaaccagcatggttttgctgtgagtgggaggatggaccgtggagaactaatgccatttcctatctgatggggcagtgggaaaggggggagatagcatttgctgagagacttctgtgttccaggcagatcacagggaatcccatatctaagtttcagcatagcctttgacaaaacctcttatttcctgatgaattaatggagaaatagcagcaggtgagaatctagttgtgtggctttagcgtggtttcagtgactgttacaggcctgtctccagccactgtctgcctaaagggagatctctggtgctgtacattgaagctcacatgttggacattatcactagtgtcgatggaatgtgacttagcctggggtccccaagaaggcagagcctgaggcaagggctggtgtgcgggtggcttattttgggcactgatcccaggcaacaggagaaggggctacaaagagagaaacaaggaaggaggaagagccaacacaagcctgcattatcaagctggtcactgctgtgggcagtgggggcttaatcccacagggatcctctgaggagccacatagaatgtgcttgggaagtggctgaaggacagatgaggtaggcatgtatccattattcccctctcccttggccaagtgttgccccagggtactgagtccctgtactttcaggtttgtacgtgtttctgcaggtgtctcaaagacgccccaaggcagaatgctagaaagacatggtacagccaaggcagggtgctgtcaggttatacctgtgtgaagctgggggccacagcaagggctgcagtgttatccaagctaagaaggtgtttgtaaagtctatggatgaacctagaaggatagctcatggcttgatgacagaatcatgatcaaaatatttgaatgtaaccagatgacatataaagcattaaagtgtagcccctacattggcatcccctaaacctaagctagagaaggcatagtgcttcaatagcatgcataaaaagggactctggcttttagcacacttacaacttcatatgaataatgtcacaatgtggttgcgcccaaagccactaaactctgtaatacagtcattgtactcagaacaagtctgtgctaccagtcgcactctccctggagtccaggaggcagttctgggtacacactcggagggagatggacaaatcaggatgtggccagagaagacagaatggcgggggggcactcgaaagccagggtgaactgagaagaagatgagcagagagctgtcactgcttactcagaaagctggcttggagttgaagggttaaattctccgtccatgtagagggcagtgagtggaagctgctgttcatttagctcagagtagagaaaaactttatgatgattagggctgcccaaacaatgcagtggcctgggcttcatcagatttggacgagcctttagcatcaagcagaataatcctttcgagtaagactggctcctgtttattgagcacctgctctgtgccagttgtttgcataacatgacctcatttattcttctcaataaccctatgagatgaggtaggaactgccattattccatttgtcagggaggaaacaagcactctggcttcggaaccaccccacatgcctctccactgtaggaatttagtgtctatttgcttaggaaagaagctctgatttcttggatgacttcca

SEQ ID NO: 75467 - DNA, 1044 bp, Homo sapiens
aaacaaggaaaggggccgggcgcagtggctcatgcctgtaatcccagcactttgagaggccgaggcaggtggatcacctgaggtcaggagttcgagaccagcctgcccaacatggtgaaaccctgtctctactaaaaatacaaaaattagccaggcatggtggtgcgtgcctgtaatcccagctactcgggaagctgaggcaggggaatcgcttgaacctgggaggcacaggttacagtgagccgagatcatgccactgcactctagcctgggtgatatagtgagactgcgtctcaaaaaaaagaaaacaaggaaagaactataggaagggccttctctcctaggagctgacgccttaggcagaagatcacagccactgacaaagcactctgccagggagggagccgacggggagatgccccagcctttctctcctcagggtcctgctggcaatcccattggaggacccaaatgaaccccagggaaccacgagatgtagtctgaaggggcagcctcccagggcacacatcagggtgagaagggtggagagtggttcttggtgggggagggggtaaatgcagaatatccagccgggagagaaaagcttcaggttctgaaaggtagccttctctgttcatagccttcctgaggattctgttgcttgtagccagacctctaaatcagatcttatgaaagggagccccatgcagaagtgttttgtttcatgcccattgcattttattgaaaaagaaaacaaacaaaacaccatatatctgtattagctttggggagtgacacctcaaaatctgagtttctttttttttttttttgaaaaatggaagatttggcagcaccaaatatgcattcctatgtgggtacaatctgcttagcgtgtaggagctgtcctgttaggtaggcatgcttcagtttgcctcaatccccacatctctctatctctctgttgtggtctttttctttttcttttcttttttctttttttttgagatggagttttgctcttattgcctaggctggagtgcaatg

SEQ ID NO: 75468 - DNA, 1028 bp, Homo sapiens
aaagaaatggaccctaatatctatgatgaaggatttggagttagaagacctgagtttcaattttggcatggctgtttgtctagctctgtgatcttggacaggtcaattgacttgtcttaatcttctcatccatttagtggagacagcaccactattcacaggactattgtcagaattacgagacaatagcataggtgaaaatataaagtactttgtaaactaaaatgttacacggataagctgatatcattggtagcaagagcaacactattccgaagtttttgtggtgtagttccctctgattattcttcatattacaggtcaatcaattgggtagacatcctcttaaacctctgttcctcttttcttcttaaaacactgagatctcttcatctgaaataaaaatttcgagagagtttatagatttgtagtcttggatcctggagagaagagacatgtattcctgtatacacccagatcattaatcctacttttaattctactccaaaccttgtaccacatcatttcctactgccaggctggagtgagtaatgacaaccttttggcagatcaaatttcagttttagaattcaggaagcaaagctgtgtcctggcctttctttcttctttttaaattatagctaaatgtccttttctgtttgggggcaagttacatgcctggttctgccagagcaaacgaaaaccaggcaccttctcctgagcatgtcactgtcataaacccaggcagtctggtgaggcagctgcttaagaaataatattccaccattaactgccccacccctgaaattagcatctttggaaggcattatccaaggttttgttgttgttactgtttttgtttttctatttattcctaaaacaaatcttcattaagttcatccagtgcttccattgacccagctgcttggaattcagtgaactgtcaacagaatataatttctttcagaatttgttattctactggaactacactgcagtgtctttgtgattgagttagccaccagata

SEQ ID NO: 75469 - DNA, 1550 bp, Homo sapiens
acggggtttctccacgttggccaggatggtcttgagctcttgacctcatgatccacccacctcggcctcccaaagtgctgggattacaggcgtgagccaccatgcttggccccattattttattgtatccttaattcccttagctcacccttgctgagcatagttgtctgtggtagaattagccattggctccttgcttgctcttccagtttgtggtgtttcaaggtgctggaatccaccaccaagaatggtggcttcccacaatgccttttaacaagaatgtgtctcttcaatgcacgttgtaactttctctttgaatttattgaagaaccacaaattaagtctgtgtctttattgaagcaattcaggtgatgggaagaggctcttgaatcaagaaagaaaggaagaaccaggagtggtgatattaggtaaggggagatttaggatcactcttccgcaatacaaaatgaacttcctgtgctaagaaaacttacagccctgaataaggagttgatggcatgtctatgcaacgtacaattttattcctgggacgtcgttggaaaaccattatattagatgatcttcaatcttttgtagttctgaaaatttatgaacgcttatacatgttgcttataaatcctaaatgaaaaaagggctccctgtcttaaatttatgttctatctaatatgcacttttaaagtttgagtttttattgcacttctgatctttttaaaattataaaacctatcatacatacaaaagagtatataacacttattaatatgtatagttaaagattaataagatgaatgcccctgtgcctaccacccagcctaaaaaacagaacattaccagtgtctttgaagctgtctctgttaatgtgcatttctagactgctttaacttattggatttgtgcattgcagtgttttatttgtgagcagttatatcagtgaataccaagtgagagtggctcagccatttttaccttatgctcaaactcctttcagatttccaatctgtctgatattggatttaagaacagttaaatcttactgcttggaaactgatctttaacaagctagttttcctgctttaaaataatagtgttgttcgtgatgttaatttccctgtttcacttgacaattacagcgggggtagcttccctgagcacaggatgaggatcagtcagcttgagtatctggtacagaaggcaagctccctgtgcaccaaaaatctactcaggccctggagaaagcaaaaaaaaaacccagcagagcataattaatggaaactatctttaagtcatcaacattaaatgtgattgaggtagcagtatttcctgggtgcatgattggggcattgaagtactacactttgatttctgatgtgaattatttgttgccatctgaagttccaaagagccaagattggatgtacatatttttaaaaatatgtgctttggtgaaaagcaaagttttggaagggtagaaaactttcagtagccaccaaattgtgttattttaaaatgagcagggaaacctcacaggg

SEQ ID NO: 75470 - DNA, 2960 bp, Homo sapiens
tgaccttgtgatccgcccgcctcggcctcccaaagtgctgggattacaggcgtgagccaccgcgcccggcctcaaggtcttattttaatggctataataatttctgtattgcttcattgtttggtatttgactattatatatgggcaacatggtgaaaccccatctctactaaaaatagaaaaattagccaggcatggtggtgcaaacctctaatccccgctactcgggaggctgaggcaggagaatcacttgaacccgggaggcagaggttgcaatgagcccaggtcacaccagtacactccagcttgggtgacagagcaagactccgtctcaaaaaaaaaaaaaaaaaaaaattggaaaagtaacatgccatgccaggaaaggaggaccctcagccactagtgtcgagaggacagaagcgaagagagcaaaccatttggactaagaaggcctgaatttgagtcctgggctttgccacctactttatggccttagctgagttactgaagctttttggacttgaatttcctaccttcatgttggggatgatcataatattttccatacctggcccagttgtaagtggatcagggagatggtgtactggaaagcacttggtgctctgtggtgtcctgtacaaaacatagaaaatctgcctccagtctctgtctcagtccaggtcctcacctgtcataataacaattactttttgttatatactgcctaattggaaagattcctgttgcatatatgttcttaatcgtatgctctcacatatgtattgaaaggaaatggggcataaataacagaaaatagcttgcctctgtatcgccccgggaaatattggaaaatgccatgctaagcccaataacagcagggagtatgccacttttgtctaatactggacatgctgtgctggcacatagtaggttattgagtttgatatttcggtgaatgaaggtcttgccaaattctttgagcaatggattttgcatttacactagctggagaaagggagttacattcagagcagcccaactgtgtatttttagtggaagaagaaggctctttcttaggtaagaatataaaaagaatcgtagatatagaggtggaagggacaaaagaagaagcaatagcatggtctccatactaatcccactttaaaggtgagggcgtggagaaaccatagctggacagttagcaacggaagacagctatgagtccagaccttttgagatgatgttaaagtcacttaacaagaataagtaaaaggcgcttttcacatgtcagaatgttttttcttgaaaattaatgaaggcaaatgttcattttattcctggtaactaacagcctctcagagatgtgtatgtcctaatctccagaacctgtgaaaatgttatgttacatggagtagggggatttaggttgcagatgaaattcgttcttggttgagtttaaaataggaagattatcccagattattgtagtgggctcaatgtaatcacagcgcctttataagtggaagttggaggaggaagagtcaatgagagagacgtgatgtgagaaatactcagccagccactgctgacttcaaagatggagaaaggggctatgagccaaggaatgcaggcagcctgaagaggttggaagaggcaaggaaagagattctcccctagagcctcccgaagatgtgaagccctgctgacactttgatcttagtccagtgagacccatttcagacttctgaccttcagaactgtaagataataaaagtgtgttattttaagccactaaatttgtggtaatctgttacagcagccaattggaaaagaatacaattccagcatagcctgctcctgatggtcaccttgtgaagaataatgtactgtttggcattcagatgctttaatggagggctaatttatgacgtctggaaaggaaggtaaatttaacaagacaagtttgaaagaaatagctgtaattgacgagtgcatcattacaggttcctcttggccacgctgcccttttttctctgccacacaatttctctgagtggacccttcttgactgtcgaaaaaagtaattaagtcctttatgagtcagactgacagcaaaagttagcaatcttgttacagtattaaaacttgcttacaggaccaaagactttatttggtctttgaaataaaagtaaaatcaccatctctttgtgggtttcttttcacaatgaggcattgatttgcttttggagagatgggagcccattatgattttactttttttgttggcgctgctgatattaaatcagcgtacctcaggtgatgaggttatatatgccgtgtttttaactttcatctgcttagtgaattccttttgtcttttgatctctctcagcaacctagtttttgtttttaattttagatatgaccctgcttttccagaactagatcactttcattctgttttgaatacttaataaaagttcccaaaatgaacacgagttttcgtagccttttgttttccaaacaagcgagggctcatttcttccaattagaatgaaactaaaatgcgaccaagtcagcattttcattggaaatgtcaagaatgtatttctacaaaaatataaactgaactttaccatgtaaagaaggaacaaagtcatctgtcgaaaagcaactccaggccccggagctcacagagtgcccattatagtcgtcccagaaaagcgttttctttaccagagaccttaccagctagctcagcctggcaccgcaatgggctgacaccagctcttactattctctttgctcggggtctgaaaagtattttttggcacatatctctgatctttggttctctgcctctacaactgggggttgcttatgactaaatgttttctgtgataaagttaatttctgaagcttttaattttttatgagccaagtcacctgtaacactaact

SEQ ID NO: 75471 - DNA, 1441 bp, Homo sapiens
caaatttctctttaaacttgaaaatcaactgaagaatttaagtcaagtttagaatagataaatatgtctttgagtatattttacaatgtctgtttgatttagtagatccttctggggacaggtctttctagagtttggagagttaccaagttactaaggtgtatttcctcagggctgcttcttgcttgttctcagagaagttggccaatcactgacaaaatgcatttcttttcccccttttcctgtcgtttgttttatttttaagctagcacttgtattttggaaaaattatttactcaaagatatcttgggcaggaaagaaaaatgttttacttcagttatttattggatctctataaagcaatatgatttctcctaaggctaactatatagtaggactagcatcataaaaaagtcatgtctttaaaaatgccaaaaatttgattttttgtatagaaagaaaaaaagagcccctttattaatcaaatatatgtccctttaaaaatgttttgagggtaaatttatagaatcatttccaatgtgtagacaactgccatcaaatgcattcttaacaatgatttaaaatagaatgaactgtaagtgggaaaattgctaaggatgataatctcctgatacaactaataggtaattattttaagtcaaaatgttaattcatcaaaatcagtttcttaattcagatatggttgttatcaagactttgaaaatgataactttcttttcatcctatccaaaattctatttaaaattctttaatccctcggggtaggaggagtaatcttgagctcttgccttctcatctacatttttcttttctgactgtgtctatatgctgtaacttagtgctcagcccatttcacatagcaggtgttttttccctatgtaacatattcttagagggaatgactataacaagtttaaccaagggcatgttaagaaattggggaggggactgtgccttggctagggataaccttttttgttttaatcattttttttaatttaattttttaaacttttaagttcaggggtacatgtgcaggttttgttatataggccttgtgcccactagttatttttcctgatcctcccaccctctccactctgataggtcccagtgtctgttgttcccctctatgtgtccaagtgttctcatcatgtagctcccactggtaagtgagaacatgcggtatttggtttctgttcctgctttcgtttgctaaggatgatggcctccagctccatccatgttcctgcgaaggacatgatcttgttcttttttatggctgcatagtatttcatggtgtatatgtactcagcctattttgttttaactgaaagacaaaaacagggtcaggtaagtcagttaattttttaaagtattgtttattttcctttggacttgaaagactttttttttctt

SEQ ID NO: 75472 - DNA, 1048 bp, Homo sapiens
cttttagttgtttccgaagcatgctaagcaaagtctgtgtttagctcctgaccgaggcttggtgttgactgtgggacatacttacagaatagcagctctactgctaggtgtgtgtgtgtgtgtgtgtgtgtgtgtgtgtgtgtgtgtgtgtgcgcgcgcgcgcgcgcgagtgcgcacatgtgcatgcatgagggacagaaagagacatcttgtttttttttagactctagcttccaggaggtcaggaaaaatagtggctctagtttaattaacatcctgttttagcaccagttacagggtcattaccacagtaaatgttagatgttagactttatctcttctccatcagaatttcactttccacaggatactgtatttctttcaggctaatctatattttaatggcttctaaattgtcaattgagatggtaattagttctaatttagtgataatgctgtgaacatggagtaagaagctaattgacatggcatgctaccaactagaattttatgaactaaaacttcttatctcttgcacaacagtgagtgttctcattataaaggtgccattcaggaagggagagtggctttgcccacaggtgttcggtaccttgtggatacgttgctgattgctaggtgatggccaactttgactttccaagtcgaacgggtctcccttaaacctgcttttggaaacttgtactaaaaacccctcctatatgcatatttagttaggacatgtttgtttccagttgcgtttgtttttcctactagatataaggaattcctatggaggctgagggatatacaagcaggagaacagcaattctctgttcaacacatctggattctggtagaatagcaatacattcactgaaaagttcttaatagtttacagaagacttgcacatatgtgacttcatttgatctcataattgaagtcagggcaggcattattatacccattttagagctgaagaaacagaagttcagggaagttaaatagtttgtccgtgattatttgactgggtaagtgggagagccaagc

SEQ ID NO: 75473 - DNA, 1049 bp, Homo sapiens
ggtctttgcagatgtagacaagttaaaatgaagttatgacgtgatggtgggccctaatccaatgtgactgggtatccctataagaagccgacaatgccatatgaagagagacacacaggaagagcaccaggtattaataatcacagaggcagagattagagtgaggcagctgcaagccaagcaatgcccaggattgacggccaccaccagaagcttggaagaggcaacgacagattctacttagtgtctcagggagagcatggccctgctgacacatcttgatttcagacaacctgatttgttttcagaactgtgagaataaatttctgttgttttaagttacccagtttgtggtattttacagtcatcctaggaagctaatacaaatatgtttttattgtaccagattcaatcagtaagccccagtatggcatacagagtgatacatgaatatttcgttttatctgtcccttcccatcttattggtaactgctaatgacagtttatctcctttctatgcatgtatatttatgttagtttttatataatgaacctatattatattcattttctgctattcttttttttctttaaagcttactggtatattctggagatctctaagtatttggcttaaaaatttttttttcaattgcggtaaaatacagtttatcaacttggccatttttaagtgtacagttcagtggtatgaagtgcattcacattgttatgcagccattaccaccatccatctttagaactcttttaatcttgcaaaaatgaaactgtgtgtgtatattaaacaatcacgccccattacttccttcccctggcacccactgttctattttctgtctgtatgaatttgactcttctagatacctcatataagtggaatcatacaggacttatccctttgtgtctggtttatttcattagcataatgtcctcaagcatcatcatgttgtagcatgtgtcagaatcttcttccttttggaggttgaataatattccattgtatgtatatatgtcattttgtttacccactc

SEQ ID NO: 75474 - DNA, 1058 bp, Homo sapiens
ttccatctccccagtgttcctccaagcctctctactcatttcccatcctaacgtccttactcttcaccctcttgcatagcctcgtattactattgtcactcattagaagtcaggctgaggattcgagcatgcccgtggctgggcaccttttccacgctttgtggggggcagaagaatcagggccaggcttgtgcttaggcaggataacctggccaagtaacctggcctctctgagattcagtttgcacacctgtaaatcaagaatgcctggctcacagggcccttgagggcttgatgtcataaggaagaaatcaggcaaggaaggaaatagacaaaacctggaatccagtactatatcctgtttctgactgctagtaatattaaaaggatatgtgttttcttggtcccttacagaggtttccccagcctttttttatgcccagacacaggctaacatttgttgaagacactagggttacccagctatcctgggtcttgctcggctgcttgaggactgatgagatcaaaatctctatgggtgtggaatgcatttgaaatacatcatagttggggactcagtctcacagttcctgagcaatatgccatcttcccttggtggtatccattcattcttatcagagctctgtgtgtgtgtgtgcgtgcgcacgcacacacatgtccgtctgtctctctttttggtttgtttggtttcgcagtgtgggttttttgtttttggtttctgagggattttgattatttgttgctcttacataaccttcttttacctggacaatgaataatcagtcatcaaatgactcctcatcctgtgtctcattcttcagcaaatatttactgtggttattctacgtgatgctttgggggaacaaaggtagatgaatatgtctcctccccaacctcaggtgctgatagtcatgaggtataatgtgaaacctaaaaatgagggggaagagccaaggagcccagctgttggagtgtggggtaaccctgaactctggaaatttagtttggaaactacttgtgctgcaacattacctggc

SEQ ID NO: 75475 - DNA, 1066 bp, Homo sapiens
aagcagatgtggtgagagtgagagcaagagttgggttgtggacatgttgactttgagatcatctgagtgagcatggagagggtgcagttggagtgtgaatctggggctcaggggagaaacctgggctggaaatacaaacgtggagttgtctgcatactcatgggccagaggtcagaaccgaggcaggtggctgggggagctggcctggtttttgtgccctctgggaatggccagcctcagacctcctgactggtcatggccaggaggtcagaaatctgaaggtgaatcctaaccctaacttgagtccttggctgagatctcaggactacttcccagctggcctgggtcctcaaggagtaaaggagcagtcctggagcacccagctgtgccggtacctggggaaaaagtaactacagatggaaagtctccatggaagaaatgaccagatctctactctggaaaggtaaagggctcattggaagtatctgctagggcaagaggtacctggttcttgccttttgaggatggtcagatgcctttgaatgaccagcacctgatgaccttctgctgtcagaaaagactggaatggtcataatggtctatacagtccactacatagatgcctgccttttctagtgaatccaagggacagtagcattttgaagtgatctttaccaagtaaccaaaagctctctgtattcattaactattgctgtgtaacaaactaccctaaaacttaatgacttaacataacaacaagttatctcagttttctgagggtcagcaatttagaacagcctggctgggaagctctgccttaaggtctccaacaaagctgtagtcaagaaataaactagacctggaggagccacttccaagctcactcacatggctggcaagttgattctggctgttggcaggaggcctgaactcctccccatacaggtctctccctgggatgcctgagcatcttcataattggtgtgactggcttcccccagaacaagtgaaccaagacagcaaggtagaagctgcaatgctttttatgacctaaggtcagaacgcc

SEQ ID NO: 75476 - DNA, 1058 bp, Homo sapiens
ccacccatgaatgtgccaaaccagcctctaggacatggatggatgtctcatgaggacttacgagctagaggaccccagtgcctcccatccgatcatgcccccctgtctccacaaagcagtgtagcctcttcaggaagtggtgggagtgaacacttagaagatcagaccactgctcgtaacacattccaagaagaaggtagtgggatgaaaggtgagtgactaaatgagaaaccactggggaaagagcccctccctttattggagaccagagggtaaaaaaagagaggtagtcagcaagagagaaggagcccaccccttccccaggcttacgcatttgatctgtcccttccagaactccaggttgaccatggcagaaagggctcagattccccttccagtgcttcttgccaaaatctgggaaataggaaccagagtaagagaggtcaacccactctctctctctctctttttttttttttttttttgcattgcagtgacttgtagaccattaaatgagtcacagctaatggtgataggatcttctgtttgtaaagctactgagctgctccaaccttgtacctcattgctgtggccagggacctgtcagtaattcagaaaaacaaaccacgggatttttttttttcctttataagtctatgttaatgcagaattgcagtagtgcttcctttctctctcctcttctctttgatatccaaagaaacctttaaaccctttcctctgcatctatttaagggacatgaaaataccactgagaatctctaacagtgttttaatcctgataacagatttgcatacaggtgataaaggccttttgtgtagcataaataaattcctccattgccttgtgaatctaccctcttctaaaagatattcatcaggagatagatttccaaattacttatgataggtacaaagaggatacgtgcatgctatatttttagactccacttgtacaagggctgggaagcccttaggcaaagatgcacattcagagacacactagtaacaattttagatggtgaaacagtaaccactca

SEQ ID NO: 75477 - DNA, 1100 bp, Homo sapiens
ctgtaaccttgacagtgctgctaaacttctcttcatttttgaaaggaacatcttccatcccacttcagtagtgaagagtgggtaccttcttacccctcagttggctttcctcttctccccctcagagatcaagggtgcagtcatatcttggagggagagagcttttgagagcagtctggcttgctgtggtgaatgggagttgatcttccatctgcagttaccaggaccacccctacgtgagcccttgtgtgggaacaaggctgttcatgtttctgtctgccagagatgcctttctccctgcccttcatgctgcattcgatattgggctcttcagcaatatcgatcccatctttctgtcttctggggtttccttgtttgtgggtcgggtgctgcatggtctgttgatctgactcaaatttgcagccatttctgcagcatgcattagagacaagcactcccagttctaactggagccctgcttctgtgtgaactgttgtacacaccgcacagcctccctgtggctggtttatctaaattctaaaaaggaaatagaaatcagcatgatttaaaactgaatcccactggtaaagaccagcaggcaaatatagaacatatacaagatgagtgtagcactattatcaagaatgaccatgagaagataaatcagtgtggacttgcagcaaggtctaggagctttctgaaggatgaagactgtgggatgagacccactgatgtgcacatgcatggtggtgctttgtcccagaaacctcctacctgttggcattctctccttgcacttccccctgaaagtctgctactcccagagctctagcatggctctcaccccatgctctttgccagagagattcacccacttctgtggctaaaacaaccaccatgaactactgacaaggaacctcgttctccagctcagacttttcttccaagaccttgactggttgacttctccccttgtatgacccaaaggcattgacagccagctgatctcaaatggagtttaccctctctctcttctcaccccaaacctgctgctcccctgttttctctgtctcaccaaacctgaatcaaaggagtcatct

SEQ ID NO: 75478 - DNA, 1051 bp, Homo sapiens
tcctcttgggttcagatctgagacccccaattccatcaagtgctgcagagaaaccgcagataaacttaatattaaatgctaaatatttctggagtaataatgccttataccagtaaggtgcattgtatactttttaaaaatgtttcacccctatcggtggatttggcccttacagcaaacttcctaaggtaatcaggagagctgctggtatcctgattttaagaaaaagaaactcgagtgagtccaaactccttagaaagttggttgctaaggacttggaaaagctcttcagcttcatctctggccaccctgagccctgctcggccacgtatagcgtcctgtcatcctttgttcctttcatgctgtttatcctttcctgaaacatgcagtggtggtcagggatccctcttatatgttcccacagctccctgccctgatgcccatcataccgtgtgggtcccagaaactgcaagcaccttagagcaaagattatgacttaatttgttttcatatccccagtgtgtaacagtgcctggttgatgacagggctcagcagctgatgggtgcatgagaggaggaaagaatggatgcgctagatacaggagtcctgtctattatgtgagaatcccaattcttacacaaagggaaggatggagctagagatatcacatgagtgctgaggacacttcggctgctcaagactctcttttccagatggtttgcagcttgttgtcatatgcccaggaaaggcactgaaccagccttcctccaagacccaagttagccacatcagggctggtataagtcaggaagtaatttccttcctgcttgtctcctgagtgatggctgtggtcagtggtggaccagacttcccactgtctgctctcaaaggagctcctcagctttgtaacagcacgttagttaatgaacagcttcactgtgcctctttgtgtttatcatgtgggattatatttttggtatgaaggatcagtaaagacttgggtggattcccaattttttgtcaacaaggagaattaattcttacagtcaa

SEQ ID NO: 75479 - DNA, 1097 bp, Homo sapiens
aaccccttttagcagtctgtagttacctgcaagtctctaaataatatgcttcgcacactggacttaaaactctggaacgctttgagtgttttttttaaaatctctcaagtattacaaacccacttccagcaaggtcttaaagatcctcacatggcatttttaataacagccaaagcacaggaaaaagcccgctctaaatttcctgattgcaaataaaccattgaacgctggacaggagccactcctaagtcctgcccagcacgctcagcaccatgctgggtggctcttccaggacatgcataaagggcatgatagggcagggcctggccaggacccaggatccctcactgaaggggaaggaggctgcagaaggcccctgcttaagggcacagggttgaggttcctcagcccttgccaatcattgtcaaggccacaggtcactgtagtgacttttccttcctcccaaggaggcagcctcctacccagggacgacacctctgacctccaagcaggtccagacgaaggctcatcctagagtcatagagtcagggtcctcatcctggattcagagccgcttctgctcttcctggattcagagcctcttctgcagatgggcctttccacacaaagcagtgcaatctggttcgctatggagacttcccggggcttgtggccaggcgttaaaactagactacaaatatcatgtcaggacagcaaaaatcaggaagtcagaaagtggctttcatctgtacatgaacaggagtaatagtgaacacaaaatgaaattgagatgtgtaactaacccaaaagtagatactcggaaaactgttatcatacaatgcagtgttttcctcctggctgttagatgtcttcagagaatccattgtaaactgggcaaatcttgaagactacaatgcatttgaaggatgctttcattctgtaaacctaaaataactctactgatgggagactttaaacgtctcatacagagaagacagagggctagaacccaccaagttgcggatcaattcatcagtcaccttgctcgggtttacaggactcatccctcgttcctggttctacacaattcacgggca

SEQ ID NO: 75480 - DNA, 1075 bp, Homo sapiens
atactttgcagccttttttccccctggtccctctcccgttttgattttgtgagagcgtaggtcatcctcgtaaacatatcagtagacctggggttggttattttgtcatttgtttctgtcatgggatggtttggtgtgtggggtggggaggggtctctagggaattatgagactgggaggggggtggagggaatgcaggtagctctctggatggaacggggacaggggaaagagtactgccatgaaagagataggagacacataagaggacagcagaagccctggccctggggaggcttctcggaaggcctggcttcacaggcaggccacagaaggatatcgcgggcacgtgcacccaaagcaagatagtggcttcccttttatatccaatctaatcctgattggatgtccctgaggcccctgctggaaacagccataggagagggcccatggcagtaggggaaagaaggaagaaattccctgcaacaaaacttcagctaaactttgatttgtgtattgtttacataataattttaaagggtacataatgtgtaaagagtttggatagaacctctcttcatactatggttttcgtaaaggatctgttgttgttacggattcattttttccctctatttttataagagcagcagagttgtcttctcaaaacggctgccaagctctgcttcttgggaagatggatgcagtcatgtaggcctgagctgtccgtctttcaccgttaggtgggaggagcgtatgggtggacttgaaggacatggacgtggctggaatgagcacagcattgggtgagcgcacaaggatgaggacatcatgtgatcagttatgggtttgctcgcagggcacccagagattctcaaagaatcctgcagcctctttctgtgctggatttgcttgtcacggagaggcctccctccctttccaccccacccatggggcattatcctgtcactcccagccttgctccacacacacacaggtgggtacaagttccactggaggagaaaaggcaaggatggactttttccccttgtgagaggtttgatacccagaaaat

SEQ ID NO: 75481 - DNA, 1051 bp, Homo sapiens
attggagatggctgactgcttccctgtgagggctgaggaagcacagacactggcagtgagtcatatccccacctcagccattttcactggaagattatgtctattcgctaaagataatgggaggcaattagatactttgtttatacaaaaatgcatcttagacacttcatactgaaatgtagcaatcacaaaaggtttttctttttgaatcacaaacctctcggatttattaaattagactgctgtggtgaactaagaattttaacaacttctaagatgtgaagaggaacaaaaacataaactatttactattctctcctatatcatgggtgaaaggtgagtttatatcccaagttttaaagtatattatagaaatgctcttctcatcattaaaaggtactattttagatgtgtagctcactcaaattttgatccattaataatttttgtgcttggtttgttaatgaacacttatataggacttagttgtgttcattgccagaaagagcactgtgaataaagaagaaaaaataacaaggcacttttgacatattatatgattggaattttggacatgtctaagtggaataaaacagttaagaagttactgagaaagggggagaaaagccaatcctaatagtttcttttaaaaatggattatctataaacaatttttctgacatgggaagaaaaatcaatatacataacttcactatagcaagcaaagccttcaggttggtactcgtactagattcccagggctgctatcacacagtaccgcaaactaggtggtttaaatgacagaaataaacagtctcacagttctagagactaaagttccaaaatcaaggggtcagcagaaccatactcactccagaacctgtagtgggggaggctgtccttgcctcttcccagcttctggtggtggccgtcagttgatggtgttccttggtttgagctgcgtcactccagtcgctgcctctgtcagtgtccatgtttttgttttgtcttataagaatgtcagtcatatgaggcagggtccactttactc

SEQ ID NO: 75482 - DNA, 1044 bp, Homo sapiens
gatttttttttactcatctttgaatatagactcgagtctttgggaaactcattatatatatattttttaaagagtttgaagcaactgtttgtctttataagataatgtagtaattatattggtgtaggtaacaggacatatgtaaaaactatcatctttgcagattactctgcctccaaatgcagggcctttcagagatgcattgtgattgtaattactgagttgaagctccaaccaatttgaatttgtttcttaaccttgaaaaatcattaaagccaaggtattaaaacctttgtgcattaataccttctaggggtttggttcatttggtttttgtcatgtgcaaggaaggacaatagtcctctttccaagtgtgttagcatagacttctctatatgtttctactagacctaggggatgacgtcttttaataatactggccctaaacatgtaaataatcttgtaggtgagactttttcttttgtgtttcggaaatttcctatgtggctttcagttgtctgtttgtatagcctggatttttttgaggtaaatgaaactttctcatttgtatatttggcttgatatggtcttaatattatctttccacgaaatggatatatttctagaaaatatatatttactaccataatttctaccaccacccccattttgctctgcattatacacagtagagaagaactgaagacactgctgtgacagtattgcagtccaaggcatcatgtgctcttggtgggatactctgattatcagcatcaacagtactttactgagcaagactttgaaggcctgagaagagagcaaagttatggaaagtatttaactcttattttatattgaacaaacaaggtttaatcatgtcatacatttttggttttctaagcagagactaatacaaatgcagccacataaaggcagtgtactgggggtgggagggaaggaaacaatcacataaaatcagctgactcaaaattgaggatagttaataggttgaaagggaaaaagtatgttgaaaatttagacata

SEQ ID NO: 75483 - DNA, 1024 bp, Homo sapiens
ctgtctagtattatagatgtcagaagtcatctattttctaccattattaagcaagggtttcttttttgtgaaaggtgcagttacctttagcagccaaggacgagtaaatccctttaaggtaaactcttccaagtgatgttttatattatttaaatacatttgtatacaaagaaatatttccaaatgatgagatgactctccccagacttggaggcatgaaagactgatctgtgtggaaacagaagaaagcagcacttgggctgagagttgtcttttctacttaccttctaagtacctatggttttgaaagatacctctgtctttcttggggatgtggtatttgggaatatacgtatcattcttaatttggattgtaccaaatgtatttagttctaaagatgagatggcaatacaaacttaacagaaatttcaagaaaaaataagtctcttgggattttatttttcttctttaaacatacagtgctaacactagtttgctctttaggtatcagccagttccaaagaaccagccatgtcaatgaattcagcacgttcaactaatattttagacaatatgggcaaatcatccaagaaatccactgcacttagtcgaactacaaataatgaaaagtctcccattataaagcctctgattccaaagccgaagcctaagcaggtactgtttcagctaccctcatctgcagtaagcagcatgggatctgtttgtcttcagttttgttcactgtttcagatataggataggaggttctgattgtttacaattgtcttgctagggaagtgggttcaattctgtttttgcagctaggcacagtggcacatacctgtagtcccagatactcaggaggctgaggtgggaggatcacttgagcccaggagtttgagtccagtctgggaaacataagagataccccatctgaaaaaaacaaaccccaaaacagttgtgttttttgtttcagaatcactccctattctgcctcgtgagttgttacacactttgtagcag

SEQ ID NO: 75484 - DNA, 1525 bp, Homo sapiens
ttttagtagagacggggttttgccatattggccaggctgatctcgaactcctcacctcatgatccacccatctgggcctcccaaagcactggtattacaggcgtgagccaccgtgcccagcctcccccttgaattttttaaacaaatttcttaattttcttgcaattagtagattaaagtggtatgtaatatttcatcaaatctaagccactgtttattgcatagtgcaccattactttattcatttaagccatggagacataaaaatgctgccaaactgacccaccattaattgtaattaattgtaattccaatttcagagatgttaaaacttgtaaaaatgtgcatcttagaattagggagatagagtagctagaaaactattgtctcagttttactagtagtgtcagtatctttaaaaagttttacttgatgttatttgatctcccccccccccccctttttggattagctttcttgtaaactggagcgagaattccgttgtgtggaacttgctgatctaatgactcaaaatgctgtgaatttagccattaaatatgcttctcgctctcggaaattaatactggctcaaaaactaagtgaactggctgtagagaaggcagccgaattgacagcaacccaggtggaagaggaagaagaagaagaagatttcagaaaaaagctgaatgctgggtaagaaataatttagttgtttgaattttcctttactgtcttgaatgttaagttggtctttgcatagctctttattgaataatattattttctcttagttacagcaatactgctacagagtggagccaaccaaggttcagaaatcaagttgaagaagatgctgaggacagtggagaagctgatgatgaagaaaaaccagaaatacataagcctggtgagatacattttcaagcccataaatcatgagaactatcatggatgtggcttttcccattttgcttaactgagggaaattgaatactcatactttttttcagacctctttgctatctggttgttgtatattgaggatgactatattttccccatttacattatattgctttattttaatctgtaggacagaactcgttttccaaaagtacaaattcctctgatgtttcagctaagtcaggtgagaaatatttataaatttgtaatatcaaggaaattttgcaagtcatctgcaaagtgacacatctacgcaaatacaccttaactcttaaggccacttttggtgtgtgtgtgtttatgtttttgtttttttaatctcagatgttgtttgtgaagctatggtcatttaacagatgtttataaaatgcctattgagtgtcaggcattttacttaatggtggatacagaagtcaaacagacatgtgtggttgatctctgttttaatgctattttagcccagctgagaagacagatgttgaagacagatctgggtatcactgaggaagcatgcaggatactggagaaacagttaaaaggaattgaaggctgggcgcagtgg

SEQ ID NO: 75485 - DNA, 1041 bp, Homo sapiens
acaaaaaaaaattagctgggcgtggtggcgggtgcctgtagtcccagctactcgggaggctgaggcaggagaatggcttgaacctggaaggcggagcttgcagtgggccgagatcgcgccactgccctccagcctgggtacacagcaagactccatctcgaaaaaaaaaataataataataaataaataaataaatgaaattattattatcttccagcaggtggcatagttttcactgaaactcagttttttcactttatttgtgtaaattttagtcatatcaaatccaatgttttttctttttttagttaggtcttactttatatggttaatgaaattttacgtaataatcttagattatttgcttctgttttgtgttttgcttttgaaagcaaagttgaatccttggtatgtataatatatttgaaatagggttcctttaacaacatgtagctatgtctccaagtgatttttctgttggtgtttaggtaccccttgttacgtggattcagaaggaattgttcgaatgcttaacagaggacttggtaatacgtggactcctatatgtaatacaagagagcactgcaaaggaaaatctgatcactactgggtggttggtatccatgaaaatccccagcaactaaggtgggctattaaaagaagtctaaagttgactctttttaaaaagtatgttgaaattctttttatgaggccctttaagtgtatttgtcttttatcttagtccaattacttgctttccatagtcactaaattaggaatttgttcatattcactctgaagttttcagtcacttgctttacttgaaacatgttgaacaaaatagaaataattaggatgaccttaccatcatttcagccacacagggagaggaattctgattaaacatggcatttcaccttttattactgtcttttattttaataaaataacaataaatataaaagttaaagtgaaaataaaacaatatatattcaattgagaattgaaatatacaattaagctgctttttgagatgttttg

SEQ ID NO: 75486 - DNA, 1031 bp, Homo sapiens
ggagctgcaatctttaggcaaggtagccattgttttatgtataagatcttgtttttatttttatgttcttttaagacagggtctggctctgttgtccaggctggagtgcagtggcatgatctcggctcactgcaacctccacctcctgggcttaagccatcttcctacctcagcctccttagtagctgggactacaggcatgtgccaccatgcctagctaatttttgtattttttgtagagacagggttttgccatgttgcccaggctggtctcaaactcctaggcgcaagtgatccacccaccttggcctcctaaagtgctgggattacaggcgcgagccactgcacccggctaagagctctcttcatgagaattctcattagaaaacttataaagaaggaaatatatttttctgaaagtattaaatagcaaggaggtgatacaaatcaataataagttgtgtcttttccagcagatcatacagaaaacttagaattttctagagcttcactgtttactacaataactagtatgtgtgtctgttgagcacttgaaatatggctgagatgtgcttgtatgtgtaaaatactctggattttgaagacttagcatgaaaaaagatataaaaatcaatttttttatgttgattacatgttaaatgataatatttgagatatcttcgatgaaataaaatgtattattaacattaacttcatcctttttttctttaaaaataattttttttttggctgggcatggtggctcatgcctataatcccagcactctgggaggccgaggcaggaggatcacttgagcccaggagttcaagaccagagtgggcaacatagtgagatcccatctctatttaaaatttttttttttttaaggaataaattaggagtcttgctctgttgcccaggctggagtgcaatgatgcgatctcagcttactgcaacctctgccttccgggttccagcaattctcctgcttcagccttctgagtagctgggattacaggcttgcgtcacc

SEQ ID NO: 75487 - DNA, 1045 bp, Homo sapiens
caaggatgggctgctgccgctactagtgccctgcttcttcgattgtttactattggaggggttcaaaaagaggtattcagccttgctggacctgtggtgtcaatggcaggacatggagaacagcttttcattgtttatcacagaggtagatttttttcagtcttttatgacttgaagtaaaatggaaattacttgagcttttttgctgtttttgttactctttttgtcttggattatatacttccttttgaatccgtgtaatctttaaatgtagataattttgttgtgttcactagcagcaatgaaaatgaaaatgtttcttaatagaactatattatagagagaattccaaggtggaatttggttaattacttccatgtctaaatcttaccattttggcaagcacgaccagagaactttcagcgttgaaattccacaaaaataactcctagtaggaagggccaaaacaactctgaatgtgacactttttaaaagctgctgcctcctttttcctcccctcatgtctttcttcagtccccgtcactatgctaagactggtcttatcaaggtaaccgataatctctgtgcttttttaaaaaaataattccattgaaaataccttcttctcatgacttctgtgacatcatactttcaatatttttcctcactggcagctccctttttacttttttgttggctctatcttttagctggagtgtatcccctttttctctactactctctaggtcagggtctttcagtctttttgtctgctttgccacagtaagaaatagattcatagattctggaccaggtatggtgtggtgtggtgtggtggctcacacctgtaatctcagcactttgggaggccgaggcgggagagttgctttagcccaggagttcaatacaagtctggatagcaatagcaagcccctgtttctatttttaaaagaaaaacagaagaaaagaaatatattctatataactgttctataaatatctgcaaatgtaactgaaataaaagtctcctggacaatgtttactc

SEQ ID NO: 75488 - DNA, 1051 bp, Homo sapiens
gtgcttttttttttttttactattataagagtaatatacattcattgtaaagaaaaaaaaccagtatacagtatagaagtttcggaaaatgaaaactcctcccagaattctactctcagatataactgctatttacaatttgatatgtatccttccagatttctttctatttgaacctcccttattttaatttactttattgagatgtaatttatttacaataaaatgcacccatttgatgagttgacaaaggtgtatatacacagataacccctaccacaatcaaaatacagaatgttctttatcacccgaaaatgttttcttatatccctttgcagttagttcaaccctagccttggccaactattagtctagatttttgtcactacgtctttatcacccaagaatgttttcttatatccctttgcagttaattcaacctgagccttggccaactattaatctacatttttgtcatgatggattaaatttaaaatctctcttcgagaaaggaaaaaaaaacggaaaaacaaaccaaaaaatgtactagtcacccgtttgctttttctacttaatattttttggatgtttacatgttttgataagtaggtaggtaagtaaataggtagatagatgtcaagaaaaaaattatgatgggaaagcaatgggtgcagaatgtttttcttttcaaaagaaaagaaaatattttttcagctttttgttaatcaagagattgccctctcttgatcccttcttcagctgattatagtactgatacacttcatggattttactatcttctatgtgatttgaaatttgtatccttcaggctgggcatggtggctcacgcctgtaatcccggcactttgggaggccaaggcggacagatgacctgagctcaagagtttgagaccagcctgaccaacatggtgaaactgcatctctactaaaaatgcaaaaattaaccaggtgcagtggcacccacctgtagtcccagctactcgggaggctgaggcaagagacaggagaattgcttgaacctgggaggcgg

SEQ ID NO: 75489 - DNA, 1089 bp, Homo sapiens
ctcaaatgttatcattggcaacaaattctgccagttattttttcttaattgataggctcacttcattcatttacaagaaaatgtttgccaaagatccaattctgcataaccgtagtttatctggcatgtgttttttaagtaaaagtagtgttgtatgaaaaaaaatcacttagttcagcttacaactcaaacaattgcataagtgctttttttcaagacaaccatcacacttctcattttagcacacagaactttaaaaaaaaaatctgtgtaagcgtcaagatttaataaaattaatatttttactgcaagtgagtagtggttaacaatgcagtaacgactaatacagttaggtgccactgccttgattggtgccaaggcaccaggaattttacccaccattgcttttgcaccatcactgcatctctttaacacagtgaaagaggcaaatagcatgtcagtgtcattgaatatgaatgaaaaagttactagattccataatgctttcctttttccaaatcattggtattcgtgattcccttaattatgatcctttgtgttgtagatatttcaatgctaaaaactggttctagtcttctcaaagaggaggaggaagatggtcaagaaggcagcattcacaatctaccacttgtaacatcccaaaggccattttatgatggacccatgccaactccccggcaaaagccatttcagtcaggttctacaccgttgcatctcactcacagattcatggtaagacttggatctacacttaacttcttagtaggttttcagcacttttttcttactatagttaatttttttggataaaacatatttttaaaaactttgattaagtagcctggagcactttggttgattacagttttgtggttggtttattttatggttagctcacagttttaatcttgtttcaaccttattgaaaatgatgttaaataaaattctgctttccaaaatgacattaaatgaacataagtaaatattactatcttgcaatatttcttggcaatactttcaaaccttattcttcatggtcattgttacatagaagattatactgactcc

SEQ ID NO: 75490 - DNA, 1043 bp, Homo sapiens
tttgtttttctattggttctatcactttatttttataagtatcaaaacactaactttaactgagataatataaagaaaatgtatcttatgcagtattttgttcaaaataaaagtaaatgagagactgtcttacaatatgacagactttatagggactttatcatattaatatcacttcttttctagggaatgacttctgaggaataaaatcttattttatattttggcatatacagtatttgtttacatgtcagtccctatactcccatcccatccccagactacaaggcatttgaaataaggactgggtcttattgtgtaaatataaatacaattctcataaatacatttactaattattcttatctgttcagtgagtttgctgcttggtagaatttataggtgcatattaaaagtttacctttttagtaattgagtttttctaaatcattcacttttactttataatttgtattaatttgttcaaggtatctagcagagtggaaaaggattataatgatctttttgatggagatgatatgagtaatgctggtgattttctaaatgacaatgcagttgagatcccttctttttcaaaagggattataaatgatgatgaggatgatgaagacctcatgatggcttcaggtcgtcctagacagcgaagtcacatcctagaagatgatgaaaactcagttggtaagaatttgactttgtgcatgtgattaccctgttgattaatattttagattttttattaacactattaaagtcattattgaatttgtagaatgtagctaagtggtgcttagaggaaattttatagcattaaatgactttgttaaaaaaggtttcaaatctataatccaagcttctgctatggcagactagaaaaagagaaaactaaaccccaagcaaatggaaggaaataatacagagcaaaattcaataaaattgacaacagaaaacctatagagaaagtcaatgagaccaaaagctggttctttgacaagatcaataaggccgggcacggtggctcacgt

SEQ ID NO: 75491 - DNA, 1035 bp, Homo sapiens
aagaaaattgaatttggtaataaaatgagtatttagtttgaaattttacaaaatcattatttattaactgtttttctttacagaccctcaatatagtaacctggtctccctgtgggcaatatttagctgcaggtagtattaatggtctaatcatagtttggaatgtggaaaccaaagactgcatggaaaggtatgatttagtgtatcttttgtctcttctttgctcatctctattagttttgtatttgttttattttgaaacatttcaaatttgccatcagattgtcagaatgaaagtataattaaatttatattatttataaattattgtcaaaagtcatttattctttcctaactaaaatttacctaaagaaatgtacaatttatatttttcttgacagtatttttagaacctactttttaatttttagggtgaaacatgagaaaggttatgcaatttgtggtctggcatggcatcctacttgtggtcgaatatcgtatactgatgcggaaggaaatctagggcttctagagaatgtttgtgaccccagtggaaagacatcaagcagtaaggtaaaagggagtatggtacaacagtttcttcaaaatgtttctgtgatcatatggatttggaagacaccacaaactgccttactttcttggaaaattacctttcatgttactatagtagatgctgagtagtaatctatagtaagaaaacttcttacttgttcaacctgatgtctcccaagtgtattttactaagaaacttttttctctccatataatgcctttccaaggaatacctttcattaaatactattttgtatcaggtctcagtttggcctgcaaactgtttctactctgaattagccttaactcttagaactacctatacacctcctctgcttagtcaaacagctttactgagcaactttaaacaggcaccttgttttataccttcttgcttttgttcattattcaccctgcctggcagatgtacctatttatattcaagtcttagtttagacttct

SEQ ID NO: 75492 - DNA, 1168 bp, Homo sapiens
ctcaaacaaatgggaggaatttttatatcagaaggacctagattccttaagaagtagtattgaaggtcaggcatggtgtctcacgctgtaatctcagcactttgggaggctgaggcaggaggatcacttgaggccagagttcagtatcagcttgagcaacacagtgagaccccatctctacaaaaaaacaggaaaaaaattagttgggctgtagtcctagctatttgggaggctgaagcaggaggatcctttgaccccaggagtttgaggctcagtaagctgtgatcacaccactgcactccagcctgggtgacagagcaagactgtctcttgggggaaaaaaaagtaatcatatttaaagtactagtaattacaagttctccattttttgggtgcaagcaatagagtgatcacctttatttttttctcttcccatgacaaattatcacctattttttgcttattgaagttttaagtaatgttctgagtttcattagttgccaattaaaatacagatttgcgcctggcacagtggtgtatgcctgtagtcccagctacttaggaggctgagccaggaagatcccttgaacccaggagttagagaccaacctgggcaacatagtgagacaccgtctcttaaaaacagaaacaataaaaactaatttgcttttatgtcttgtaaatatatctgaatgaattttgtgcctttttccttcttcaaattcaatttaatgtaaacttttgtttacgttgtttatcttttctaatagttactggcaattcctgtggaaaaatctgttaagctatatagaagagaatcttggagtcatcaatttgatctttcagataatttcatctctcaggtaggttttacaaagtgacactttcagtgggctataaggagcagttaatgcgtagtttgcctgaatacagttgcagttaaatattattggaatggaaaacaactcctggctgttgtatgtggtccatcttctaacagctcatcctttcttcatttgatcaataactggatactaaataggtctttgttataagaagtcagatttaacccttgcatagtattagaacaagttgttctaaaatgatcagtagttagcctttattgttaagtgagtttcactgagacttgtgatcatggactctgaaa

SEQ ID NO: 75493 - DNA, 2847 bp, Homo sapiens
ggaggcttggctttttcttatccacactgaaaattagctatgagaaaggaactcactcttcactctatggcactattaagttatcatgtatattatataatatatagcatgttatttaagtgggaacaaagtgtcttgggactcccttccaacatctctttttcatgtactaactgtgcttttccctcttgtgtctaatagaagcttaatatgtaaactagacaaggtagatgacaaatggttaatgacttttttttgttttctttagatacatccagaaagtgcccagaagaaacttcctgctggaaaaaatgaaaaagcagtatttataacattagaatctggataatttgttaacatggcagaaaataatgaaaatattagtaaaaatgtagatgtaaggcccaaaactagtcggagcagaagtgccgacagaaaagacggttatgtgtggagtggaaagaagttatcttggtcaaaaaagagtgagagttattcagatgctgagacagtgaatggtatagagaaaaccgaagtgtctttaaggaaccaagaaaggaagcacagctgttcatccattgagttggacttagatcattcctgtgggcatcgatttttaggccgatctcttaaacagaaactgcaagatgccgtggggcagtgttttccaataaagaattgtagtagtcggcactcttcagggcttccgtctaaaaggaaaattcatatcagtgaactcatgttagataagtgtcctttcccacctcgatcagatttagcctttaggtggcattttattaaacgacacactgctcctataaattccaaatcagatgaatgggtaagcacagacttgtctcagactgaattgagggatggtcagctaaaacgaagaaatatggaagaaaatataaactgtttctcacataccaatgttcagccctgtgtcataaccaccgacaatgctttgtgtagagaaggtcctatgactggctctgtgatgaacctggtttcaaataacagtatagaagatagtgatatggattccgatgatgaaattctaacactttgcacaagttccagaaaaagaaacaaacccaaatgggatttggatgatgaaatcctgcagttggaaacacctcctaaataccacacgcagattgattatgtccactgtcttgtaccagacctccttcagatcaataacaacccatgttactggggagtgatggataaatacgcagccgaagcactactggaaggaaaaccagagggtacctttttacttcgagactcagcacaggaagactatttattctctgttagttttagacgctatagtcgttctcttcatgctagaattgaacagtggaatcacaactttagctttgatgcacatgacccctgtgtcttccattctcctgacattactgggctcctagaacattataaggacccaagcgcctgtatgttctttgaaccacttctatccactcccttaattcggactttccctttttccctgcagcatatatgcagaacagttatttgtaactgtacaacttatgatggcatcgatgcccttccaattccttcttctatgaaattatatctgaaggaatatcattataaatcaaaagttagagtactcaggattgatgcaccagaacagcaatgctagtaacaggatgggaacatgggaatgataatatatattttttcttttaatattttatttttctttttatgccactttggatttttctacaaaggcagtggtgtccaaaataaaatctctgccctaaattttactaataaatccatttttctagtgatacacaaattgtttaaggttatacactcgagcttaaatagatatttttaaccaggtgtttggtttttgtttttaccgtgtaggttgtatacttacattttttctttccttaatttatacatgatcctttttccttaatttatacatgatccaggcacatttgaaatttggtaggcattgcaaacacatttgaatattgtgtatttcatactattctttaaaagtaatcttatgtcctttcctacatgtaaaatattttgttaatctatgccattagtagtattatatataaaatatagttccccgtcccccttttcattgagtttgatattcttcagtaaagctgaatgttgtaattcaccattcatactaatgttattgacttttgtaacttactaatagggatgttaaaagtaacaaaaccaagtcaaacttggtgtatttttattttaaatattaactctaaagcaggattactaaatttgattaatctggtcaatgagaatcaaatggaaacatatcattctggaggtgcacttactcttctacaatgtggccggatcatttgtcattcctgaataggtctttctctcaacctgcaagagctaaaccatcttcaaaacataaatcttgttcctttctcattggaagctttgaaaataatgataacactattagtagctagtagttactaaagtgctaaagtaattgtggggtttttctgtattagcttatgaactgttgcttctacttagcccttttatagaaactctgagctgttactttggggaaattccacaatgtattagcagccacaaatttccactggtaaccaaagagtacctaagtagtttttcattattttaagttgaatttgaataaagattccagaaataaacatggagctcagtattcaggaagcttaatactgtttttgatctacaagatccaaataattatccctatcttcagaattaacttagtctgtaatgtggcttcaaaaaaagaaagcc

SEQ ID NO: 75494 - DNA, 3567 bp, Homo sapiens
taacatgaaaatggcatttttccataatagctttaaaataattttttagtaattattacaaaattaaggaaaatctctattaccgttatcttttagcattttttttttcctcagtgatctcaagattgtcttagtctcaatgagatgtagctacaaaaatggcacctcttagcagtgatgaggctcaggatatcggatatcataacaccaatgtcaggataaatatctcttctaaagacgatatttaccttttacaaggttagaaaagtctcatactacctcatctttattgtggcgcttttgtagatcactgagaagcttatcttattaaccaatataccacttcctaaatatccatctttggtgaaagaaaatagtgtggtaagagtacccatgattatagttttttatcagaatttgataagattttctgtttctgtgaaacaattattttaaatatttttcttttaaaaataactttttatcagtacagaaaaacctaagggatgactagcttacaaatattctgttaaggggtagttttataaagaaaaatgatatatagttatgttgtcttttatagtgttaaaattagtatttatatgaaagtcaagatctaagtaccttttcatataattcaaactgattgcttgtgatatgttttctctggcttttttattttttcaacttcaaggtattaacagctgttaacacttaaaaagtactgccacatatgtagccttgaagtagttgatctaataaatgagagcagggaggagattcattgactctgaaatgatttttatttttcctttggtatttgctacagtgaaaagaagtttggaaagtagatacataaagacttgagaagggaattgtttaagggaaaagaaaagagtaataattttttttaaaacattaaggaattggaattcagaaaggttacccccttcctctgtgtctttgtaaggatacatttggaagaacatacagtattcagaaactaacctatataaaatgtaaacaatatattgattgcactatataaatgagtaaattttgagaggaacaatgtgggaatgtataaatttgtctaaaattttataactgttgaacaaagggaagatttgaacagtgtaaattccagagttgagaaagcatttagcatggtggaaatgtggagagcttattggtgagagaggatggagctaagagaaataagatcaaatattaaaattaggaatttaggcattacctcagggaaaagccttgacagtgaaaagaaactacttaatcgctaatagctagtctggaccagacacttaactgcgctttgggaatcatcctgggctaatcaggaaataaacttgacttttctatttttctctgaagctttacaggacatactcccactcccatttttttctaagcctacagcatcttgattcatagtataattcctgaagtatgctgaatggactttttaaggttcctttagcatttttgtatagagttatatgtgatctttctataaccatgccattcacttaaataattcatgaagggaatggtttaatttaaaggaagacctaataggaagaagattaaaggaagcttttagtcagcctgtggctagatttattgatttggtgatcaaacctgtgctatttcctgaatttcagctaatggccaactgtggtcaaagaatggctttcagttaaagttttgacttcttattataaataatataaagaatgtctcagtaattagaaatcccttaataagtagaacaaatgtggcaagtaggactcctatcggtatacaaattccatttctttttataagaaaaacacataaaccattatcatttattcatgagccaaagccattaagaagataaatccagttatcagcttcctgtctctgaagtttggatcattttatagatccacgcaatagagagcttccttcctatgaaacaaaaaccttgagatctctttttttttgagacagagtctcgctgttgtcagcccaggctggagtgcaatggcgcaatctcggttcactgcaacctctgccttccaggttccagcaattctcctacctcagctcccaagtagctgagatgacaggcgtgtgccaccacgcccagctaatttttgtatttttagtagcgatggtgtttcactacattggccaggctggtctcgaactcctgacctcaggtgaccacccgcctcagcctcccaaagtgctgggattacaggcatgagccactgtgcccggccaagatctaactcacgcttacttttcattaaaatatttcttgtcgcttttagctattgtcagaatccaataaacagcttacgcattcattttggtaaagcaaatttcacaggaaaatagacaaaattataagagattcctggagacaacacaaggaaaacaatgtttaaaagcaaaatagcctgtgtaatgttaggtaatgtaatgcccaagtgaataaaagatttttcgtcaagcaaactactgtttctactttgggggaaaaaagtcagttttacatttgtaatttaaggaaagaacagaaagcacaaaggtttttcttttctttattaatggcctactagaaatgagcagtgcaagagtctacctgtactattctaatacagtaagatattggacacaaaatggaggtaactttttaaaatagattggcttggaagttgaaatgtagattaatggatataacccaatagaaagggattttcaaataaaaccaaagtctatttttttatttactttctaattttgaacagatgactcagtcctaaatctttgcctttatttcctataaaatgtaggtgatacttgtaactcgacttcctggagttaattcttcagcaagaggtgaccctgggagcgtactttaaaataattgctgtacagccattgagtactaacatgatgataggttttcaaaatatctttgtagtggatgctgcataattacattcacttctcttagactgtaaaagactttcttgacttgttttaacagtagagatagcagtacaatttgaatttatggtttaggctctgcaattagaggaacaattgcagtttcctcctacccttcatatggtctgtgtaaaactgatgtttgcttaacttattttaaaagttgattacgttttcagaaaataaagataatcacttttgccatggttataatcaaatctaagctttcagacttgagagccatggtgtaaaactcaaggaggtttatttaaattatgctgactttgctagaattggataaattctgtataagccaagtatgagttcacatgtactcgaatatacagttttcacaaagctattactctcatcagtcaggcttgtatgatctattccttaccacaaaagaagtagacaattgccacttttatttctaatccttaagttgaatgtttcttcttggatgtaagttcaaataaattgatctggataaattttcatttctacttaattaaaacttcctatgtaaaatccaaaggctttgtg

SEQ ID NO: 75495 - DNA, 2460 bp, Homo sapiens
tgcaaacgtcttccctttcctgtattaatattttccctctccccacttttggcccgaggatctgagtcctcgggtcaggccgaaatcagaccgcgtccatacccagcctccttcgaggcctagctgtaaaaaccgctgagcaaaaggaatccagaatcagccctcaagcaactcaagacaagttagcaatttccgccgggaagccgtgaacatcggcagccactggcgtttcctccgagtcctcggaactccggaaactctgggagcttttagcccgcccaccaggggaaagcggcccggagccggcgccaggtggagcccatccccctaggcctggcgggccgcagtaccgccaggggcctgcgggaggcgcacgcggcgcggcctgaggggagggggagaacgggcggaggcggtgcgctcggcgcttcctgttccggcgccaggaggagccgcgcgctgctggtgctgttgccgccgctgctctagctgccgtcagtcaggctgcgcccgcgtcttcagggcccagtccctcggacccatcgccgcttctagaccctactgcggtctcggatattgccgggtgaggctgcttcggtactagtgggagtcgtgaaggggaatcggggagctggggttgcggagcccgcgggcgcggccaagcgggaagcgggcgcggtgaccgaggtgcatcgagtcacgtccagtgctcgggccgtggtcgcctgcctggcaccaggactaagcgtttctatcggtcgccttcctccacgctgcgggctgcctggggatcgccccccagggagaaggtgtcggaggccgctgacgtcgcgcccgacgggtttctgggcgcctgacgtcaggtctggctgcggggcggggcgggcgcgggccggcccctcccccaccccttcccggcgggcgcgacccgctaggaggccggttcgctccggttgatcccggactccctttgttcgtgcgtccctaaacggctgccggcctcgcgccccttggccccgatttcccctctacccccaccctattacactcattcattaatttttaataaaaagggaaaggcctgaaaagattcttacaagagtctcgggcgcttgttaatccgcagtgtgacaacgttctggttatgacttactagaggaattgctcacggatacattagatgaatacccagggcaaaccacgagaagggcagaattcagtgatctccttttttaggactgaggagcacatacctgcgatagcgtatgcatagctggaccgttttcctctttaccttgaaaagcaagagtacagcttttaataggtaaagattccagtgttaaagcatgaagccaggctcactcgaccgcaagaattttttttagttttactactagagaaatacacacctgggggttgtaaaggtctgtttcgaaaaggaaccctcattacaggcaaaggtagccttcagaaacatttcataagttctttgttcactggtgttctttgggggaagaatagaaatttttcatgctggcatctctgagcccacaatgcaaagcgagtttgcttcagaaacttggagtgaattgcaaatattggaatgttcttttcctcactccaggcggaatgggtaaaatccatccccagtctcttaactgaaacttttgaagctagtgtgttttgaattcaaaaatacttggattttatcttcatctttttagaaagtcatgttagacgagagataacacccccagcagagtggggcaccccataatccaacattaatatttgcagcaatagatgtgaacattcattctaagtgggggcgaatagaaactataaatagcttcaggtcacattttgccaccatgtaagttttgtgccaaactagggcagataaagatttatggacctaaaagtaggcatcataaaagctaatatttgttgaggttttgctatattccaggcagcgactaagagatttgtttattaaaagttttacagcaaatctatgatgtgggtacgattccgatcttcctttgcctcaagtttggagagttggacttgtcaactctggccgaaccaaccagtgaagagctgcagttatagctagataatcatactttaacgtttacttttttacctataagctagatgtccacatacaaagaaaagagaatttggtatttgttttccacccaagcactatttttttaggcacttgattggacagagtcccatttagttcctcgcaacattactggcctggtttttatttgttttgttttttaaactgcgtgctttttacaaatagtatggcctgttctttatagttcgggttcattcagatgagccgacttttagtgaaataattcaaaccctcgtctaaggtcactctgctaagactttaatacaacccttccctttctcgctatattctaacccatctgaactgct

SEQ ID NO: 75496 - DNA, 3750 bp, Homo sapiens
ttttttttttttttttttttttttgatatggagtagccctccgttgcccaggctggagtgcagtggcgcaatctcggctcactgcaagctccgcctcccaggttcatgccattctcctgcctcagcctcccaagtagctgggactacaggcacccgccaccacactgggctaatcgtttttttgtatttttagtagagacggggtttcaccgtgttagccaggatggtctcgatctcttgacctcgtgatccgcctgcctcggcctcccaaagtgctgggattataggcgtgagccactgcacccggccaaaaaattttaatctcatatatgaaagctagtctgcttagtatcttacaaagcagtgagagaaaaagatgtgctactgagtaataaaatgatcaaaggcaaagagtacctacagtcttttatttatataaagtcaaagaacaagcaaaattaagtcaaaaattgactgccatgaggcaaggtagttgattggaaaagagcatgagtaaactttctggagtgagaaatgttctgtatcttggggtggttataggggcgtatacaattatcagagcttgttaatctgaacacttaagatctctgcattttgttgagtgctaattacacttcaatttaaaaattggtaaaagtactccaggacatcaataaatttaaatttgggagtacacacagtggctcatggctataatcccaatactttgggaggctgaggcaggagggtcctttgatcccaggagtttgagaccgggtctgggcaacatagtgagacacctgtctctgcaataaatttttaaaattttaagaaatttgctgggcatgatggcacacacctgtagtaccggctattagggagactgaggcaagaagatgacttgagcccaggaggtcaagattgcagtgagctgtgatctctctcgccactgcactccagcctgggtgacagaatgagaccctgtctccaaaaaaaagacgaggaaatgtaagttaaaataagacgctaatttttaatatctattgtcattataaacaataaatttaataatatccagtggtaaaaggagttagagaaatgagtgtaaattggcatggacttttcaaatggattttagataaatttatctgttgactctaaattccatgtccagtgctttttcctggtgttagattctcacacacaaacaaagaagtgttgagagatgttcactgtatcatacttaaaacaacttatactgctacaaaaagaaggtaaattaaattgcaaatcatttttgtatgatgtgcagccattaaaagggatgaagttaatagagctgtatgaactattatggaaaactttcctatgtaaagaaaaacacattacataaataagattccgcttaagtaataataatgtatgcatagaaagttccttaaggaatatttaagaaatggtgaacactgattttgaaatttttctttcttccttcatttcttttctttttttaggaaaatgtctgatgaattttcggtaagttgatcagtttatctgtgataagtttttcatctcttaagaaaaacaacatggtcctaactgggctacgtaaatcttttcacttaaaagagatgctttaaccaggcatggtggtgtgcacctgtagtcctagctacttgggaggatcccttgaccccaagagtttcaggctgcagtgagccatgattgtgccattgcactcctgcctgggtgacagagtgagactctgtctataaataaataaaagagatgctttttgtgattcttggctttgggggtagtaaagagattttgataggtgatttgccttagtttactgagataatagcatgtttggaaatgtttcctgtatttatgaaaatatgtatttctttaaatgaaaatttaagatgttacttctgttgttctcttttaccctgatagtattaatagccaacatttattagaaattattatataccaggcactctgtgaaagtgtactacatgaaatatcatatttaagcctcaagttaaccctaaaacagttttgaaactgaagaggctctatctcagagtatgtagctcctttgaggttaagccaggattcaaatccatatcttgactgttagttctatcttcttaattactgtattttgttgtattaatacagcagagaaatgaagcacaatatgattagttgtatttagaaaacgagtttctctgaagaatttgcactgtaaagttgatacgcaaagtagcatctcaaggtttatgttaaatagagtattttttaaatgactagcttagcttttgaagatattcttgaggtttataatccctgcccctataggttactattctctgtgggtttataatggtgttcgatgtaacttttccctagataggaaagacgtatctgttttgtgttccagttggcagatgcactacctgaacactcccctgccaaaacctctgctgtgagcaatacaaaacctggccaacctcctcaaggctggccaggctccaacccttggaataatccgagtgctccatcttcagtgccatctggactcccaccaagtgcaacaccctccactgtgccttttggaccagcaccaacaggaatgtatccctccgtgcctcccaccggaccacctccaggacccccagcaccctttcctccttccggaccatcatgtcccccacctggtggtccttatccagccccaactgtgccgggccctggccccacagggccatatcctacaccaaatatgccctttccagagctacccagaccatatggtgcacccacagatccagctgcagctggtcctttaggtccatggggatccatgtcttctggaccttgggcgccaggaatgggagggcagtatcctacccctaatatgccatatccatctccaggcccatatcccgctcctcctcctccccaagcccctggggcagcaccacctgttccatggggcaccgttccaccaggagcctggggaccaccagcaccatatcctgcccctacaggatcgtatcccacaccaggactctatcctactcccagtaatcctttccaagtgccttcaggaccttctggtgctccaccaatgcctggtggcccccatgtgagtgttcaatttgttatttaaagtgtactaattgtacatagcacaactgacattgtttctccccagttttggatggaagattaagaaggcttttaagtttttaaaagagggtgtgtgtatattaaataagtaaatttcaaaccttcaggtaaagcatttaaaaggatgaaagcactgttttaagtattccttgtgctaaaaagaagaattttccaaagatccccaaagactttgtaatgtagtaagcagtgtcctcaatagcatcctttaggtaaactctgagattcatttcattgggctttttgttttattattattatttctcagtattgttttatagcatcacaccaaagtacagttcagtaaaagcagtctctacctgtctagcttgatagaggtagatttttagagaatccaaggcaatgagtaggtaatgttcatctttcaagcagttctcgagctcaagattacacccctattctttattgtcagttacatgtaatgctttatgctttactgtcagacaacccagtgtggggttaacatcttagttgaggagcctgccttggtcatataaccaaatggaa

SEQ ID NO: 75497 - DNA, 1409 bp, Homo sapiens
ctcctgacctcaagtgatccgcctgcttcagcctcccaaagtgctgggattacaggcctgagccaccatgcccagccaggaaaaaaaaaaaatctgttaactcttagtacgaaaataactagccagatctctgattagattagtcaaacatccaatccagctataaaggaaaagaaatctttaaagtacccctaaaacttcctccttgcattagtgtaatttctttcttgctatatatattatctaaaaatatttgttttgcaaagtgtatgccagagtaaatgatgtgacttgctgtttggatttattaagcaataaatttactttaagccacagtaaggagttaataaactccatttgcaaaatctagaagttgactttttcttttttctattgcagtcttaccattaagttaacaatggacgaagagatgacgctttgctttttgaagtacatgtatatgcacatgaatgcatatataaaaattgctggtttcactattagagggcattcatgaaagaacaactcttgcacctctcagagaagataactgcctcttgtacttggatgcgtagtacatcatatgtatacaatcagataaaagcatagaagtaaatcattcggatgtgatttttatttggttttcatggaaagttaaagtgataaagtatattgaatagttctttgacagaatttgtttaaactatgaaactacacacttaaaaatctaagatgtggattattgttagaatctgcaacttcattggcaaattatttcaagtatttttctataatcactttccccttctaaataaataaacttcgagaataacccatcataatccaaacaaatgatgcctcaacattttgagctgctctgtcggacaaataaacctggtcctcttgaggttatattttggatatacatttttaaactgtcagtaattattgtcagatgtggagttcaatagccagccagtgttcatttttatccttgagcttttagtaaaaacttcctggttttatttttagtcattgggtcatacagcactaaagtctgctatttatggaaactaacttttttgtttttaatccaggccaacatgtatgtaaattaaatttttagataattgattatctctttgtactacttgagatttgattatgagatgtgcatattgctttgggaagagctcgaggaaggaaataattctctcctttgttttgaacctcaaactagataaaccctaggaattgcttaactgcaacaagtaattttcattcccacaaaaacctgaggcagctcttttgcccagagcgttccctgtagccacccccaccccacttgcccttggttctttagaaggagcacacacatcccttgattcctccctgatgtggtaaactgg

SEQ ID NO: 75498 - DNA, 1038 bp, Homo sapiens
agaggctcatagtctataagtaacattacagaatttgttagcatacccattcattattagttttacctaaacgtgttaggatcactactggtggaaattgtaaccagcctttgggcatcttaaagggtgacatgtggcatgcctttttttttttttaagaatttaatgtttttcaagattgtagtgttgatcagcgcaacaattcaagtgtgcaaagtaacaggatagtttgcctcttcactttacccctggataaaggcactttcactgcctgtcactgatcagcagatactgacttgttgccattaagtgaacttgacttcttatgtgtgctctatgagtttgttgtaattttcttcttgaaattgtgatttttcactgacagtaatgacaaatttaatgtatgtaattgtctatgcattttaagttaaactgcctaaaatgtgatttgagacatatacatatgtttgtattataaattgtaagcaatcagtttgagatactaggttttatcacctgctgctgtatttgtaaacaaagacaaatgttgctttaagaagtaattataattaggaataggctatggatgtgatacttggtattttttaagataaacttgtttgcttttgtgtattatacctggaaactttttttaaaaaatgtattttcatggtttcacagatttttcatgttattttattctttaggcccaattctgggcttctctgagcaagtccagagcctaattaactgtaaatttgttgtcaaaaaggaagaaaaaagggcctgagatacctctttgcatgtgacctgcattcactaaggatatctggaaaccacccttcctccgcaaaccctctcagcaacatggtgtccattgtggtgattttctcttcttttaaggctaggctactcttggtaaccagattatccgtatatatgataatatgaagtcagggaactttctctgtctgtccctactcccctcactcccccactttctgttatgaaagatagttctacttttatcattaactg

SEQ ID NO: 75499 - DNA, 1075 bp, Homo sapiens
gagtgggatggtggctatacatgagtattcatttgacttatttaactccaaatatatgtcattctcttgcatatataatttacatgtttttaaaagcatatgggacctgagaacctaatattgaaagaaaactccagtttcactcagactgtctttgagagaggcagacaagcctaacttcagtggtgactgatgtctgaggcatgtaacagtagcacgaggctgtgcctagcatccatggtttccttttatgctgataactgaaaatctcaattactttaggaaacagggctgtcatttagaacacaagagcataaaagggtcttcccagtagtccactcagtctagtgtcctgtctgacaatggcatccagaaatgtttttgtgaaagagcataactgggtcataaacccagcatgccagacccagctctgcaccaatggggaggcaattgtcaagcattcaattgtgtaaagcattatgttgagccagtacaacaagaatcgcagaataaagatagccccacaaatacggaagacaatagggatggtatttttcactgtgctattagggagaaaaatgagaaaaacataattagagtgaggacagaggcagcgtagtatagaggtagagagcaggctgggcgtggtgtctcacgcctgtaatcccagcattttgggaggctgaggtgggaggatcacttgaggtcaggagtttgagaccagcctggccaacgtggtgaaacctcatctctactaaaaatacaaaaattagctgggcgtggtggtgcgtgcctgtagcgccagctacttgggaggctgagacagaagaattgcttgaacctgggaggcggaggttgcagtgagccgagatagtgctactgcactccagcctgggcgacacagcgagactccatctcaaaaaaaaaaaaaaaaaaaaaaacaaaagaaaacaaacaaacaaacaaaaacagaggtaaagagcacaggttctggaacctggccagctgtgtttaaatcgtgactccactgcttactacatagatcacactggctgaattacttaaccttgtagtg

SEQ ID NO: 75500 - DNA, 2129 bp, Homo sapiens
gtccaaaactaatctatctggatcacgcctgatcttgcaccaggctccatgtttgatccattccctaaactaattgccatcattaaaggaaagactcaaaatacaagtgaaacaataacaatatgtttatgagtgtaatgctgctttttttcttctttaggagcagcatagaagatgctcagtgtcctggattaccagatttaattgaagaaaatcatgtaagtacaattccagtgtggttagatagcccagtatgtcatatgtttatatcattatagaaagtaactttgtaaagcatccccagaatttccgttggaaatctaaatcagtcatgtagaattgtagttcttgtttcaatgacatttgggttgtttaaaaccatagtgtcattttgtattcttcaactcatatcagaatgaatatggaaccagtgaactagagcagaaatcagcaaactttggcccctatttttacaaatcatattttattgtaatagccacacatttgtttatgtattctatctggctgcttttgcaatacagtggtagagttgagtacttatgacagagaccctgtgactcacaaacctaaaatatttactatttgatcttttacagaaaatgtttgccagtccctgagctagagtataggtacttgctgagaaacttgccttcaatcatactatttctataatattatctgaactaattgttgaagaagcaggatagtaggatttataatgttcttaagactgtgtccgggatgtcatccttctgtttttcttgtatttaatagcaacaagacttttaaaatttgttccaagtaattaaattgataattaaatataatgccatttttacttccaggttgtaaataagacagacttgaaggtggattgtttatccagtgagagaatgagtttgcctcttcttgctggtggagtagcagatgatattaatactaacaaaaaagaaggaatttcagatgttgtggaaggaatggaactgaattcttcaattacatcacaggatgttttgatgagtagccctgaaaaaaatacagcttcacaaaatagcatcttagaagaaggggaaactaaaatttctcagtcaggtgagatatttaaaatatatttaaacgagcctttattaaagaaatgaacttggattaaggtataaattatcctataaggtccattttacattagatctaactattgaggatccttcattgttagtgaagaccctgaattagaacaattccctcaagattttttttttttttgagatggagtctcactctgttgcccaggctggagtgtagtcgtgtgatctcagctcactgcaacctccacctcccaggttgaggcgattctcctacacatgtaccaccgcgcctagctaatttttttatttttagtagagacagagtttcaccacattggccagcctgggctttttttttagttgtccttttcaacacatatccccaagtctttcttcaaaatatcctatttttcttccctactgcctagttctacctatattgttgtgatggttctgcaataggaaatggctcctatatttttgttataatgtgtgccagttttacctgccattttcatcagttagtctgtagctggtctaactggggcctatggtaaaacaaaaggttttaacctcggccagacatttaatgtcctccagctgttcttcatcagcattttctgggtacctttaatgttacaagcatgagatttgtttacagaagtctgcttttataccaaagttaaggataagaatttaactactttcaaaaaacattatagcataggggtctatatttttgtcttagcatttgatatgtggaacttttcatatttttcatggctttgtccatttctaacagccctcgaatgtgagaatattctttaaaaagtttttttttgttgtttttcagaactatttgataataaaagtctcactactgaatgccaccttcttgattcagtaagttttccaacttgacaagtccctttatattctagatttgttttataaaatgaatattgcttttctatttgtgtacaaggcttaaaatgtatatcttgtcattgttttgcttactca

SEQ ID NO: 75501 - DNA, 1008 bp, Homo sapiens
tgggaatctgaggcaggtggatcacctgaggtcaggagttcgagaccagcctggccaacatggtgaaacctcatctctactaaaaatacaaaaattagccaggcgtggtggcatgcatctgtagtcccagctactggggaggctgaggcaagagaatcacttgaagctgggaggcggaggttgcagtgagccgagagatcacaccactgcactccagcctgggtgacagtgtaagactctgtctcaacaacaacaaaaaaattatctctgttcatgtaaaagtagtgggatgtcaaaaggaagcagcatctaatatgcatttaaatactatctttaacagaaagtcccaggcatttgtctttaacagacattatttgacaggagaaagaggctaattgataggattttcaccgtattcctagttataatgaaaagcaaaagaactatttggtattgaggtgatttctctcatcttctaggactttctgtctcttctgaaggcccttctcaaagacttggaacacctaagtctgtcaacaaagctgtatctcagagtagaaatgagatgggcattccacaacaaactacatcaccagaaaatgccggtcctcagaatacgaaaagtgaacatgtgaagaagactttgtttttgagtattcctgaaagcaggtatttctttaacatgttaataagagtttaacagttgctgatactaaataccatttcagattgttaagatggtaaaaggtgccagacatatatttttaataaatttcataatgaccctgcaacatataggcagtactccctttttataaatgaggaaactaaagcttaaggtttcaggatactaaatggtcacgtttagttgggtaaattctgcagcagtaagaagaaaagaagcaatatggtatcctttggtgctaaacatactacaactttggtgctcaacagttctgagctgagaagagctctgtgacttactagctatgcaactttggggcaagt

SEQ ID NO: 75502 - DNA, 1090 bp, Homo sapiens
aaacatctctctagcacttgcctcaccccatcttttagtttgatgaaatatggtttcagcataggtgctacttcctacaacctttcctgatgcctgaagattggtttaggtgtcatccttatttattttcttttaatgttttactttttttttatttactttttttgctttttcttttttatggggggggggtgtcatggttataatctaaaggatgtcccctaaatttatttctaacaggacatttatccttcttactattcttcccagatcttctactaagctgcaaactccttgagggcagcaactctgtcctttacctttttaccttttagcacatactaggaacttgataaatatatgatgaatgtgaaatattttatgtatactttatttttaaaaattaaatttttaagtgatgaatttgtgtttgttgtgtgtttttcttgtaagatggtaatgggcagctttactatgttagtttctctttgcagaaaaaagttgtctcaggtatagcaagtaaaccaaaacaggatgatgctggaagaattgcagcgagaaatcgcctagctgccataaaaaatgcaatgagagagagaattaggcaggaagaatgtgctgaaacagcagtttctgtgataccaaaggaagttgataaaatagtgttcgatgctggatttttcagagttgaaagtcctgttaaattattctcaggttagttgtttttgattttttattttttttgtttttcctgagactacttaagagaaatatttgggatagatgggggcttgtgtaaggtgaaaaatagttttttacatgaagagacataagtttttctgtgatttttagaaaatagactatgctcgctcacaaacactgtaaatcacattttgatgggtatgatcagattagtttaagtgcgataagtcttctaagattgcttttctactttctaagtgatttcacatctgtaatgtaattaccatgtaaccctacagtctatgagaaaggtcacaggatcccaagaggtaagagaaatgacggaagcatgaagaagtaaactgattttcttcaggtcagttagaag

SEQ ID NO: 75503 - DNA, 1062 bp, Homo sapiens
aaatgagttgaaaacttatgtccatataaaaacctgcacacggatgtttttagcaatatagcagctttattcataattgccaaaacatggaagcaaccaagatgtccttcagtggaggaatggataaataaaaaaaaaattagattgtgttcacattgtgtaatttaagaaacaacatttaggatatcttttctaccattttagcattttagtcaaaaataatctaggagagttattcatgtatgatattctttatgtagattttggaggtttgtaagacgaaagataatgaaaaactttaccataaaaattatttgaacactaaattgagaatgactcagtccagttttaataactcatcatttctgaatcactatttttaatttttttttagtcttcagctcattcgtttataactttaatatggctagcattaatctggtaaacttgtgctttattaacagatagaagatgtaatccacaaattcaacaatctgatcaaacttgaggaatctgggtggcaagtcaataataatatgaatcataatatgaacaaaaatgtctttagggtaagtttgtgggttttatatccaatttttttttttttagttaaggaactgttatacatacatccaaatttctaatatagattcttctacttcttgtttttaagttttaaaaacatttaggtttagatttctcattattttacaaagttaagtctttatactacttagagtgtacttgattgcctttgaagaaagagcaaggaaatcgatcaacataaaatttaggatagttatgtctagagagaagaaaggaggggctgtgattgaattggggtacccagagggcttctaagttaccacatactggatatatgagtgttggttttattcttcttcttctttttttttttttgagatggaatcccgctctatcaccaaggctgcagtacagtggcgtgatctcagctcactgccagctccgcctcccgggttcacgccattctcctgcctcagcctcccaagtagctgggaatacaggcgccagccaccacac

SEQ ID NO: 75504 - DNA, 1050 bp, Homo sapiens
tttagtagggatggggtttcaccatgttggccaggctggtctcgaactcctgacctcaggtgagccgcccaccttggcctcccaaagtgctgggattgtaggcatgagccaccgcgcccgcaggcatgagccaccacaccggctgacgttgagttcttataaagtacaacaagaagtagaatgctatttagtatatagcaatatgtatgagaaaatattgttaattttgagcaggaattgaagcaaatagttagtactcagtatttgtatgacaaagttttgtggtagatattttttgttttgcttaacaacctgtaggccctaggatgtttggagtgaagtcttatcagtgggctgacttgcaatgaatgtcccgttttgtcctttaattttaaaaaatctcttatttccttcagctaaagatcttattcgcacagcagttggtcaaacaagactccttatgaaggaaaggtttaaacagtttgaaggactggttgatgattgtgaatataaacgaggtataaaggagactacctgtacagatctggatggattttgggatatggttagttttcaggtatgtggttcaatatttcaaatatattaacttagggcttttttttttttttttttaagtagcaggagtaaaatggggtaatagtagctgcttatgtacctgtaatattaaataagatgttataaagcactttgataaactgtaaaacatgatctaaattttatgactgatgtcctcttctcccatatattctcaggataattttttttttttttttttttttgagacggagtctcactctgtcacccaggctggagtgcagtggtgtgatctcggctcactgctgtctctgccccccaggttcacaccattctcttgcctcagcctcccgagtagctgggactacaggcgcctgccacctcatctggctaattttttgtatttttagtagagacggagtttcaccgtgttagccaggatggtctcgatcttctgacctcgtgatccacccacctcggcctcccaaagtgcta

SEQ ID NO: 75505 - DNA, 1101 bp, Homo sapiens
ttaattataacacatacatttttcaaaagaagaaaattgctatactgctttagctcagatacgactttttcctcattttcttctggcttagtatttagaaaaactggccctgaagacaaaaatgattaatttgcaaaacaagggaaaaatcagttggaacctttaaaagaaaaggcaagatcattttgcaaagactggctggcagcaaatatactaaaaactgctcagcagcatctaagactgttaagtgtttatgttccattaagaaatcttcaaaatctttgaatctgattacaattaattagtaaaaatggacattcacactataggtgtttacattttctcccctccagaatacacattttaaaaaaatagaaacatttctattttagcccagatctacaagtgacacaattttgaaaccctttatattagatatatggagttcatgtttcatgaagtatatttttgctattgtttttagtgatgagtctcaagcaacaaaagaaattttggcacaaaaatgtaaaacttactctaccaagacaatacagcaagattcaaataaattgccatgtcctttgggtcctctaactgtttggcatgaaggtatagtatttaattaatttattcattttttagaataatgttaatacaaaaaatattttgctttcaggtatagtaattacatttttacttttctggattattacttgtcagatttgtttggagctctttttcaccatatcatttggggatgtgaactcagggtcagaaaagacgggaaagcatgggtaaagatatctgaagagaatattggaatgaagaatacagacagaagaggggaaataaatgtaaatttaaagaaaaaatattgagagctactttagaggaaatgtgaagtgattgaggcagaaataaaattttaaaattaaacattgaaaaggatttttaaaatgtctttttaggggctgtcattttaggaattgttgctttgaaatttatatgtaagattttctttaatttatagaacatgttttaaataaaaatgaagctactactaaaaatttaaatggccttccaataaaagaagtcccatca

SEQ ID NO: 75506 - DNA, 1019 bp, Homo sapiens
gttaaggttatttataatctaaggttatttaacttaagaatttggtccttaatgatagtcattccataatgttagatttctgattttaaaccattgtaattatcaacataattttttttttgagacagagtctcgctctgtcgcccaggctgaagtgcagtgacacgatctcggctcactgcaagctccacctcccggtttctcaccattctcctgcctcagcctcccaagtagctgggactataggcgcctgccaccacgccccaataattttttgtatttttagcaaagacggggttttgctgtgttagccaggatggtctcgatctcccgaccttgtgatccgcccgcctcagcctcccaaagtgctgggattacaggcatgagccaccgtgcctggccgtaattatcaacataatttaagtaaaaagatacgtatttgttgaataagtttttccatattaattttccattatcttttaatttgttgtaatacccaaaaggtattagttagtctttaaataagaattggttcggggtgggtgcggtggctcccgcctgtaatcccagcactttgggaggcctaggcgggcggatgacgaggtcaggagattgagaccatcctggctaacacagcgaaaccccgtctccactaaaaatacaaaaaattagccgggcgtggtggcgggcgtctgtagtcccagctacttgggaggctgaggcaggagaatggcgtgaacccgggaggcggagcttgcagggagccgagatcgcgcgactgcactccagcctgggcgacggagggctactccgtatcaaaaaaaaaaaaaagattctattcccgggtaatagcaatggatttagcgtaactggtcttctgattccatgtatacacttaattgtatctgtttttgtctctcaaattatgtacatagaacatatatttctgttgtcatattttcagacctataaaaattggttgaatatatcctcagaagagagaaatcttactctacttt

SEQ ID NO: 75507 - DNA, 1073 bp, Homo sapiens
ataaccctttttataatatggcttttaataaaaaaatccttcaagacatatattcctactgttgcttcttttcctttcccaagttacctagtattttcatgtagcatttctatctagtaaaataaatattttattgttgttttagaaaacgaaccagaaggaaaggtgccaagtaaaggaagacctgccaaaaatgtagaaacaaaacccgacaaggtagagaataaacatctttttaattctagatgctttgaaaatctcattgctactttcataaagttgaaattaaacataaagaactgcttcaaaaggttaacctacatgtgtgttaaaacttcctgaaccataagaaagcatcaagaggatttactcttgttatttttcaggtatcttattttcagagctttataggtagagaaagcataattttgttagaagatggagaaaaataataaaaacacagctgagagaaacctgtatgtgggaattagccaagacatagggtgaagtggggtgaaatgcattgactttggattcatttaggcctgggtttgaatactctctctgcttccaattagttgcataaccctgggcaagttatgtagtttatgagcttcttttcttattcctaacatggaatacctgcatagagtagttgtaagaattaaataaactaaaatttctgcctgcatctagcatggtttctaataaggtcttcaaaaaagatgccccatttgaggacccaaccccttggcctataatctatgatatagtttattttcttttattttattttttgagacagagtctcactctgtcgcccaggctcgagtgcaatggcgcgatcttggctcactgcaccttccgctccccgggttcaagtgattctcctgcctcagcctcccgagtagttgggattacagacgtgcaccaccacgcccatctgatttttgtatttttagtagagacgaggtttcaccatgttggccaggctggtcttgaactcccgacctcaggtgatccacctacttcggcctcccaaagtgctgggattacaggcgtgagccaccacg

SEQ ID NO: 75508 - DNA, 1025 bp, Homo sapiens
aataggtatggggtagaattttgattgggcagttaaggaaggcctccctgagatgaaagccttttgagtgaagtcattatggaagtggagaagagaaccatgggaaagcgctttttatccaggagaagtattttctaggcaaaattaaaaggtcttgaagtgaaagtatgtctaggagtgtttaaggaccttcagaaggcaagttatagtgagctgtttttaatagcttgggttattagcattttccaaattctgtgattgtgaaaaaggatgtaagcttttttggaagcttaatggaaagcttttctttatctcattttatttggggtagttttttgttgttgttgttgggtcatttacgatgatcagatttcatatgaggaatcaatttacagattaaaaatatgatggtctgattcattatgcaattaaatcacatagcacctaatctcttaaatagattgataacgagagtgatgttcgagcaatccgacctggtccaagacaaacttctgaaaagaaagtgtcagacaaagagaaaaaaggtaggaatattagcaattactataaatcctctgaggctaccacagccataattttttttaagtgtcttgaaggtcaactggaatttgttcgtttgtttgtgacagagtcttgctctgttgcccaggttggagtgcagtggcacaatcatagctcactggagcctccacctcctgggctcaagtgatcctcccacctcagcctcctgagtagctgcaactacagacttgccaccatgcccagctgatttttatattttttgtagagacggggtctcactatgttgcctaggctggtttcgaactcctgggctgaagtaatcctcctgcctcccaagtagctgggactacaggcattgcactaccatgcctggcttcacagcaataatttcataactacaagggacatttgatgtagttatttttttttcccacagttgtgcagcctgtaatgcccacgtcgttgagaatgactcgatcagc

SEQ ID NO: 75509 - DNA, 1018 bp, Homo sapiens
aaattggtgctaagatgtcgatttaggatataatattgggaatatggatgagtgtttaagctgtaggactaaatgagaccattccaataaggatatataaaattatgaaaaagtgggctctagagagcacttttaggtaggcagaagccaggtaccaggctgaggactggtcagagaggcaggagaactaagagaggatagaagctcatattaatgatgattccaatacctggaaaatacggtttgaaatttctttctcactgagaaatgtgagtaatttttgaagttactaacttaatttaaatcaagctagaaccagaaaaaggaatttaagtatctttttgctataagagattaaggataaaatttaactttaaaatgggaactttattttgtaataagatatggaagtaaacctttaccagttcatattttaagttcatcttcttttgactgttctaaggctattccatcttctgtacggattacaaggtcaaaggccaaagaccaaatggagcagactaaggtatagttgatagtagataattgttactaaaatgataaattgcacttttttagtaagtaaattcattttaaatctagtatcagattcaaacataatgattaatttactagagttaacaggtaccaaagtcactgtttttagtatggtgatgtagagcaatttcacttaaaatatttgctccaacattccgtatgagatccatggcaaactgtctttgtgtcacactcttgttttgtttagtgggctcctattatgcattccaagttacctgcatgaaatgcatatggggaggaaagcacacagggtaggtgttataaacttacgggtcttcaaaatactgtaatagagatatcaggagggttactaaaacaaagtgaagtgggcaagaagggaaataatatgcctctttatcaggtgaggaagctaagttccacgtatgcatatatattttgcattgctatgatgttcctggtgttgtaggcttttggatat

SEQ ID NO: 75510 - DNA, 1025 bp, Homo sapiens
tgaaagcctttttttttttcttgagacggagtcttgctctgttgcttaggctggagtgcaggggcgcaatcttggctcactgcaacctccatctcctgggttcaagcaattctcctacctcaacctcccgaatagctgggattacaggtgaccgccaccacacccagctaatttttgaatttttagtagagatgggatttcaccacgttggccaggctggtctcaaactcctgacctcagatgatccgccctcctcagcctcccaaagtgctgggattacaggcgtgagccaccgtgcctggcctgaaagcattttttagcagcagttgaaatgacacaaaaataattgtttatacatttgcataacttttcatctgaaatgttttatatactgtgtggttttggttttttttctgcctaggggcaatgaaaactattctaggtgatcaacgaaaacagatgctccaaaaatacaaagaagaaaagcaacttcaaaaattgaaagagcagagagagaaagctaaacgaggaatatttaaagtgggtcgttatagacctgatatgccttgttttcttttatcaaaccagaatgctgtgaaagctgagccaaaaaaggtaaatttagtgtcttaatataaaggaatagtttcttttatttggtattttcttcaagacattaagtgactaacccctttcccttagtctcattattaactggttggtagaaggtgggaatgacataatagtagctcagaagaatgaaaatcaggtctcttaagatagctgtaggtaagttgagataggataaaactaggaaaattggtagaatcaggctgaacaatgttatgcaaaggatttggtgtttatcctgtaggttttgcagaatcaggagaagtttataaataagggtagtgccgttgtcaaattaataattcaggaaaataccatagccctaaagattttagtctggaaagggaagcatttatagatagggagaccaattgtgagactattgtaatagaata

SEQ ID NO: 75511 - DNA, 1013 bp, Homo sapiens
gattatccctatatgactaataggtacctggtgtggggtttttgtttgtttttggttttcttttggctttagaagaaatgttagactacctgcattcctcatcatgggtaaggaaacccttgtgtacatggtccttcacttaacctattttcacctttatttcacgcttttctttttgcagtgttctctgtggtaagcccagagcctcttttattctggactatcacttactggctttctcttcactggtcaagcaagttcctatttaaaacccccaaataggtagcttcttattctctgataatcttcttctcacttttcagtgttacatatttatttcattgcacattttatatttttatttcagaaggccctgaagtgggacaggaaatgaactgtaatcttaattttttaaataatgaaaattcatgtaagttgggttttgtccttttccttgacaggatgtcttcatcacattttgccagtcgacacaggaaggatataagtactgaaatgattagaactaaaattgctcataggaaatcactgtctcagaaagaaaatagacataaggaatacgaacgaaatagacactttggtttgaaagatgtaaacattccaaccttggaaggtagaattcttgttgaattagatgagacatctcaagggcttgttccagaaaagaccaatgttaagccaagtaagtaaaggtctgttgtaattttaagtactttgaagagtgaataatagttggtttaatgcctgtgtgagtaaaaaactctggccagaagagttttgaaataccattctataaataactttcctttttggtctttttccttttttttttttttttttttttaaattacaagagacagggtctcactgtgtcacccaggcgggagtgcagtggtgtgctcactgtaacctcaaattcctgggctcaaggaattatcttgcctcagcctcccaaagtgtggggattacaggtgtgagccaccgcgcctggcccc

SEQ ID NO: 75512 - DNA, 1140 bp, Homo sapiens
tcaaaaccacaatgagataccatttcacatccattaggatggctaaaaaaatttgtttaaatatacagtaacaagcccggcatggtggcttacacctgtaatcctagcactttgggaggctgaggcgggcagatcacttgaggtcaagagttcgagaccagcctcgccaatatggtgaaacccgtttctactaaaaatatttaaaaaattagccaggcgtggtggcaatcacctgtaatctcagttactcgggaggctgagacaggagaattgcttgaactcaagaggcagaggttgcagtgagccaagattgagccactacaccccagcctgggtaacacagggagactccatctcaaaaataaaataaaataaaataaacaggaggaaggagcagcaccaaatccaagatggcggccagcaggaggctgatgaaggagcttgaagaaatccgcaaatgtgggatgaaaaacttctgtaacatccaggttgatgaagctaatttattgacttggcaagggcttattgttcctgacaaccctccatatgataagggggccttcagaatagaaatcaactttccagcagagtacccattcaaaccaccgaagatcacatttaaaacaaagatctatcacccaaacatcgacgaaaaggggcaggtctgtctgccagtaattagtgctgaaaactggaagccagcaaccaaaaccgaccaagtaatccagtccctcatagcactggtgaatgacccccagcccaagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagaccccgtgcagtgcattcagacaccccgcaaagcaggactctgtggaaattgacacgtgccaccgcctggcgttcgcttgtggcagttactaactttctacagttttcttaatcaaaagtggtctaggtaacctgtaaagaaaggattaaaaatttaagatgttctagttctgctctctttgttttaaaaatcactgcttcaatctacttcaaaagaaaaaaaaaaca

SEQ ID NO: 75513 - DNA, 1024 bp, Homo sapiens
ataatggatgctaaagccagtggcgggggtgctggggaatgtgatgaagaacacgatattcatataacataaaagtagctctcgccggcccccgccagctgcggagcaacccgcgagcgagctcacaccggtttctctccatcctcagcttgcgcgccaccatcgccgtcgtgctggggccgctctccaccgctgcgcggtgactgcaaccgcccgggccggccctcgaggcctcctgcattccgccccaacccccggccccgccgcggctatccagtcagttcactgctattcccatgggtcacgagacagatgaggagtttgatgctctctgagtaacatacttcaacaagccagatatagatgcctggcaattgcgtaaagggatgaacacacttgttagctatgatccggttccagagcccaaaattgttgatgctgctttgcgggcatgcagacggttaaacgattttgctagtgcagttggcatcctagaggctgttaaggacaaagcaggacctcataaggaaatctacccctatgtcatacaggaactcagaccaactttaaatgaactgggaatctccactccggaggatctgggccttgacaaggtgtaaaccccatggatgggctttgcaaggatttattgatattgctacttgtgtgtaaacagttacctggaaatactgatgataatatataccttatttgaacaagttttcctttattgagtaccaacccatgtaatggtaacctggactttaataaaagggaaatgagtttgaactgaaaaaaaaaaagtagctctccacaaaatacctattaataacttttaacctagtaagtacaaaatacttattaattaattttacagtgaagaaattcagcagacaccatcttaaccaagtgataaaagtcaaccctgatagaaatagaacaaattacgttgttgccttctgatgctgcactgagaagaacatagcatcacttctgtggtacgcctccataaaaacccactacc

SEQ ID NO: 75514 - DNA, 1032 bp, Homo sapiens
ttcatgttcaaattgtcccaatttaacacaactttttcacacagtttgtcccattgctttattctctgattttattttttaaatcttgaaggatggttttgtaaaggctgcgatggctgtgttaaaattcaaatgtgaagcttaccctttctgaaaaatcactccttggttttcttatgctgtctcatttctctactgtctcatttctctacctttttctttgcccatttttcaaattgtttctgtactgactcccttcacaaatctgttttcttctccatctcctgaaaggtggtagttttttggttttgttttttacatcttattttttaaattcattttttaaaaatcttgtatgttcttccaatgaaaaaattatttctttaattgacaaattaaaattgtatatatttatggtgtacagtatgatgttttgaaatatgtatacattgtggaatggctaaattgggctaattaatacatgcattacctcatacacatcattctcttgtggtaagaacgctgaaaatctactttcttagcaatattcaattatgcaattcagttttgttaattatagtcattgtgctctacagtagattccccaaacttttttaccttgcagttgaaagtttgtgtcctctgaccaacatctccccatttcccttcccagctctggcaatcatcagtctacactcttgcttttcggtattccaaatttttagaatccacatatgaatgtgatcatgtggtatttctttttgtgcctggcgtatttcacttaatataatgtcctccaggtaaatccatgccgttgcaaatgacgaagcttagttcttgacccacagatttaatgtgaagtctttctcagaggtgtcactcactcataacttcaaataatcacctttgcaattgtctccaatccttactgtgtttcaggcctccatttccaactccactaggaggcactgtagtgatctaaaggcagtacacctcaaactgaaatctttcatccaaaactattaatagctg

SEQ ID NO: 75515 - DNA, 1641 bp, Homo sapiens
ctgagcgtccccgcgggccacggagggtcgggcgggtagggagcggggtcctgggtccccgctgaagccgaggagattcacggataggccgtgagcttgcaccggaccggcgctcccacttacgggacccagggcggtgaggaagtcagcctctggactggggtcgcctcgcccctgtcgcgccctcccgggctcggccactctgcccttccctgccccagcgcaggtgagctggcgcttgtccttaaccttcttcaacgacgaggcgggacggaggctcggacgcctccccagcctctgggctggcgcaagtcgactgcggttcgtcctcagtccacgatgaagtcatagggctgtgggtccgtgtgtctgtgacgtcagaagatgggtcctgggatgtcactgcaggcccgggcggggacctgggctcacggaagggccggggggacccgcagggtagaaaaaggaagttgtcttccacgaacgcttggaatcgcagtggatttgaatcgaaagttgttcggtatcagcattttgcaattttaatgtaatagttgtcaatttctttaacttcttgtccagcaagcgttgcgagtacagctcagtataagacatttgatttagaaaaacttaagtcagggtaggaggttttttggagggtgtaatgtaaaaagccttttaggaagctaaattcgtagtttgatagtttgcaatcagaattactgaaaaaaaagagaaccacttctagtgttgataaatcagtttgctttttttttttttttttaactggacatctatctgcttgttagcattttttgttagaaaatggccaggaggagggagagtggatcttacatgattttttttttctgttgtaaagggagggaggagtttgaattaatccaacatttgtcttaaataataattacctgaggagttaatttatccaggttgtccctatcccaccctatggtaccatgctaccaccccatgctaccatggtttagaagtcagcaacaagctgttttcttgctttcttactgagacccggctataacttaatataaaaacatattccaggaccgcttgtctggataggtaactaaaattttgtctgtagtgcttttaaatatgaaattagagaataaaaaaatgatttgtctgtgaatactgtttttcttccaaagctttcagaagagatctaactggaagagaagctagtcactttgtcatagtgaccctcttcgggtattccagcatatcagtacttttcatttcctcctctgtagaataatgtaaatggaatctagttcaaaaggtagatggcttaaacttgaagcatagttagtctttagcaggaagcttgggtagaagtccttaatccttcctcactgaccttgacttgtaatggtacggttttttttttttcctctctctcaatacttcctgctccccatttgccttttagaggtgattgataagatactgtctctctgggttttacatcaacatgcagatggaagttatgcccattttcaggcaggaaataaaagcaaaaatttacccgttaggtactattggatttgactggaagttcacaaaacaaggctttcctgtacatgttattttgatcctcaccac

SEQ ID NO: 75516 - DNA, 1023 bp, Homo sapiens
aggttctatgttacccttttaaaggaaggtttctagaagctgtcacttcatagcagtttgaattatgtttcattagttagaacttagtgtcatagccacatctgaatgcaaagaaggttgagaaatgcagtctttattatctttttttcccattataaacaatgctgcagtgaataaccttattcagatttatttttatttatttattttgagacagagtctctgttgcccaggctggagtgcagtggcactatctcagctcactgcaacttctgcctccggagttcaagtgattttcctgcctcagccacctgagtagctgggattacaggcacctgccaccatgcccacctagttttttttttgtatttttagtagagacagggggtttcaccatgttggccatgctcgtcttgaactcctgaccttaagtgatcctcctgccttggcctcccaaagtgctatgattttaggcatgagccatcatgcctggcctcagatggtgttttgtgggatacatttttagaaggggaactactggatcaaagagtatttgcagttggacaatacacttgttttctcatatccttgctgacacagtttttgtatttgctaatttcataggtaaaaaaatgacagagggtagctctaatttgcctgataggacatgtaggtagagaaaatacttctatgcttacatactgatgatacctagaaagcatggattacacagttagctaatgtaatgctagttggggtgaagcatatgcagcatgttttcattttatttaggccaattgtagcagaagattgatggttaaaggtagatgagaaacccttctactcacaaacatgtcactgtgaactgacaggaaaacagggtaataatgtattctttaggagtttttaaattaaaaagtaggttagggctgggcatagtggcttatgcctcctcacttcaggaggtgaagtggggaggattgcttgaggccaagaattggagaccagcctggacaacatagc

SEQ ID NO: 75517 - DNA, 1136 bp, Homo sapiens
tggggattataattcaagatgagatttggctggggacacaaagcctaaccatatcacatatactagaaactgtgtgtgtgtgagacagggtcttgctctggcatgcaggctggagtgcagtggcatgatcacaacttactgcagcctcaaccttcctggctcaaagtgatcctcctaactcagcctcacaggcagctaagaccacaggcatgccaccatccctggcaattttattttttattttaatttttttgagagctgaggtctcccttttttgcccagggtggtctggaactcctaggctcaagtgatccttccagttaggcctcccaaagtgttgggattacaggcatgagccacaatgcccagccctgaaaacctgtaatttagtgttgggaataataaagatatgaaaaaaaaatggattttgttaccaccttagggcacattctagagtttattgtgtttatcagtttctcacaacttaagtggaaacggtcttaacagtgctttgacagactgtagccttgcagggggaaacctaatgtgagatagttaaccaaatacacaccttggtgtaaactactgagctacctcccagaagggaagctgctatcttcctgaggtgtgctagattgggtatcacataaatgttttgtctccccttgagtctgttccctgggaatggattgggtatcattatgacataggaacagctgaaaataagggagttacagatgattttgaatatcagacagtagtaacaggtatgtataaaatgatagatgataatattaaattttgattatacagcaataaatttttgttgtagaaaaattggagaatacaacaaatgaaagaaaaaaaccttgttggaaaaatttaatctgaaaaaagaactaaaacattttgaacttttatcactattcttatccttttatattgtgtttttcattgaagtattaaatgtacatagtttagttgatagctgtttaagacttgttttgaaaagtgtcagtctttctcccacttcatccccccacttctccctcttggaggcttgcttttagcttattatttttgcatttacctccatgttcttaacagcattcttgtattctgatttcttgatttct

SEQ ID NO: 75518 - DNA, 1131 bp, Homo sapiens
cctgtagtcccagctacccgggaggctgaggcaggagaatggtgtgaacccgggaggtggagcttgcggtaagtcgagatctgccactgcactccagcctgtgtgacagagcaagactccgtctaaaatatatatataaagttttaaggtgagaaagttgaataattttaatgtatagtcatagtctttgttaaaacttttgttaaatctgggatactgttgagatagcagatggctgttataaaatgggaacatgtcagctgtaaaaagaaaccaatgtggattaaatcataattaaaaatacctctggttcactaaaatatttttcctttgggttaaatattaattttgttatagttttcttttttattcatcttttgagaaaaccaaaaaataaacagtggacacagagaaaatgaccaagggtagctttggaattccttcattcagagactttttagaatgtggactttccaaagtcaaagaatcttaaaaataagagttacttgtaaaagcaaggctgatatgggcggttttttttttttttaattcagtgacttgtcaaaaaatagatgatacttatcaggaatatttggccatcttgtaatataaggaatatcagaaggatattgtccacaaatgccttaaaatggcacgtgctttacacatcccacaccccccacctgcaaagaacagatgccttctattccctggctcccttgcattgttgcccaaagtagttacatatgaccttttactgagacaacttgcaatgtttctttttttttttttggagacagggtctccctctgttgctcaggctggagggatttcagctcactgcaacctctacctcctgggttccagtgatcctcccacctcagcctcctgagtagctgggattacagccaaatgccaccacccccggctaagtttcatattttttgtagagatgggatttcaccatgttggccaggctggtttcaaactgctgacatcaaatgatctgcccgcctcagcctcccaaagtgttgggattacaggcgtgagccactgcatccagccagcttgcagtgtttctgactggtcccagtgcttagctcagtaccaaggcacagtaggttttcatct

SEQ ID NO: 75519 - DNA, 1030 bp, Homo sapiens
actcggcctgggcaacagagtgagaccctggttcaatcaatcagtaatttgtgtatggcacacacataccttgctcccttttttctccatagccttttatatactgtgtaccttattaatctgtctctcagctagaacataaccttttctatggatggagattttgtgctttgttcacttctgtatccccagtctctgaaagagtgcttggtacatagcagatgctcagtatatattgagtgagtgaataaaagatctgtttgataatttagctcccaaactgtgggatttgaataggagaaatgattgcttgaacattcaaattagagacaggaaattttttttagacttgtgaaacagaagaaaattcaccaaggttacagattgggcttctattataataccctgatctctttaggccccactaggtagtttcaatttgagcacaattccagtgttgcatatttggaggagactggctagaaatttctcccttctttgtggtttttattgaatttctctggtaaaaatatattaatggcttttcctatgccactctcatcctctcctgcactgaataatttctgttctggagtagtagtttgtaaatttgagtaaggtatgaattatatccaaaagaagaaatgtattgaggttcttcagtatagatgtaattttctaatttctatgttacaaatatatatgcagctataaagagcaaataaatacataacacctcaatattattttgatattaatttggttagagtttggaaaactaaattgaggcgtgatatatatatatacacacacacacataccaacatggtgtgtgtgtatatatataaaaaaatataaaatatataaaaatatatataaaatatataaaaatatatatataccaacatggtgtgtgtatatatatatatgtgtatatatatatatatatgtatatatatatgtatatatatatgtatatatatatgtgtgtatatatatatatatgtatatatatatatatataccacca

SEQ ID NO: 75520 - DNA, 1102 bp, Homo sapiens
gtgttagtatggacatattgtcaaatgttttcatagggagaacttggtgtacctcattatttagatttttttataacttaaaatgtggtatgttttgaacttttagtttatcagaaaatgttgacttttgatgtaatggctacttctgtagctacggtgatcttcagcaagtttcactttctaaacttttatcttttctgtgcagtggttgcaggttgtgaggtatggagatactgaggggtacgaggcactgtttgtggtgacatgagagccactagcggacagagactggggagaaggattgatcagctggcgcattagccccaagatgcaggtgaatttgggaacagaaagagggccaaatgagatgtttgtgaaaatactttgtcgatttaaaacattccttccagctcaggtgctgttatgtttagggaagatgtgcgtgttttctctttctagtgggctattgttagctacaaggtgaccttgcctcctgctttgagggagaaggaaaaagctggacccacaagacacaaatcccagcagtctgtggttactgctggaatgattactgttctttatttgtactattagttgtctctaagattggtaacaggaaagtgagaataagcttactctcagaaatttttgttgagggagttttgtataatttctgactattaccacattcccctttacttcgaccctcttggttttgctgtttgctgtgctctagttttaccatctaataacccagcactaaaatctgatcttgggtatcagattctcctttgtggtttggtttgttaataattgaagtacctaatggttctgggtgtgaactgtgcatacttgacaatctagaaccagggaagtgagtttcctattgaagtaattaataaaaccttgtggctcttaaaaatatataaaaactgttacacagaaataaccaaaatgtaaacttaacaggatatagtttaattatgtttttataacataaaccttaaagatagaagtatttttaagcttgttggtgtcctgttcctttctagtttgggtgtgtaggagtcttttttatcaggaattttgttagtgctaatgc

SEQ ID NO: 75521 - DNA, 1225 bp, Homo sapiens
caggcattgccctatgggccagggtattggatgtgctgccaccggtctcagaaaggattccctggctgtaagctggggcttcatgacaatcactgggttcctgcctgccacagctttaatcgggcaatccataagaaagcaaaagggactgaagctgaagaggaatactaaagtccatgtgagaggcaacaaaaggaccggtttctaaagctgcaaaacacctagatacaccgttcaaatgagcgtagccccctgagtcatcactctagaagaatctgtacatcatcaggactgcattgctcaggcattttctaaactctaaatttacgagctgtacaaaaaaattggtcttgttgtttatagtggcatctcatgtttgaacccgggtggtatcccacagttggattcagttggctgtgaataactgcctgttttcctaaatcaaacccatcctcaaaggatgaagactcaccaccatccaggacattcagaagagttcactgcagatgctgcaggtagtcctcaaaaatgggttccagaaatgttttgagcactggcaacatatttgaaataagtgaatattgtcctgtgaaaagaatagcaggacttttagatgaaaagtattcttaaaaagaaaagtcaggcaccccaccttagacctcgtatgcttgatcctgtgagattgatgtttgtggctggaggtggatttcatgccctgtggtgtttacagtgtatataatggttgtgttttcatggggctatgaaagtgcacgttaaacctgagcgcctttacctttagatgagtgctttggcccctctgtgaatagcacgattaaaatccagttgtatataatggacagctaacggaacaatataatcaccacaatgcagctaggatagtgttgcggctataattttgtgttttttttttttaattgtctagtcttaaatttgtacatcttgtataaaatatgaatgtttcccaaataaactatgaatgtttcctgtataatatatgaatgtttctgagaagaaactctaaatagttgaaaggctaacctgctcaaaggataccaaataatggtttaactggacaacctgaaaattagcatagaaaacaatcctttgttatattttagtgatccacaagattgagaaaatattatatagttagataataacattcttgtctactttatcctgtctggttacaaaattttttaaa

SEQ ID NO: 75522 - DNA, 1029 bp, Homo sapiens
agaaaaaaacactttatctccaacaattcaaaacaatttaaaaaattcttatgattcaattcacaagaaccttcttcaacattgtatcaaaacaggagaaaaaatctttgcaaaacttgggttccatttaagatgcatgtttttatttaagttttaaaaaattttgtaaccagacaggataaagtagacaagaatgttattatctaactatataatattttctcaatcttgtggatcactaaaatataacaaaggattgttttctatgctaattttcaggttgtccagttaaaccattatttggtatcctttgagcaggttagcctttcaactatttagagtttcttctcagaaacattcatatattatacaggaaacattcatagtttatttgggaaacattcatattttatacaagatgtacaaatttaagactagacaattaaaaaaaaaaaacacaaaattatagccgcaacactatcctagctgcattgtggtgattatattgttccgttagctgtccattatatacaactggattttaatcgtgctattcacagaggggccaaagcactcatctaaaggtaaaggcgctcaggtttaacgtgcactttcatagccccatgaaaacacaaccattatatacactgtaaacaccacagggcatgaaatccacctccagccacaaacatcaatctcacaggatcaagcatacgaggtctaaggtggggtgcctgacttttctttttaagaatacttttcatctaaaagtcctgctattcttttcacaggacaatattcacttatttcaaatatgttgccagtgctcaaaacatttctggaacccatttttgaggactacctgcagcatctgcagtgaactcttctgaatgtcctggatggtggtgagtcttcatcctttgaggatgggtttgatttaggaaaacaggcagttattcacagccaactgaatccaactgtgggataccacccgggttcaaacatgagatgccactataaacaacaaga

SEQ ID NO: 75523 - DNA, 1044 bp, Homo sapiens
tagttctcaaccccacctgcaactggaatcacctgggagctcccacccccagtggttgatttaataggtctagggtgtgccctgagcattgagaattttaaaagctccacagttgattctaatgtgcagccactaccctgcccactactaccccacccactactacccccaaccaggcagctggggcctctgcaccagctcctgcacattagtagggccaatcctttggccttcctgccctgcgcctcttcatgggcaaggagtttgaaggatcaagggggcaggcactgttccagaatctttgttctccttataaaccattacctaggttcccagaacctcaggacctccagcccttccccagctttgtcctccagacagatcccttcgtcctgagaagtggctgaggcgtggctcagtacagagggtgggaggatgctggaggggatgtgctgcaggagggctctctgtgttcctgccatgggccctgcaaatactgggaagggcttgtccctatatctacacccttataataaatccttgaatttactcatttcaagtgtgcagcagtttcctttcaagaccctgcatggagcacagacttagaaatctgaggggcctaaagccaagaccactggccgtggaaaaggaaaagttcacgagaggtcccagcttaggcactagggcagccaagtcatctctgcttaggagagaaaataagggctggtagagaaagggtattgctcaagacaggccacacaccctgtagcagaatcatgctgcgttgtctgtataggggaggattggtgaggaagggcagagtgaaggccaacagttcggtcccagaatagggaagggtgggtgggccaggcctggctccaaccctacccttgaaccagactgcaaacactcaagttatgcaaatagattatccagcctcacagtggagagggaacagatacaattaaatacaaccttgctttccattttactcatgtttggcaactaattgattttttattttttatttaactaattgatttt

SEQ ID NO: 75524 - DNA, 1030 bp, Homo sapiens
gattacaggcctgagccaccgcgcccggccccttatgggttcttctacactgctgggatctctgttttaagtgctcagcttcatgattgattgctgggcttccattttcccatccagttctggagttcgtagagagtgaagatggtagacttgaacagataaataaacttaacgatcttgtaagagttgtctagctacttaaaaccctcagaagtaagagcttagtctcacgagttgtaagagtgggatttggagcttggtggtggagactgacttcagctgagagatgcacaacagtcatggttttcttaagcctcttatgaaaccatgaatgagagatgaagctaaagaatagaatccagagatcacaaactcatctagagtacttccacaaaatttacaaagatgtgggaactttatggataggatatattttgtttgttgttgttaatatcaactagaggcactttacatagggttaagtgatcgaacccttttgtggttttgaacaccaacatactggcttacactgctgaaatattttgggtttcattattttgcactggatccaccctgtaaatactcttaagtatacatttcaaccactgttttttctactctttttgctgctcattaaaatctttcatgtaggtgccagaaccatatgtaaacagctttttaaaaaattgaagctggtattttgtttaaacaaaaagccatagaacttggtcatgttttccattttaaaatgatttactgaaacaaagtaatactaataaaaacccacaggcaccaaacaggctgcttaaaatggtctgttaaagacattttttggttatggaatataagaaaagttttgcacatctgtaagggggaaaaacagtatatcaccattgggtagagtggacgggactcatgtaaggactcaatttggggaagagcattcagtggcatgctgttagaggactagtgtccgagaatctcctcacagtatcatgttgcaggaattccccattgctctgcaacttcc

SEQ ID NO: 75525 - DNA, 1016 bp, Homo sapiens
gggagacaaacatttctatttgccaagtggcctgtgatggtgaccaacatgcttatgataattaagagaacaggggtcgaaggtctttctacccagaccagtgctggtggaaggaggacctgtgcgtgtggccagttctgccaaggaagcagttgatttgggttccctctgggcccgggccaccgggcccacagatatgggtcagtgtgctggtccttgcggtgctgagactgttcctgacactttaagttttagaggttggttgaatcacaagaggtgattcttgattattaggacatgaaagataaaagctctttaataagagtttttctgccattgttttttgtatgagaaccagcaggcaatttaaaatttctaatttggtcctttgattttgtttgggaggggtgagttacacgtattttattcatgctgctctgtcgtagtttgtcagacattcctgtttttctttcccccacacaccaaagaaaatgaaagtctttttctttaggacccacatccataaatggaagaaatcctggctgcaataatgtctagagagtttttaactattttcttgtattctgaggggaattaagcttattcttacctagttgaattcctgccatccacactatgagcattttgaaattgaacttatattttctgggtgaaaataagtcatgaaggtcattcccttatgtaagctcaatgcctgcctgggcacaggggaaaagccacttagttaagtggcctctggtcattcttgtggtgtccactttctttctatgggattgagtaggtggcaggtgttttcaggggaaaccatcctacttgtttccccgaactctttgttgctctgaggacacagctttgctcagaaatgcagcgcagatccttacggctgatgctactctgctctgttctggggaaagcacaatataaagaaagaatttcccagccaggcgcagtggctcacgcctgtaatcccagcactttaggaggccgaggcaggc

SEQ ID NO: 75526 - DNA, 2090 bp, Homo sapiens
gtgggtaaaaagaatggcagttgcaaagtcctggatagaataacgagggcagagaggaagatggggtgcaaatcttgtgggcctcatagggccgttataagcctttgactgccattctgcataaagcagatgacagttgtatagtttgcctttctgtaaaggtgtcaagatcttaccagtctgctgttgatgcttcaagaaataatcttgtacatttttcatttcattagtgtgcagatatttgtgtagaataaatgtcctgacgtggaattgcttggtcaaagggtatgtgcatttgtaatttgtatagatgcagtataattgttctctgaggggaatggtgtattcttagaaagtctttaagtgcaatttactaaggagtaaaagggcacagagtatgtgttatacctaattgtactgtaaatggaaattttaacatagaatttcctcaaaaaatgcaactttataaattgtatgtttgttttacagtgaattttgtggcgaaaatctaagcaagcagaaatttactcgagcagtgaagaaactgaatgcaaatattctttacctttgtttttctcaggtatgaaaaataggttgtgaactaatttttactttgttaaatagttgaaaatattaaccaattctttaattttttttagcatgtaaatttagatcaattacaaccactgcataccctcaggaatctaatgtacctggtcagtccaagctctgaacacctaggcaggtaagaagatatttgttgcttttctctaagtgtttttgtgaatcctgttagaggagttgtatgttggcatagtagagtcgtgttccctaatcccaaactcctcaaaccggacaaaaatagtggagtccaatacagaaagaaacaaaggtaattatatttgaacttttatgggttttttttgtaatcatgtcttagaaaaaattaatatcaatcatttttaatacctgaagcgcagttgaagaacccacatgttcctggagtagtgcctttttgtgcttttcctgaagtccaaaggccatgtctttggatctgcgtctatttcttctccagcccttcctggacatagacccctttataaaaagctgtgaactctctagccctacctagtgtctgccctgtttcctgcacattttcttttgctcctcctcactccttgtccgtcgtaacaattcacaatttccttttttttttgagatggggtttcacccttgtcacccaggctagagtgcagtggtgcaatctcagctcactgcaacctccacctcctgggttcaagcgattcttctgcctcagcctcccaagtagctgggattacaagtgtgcaccaccatgcctggctaatttttgtatttttagtagagacagggtttcatcatgttggccaggctggtctcaaactcctgacctctggtgatccacccgcttcggcttcccaaagtgctgggattacaggcttgagccaccgtgcctggccacacaattttcttatcactgagtcaatctgatcaccatttgttggagataaaaggtattagaggtgtaggggatgaactggtttgaaatcaatgagcttaaaaacagttaaacaaaaaataccaaccagggctggtgtgtgagatctttttattctctcagcccatgaaagcatgtactgtacgagccttagctttcgttccatccatgcacgcctgtgctgggtgtttgcccttttttccttgctcttagcagtctgtccatacatttctgcagagatgtgatatggttatatatttacacttttgaaagagaactcaagaaaagacaaatggcgggaaagttcttttgggtttcccttccgcatcatccatctactgaaacccaaggcattaggggaggcctcgtccactaacacgtgtgcctggcttcccccatgcagcagttaactttcagtgataatctgcttttaaccattgtcttatgcttcctccccctccccacctcagatagttaacatttccaggacatagactcctttataaaaagctgtgaactcgccaggaaactgcacatatacttacaatgttgt

SEQ ID NO: 75527 - DNA, 1027 bp, Homo sapiens
tctacaaaaaaaaattttttaagttaaccaggtgtggtggtaggtaggtacctgtagtcccagctacttaggaggctgaggcaggagtatctctggagtctaggagtcaaggcttcagtgagctatgattacatctgtcactgcgctccatgttggataacagagtgacacccatctctaaaataaaaaataaaaatttaatgtaaaatttctgtgctcataggcagcttttcgatgttctagcatgtcttgcagttatattgcatgcccttaaaaaccctctctcttgaaaatccgtgtgtgtcttcctacttgtagagaccccgcagatgtgtcttcagagagtgacagtgccatgacctccagcactgtgagcaagcttgctgaagcccggaggacaacttacctctcaggacgatgggtctgtgacgatcacaacggagacaccagcattagcattacagggccttggattagcctccctaacaatggggactactctgcctactacagctgggtggaggagaagaaaacaacccaggggcctggtgagaagcagcatatcctttgaaatctatatatagagagagttataggtaaaattgacataacaaaatgaagagctttcaagtgaaccattcaggggcatttagtacattcacagcactgtgctcccatcacctccatgtcatttcaaaacattttgatcaccccagacagaaaccccatggcatgaaagtgtcacatttccccactctcccttcccctcagctcctggcaaccacacattgctttctgtgtctatagatttgcctgttctgggcagcttatataaatggaatcacagaacatatagctttttgtgtcagacttctttcacttagcgtaatgttttcaagattcatccacatgatagtatatattagtgtttcattcgtttttatggttgagtaatattccatcatatggataagacacattttatttattcattcatcacttgatggactgaaaacattttttagat

SEQ ID NO: 75528 - DNA, 1007 bp, Homo sapiens
tggcgtgatctcggctcactgcaaactccgcctccctggttcaagtgattgtcctgccgcagcctcccgagtagctgggattacaggcatgcgccaccacgcccagctaatttttgtatttttttagtagagatggggtttcaccatgttggccaggatggtcttgatctcctaacctcttgatctgccctccttggcctcccaaagtgctgcgattacaggcgtgagccaccgcactggcctaatttctcttttctctgcattgaactagaaaaacatcgttctctttttcgtaatgttccatagttacaaaagctataacataaggtctttttcttcattatgttttctgacatatctgaaaataagcagtgatcccaggtagataatcatattaaccataagagaccaacgtttgtgatatttattacatgcttttttcagagatggaaaataatgtcctgcaagatgaggattgaacagttaaaacaaacaatatgtaaaggaaatgaagaaatggagaaaagtaagtaattcgtgtccttccttccagccctagaaagtgcctatgtggaatttcatgggattaataaactagagggacacagaaaggaaggggatggtggggcagtggcaacttggagaattttactactcgccctcatctttccttgtaaaacatttgtataaggaatttttaaaagttaaatacacaatttcagaggccttaaataaccagattcttttctcaattaaaaaagttaggcgccaggcgtggtagctcacgcctgtaatcccagcactttgggaggctgaggcaggcggatcacaaggtcaggagatcgagaccatcctgactaacatggtgaaactccgtctctactaaatacaaaaacttagctgggtgtggtggcgggtgcctgtagtcccagctacttgggaggctgaggcaggagaatggtgtgaacccaggaggcagagcttgcagtgagctgagattgcgccac

SEQ ID NO: 75529 - DNA, 1030 bp, Homo sapiens
tcccgagtagctgggactacaggcgcccaccaccacgcccggctaagtttttttgtgtttttttagtagagacggggtttcaccgtgttagccaggatggtctcaatctcctgacctcgtgatccgcccaccttggcctcccaaagtgctgggattacaggcgtgagccaccgcgcccagtcatatatttcattatacttaaaatttgtgatagaagtgaattttgcttattctctgaatgttttagtaaacaaaacatgttctgtggaagattttcctgagttttctgtaatgtttctagtttttctatctaagacttcaatattcatttctaaagactctgttaccttttaaaattgaggataggtcatatctgatatatttctgaacccctcagtccctgtggatctgtttttgaatgtctgactctattcgagatgttagagtttcgctcaccataacatccctgtaatctgttctgtgtctcttaccatcagactacttagataagtgtaacaccatgaacatttgagcattgttttaagcttttaattattcactttacggagtcattagagaataatcattctttttaactaactagtagatccttctttttttttttttttttttgaggtggagtcttgctatatcacccaggctggagtgccgtggcacaatcttggctcactgcaacctctgcctcctgggctcaagcgattctcccacctcagtctccctggtagctgggactatagatgcatgtcaccacacctggctaattttttgtatttttggtagagatggggtttcgccatgttgcccaggctggcctcgaactcctgagctcaagtgatgtgcctgcctcagcttcccaaagtctaggattacaggtgtgagtcactgcacccggccatagatcctatttttattgatcctttgttcactttaaggcaggggtccccaacccccaggccacatatacctactgggctgtggcctgttaggaaacaggccatacagcaggagg

SEQ ID NO: 75530 - DNA, 1051 bp, Homo sapiens
ccccgccaccccacccccaggggagacccaggcttcagtgtaaactgaaggcgtgttccctgtcatctgccttttaaactgtatgcttccttaagggatgaagaagaagaatgatattaggcagtacctccaacacagtctttggatctgtactgctggacatattaaaattacaggaacagaactgtatggattatgtatttgtctgacaccagaaatagcactgctacccagtagatacctgataggttgaagtaatctttccactcacaacaggaaagaaattggttaccagttcatgttaggtgggggaatgggactgagaattaatctaaggatacctggggaaatgtatctgctggtttaggagccactgattttcacatgtggattaaaaagagagacaaattgtatgaacatatagatactactttataattatgttttcaggaatgatgccacattaccttcactgacaagttttagaatatatgattatacttttgccaggaaacagaaatgcatgccctaaacaaattgagaaatgggataaaggatgaggaagaaatttaaatattattgcagatttcaaggggaaggcacaaccaacatccaaaaaatatcctttagatacttctgttctcccttcagtatatttttgtttgtcagccactgtggcccgtaaaaatctattgtcttgagaattcaattctgtatactgaactcagcagaacaaaagctctacaggtagacaagagttcatcagccttacgactgtttcactgtgtccttcagagggtctcaattcctgtcccatggagtttgtttatggtatttccaccagaaaatgtggatctgctaagaaaatataacttattttcagctagtatcactggctactcttatgattataccttttagaacttataaaaggtttttgcatttactatctcatttcttccctaccctcaccccatgagttattaatgtattttaagcagaggaaactgagtctcaggggtgttgtggctgacttactcctgggttatac

SEQ ID NO: 75531 - DNA, 1089 bp, Homo sapiens
ctgttaatgaaacctgaaaaaaatacatttacctttacaagaactttgatatgcattatcacattcaagatccatgcaggcacagacggtttggctaatttactgaaaatcagaggttaaacaagggttttaaaactgtgctgtaaggttccagattttattaacaagtggttttctacagttagtgaggggcttttcatgaagttaaggggaaaaagagtctaaaggcaatcacagaatcaaaattttcaaaaattatgaagatagaatatctcacaatcaacctgtggccctcagagttcaaggcctattgacagtcggtaaaaatccttgagagcagagacctgtctttctcctctgtattgccagaaaattttgtgcacataacagtgcccaatgagagctcattaaaaaatatctggctattagaacaatggtcctgggtctcgagattctttcaccttattagatactgggcactattctggaaacaaagaaaaactaacaaactattcttcttaaagcacatagtctggaaaagagaaagatggagagttaggtgaagctgacctaagcagaccactgtgacagtcctgttatccctgaaccctaaaatttcttttttattctaaattttgaatggttatttgctttatatttttctgcttggtcaggaaaagaaatctaccacaacatatctctcttctgaaaatctaatgctcacatttagccaagaatttttgagattgtctttttttttttttttgagatggagtctagctctgttgcccaggctgaagtacagtggcgtgatctcagctcatggcagcctctgcctcccaggttcaagcaattctcgtgcctcagcttcccgagtagctgggtttacaggcctgcaacacaacacccagctaatttttgtttttgtttttttgagacagagtctcgctctctcgccaggctggagtgcaatggtgtgatcttggctcactgcaacctccgcctcccgggttcaggcaagtctcctgcctcagcctcctgagtagctgagaccacaggcatgcgtgccaccacgcccagctaattttt

SEQ ID NO: 75532 - DNA, 1588 bp, Homo sapiens
tagtgctcctcccccgcccccagccgttttggtggctctcccatcccaggccctcagagagcagggatggagggtgactcatggacaccaaaccccttgactcaccaagatatacacctgggctagggcacttggcctgggttaatcacagatgctcttaaattctcttggccaagctggaactgaagttctttcattccaacgccttatcttctcttggccatcgaatgattatcccgtcaatagagtagatagggatcatattgctgtgctttccctaacatttgttagctttcctttcagatatgatctgaatggaagttaaaaattcctttttcttctaaaatattttcattcattctgagattcagcttttatgatatgcttatttttcttttgacatgtttatttttctcttgattatgttttcttttttcttcagttttttcactgtatgctattgaatgcctaaatataccccattttttaaaaatctgagctccctataaagtcctcccattcccccatgtaagacatgttgcctctttaggtatctttcttccttcaatcttggcataatttgcagatttcctaataaagcctgtttctaagagtctcccagtgcttaagttgtcttatcttccagactctcaagtcacgagcctccagcctatctttctctgaatcggcttagtgtacatctgcaagagctctgcccgaactctaaggttgtgtctacattagacttagcattcccttctggccattcagggctcgaaaatgatgtgtgtggttcttcccaagtgtccattcatttctttttcaccagcatcttccttgcagagcagatctaagtctagaataggtgccccttgttattactaccagcttctggaagggttgccagtaaggcgcagtgagaatacatcagacggagtgggcccatccctgttctatcttcctcctgggacagttttatgatctcagtcatcttttcttttcttttctttttttttttttaatctggccaggaagcttgctttgtattcccacaactttctatttctagtctcattcttgcctccccctcatcctctccattcggctgtcagcctcaggttatggattacaactccagagtgtgtattcttgacactgggaacattaaaaacacctcttagaagatttgaatttttaacatgaggcctctctaattgtctgtagctctgtggggaaccatgctacataatcagttataattatcaggccaaatttgccttgtgttaaacccctaaggtcattcagtttcccaggttctgcaaatttgtatgtcaacatttaataatacaagtatctccttttgttaccaggcactttctctggtaatctttctatgacataatcatttccacagttgtcaatgagaatttttccctctttattttatttatttattttttttttttgagatggagttttgctcttttgcccaggctggagtgaagtggcatgatttcagctcactgcaacctccaccccccagggttcaagtgattctcctgcctcagcctcctgagtagctggtatt

SEQ ID NO: 75533 - DNA, 1081 bp, Homo sapiens
tattttgattcacttagagctttctctagatggaaatgttctatatctgcactgtttaatgcaatgatatagccactagtcagatgtggctactgagcacttgaaatacagctaatacaactgagggactgaatttatattaattggacagagcagatctagaattttgtttcaatgtaagataattatttttcccaaatgatcagtcggtactcagatacatttattgaaggatccattgttactacatttcccccaatctgtttttacatattaagttcttcacatgtgtctgagtacattgctggactttctcttatgttgatcccaggaatctccattttaaagtgattattggacagttgtgcaagatgtctgtaataatgttcatttcagcaatagaacagggaaaacctaattaataatagggtttcaatttgaagtcataaagtaaaattgtattagccatatagtacacatactgagctgaaaggatggtcacattgtattaagttggattgcagagggagaagtaagcagctaaatggtgtttgttatccaactttcattgtaaaatatgctcatgttacacatattacacacattcatgagtgtcttttcttatctgaatttattcctaaaatctgatagtgaaagtttggataatgagttcagataataagagatactttttatccaaatatatttggttttgaagttttggatagtgagttgtgagaatttagttaataagaggtgccagtattatctccacattttatccaaacctattctcttttgttgtaacagcaagagtatgagggatacctgtgtttgcgtaggaaaagtgcagaagatcaaatttaggtagttaacaccagtatgggtgagattttaagatttttaaactactttctaatgtttgtacaatgaacatgtatatagactttcaactattagttgtttcaatagaaacttctgtgtccttagaatatcacagctgatatcccaagaaactacaggactatgcaaacttgaacaaatttgaacttatttacattacgggaaatgtaatagatta

SEQ ID NO: 75534 - DNA, 1053 bp, Homo sapiens
ttcagtacattctgaagtcttggtgagcctttaacatacttatttttttcccaaaagattcttcaaaagaaaaaggaagtgtgtcaaagtaaaaagcagagaatctgattagtgtgggttttgaatcttaactttaccacttcctgtgtaatattggaggttatattgctacttgttttccctgagcactaaatgaggataataaacacaagttcatcctatcatgagaataaataggaactgaaacataacaggcattcaaatttaagagttactgatattatttttacctgttaataagtacattttagaatcatcattatttttgttaaccttaatgtagggagaaaagacccagacatttagttttcccatccaatctgtttgagattttcatattcagctcggctttttcaactgggataatgttaactcctagcagaggctaattctcttttggtttctgggtatagaggtttgctgctgtcataatgaggatccgagagcccaggacaacagcccttatatttagctctgggaagatggtctgcacgggagccaaaaggtatgaggaatcatccctccacccctaccagagaaacaatttagtatgtaaaacaaggaagcatagaattaatgtgctaaagcacatagtagaagcaaaatgcctttctttgctgaagactttattcaatgaaatgccacattttgggttaaaaacactcctataaatactgacttgggccaggcatggtggctcacatctgtaatcccagcactttgggaggcctaagcaggaggatcgcttgagcccaggagtttgagaccagcctgggcaacacagtgagactccatctctgttaaaaaaaaaaaaaaaaaaaaaaagagaaatctaaaaagtagctggatgtggtggtgcatgcctctagtcctagctacttgggaagctgaggtgggaggatcacctgagcccatgagtttgaggctgcaatgagctatgatcataccactgcagtccagtctgagttacagagcaagaccctgtctctatta

SEQ ID NO: 75535 - DNA, 1014 bp, Homo sapiens
agtcagggggtaaatctagtgccgtttgctgaagttaaaaggcgtggggagccaggtggtgccctggagggagggccgcgcgagacgagaccaaccttcgggacaggggagagcggggctactgaacgcaggggattccgctgagcctccagcccctgagcgtccaccttcggcccagctgggggacgcggtctcgggaagaaagcccggaatcccgagccggccagccgcgagcagcgagtaccggagcgcgtgggcaggcgcgcggaggcagaggcgggccggcggctgtccctttaaggggccggtctcccggcgccgccggcccagacgccaggacgtgccgggtccgccccgccccgccccgaagccgcccgtttcctgccgagcggcgcgacggcacctgagcgactgcggcggcggcggcggcggcggcggcgcctcggagcgggcggcccgggctgtagtgccggcgccgccgcgtcttcccggtctcctttcccggccgcacagggtgagggagagcaggccgcaccgggacgggcgccggcggcggggagcgcggggggaggcggcgccggccgcggggtcctggggcaggcgggagggccgcgccgggcgggggggcgcggccgcggggcccggacgccgcccgctgggtaggcctcgggcatccggttgccgccgcggggctcttgttggggccgggacgccgcagggggcgggctcggagggacctcctcggcctcgcggggccgctctgggcccgaccccggctctgtcgcggcacccggggcgcggccgagggacaccccccaccctccccaaggacgactctcccgaaggcgaggtcgacccgagcgggccctggggtgaccgaggcacctatttttagccaagcctgagggcccccgggagggaaggcggattaccgcctcctcggccggtggacggaggcagcgcgtctccggcggcgtccccgggccggagctgggccacacttacgccatgctg

SEQ ID NO: 75536 - DNA, 1065 bp, Homo sapiens
taaaagccaagactcttgccttccattttactgcctcattatattgctattcactaatcttaaaataatttacttttgctcaggatatatctgcaatataacacgcatactgtatttgaaggttatcaactacatgatggctaatatttacttttagcaggaggagttcattgtatctaaaccttttgcagaatggaaatctaattaaatgatacttggctaccaatagtaaactttttatcactgtagagtacttaccataaatcatttttcttaaaaaaagattaacttgtctgtttaaaaaaaaataagatagtaatgtgggtttaaagaaaggtaaacatggtatgaagagtgtggcacgtttggaatgccaagtatttagattcagtgtgatcagattacagatagttttttttgttgttttttgttttttttaacctatgaacattatttttacaaataacctataataatagctttcagcttaggcctcacagctacttctgtaatattttaactgtattcaaataatgaaataaagctcttataggctactctggaagcctgtatatcttaaaggtgtattcatttagttgtccagacattgatttatactggaatttttatgaaattatgcattcctgtgttgaaaattacctttccctcaacttactgtttttgtttttttcaaatgtgtctgcttgcttagtatgttttgtggtggaaaaagattttcactgtgttcagatttcagtcttgaattttgatttgttaagtttttgctaatggtttttttgagccaccccagctgataaaattgtgtcagttgaaggacagaaatattgataaaattagtttttttgtgtcatttgttttcattgtttttaatgtgaagaaaaggatagcagaagcaagagcaactgaaacactatagtaaaaaatataattcaaaattgttgtattacttgaaatttaatagtatacttatcaaactgcctcagttttttctcataatgttaacaattcttatgtttatgtatttaagcttttaaaagtttagta

SEQ ID NO: 75537 - DNA, 1507 bp, Homo sapiens
ggtgtaaagatgcaagcagttggtgactggtcttaatctgtaaataaaccacctctttttgcgtgtgtgtgcatttcagaatatgacacttttaatgaatgtccattgagttggtaatagtacctccttattttcacgtgtagtagttatcaacactgtacaataaacaaaaaagttaactactaataaagtaccaaaagtggatatttcgggaaaagaaagtaatgaatatttaaattttttctcttcaattaggatattttcacatgatttagaaatggaaggatgttttctactccttctagttaccacttgtcttatttttcatagtatatatgaattgtagttggcaaataaatcaagaatgtgatttaaagaactaacctgtttagatttgtaggtcaggttagatttgaaatgccacttgaaagagcagcagttttgactttaatttttatgagactgacaggttctttttttttttttgtccccaccttcttccctatttaggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcggtattgtaatctatttaatctatttaattttattgtatgatttggagcttggaattgagatattctgttaggtacatacacagaatgtttaatattgaatttgaaaccatgattattcatttcattatgtgtttgcttcattaacattaattgctggtagaaattagtattgatcataaaatagcactttaaacttcagggcctgatgcagtggctcatgcctgtaatcctagcacattgggaggctgaagtgggaggaccccttgagcccaggtgtttgagaccagcctgggcaacaaagtgagacctcatctctacaagaaattaaaagaaaaaaaaaaaaccccatacatcttataaatatccaactttggctattttacttaaaaccacttaggacctgtaaatatcagcagttacgaactttctaaatgatatggtaag

SEQ ID NO: 75538 - DNA, 1089 bp, Homo sapiens
ccacacctggctaattttttttatttttttcgtagagatggagttttgtagagatgaggtttcaccactttgcccaggttggtctggaactcctgggttcaagtgatactcctgggttcaagtgatccacctgcctcagcctcccaaagtgctgggattacaggtgtgagcagctgcaccttgctgtttattttttaagatgatagagacttgatcatgcctataggctcagtagggttgaaaatagctgaggaatgggaaaggaggagtaagtacattgaagagctggtgtagtggagtaagaaagctagaaaaagttattggtgagagcgttatatgtcagactttaaatttttagtggtaaaacattctgggaattactcagtgattgcatcttttccgttatgttcattgtttgccacaattattttttttgtttgtgtttaataaagatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatggtgagatgtttagatatgtatttttataatgctaattctagagaagtacaccagcacaaggaccctggaatctcacacgctctttagctcccagtttaatgtgtgctaatgacaactgtaatactaatgcaggtctaaaattatctttagccttatgactttatagcgctttgacagatgggcagggtgtacatttgagatgaaaaagtttatataccatttacaaagggcaaagcatttataaatattcttaactcagttttgaaaaaataaatagcatacagaccatagaagaaaaacattcttgaaattttgtgctttttaatatcacttaaaggtaatgcttaaggacattagctagatctggcattagcttacatttccaattaattcctaaacagaactcacatgtgtatatggcaagcatcagattataagagatggagcaatcttatttgttcacagttttccagggaaagcttggctgtgaaatttgtga

SEQ ID NO: 75539 - DNA, 1177 bp, Homo sapiens
caagtgtagatgtgccatggaaattagaggcataactcttcagaaatgagaagctatctgcaaggagcactgtggtttttgcacttagcaagtacaaagaacttgtttaaaaattatcaactacagtaagttggtaaagtaccaacataaataaaaactaatagttttccttgagcactaattaagtggaaataattcttatattaaaacaaaaattaaaggagacttaaggatgcataaaaagtttttagataccattagaggagatatgctatacacttttagatgatttaaatgatttactataaaataagactgttgagctggtacggcttcattagaatgagtgttttgacttgttaaatgacgaaataggaatttaaaaccaatttgagctaccagtaaatgtttcaaaagaactgcatttatcattaaattatgcttgcatgtcatttactctgttttgtaaaaattctaattatgattttgttgaacttaaattgcagtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaaggtaatatatgggatttatagtctttgttgtactataaaaacacatttctgagttctgatggagtcatagatttcattttctcatagaaacaatgcatttcaaaagaatcaaatccttgtggtagaagacttattggtagtcttttagtccagcctcctcagttttgtagatctggaacttgaatttgactttttaaaggtcctacagctattttgctatctgatgattatttcccagctactactgtctcctgtgaggtttcttggctaattcataactgttgtttttttttaatagactgttttttttagagtagttttaggttcacagcaaaattcattggaaagttcagagttcccacatatcccctgtttccacataagtacacaactaccttttaaaacttataatttagctgaagtattaaaagcccgaggctcctttgagtctgatgggtggcagctctttttaagaagaggttgttaatgcctaatacgaga

SEQ ID NO: 75540 - DNA, 1117 bp, Homo sapiens
gcatggatttttaaaatgtcaggatggtttgcatatatttgatcttcatagaatcagatttcctttttacaattatcttagaacttattttctcatgtgtggaatttggcttaatatctctcaggattattttgtttttcacagttggttgtcagtgtgcaaggattattaaagttcattgagattattgtgaatataatagtgcagatattagcacatactagacacctaagtgatttttttttaaagtgagggtatattggcattttagtattttgcagtttgagcaaacttttagctaatgtaattattccgtattatagatgataaaccctttttttcctcttgactggagtatttgttttatttaacctgaagtatatatctgttttctttcggttattgactttctgggccgtgaattcttcatgcttacctttgctgaagttattatttgtgttttttaaatgccaactctttgtttgtttgtttttttcaaattaagaaaatgctgaagtgaagtttaaagattttcttctgtccttgaagactatgatgttttctgaagatgaggctctttgtgttgtagacttgctaaaggagaagtctggtgtaatacaagatgctttaaagaaggtaagcgtgttttttgattatgggcatattcatgaccagtcattagaagttcaccaaacaagactttagccagagcaattaatatctactcccatccttaacatctcagaacatacatctggaatgccttcagaaattactttatatatcgtattagtctgttttcatgccgctgataaagagatacccgagactgggtaatttataaagaaaaagagtttaaatggctcacagttctacgtggctggggaggcctcacaatcatagtggaaggtgaaaggcacgtcttatatggtggcagggaagagggaatgagaatcaagcgaaaggggtttcctcttataaaaccatcagaccttgtaaggcttatttactaccacaagaataatatgggggaaattgcccccatgattcaattatgtcccaccaggtccctcccacaacacatgggaattatgggagctacaattcaggatgagat

SEQ ID NO: 75541 - DNA, 1343 bp, Homo sapiens
agacatcttatccctatttttttcccttaggaaagagaattatttccttctaggccttttttccctgaaagagaacgtgtacctgggaatgatagagaatgaactgttgtgctttaaaatgttctttcgtgtaatcaagttagaatgtaggatttattctaggttcatagtctttaactcataataaactagaaagtgcatttgaattaagagtaaacaacagtggcaaagtgtttatgaagggaattggcgtgaagagcagatgagatgcagaagactgtttttaaaatcttttgaccttgctttttttaagcaagtacttaatgttttatcattcatgattattttactgatgttaaataacatcattgtttatcattgttgcaggcttatgatacttattaaataacaagtttttaaatttctgggatattcttttaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaaggtatattttcattctttggaaacaagatgaaatggttgcattcactttattagcaaacttttaagtggctagtatgtacaaggccctttcttgggccatcaacatacagtggctagtgaagttcactctgcgtcctaagtaaaacaacttttctaggtggggatgaggtagggaggccggatgcagataaatatgatgatagagataagtattggcgactttagagcaatggtgatgggaggtaaggaagaaaaggatttgatagggaagactttttagaagtgatatgcagactgtgttaaatcttttaaatcaattaggcattatcaagtaagagagtaaagaaatgggcactgaggataagagttacttggtgtgatttcttagtccatctctggaggtgatagttcagtgggtatattttgggacccaggactgagctttttaatgagtgcactccaggtgttaccagtacagattgtctagagtaactgctctatgagaaatacagtaagagttgtggtatttggtaatgagggctggaatgaagaagggatattgagaagtagatagaggccccatcttaaagggccttgtatacctgaagactggggagccagtgaaggagtttaagcaacgcagcagtcgctggaattatactactattttaaattttcaccttggtagcagtggggaaagtggagcaagggatagttggaacactttgctagaattcaagtcaaagaacaagggcctgaaat

SEQ ID NO: 75542 - DNA, 2058 bp, Homo sapiens
tccgtcttgtatttggtaccagatttttttttggtaaaatattgctttgataatatcgctagtctgctaaaaattttaaaatattctttgctgctttcagagtcccagtgttttcctctgaaatgccactaatagcaaaaaagaagtgaatgatgctgttttcatgttcttaccctatccactgcttttagcatttgtttaactcattccttcatcttctcatcccccagcaatttgagttagtgaagaactgattttcctagcctcaagtgatcttttcttcttaattcctaattcctgttaatttgaaaattaggcagatacttgtagcagcatcttttgttgaaggtgaaaggtatttaagtgattcatcctgttttacttgattacttacagaggtcaggatatagattccatatgataacttctgtgaaaaatagaaatgtataccttaatttcccttaataagcaacagtttcttttgaaagaattattaataagattatttcatacaaaaacatgttcttatgagaatataagagtcagtgtgcctttatctttagattctttaatccaaaatttaaaaattagaagaagaaagttagagtggtggtcgccaggggctgcagggagaggaatgggagttattcgttaaaaggtgtagaaggtgttttacacaatgaagagagttatggagagatgaatggtggtcatgattacacagcattatggatatatttaataccagtgaactgtatacttgaaaatggttagaatggtacgttttatgttatatgtattttataatgtaaaaacttggaaaaaaaattaagaggtcagaatattttagcaagcaggtttttgtgttatctatatgattatggcccaatttgtaacttaatataaagtgtaccaaacatattttcagtttttaaactttggcttactaaagactttaagaatattgctaatgtataattgacataagatcaggacaagcttaattttgtatgaatctattcggtaggaaagaaatcctaaatcatatttagttctgaaacatcatctctaagcatgtttatcttgtatttcaaatatgatagcagctagcatctacttgtattcttgaatgtggtgacagtttgtatttgatttgcattcatcactaacaaaatataattcttttaaatttgtttatatttatttgagaagaatgattcaaacttcattctattgatgttttttatattctcattttaataaagtttattttaaaagttagctttgacagtctttgttttctaagttttatgtgtgtaaaataattttagtttcagcaagttcgtgagcagatggaggcagagatagctcacttgaagcaggaaaatggtatactgagagatgcagtcagcaacactacaaatcaactggaaagcaagtatgtttccaaataccttattttttaattgaatggcagagtattttcttgaatcatcaaaatattaatagcgtttgatagtaattggttagacttttgtgtttttacatttgtttctaaaatgagttacttttaaaaacaattctcttttgctttgtgaagaacttcttcagttatacatatgtaaactatgttatattaatgtcatactattatatacttatacaaatacattaatatatatcatatattacatatttatataaacatgtatgtgtatattgtatataaactatgtaataaatactagtaccaccaatggaatggtctacaagcttatgagtttataagttttaaaccatctgtcccctttcacagtagctcccaaacttcagtgttctgaagaacacctggcattctaattaaaaggtgtattcttgagtcctccccttaaaagattatgattcactgactctgaggtagagcccaggagtctacatattaagacactttcgggccgggtgtggtggttcatgcctgtaatcctggcactttgggaggccgaggcaggcggatcacctgaggtcaggagttcgagaccagcctggccaacgtggtga

SEQ ID NO: 75543 - DNA, 1127 bp, Homo sapiens
cgggagacaggagaatcgcttgaacctgggaggtagaggttgcagtgagcccagattgtgccactgtactccagcctgggtgacagagtcacactccgtctcaaaaaaaaaagacactttccttgtgatagtgattggctctgaggccatactttgagaaatagtaccttagagagactagtaataccggtacacagtaccctgactggctgatttttaatacgttttcagaagaccagtttgaaggtgacactatttatggtcatccatttttcttgatattttacagtgattttagaatttgaataactcattagaattatataggaattatacaactaaactttattgttagtagtcacttgtgttctgtttcagttgggctgtaaatggaactactagctcagctcagcaaaactaacaaagtatgttttgtttatttcttatatatatttgtaataacggaaggctcctaatccagttactgttttcaggcagtctgcagaactaaataaactacgccaggattatgctaggttggtgaatgagctgactgagaaaacaggaaagctacagcaagaggaagtccaaaagaagaatgctgagcaagcagctactcagttgaaggtgatatattctcacctttatttgtcatttcatgaataatataggcgtattagttcgttttcatactggtatgaagaactgcccgagactgggtaaatttttaaggaaagaggtttaattgactcacggttcaacatggctggggaggcctcaggaaacttacaatcatggcagaaggtgaagaagcagcaaagcatcttcttcacgaagcagcaggaaggagaaatgccgagcgagggggaagactcccttataaaaccattagatcttgtgagatctcactattacaagaacagcatgggggaaaccatgcctatgattcagttacctccacgtggtctctcccttgacacgtggagattatggggattacaattcgagatgaggtttgggtggggacacaatgcctaaccatatcagtaggtatttaatttgatgacttaaatgtgtatataggtttgaaaaatatagtttgaagcttaatgggacctgtagtctaa

SEQ ID NO: 75544 - DNA, 1890 bp, Homo sapiens
catagatacggaagtctgttctctgtggatatggataaataaatgacattaaagattatagtcatgattggagtgttgtgttataaaaatacctcaaaataagaatttttagctacttagatttagcaataaagacaccatcctgtccttcggaagcttatcagctaaaggaaggttagtgggaaacaggttattgctaagtggatcagatgtatatagtagtagctatcttgatagaaactcagcacaaatattgagtctgaaataatctccaaactgtaaaccctgtaatgttggaggataggatggctatggctgataaataaatggcttttagactgtgtgtatctgcttgtcttattgaaatgtaggagactagttgcaataagcagttttatgatacaacagtaaaggtagaggatgctttttttccctctttttcaaagtagaaattctgtgtttgtgctaatttatcctttctcccttttaaaataccaaggttcaactacaagaagctgagagaaggtgggaagaagttcagagctacatcaggaagagaacagcggaacatgaggcagcacagcaaggtaaggggaagaagtattcatgtaaactttgtatataattttgggtaaaatttcctctctcttccatctgtgaagaaagtataatttggcattttggttatagctcaataaaaatagcttttatactttcagaatatctttctttctttgacatttgttagggttttaaaataagttacctactagctttgcctgaagcattaaagttgcaggcaaaattatagtacatgataggttaatgggatcctggctgtgtgtgtttcttttctgtagttattctctttggttctttggttaattcttttttttttttcccaagaaaatactcacttcttattttgaagagaaaaacagagcattaccatcccaggtagtttacttaaaactgcccatttaatacatgctaacgtttactcatttactcttaatttgatggatccatctgggagataatggagtacgtgttatgtgtattgtttatttctctactactccctttctcccatgaaacgcaagtatagcctgctacaggagcatgcaagaatggaagcaggagagattcaaagaaggttttctagaggagagaatgcctacacgaaagatgagtatgagtaactaggcaaagaaagagacctctgtaaaatgtaatgttttattacagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggtattttttcttctttttttttttttaaaaaaatacaggtggtcacttattagatctgtgtgtctagaagagagactaaagtctaccttatcctaattctgaaatgatgatgaataattataactttgtcttttgagcacttgtcacaatatggtgtgtttgaaggtgtgctcacccacagtcttaggctctttgtgttagattaggaatagcacaaacatatctttaacttctgtcttataagctaactcagattgtctaatcattgtttaaaataatgccttttggaatctaagaatgccttaaaaaaaaaaaagaaaaagataaacaaatgtacctataatacattgtgttcatatacatggggttatttattagcatgctttttctctttttggttgctatttatgaaaggatattttggagcagaatgaggctttgaaagctcaaattcagcagttccattcccagatag

SEQ ID NO: 75545 - DNA, 1020 bp, Homo sapiens
caggtaatgatgctttcttattgcttatgattaataacttgcagccatttaaacactcacctgaatgtctgttgagtgccaattactggattaatagctgggagactagtcaatgaatcaacaaatgatgatcctgagtgctaaacacttgctaattatgtacggtgctgagggaaaacactaagaaagaaatccataccaactaattggatgaggggaaggttagagagcttttattatacaaaaatgtccccaatcctgtcacaaaacaaggagagagaattggccaaatcctatctagaatagtggcttatgtattacagatgttcattaaatatcagctagctctggaaaatcctaatatatcagcagggggaacagtatggtaaccatagatcacagattatatttgcaaaatgatcaattgaaaatttgtacctcagtttagtgactcagccttccaaagttttcaagtgatagtgtaagacctgttattctttgatgtgacatacatgtctttataaataatataaagaaaatcaaataaaaacaagtattgtgaattttgagcttcagtttttcaacttgaaaattctgagagttatttgtagcaaaaagtattggcttagaagtctgacatttctgtataaaaagtggtttttaacattaaaattttgtttttaaggttcggagaagttcagactcccaaagctttgaccatataaatatatttttcccagttgctttatctgtagaaattatagtctaaagtaattgaggaagaattaatgcaggaaagggtgctggtgtggatgtgtatgtatatgtgaattaccaactcagattgaattgtgatctttagttatcagctgagaagtagctctaaaaaatttatcaggagttaaatacatagagaatgctgtaagaatcttttaaatagtaaacatgaacatgggtattactaaactatattagtcatggaatggataattttattattaaaagttgttactaaggaga

SEQ ID NO: 75546 - DNA, 2895 bp, Homo sapiens
aaacattatatattctgcttttatttatgtttttattataacaagagttggggagactttcatttgagtgttagcaattatgtggaagaggtaattgtttagaaagtagtggaagtaaattagtttttgtgtcttataagtagttgtagttcttctgtgtccagctctgtggtagtatacccaaaacaaagttatatgctttttttgtgccgtataattttgcatggacactgatcacttgagttcggaagatctgaaatctggttttgacatagctagctttaacaaattaacctcttttatctcgagttttaaaacagggttatgtattttaaggagttatagtaatgtgtgtgacagttgttagtaaactgaaaggggctatagaaatggaaggtatatgagaactactgaagtaaggatgatgctttttaaggctttaaatccttttgatttgtgacttctgaatgtttattgaatgtacaaatgtctttccttctaaaggattgcagaaaaggataagcagataaaacagactgaagattctttagcaagtgaacgtgatcgtttaacaagtaaagaagaggaacttaaggtatagtaatttgtataaatggctgcaatattttacagaactgaaatttaaattactttgatgcacataatcagtaagtgtatatgaaaaatggaaaatagtctagaattcatttgaaataactgtttttctaaactacaaaattctctagctctctacgaggaaaaattcaaagggcttctctcatgtgatataatttacaataatttgataggaatatgctaaataacaggaattggtggtttctcttgattatttgggaaattttgtaagttgagacatttgcttaactcttttgtagaaaagatgctttacaaactttaaaatcagttgtattaagtattttaaatgctatttttccttgttctaggatatacagaatatgaatttcttattaaaagctgaagtgcagaaattacaggccctggcaaatgagcaggtagatctttattgcttttgagcattgatctcagaatttcaatttgcgtattcttattttcattgatattgtgagccccaatttgattgtgtaagtaaaaaatataatggtttatcatctttggctgcatgatttgatgttactgtttttatgttgaaataaatgtttgatccagtgaattaatcacttcaagatatcacaggaggcagttaaaattatcttactatgctggtttgtttgagtcttttatttgagccatttaattcaaaaaggatatacctttttgttagtgtatatgaagaatggaaaatagtctagaataaaagaagtaaaaaatatcgaacagcaaaacatgttacagaaatatacagtattgctgtaacttcaaatatatggaaatacagctttttaatatgtaaaaattagtgaaaaaaatagttttgagcacttcctgtgaagtgatatcattttcttctcattccacacacaggctgctgctgcacatgaattggagaagatgcaacaaaggtgactaaagtattgtacatctagtcgttcatacatttatgtttaattataattgttgcagaaaatattgctgcttataactgatagttgtgcccataattcttgtagattttctgaatgtatgaagtattttaattttttttttcaccctcatagtgtttatgttaaagatgataaaataagattgctggaagagcaactacaacatgaaatttcaaacaaaatggaagaatttaaggtgtgtgattaagcttgtacactcaggtttcttagaacaaccttgtatacttttcagttgagtgattccagaaatactacgttttgtatgaagtcactctgaaacagtgtttctgtagtttattaggggacttatgcaaaccatgaattttatcatagactttccccctagattatctgttcttttagtggagcttggagatttatttttggcccccaatcttttctcagctgatagtttctatttgggactgtcttatttgtctccactgttgctgtagttctagtttctggtcatggccaaccaagtgctagggtgcatctctgtgtccagtgaaatttgaattatgtcagtgtataattcacctgtcactttgaggactgaaagctgagataaaggtttgattgttcaaaaacccattcaaatgattgctttattaccttttttcttaataaaacagtaaattgagactctttcttccagattctaaatgaccaaaacaaagcattaaaatcagaagttcagaagctacagactcttgtttctgaacaggtaaggcttttcctaaattacaaagtagaaatacttgttatataacaagatctggttcttcttatttaggtaccaaattactaattgagaaattttgcttaagcttagatatggctgttattgcctttctattcatcctgtatctaaattcaggaaattttttctccctgaggtgaagctaatgccaatctgctcaaaagcacattccagaaaaataaaaatgtgtaataggatgcataaaaataatttaagccattttgatacatttgactttcagaataaatgtcctgccttagacttggagcctcagctttttcttttagggagcatggtgtctttaaaggttgaaacttattactagcacttaaaagcagtgtgatgttgatcaaatagcttaacctttgtgacacctctcattccaagcctttcacatggagattatattatatttacaccataaagttgttagatttgaaaggagaagcttatgtatggtgcctagtctagtgctttgtttatgacaggtatctaaaccttaattct

SEQ ID NO: 75547 - DNA, 1063 bp, Homo sapiens
agtagagaaagatttgctaagacctaattatgaagggctttgtatgctgtgtcaggaccatgaacctgatgcagcatgtgggtaagccactaaagagtgttgcaaggataaatgagcatttagcctaacattttagaaagaatactctggtaggtaggagtaactaaaggtacaatacagtaaatggttaaggtgcaggtaacttagacttaatagtgttatgtctttttgtgagatggcattcattgaaaatatagatggacaaaagccatcttcatgaatgatttaaaggcttaatgcatgatttgtttttcatagtataaacctgatttaatgtacttttgacaactcctatttcccttctcatgtttggattattttttcccattgggaagttttttcctgtgcctcctacaaaacaattcttatgaactagaagcagagagaagaattagggtattatgatatttgagatgagtaagctgagggccaaaacttaggcattaaagagaagggtttaatttcataaatatgtacagagtggaattttaggacttggatagggcagtggaaaaattaatatcatttgtaaaaaatgattgtaataagattgggaaaaacaaaaaaatgggaaaaaagtaagaaactagcaagattgggaaagaggtgcacagaagagaatgttctaggagaaagaccctaaatctttttggtcaggctgcttggctgtctgaagataagggaagataagggaatactgagggagaaatcccactttggacataagataaattttaacattggggacttgtgtgtgtaccagaggatgccaggagaagtttcaaaggggactcatcttacatgtcatgttctaatgctttataaatagaatgtattcctgttgcttttgcaatttacaatcagttttaaaacattttatatcttgatctggttggtagttacataatatctatctaccaaaattcactgagctgtgaacaggatttatgcacttgtctacgtaaatgttacaccttagtatagaaaaaaaatcaattaaaag

SEQ ID NO: 75548 - DNA, 6567 bp, Homo sapiens
ggctgaggcaggagaatcacttgaacctgggaggcagaggttgcagtgagccgaaatcatgccattgcactccagcctgggcgacaagagtgaaactctgcctcaaaaaaaaaaaaaaaaaaaaaaaaaaagagccaggcatggtggctgatgctggtaatccccagcactttgggaggccaaggcgggtggatcatgaggtcaggagatcgagaccatcctggctaacatggtgaaaccccatctctactaaaaatacaaaaaattagccaggcgtggtggcgggcgcctgtagtcccagctactcgggagggtgaggcaggagaatggcatgaacccgggaggcggagcttgcagtgagctgagattgcaccactgcactccagcctgggcgacagagcgagtctctgtctcaaaaaaaaataataattataataataatatcattaactttgaaaaatagttaatacatgtgttacaaatttataatttcagcattcaagaaaaagatgagaagttaaagactgtggaagaattacttgaaactggacttattcaggtggcaactaaagaagaggagctgaatgtaaagcattttgtagttttgttttccttgtgattattcagtgacataaaaggatttctctgtaatttgtgtaaggtttttcccatagatcttaaacttaatagtacctctcacatttataaatttatataatgcttttttaattaaagtttttttagaagttaaaaatgcataacattgactgccttaatgaggtagatactattgttatagtttgtcagtttccccacttgcaccaaaattataaccaaatgataactagcagacttaattcatgaaatagtactggaggccagagaagagattgccattctattttatggttgtcattagctttacctaacttgattgggaaaaggttgcgggaagaagtaagttaaaagatgtatttgaatgtagggagaggagtagcttaactaacaagttgtatactgtatatttttgaggttgtccagacatgagtggaaatatatgtggatgtaattgaattaaaaatttgtttggatagctatagaagttacagaattatagacattacagaattatagacatggaaaaaagtgagagttttgggccttccagagtagaaaagaagcagctaaagaaatgagaaactaatgtattttgaagctagctatatttttcagagagtaaaatcatgttttgcttatgtgtctttgaaaaaggcaataagaacagaaaattcatctctgacaaaagaagttcaagacttaaaagctaagcaaaatgatcaggtaatgtaaatttttacaactgttctttgtctctgtgttttttgtttgtttgtttgttgtttttaaattaaaagaaacggggtcttgctcttttgcccaggctggagtgcagtggtacaatcataactcaccgtaacctcgaactcctgggctcaaccgataactcctccctcagtcttctaagtagctaagactgtaggctcatgccacaatgctcggcttttattttatttttttgtagagatagggtctcgacatgttgtccagactggtcacaaactcctggcctcaagtggtgctcccaccttagcttcctaaagtgttggaattataggcatgaggcactgtgcccagcccattctcttttaaacagtgggcaaactgttgcataaaaacaagtctgttgtttctcttcctccaggttggaatatgtcaattatagttttaatttatgaatgataatcagtaatagaggctgcaatttaatactgattgccaggtactgtgacaaatactccagatagggtgccattgcctcttactagagtgataaaaaggttctaagtatacaaatataaagtaagactctagtaaaagaggccgcctgaaattaggcagtttcttagttgtgttttctctatggttggaattattgattaaataattttaacatttatctaatgattttttcttttggcatatttataagtgaccttaaagctacctatgttcaaaatgctatttgttgtcattattatgacattaaaaaagtctcgaaagaatgcctgggcttttcccatttggattttgattgtattggaaaatctaaggataatgtgcatttctatttctgacccatttctattttgaacaaattactaagtaggatactttcctatttccaggtttcttttgcctctctagttgaagaacttaagaaagtgtaagtgataacattattataaactggtttttcttctttggtccattttttttttgtgtgtgcttagaaatctagttttattgtgcagttgggacagctgatgtatgtttaactttcactctataatttttcttaatggaataagagaacttagctgtgctttcccaaattcagtataattaaaaaaaaaaaaacaaaaaaaaactatttccagaggatgggagtcagtatagttgaatggaacttgattctcctctgtattcctcagggtacaaatcttatatttctgatgtacttctgaagcacttaactgacttcttgtgtgcataggcttcagctgtctgttaggaggagctttatgttcaccctggccattctacaaagacatgttgctattttatttaaaatgggaaagggttgatttggagagccatttcattatttggtgctatttttatatcttggtgggtcttggtgatttctaatcaaattatactgcatttctttattgaaggatccatgagaaagatggaaagatcaagtctgtagaagagcttctggaggcagaacttctcaaagttgctaacaaggagaaaactgttcaggtattgggagacagagaactgtgttttatgtttttgtttatcaactttagttaatatcatttaatttcgtgtgtttttgtctgtgcattgcattttatgtcaatttctgtgtttccattgtccaatcttgtctgttttgtcattgtcaaggatttgaaacaggaaataaaggctctaaaagaagaaataggaaatgtccagcttgaaaaggctcaacaggtaaaaatcccagagccatagcatgacagatttattagttgtgttatttatgagctatttgattttttttcttgttactcagaaaaaacttagtatgctgtaggtatattgggttatgtgcttttaattttattttttgcctgatttgagaaagtattcttgatattttaatctgtatatcttaaaaattttaactgttaatggttattttctagaacattttttgtgttaatgtttcattttagtttgccaattacaaatgaaacacgaaacagtttggcaatttttttaatccccctgcccccttctaaaagaaaactgcatggaccaaaatgttatttgaatatacattgctctatctctgccttagaacaaagtacaagtttcattgggatttcagacatagatgtgattactggaaattgatgagttttgctgattttaatctgataaggctttcttgaaaaaatagtgagatttcattgaagagatgattcattcatctcatagattcattcagcaatatttattgtcaaagcagtacttgtcaaagcactgtactcgtgattggtggatcactagctagtgattggagataatgtgttgaatgaaacaggtaggatgaaaagatcatacttttctaatatagattgagagttcaggaaagtcttctcctgaggaactgacatctaagccaagaatctgaagggcctgtgagaagagagtggaggataaaaggtattatcagactgtgtatgattaagaaaaaattaaaaaaggacatcatagagtactgttgagtagttggccttgaaaactgggatggagaagagctctgatacagtagggaggtgtgtggagagttaatattctaattttcagtactgtagaagtatgactggtctgagtgcagtggtgtttacaactgattgatcacaaccagttacagatttctttattccttctccatcccactgcttcacttgactagcctaaagaaaaaaagcatcacattagttagacttattattcataactattttccttgtccctcccccttattatttttagtttattaattttcctgttattggagtcaagaggaggtaaactcaaaacacatctcattttgtcatgaaaaattcagctagtttctttgtaatttgaagtgtacacattataaagacttataaagcttaataagttaaattgaaaggattattaattgatttttctgtcctttgtatttcagttatctatcacttccaaagttcaggagcttcagaacttgtaagtaccatttatctcatttccttttactatttctttttcatgagttaaatagaagtataatgaaaattatagcttcttgatttcaagtggtgttttagaaaatacgaaaatactgattatctcaaaactcctaagggccctaagtttcttatttggctttaacctattaagtttttttgtgggaaggaggtaggaagtcttttcatgatttataatctgaatataacctcaaattgagatgttgctctttgcctattttaatagccatgtgaaattggtatcttccacatccagatcaattgtagtaagttttccaaatttgtttgtattgacttaaacaaggtgatacagggtagaggtacagctaaactaacttactcatgtctggatattcagtgatagaatggttttccttaatcatcctatgcttcctgatttgattgtctccaaaatcttaaatgcctttttttttttttttttttttttgagatggaatctcgctctgtcgcccaggctggagtgcagtggcatgatctcggctcactgcaacctccacctcccgggttcaagtgattgtcttgcctcagcctcccgagtagctgggactacaggcgcgtaccaccacgcccggctaatttttttgtatttttagtagagacggggtttcaccgtgttagccaggatggtcttgatctcctgaccttgtgatccgcccgccttggcctcccaaagtgttgggattacaggcgtgagccactgcgcctggccttgtatgcctttatacttgataagttttagtttagttcaatcagctggtctgtgagtactacccaaaatatacttttttcagtgtctaagatttttgctttttatggtcatgtaacattttcatttagagttctgattaatttattatcagattaaaaggaaaagaggaacagatgaataccatgaaggctgttttggaagagaaagagaaagacctagccaatacagggaagtggttacaggtgagaaattaaaaacaataaaaaatagcctttttatacttgactatcaatttaatttacacctattctttttaaggatcttcaagaagaaaatgaatctttaaaagcacatgttcaggaagtagcacaacataacttgaaagaggtatagtataaacaaattaccaacatgttacataaggaatgataaatctttgtttaaggcattagaaagtaaagatgttaatatgttctgagtttctttgccagaaaaattatgttgtaccatagttttgttgttgtttaaataagttagcttttatttctggcaagtcatacttaactgcttaatctgtcaacctgagcctacaagcatttccttatctctaccttttcaaatagactcttagttcatccttaactatctgtttaaagtattagtctttaatcttttaataagtatgaaaaattgtttaataaaactcattctgtccttgctttataaatgacccaatcttaaatttactgcatataattatgtttttgtttttattggtgggtgattccatatatatgttttagcacctacaacataacatttaatgctaacagcattaaaaatatgattctgtttctcaggcctcttctgcatcacagtttgaagaacttgagattgtgtaagtatgctttaagaccacattttgaagagaaacaaacgtctcattattttccagggtgtgcttgaatataatgatgagtttcctgtacatcattaactttattgttaagtggaaattataattccagacgcaaataggctaagtctctgttgggtaaaataaaggttatttaaatgctttcagatacctggagactttatcctttccaaatccatcaaacccattttttcaattattctttctgcaaatataggctggttttaagttattttttaaaacaaaatatgcaattattatagagattaaacttatttcaaatgaaaattagtatttgaattagatgttagtaacatctctgaattaaccaaaagataatcttagccataatcttgataatgaattttaaacctttctgtaattttaatttatttatagggaaaatggaacttgtcatattatcctgtgctgaataggaaaactgaatctagtcagcataa

SEQ ID NO: 75549 - DNA, 2005 bp, Homo sapiens
tggtgttatgctagcggtctattgcttaggatgaccagggcaattgagattcacttgggctagatagagtaagatttacgtcagcattgggtaagggaaaaacagattaaattatccatagcatctcttcagtacaaaggttagacatattttgtaatttccagggtcaacaaattatgactaagattcttgggggcaaaactccttgcttttgaagtggtaatttttgcaacaatttgataaaatatagttttgttcttagtttttgttttagagtttcttcctagataaagccacatttgcttaagaaatgttaagtatgactgagtagaatgatcctagaaatatctttttaaacaaacttctaagttggtataatatgggggaaaaaaagctggtatgtattgtttctgccatcttttttcttaggggtgatattggagtctggttttccttttttatgtactttagttaatgcagatctttgtaaaaaattctaggttgaaagaaaaggaaaatgaattgaagaggttagaagccatgctaaaagagagggagagtgatctttctagcaaaacacagctgttacaggtgaatatggtgacttaaaattaattattttgtaaattattgtctttgcatgctttaaaataatttttaactgctgccaaaaaatagagtacagaatgagtctccctcccacccagatactaggtgtcattattggcatgttttttgagtaagtacccatgcataaaatgtgtgtatgtatgtatacttgtttattaaatactctgttgaactatactaacttgtatattttgctttcttcacaattaacagtgttttcaagatctttccatataaagcacatttctgccttaacttttaatagttttatgatattggatggttatatcatttattttatttttatttttgagacagagtcttgctgtgttgctcaggctggagtacagtggcgtgatctcggctcgctgcaacctcctcctcctgggttcaagccattctccttgccttagcctctagagtagctgggactacaggcatgcaccactatgcccagctaatttttgtattttttagtagagatggggtttcagcatgttggccagactggtctcgaactcctgacctcaggtgatcctcccacctcggcctcccaaagtgctgagattataggtgtgagccaccgcagccagcatatatcatttatataaccaattccagttgatggatacctagattatttagggctgttttttctgcacaaacagtgcagcagtgaatatccttgcacatgttttgaatacttttactagtgttatctgtatcctagaagtgaaattctggatcaaggcttatgtagcttttttgtttgttaaaagagatagttaaatagaaaatcaatatcttaccttcatgcagttagtattcaacttacttacagaagattgatttgaagtcatagcaaatgtgtagatgcctacattgtcttggattaatcttgctcacattacatgcttcaaggtttgagtctaccacattccttctccctctcatgtaggttcattttaaattttgttagacaatgctagatagacctgcaaaagtgttttcactaattgacactctcaccaactaagggccatttcaccttcttcctttccaacattgacaaggataaaaatttttgatattatacttgaaagatggtaagattatttttaatttgcatttgactgcgagagaagttaagcatttttcgtatgttcaagccatttttatatgaattgtcctttaatttttcccacactttttccactgagttgacgttttttttttttttactaatttgtaagatcctttttatgtaataagggaaattaaataaccttttgttattatatgaggtgatttattttccccattttttcttctgacttcatttgtgtttttcccctttttgggaaatttgaaactt

SEQ ID NO: 75550 - DNA, 1030 bp, Homo sapiens
atattatacttttgttgtgggttagccatttaaagttataactgattcattgccctctggaaaaaaaaatatatttaagggactgcttctacatcagttttaactcctctaaaaatagctactgtgtactgacccaggtaaaactataaatagctacaacagttcatatcttcataatatgtttcttaggggatgagatttctctttagcacaagcctgagcataccatattaggcataaaaacttatattagaaatcatttctgaaattcataggatgggctttgtatggtcaacagtaggtagactctttaatgtacttttcaaggtgctatctcttgatatttttattttgtaatagcaaatgttgataggtagggatctaagttgtattactgtttacctaaaatcttgctacatgtattcatgttctggtttagaatttcagaaagagagaaagaaataagtggtctctggaatgagttagattctttgaaggatgcagttgaacaccagaggaagaaaaacaatgtaagtagatctttatcagaatgaagcttttctttttattactttaacactgaaatatggttcaggaattttttttaaatctacttttactttagatttcttaatctttgtaagaaagtactattttctgtgtgtagttttttcggggggcggggcattattggagaacagttttttttaaataagtgaaaagatgaattcttattcttataaatatttaaatgttgaagctataattattatacctttagttattttaaaaagctaaaaatgcaattgactttttgttgaacttttatttggaaaaacatgtttttcagcttggtattttaaaatcaaagatatttcctcttagattgggctggcctttttgtaaactaaaagtaatgccagtattcaaacccagtatactcagtaatggggtcttttgaaagccttctggaacctcctcctgccctttttttttttttttttttaagacagggtctcgctctgttgcc

SEQ ID NO: 75551 - DNA, 4905 bp, Homo sapiens
acctcatggggttgttgtaacggtgagaatttgtgaactgccaagtacagtggttggcatatattaagtaataaatggtgattattggctttttatttttcgttgttggtttttatctgtttagatttctcattctgaaaaaaaagactgaaatatagcagattatatttgtgaatgaaatgctgttaaaatccagatctctcaatttttaataacctctttcgcctccaagagaatctattttatagccttccagccttcccctttgctttgatcaactagctcatacaattcatgtaaggttgttttgtggcatgaatgtttggccatgccaagaaagacataggacacagtgggttactatgggattcctaggtagatttgaaacatgttaattgtattaaaccatagagaaaaaacgttacactgcagtggaaagtcctatgagtgttattgggcctcgtttaaacatcacatgaaaagctttttataatacttctatatttgctctgtctttaatcttctaatgttcaatgtacctgaaatcatgtatgtattcttggtttgtgtctttacttttgaatgctttcttctttgtcacatgtgcatagtaattattttaaaagctggcctatttgatatatatactaaaacatggaaagtgggcgtctttattttctcattcaaacttctaaacattgctttttatttttttgctaatatgcatattttcccattgaaataattttgcagtaaccagcatttaaatgcagtgcaaaatactgatgaagtaaaaaagcaaaaatctttcaataatggataaactgaaatcattctttctaaaaatgattaggaccttcgggagaaaaactgggaagcaatggaagcattggcatcaactgaaaaaatgctgcaggacaaagtgaacaagacttccaaggttgtaatgctaactcctagaaacaatccactgaacagagaaaatctgcagcttgtcttaaaatcagactaaagcatttacttttactgcaatttaaatataaaatctccttatccatatttatcatctctatcatctctgcttttttcatctactccttgaagctttaattttgggcatgctgatttgttgtgattacctgattgtttgggctttgttgagcacaactttaagctgaagagtctcagaagaccgatgttaacctcttgtcagacaatatgcgccttttgggttggttaagataactttcatgaaaactttgaaccaaagaaatctaggtgaattaacaaacacatttgaatatgtaggatgtgccataaactacgtgttttggagggcacaccaagatgtctcagataaggtagagaaatgatcaaagtcttaaatacaggaaaggcatcaactttgggtgtgttgcttggaatggttccttagaggtggtggactgaaacttcatgtattactggctagcaatgacacatggcatgtttagatgaaatattactatcaagggataattctcttgaccagagtatgtaaagtactcctgaaatatatagccccctctgtcttcagaacaatggaggacattctccttgagctcaagttgtaccattgggtgtgaagatttctaatgaattgtaatagagaagttgtttttaaagattgagaaaattgaatctgccagtccagttaagtattttgaaaattcctgtcaagtgtaaatgtgaaacaggggtattgaattttgcagacaggtaaaagaaagaacctacatgattaattttagcactatgaaaatattttgtgtgccatggtactctattgaatctttaatataagtcttagtgacacctgaaggaatgtttaagcataaaatagttctgtaaattttttttttttttagcaagtatacgtttgtagttacatttcctgtagcttagtggatttgtatttaactatatccctatttatctagccataattttcagtaaaggttaaattcgagatagctgagaggtatattgggaccagagagtaggaaaatctaggtcagataggacatttcattattatttcactgggagtagttgcaattgtacagtcatttctgtcagcgatgagggttttagtgtggtttctggttgtttatattactttgtttttgatggttaagagccacctttttggttttatttttttagtgggactgggtatgtgggtgctaatcacaccattcctacaagaagttacatgctacttgccataggcatttttgcattttatgattctaaaagaaagaatttttgtgcataatgccttcttgcatagctaaagatctacagagaatagaattgaaagtcttctatatttcaatggaatttagacagtccttagatagcatacgtgtaaagggatgttgattgacccagtgccataaattatgttgtgatgaaaaggaactatgtgaaacacttttagtattttaactagaaataagttacggtcagcttacctaaaatgtaaagaggatgatatatgctgtctttacaggattatttttaaaggctaaatactcttgaggagctactgaaagaaactcttatacatttcacttaaagatggtatgcaaattatagttcagttttcaatattagatctttcccagatgttaaagtggaatggaaattgctgtctataaccaaactactgtgtcagatgaaaactacttagctaaaattgttaataccaaataaaagtaacttcccatgtttgtggctcttggttatgttagatactttgttcttttagttagtctttttttttccttggaaagttttcaaaaagctgttcctcagtgtctcttttcctaaccggttttctttaaagattagtactttggtcaaatgataagaattacctcttaatgtccttgaaatagcattaattattttccttattttatgcagttaggtgtattcctgaaaattagtggacttcattgaattattgaaaatatcctattaaaacacctattgtaaaaatactgctgctgatctttaacagctttttgtgtgtatggaaaatggcaaaatctgtagctgttgtgtaaattttcatgtgattagattttctaaaattgaagtgtgtagaccttgaatcagtgatagatttcaaatttcacatataaatgttgggggaaagatatggttgagatgtttctagcttgcttgccttcttgtcacctgttgaactttgtgactgttgtttttagatgattttcttggcttggtttagatgtgcatttttataggggtcttttttttcaagtcttgtggaggtagttgaaatgttacatttttgtttttggtgcgtgataagtcattaccctaattttgacaaaccatggttttgagtttataattgatatccattagacttggatttaatatcagcacatttagacttagacatttgtaatatttgtaaatttatagcagagtccatatacaagtgtcagaactagtttttatgatgtgtggcattagtgaagtaatatgccatcagttgctccttgttctttctttttcccatttatgtcatccatcagattttgatggtcctccttgtttagcataaatacttcacatgaccttgaagttggaaataagagagttaccattttaatgccatgatgttatatagtccatcagtgatgcattttttaatagagatataccagccaataaagctcagttgtgttcctccaatgtgtattttctactataggtagtttataaagttttagctataagaaatgctttttgtgtgtctgattttgaattgttcctggacaggcaaatcacttgatttctaaatgccagggaaaatgtccatattgtcagatattgctaaggcattatttgatatttaggatgctttagagattttgcagattttttcttatgggagcattttaatatcttaaagtgggaaattttaatatttgttagtattaaaaattttttttaaactttttcttcccgtagaattataaaacactatagtttttttcttttctttttttaaaaacattctgtgatcttgtaagtttgatttggctcatcttctgctttaggaaaggcagcaacaggtggaagctgttgagttggaggctaaagaagttctcaaaaaattatttccaaaggtgtctgtcccttctaatttggtaagactaatttattatttttttaacatgatgacattattcaagaaaggtgtgaataagcaacatcatttgcactccacttggtttcagtagagtgctgatttcttgatctttcctattgttaagctggtgcttttcagtaaagattaataacttggttcaaaactcatttctatttacctgatactattgtttctataaaattttatatatgagacattagaggattaaaaacatcatatttgggaaagaaatgttttttaatgctaataaaaccaatatggtaacattcttaatggctttatttaaaacttaattttaagtgattgcttcttagttttagcaacacttccttaatgtacttgatactatgaactaggctctttacattttaaaactcaagatttttggtcatctattaccttcttcaagcagaaatcttacagataatatagaacaacttggtttacttgaggtagtacatgttctcctttgttcagagaattaataattatttgagggcagagaaagtcagtgaatgtgcatgtgagtttcctaaaatagagtgtagggtctttttttttttttcttatttaatggaaaactgttcaacagtagagagacgagcataatgaggcctgatgtacccaacatctctccatagcacttatcagta

SEQ ID NO: 75552 - DNA, 1245 bp, Homo sapiens
ggtttgctgaagcatccccaaatacgtcattagaggtatttagaaactggattggtttttatccttggctactgaaattgggggggatttattattattgttttcttgtatctcaagtggcatgaataaaatcctctttcccatgtgtgtagcataggcattgtgaccatacttcacatgtgggtctgctttgatcttaccacctgactaaagactttagtaccaagactatttattataacattgtttaataaaaatgaccaaaagggttattgaatgaacttcatcgctacttagaaaggttgaaatgtagtgtttccttataaaacactttgaaaccatttatcataatacagtattaagtactaaaacaaacttgaagcataaaactttctggtagaattatggagtttttctttatttcgttctttgcaggttctagagcacaagttgaaagaagctgatgaaatgcacacattgttacagctagagtgtgaaaaatacaaatccgtccttgcagaaacagtaggaaatgatttttaatctacattttgattttactttaaatcattaccttcttccttcatggcctaaatagttttatcttggcattagaacatgaatttttcaaaacaactatgcttttgtctgtaggaaggaattttacagaagctacagagaagtgttgagcaagaagaaaataaatggaaagttaaggtcgatgaatcacacaagactattaaacaggtatttacaaaagaaaagcttagagcagtggttctcgatgtgtggggcttgaaccagcagcatcagcatcaccatgcacattcttgggccccaacccagctaccaaatccaaaacatgtatgtggggtggcagcagtctgtgttttcatgagccctccagaatagtctaatgcccacccaagtttgaaaatcactggttttaaagtatgactaaagggtaatcatatagaatgtagaatgctagttacagaactattgtgtgataaggtaaagaatactgggttcaaaatcagttttaaagtatttaacccataatatagaattcaagaaaaagtcattcttctattcctgggacctgaatgttattttgcaaccttaatttttctcccttttacttcagcgtgataaagagtaccattactcacttattttttggggccaatgtgcagaatttacagttgctgatggtactctaatgcacttgcagaataaatacag

SEQ ID NO: 75553 - DNA, 1050 bp, Homo sapiens
aagttcaatgtgactcatttttaaggtcttttaaaattcatctcttttaaatgagatgcatttcaaaaccttggaagtgtcttttaattgatcagaattctacaggatagaaactgctatatccttggtggttttacttggccatgtaattgtttcacatttcagatgcagtcatcatttacatcttcagaacaagagctagagcgattaagaagcgaaaataaggatattgaaaatgtatgttatttgattgttttacttgtaacctatggatttgtttttagcattaacggttgtctgaagatctatagtttaagattactttatagttatgctcttaatatcttgggtagtgtttgagttgatatagttttatattcataagtgtcataattttgtcttgtggggaaatattatgaaaggaaattttaagtgtgttaacttttcctttgttgcattgctagctgagaagagaacgagaacatttggaaatggaactagaaaaggcagagatggaacgatctacctatgttacagaagtcagagaggtacttacaacagaatcttttcaaacttgcttctcaattcagattaagtttataacagtgatatttcagtataagttgtttgtggcagagcttccgagtagcatacaaaacatgggctatcataaggagatcaatcttaaactctaaacttcattgcagctgaaagatctgttgactgaattgcagaaaaaacttgatgattcatattctgaagcagtaagacagaatgaagagctaaatttggtaagaagcttgtcctccactgggtatcaagtaggcactgaaaacactttattgacatgtggagaaaccatccaggcttttttttctttgctaacatctttagcttggcctttttgtaagtctaagataatcttcatattccgatgattcctaagattatctttcttttcttgactcctaaaatgatccttcttttcttagctcctaacaatggcatgtttggcttccaactctttttcaaaattttccatgttttata

SEQ ID NO: 75554 - DNA, 1183 bp, Homo sapiens
cggcattatatattcgcattggagttacagaactttctgttttgacagattgggttattcataggtatatcgtaaagcatttcttgatggtataatacaggccagtgtggtcttgtactaccccttagtgaagccttaaacgatggtcagtattttgggagttttaatttgactggatttgtagtcttctattcagtgtttttaaaaatattgtataattgactctttaattgaactgtatagattaagaaagcctttaaaaactaacgggtaaagtatctatttggcttttaatttgaaataatttcagtgactgttataaatagtgatatctttaaaaggtactttactggaatttgatggttttgtttttgcatttgcagttttctactctaaactgtagttcatttctgtggcttttcttatgtttagctttacagatgggaacctctactgcttagcctttctatacatctggtgcagcatattggctaatccactgtacataataactgttagcagtcccattcattcttcagtcctagaggtatcagcataatcaaagaatgatgcaaattaagttaattgtggtgttcctttatttttacagttgaaggcacagttaaatgaaacactcacaaaacttagaactgaacaaaatgaaagacagaaggtagctggtgatttgcataaggtaggcactgttcgtcctagagatgtagtatcatgagcctgtgttgtgtgttcaatcttaagcaaacttatgctgctaattctggatttgttgttttgcatcataatattaaccttttataaatttaagctgcttgttattagttagtattttggaatgaaacgttttggcttgtttttccaggattcttaattcacctcattatttcctcacatttctataattaattgctttataaagtacagagtaaaatttagttggagttattaaaatttggctgcatccatatattttttaaaattgggatttggctgtgtattcatttacaaagtatgtttctcttggtcttttggataaaacaaagatataaatttctattttttttagatgtttttccttcatttatttcttcatacaaatatatttttcctaatctcaatgcaaatgaatgatttttaggactgcatttctttgcattggtttgacagg

SEQ ID NO: 75555 - DNA, 1047 bp, Homo sapiens
cacacctggctaattttgtatttttagtagagatggggtttctccatgttggtcaggctggtctcgaactcccgacctcaggtgatccgcccgccttggcctcccaaagtgctaggattacaggcgtgagccaccgcgcccagcaacatggccctttaaaaagtaaaaaatattcttagcttgtattctgtacaaaaacaggctttgggccagatttgactaacctgtaatctagactaatactaacctaaatatcaactatggttatttctgtttttaaatttctttgtatagtttctgcattacttaagcttttaaaaacagtgaacatatgttcttataatctggtggggggtgaagctattttcattttggagggaaaaacctgtgtcgtcttttgagaggagcttttatcttctacaaaatgaataaaattattcattttttatgtatttatcaactgtattacttagtagctaccatattgttttccttataggctcaacagtcactggagcttatccagtcaaaaatagtaaaagctgctggagacactactgttattgaaaatagtgatgtttccccagaaacggtatgtattttcttcatccccagatctctgagctagttaccttgtgacctgtgtaaagaacaaaaatgtataaggtccatctccgaaagtcatctttcttgaaaatatcctgtccctaaaatgtagtgttttcattgatgtttgatctcatttttgcttattgaggtatgttaattttaagggttgtgttgagaggtatggagcgggggtccccaattcctggactgtggacaggtaccagtcaatggctttttaggaaccaggccacacagcaggagatgagtggtgggtgaatgaccattgccgcctgagctctgcctcctgtcagatcagtggcagcattagattctcataggagtgcaaaccctattgtgaactgcatgctccttatgagaatctaatgcctgatgatctgaggtggaacagtttcatcctgaaaccatccccgcactcac

SEQ ID NO: 75556 - DNA, 1058 bp, Homo sapiens
attttcatgtcattgttcagattttttaatgtttgtgtttaaatcagcaatataacattttctgttgtttggttttacatttcttttccttgtgtatggagtttatcatcacttccatcttctttttaggagtcttctgagaaggagacaatgtctgtaagtctaaatcagactgtaacacagttacagcagttgcttcaggcggtaaaccaacagctcacaaaggagaaagagcactaccaggtgttaggtaaggacaactgaaatattgctgtctatgggtaattgatgttatgtgtctgtgtaatgtgtatttacataaataaactcacttcactagaggaaatattccttctttatctctcagaacttccagatgacagccttaagctttcttggagctttagttctattttgtgcatatcttgaaggtcttgtagcttggaggggttatctgtgcctcctttgacctttgtatcaaacagactctcttgtaacttggctgcctgggtttttgtgtgttgccttaatacctgcaacggcttcgttaatttattctgttcttagtttagagtaagtatctgtgaccttttctcccccctcccttccttcctcctttcctccctcccaaaataaaatgaccataacattttaactgaggtaaggttgctaaactggaagtaaggtcatcacagtgtcttaaaattgaaagctggtttttattcaagtttgcttttgttaggtaatctaagaaattcgttcattagctcctgaagtgagatttttacttgaggatagctaaacccataattaaccaagtcatgttatgagcttttattgtctatattaccttggaaggctcagatttggtagcattttaaaatgacttgtattccagccggtgaatgcagtttttgtttttctggttgtagggtttttttttttttttctgttgctacctggattttacctgttttatgaataacttaagtcacactgcctagagtgtaattagagtattcagatatgcactgaatacttcagatattcttcttttg

SEQ ID NO: 75557 - DNA, 1104 bp, Homo sapiens
ttcttcaacatatcaacaaaagtaattaagcctcagctcaaatcttttatccttggtaagctgacttctccagtttcccaatgtaaaaattctgccacatttcctcgcttttccaaattaggaaataaccttgcttcctagggaaacttccatcgcttcttcccaggacttcagccttattctttccactggctccctctgttcagtcttgaaaacatgctcagatggcttattttaaccttgtacttccttcaggttaccacccttatttttttacttttttactatttagtattcttaagaaaatactctctatctacttatttattgttattgattactttatacactctagaatggcttttcttcctgctatttcaatgaaatcatttttgcaaaaatcattaatgatccctaattgctagatccaatataggcccttcttttgcatgtgatcagatactgaaagtacttaatgaaatatgtcaaaaatgctgacattagacctttgtcttataagggaagggtttcatttctagagagcttaaacaattaaaagattgcctattaccccttgcctttcgacctaagcgatattctctctttagcatctcatagatgttctttaatattttccttttcttcctaaatacatagtctgctcattttaagtcttgtgaactatttttggcttgtccattgccacatttgttttaattgtattacacttgagacatatgaatcattgataataacactttttctttttgatttgcagaattatagtaatttattaaaatatgtctgtataccctcacaacgcagttggcaggcagctcccctcctaactgatagcacaacattcttttgtcagctgataaacataagtccaagtttggcaagtgggtggttgacagtattatatcatgaatgataggctggattgttatgaaaatagaggcccaccaggcactctcgaacttcttcattccttaggctctacctggcattgacattgataattcttccttgtgtacttatgttttggttcccgtagctcttctttatacccgttaaatgtttgtgttaccctcaggtttttat

SEQ ID NO: 75558 - DNA, 1303 bp, Homo sapiens
aacttcatatgacctaaaaaaaaaaaaaaaaatctatttctgctcttttaaattatttattcactggggtaaggttgtattcaaccccttttcagtgctactcactcactttagctttacattctcttgagtaggactaataaaaatggattaccagtgttgttgttttaaatgttttctaacagaatttggctcacatttaaaagtatctacctaaaagcttgtttcctttgaatcctgagatttttctcagtttgattaccattagtgtgaattgctttgagtctatttgaaagggccatgctagatcaaatggaatatgtacttttggtgtttgacaaatgtcttctgattgccttctgttgctttgttttaaagtgaaattcattctttctgatcttttacagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaacttgacttgttctaatttttattgagctttaacagatttcattagtagtacagatcattgtaatttagaatacagctattaattggcaaccattcaacaagataggtttatgtagcctctgtaacctttctaactgatgctctgggtcctcttcagtttggtccaatgtaaagtgccccaggagtgctggggtttcagaaaggacagagcaagcatttaggatttcagactaaacacccacacttcaggtagaggagctctatttttaccattactatttttttttgaagtaataataattaactgttagttttctttttcaggcacggttacacagtttacatgtgttatcttttttgttgttgttgttgttgttactgtttttttgatacagagtctcactctgttgtccacg

SEQ ID NO: 75559 - DNA, 1049 bp, Homo sapiens
taggattctttttcctttgctctgaatgtttccactttctgatattgtatttaaatatccaattaaagcattattttccgtactgccaattggtatctcccattggcattttgatagggggattcccatctatgaatcatccaagtagagatggaaagtaaggtggttggatactaagttctggagctcaaaggagagatcataggtaaaaatataaagttggggtcataagcattggatgatattgaagccatgagaatggatgaggtctctcaaggagataatgttgaggagtgagaggagaatgttgttatgactcaactcacaatgacacttcaattctacctggttgatattctgctcatcacctgattacagttatttgtttatgtcttcacttgtacagtactgtatcttacagcacaaaatttcttagcttctttcaaagatttgatttttaactgttgttagtggtttcttttttggtaattacaactcatcgaagatgtcattcagaaaatcttttctttttgtccctggtagtcagggaaatgatgcctctccaagagcgactgtccatctatctcacccttgcctcctctcctaccaccacctccttcctcacctagttgagatgtcccgaagagagttgtatgaaagtcaccaatacctcaggattaggagaagcatctaggctccagtaggcaaatatttctcaggaccatggtcagcatagcacacttgtcctgatttccactctgccctctaagcctttttcttctccttttaaaacagggtcttgctatgttgcccaggctggagtgcagtggctattcacaggtgtgatcctaagtgcactgtagctctgagctcctggactcaagtgattatcctgccttagccccttcagtagctgggactactgtgcctggtttctccttaggttttagtcattgctatgtctgtgagtctccatcttcagctcctggtctccgtgattgtttctgtcttcctagggtcaataaacagtgtttgtgtagatgaactat

SEQ ID NO: 75560 - DNA, 1398 bp, Homo sapiens
gtagaaattgataagctctacaaaaggaggtagatacctgcctcatttcctttggatgattcagtgttttgttaggtaagacaaagaggggtatagtagcttgtagagtttatggtcttttttttttttttaaaagcaggtcccactttctgtatgctttttgttgttgctgtaacctcagcactttgccttgactactccaccctttggtggcaataagaaaccttcaaatataccctaacacttttccttttctcatcctccactctaatttgggcccaaagacatcaaacattagtatcttttatagactaaaaggtctttgaactttaaaaaaatttataaaacaaaatctttactgtagctcagcatgtggggtgatctgaagagctcagatctgtttgtgtggatggagtgtctaattctgtgggctattaagggttacggtgttactggctttgagttgctatattttcctttactaactttagccttgtttggaatatgtggctgtctgtgttgctgtgtggtttctggtctggctttctcagatttatttatttctctctttaacacaccaagactgaaagcttcattaggtcttttcatttctggttgtgtttcatcctgtgatcaatatttggggatgctgtgtataaatgaaagtaaaacaggcttgattcaggttcagtaattttaccaaacattttatcgaaaagataaaatacttatgcacaaaggaccaaaacaaaacaaaatagccgttgctatatttgaggaagaccaatattgtcacattggagcactggttttatatctgctgtgcagggcttgcagtgtggccttcctgaaagtaggtatatggggttgtaggttggcttttgaatggagacaacagcaacttggtagacctcattggtatgggagaaaaataactgtgaaaaggaatttataatgtcttttgatttaattaaacgtttctcctggggtgtgcagaaatctattttataaaaagaaaagtaaaggttagaataattcagttattagttcttactgagcttattgtcaccttcatcttctggaaaataaaataataagagcagaaagtgcttcatatttcttagctttgtctaaatcacctgttctcaaccactgtctcaagtacctcatatgtgatgatcagtcttgagggtatgtggccagtaatttatgacaagtaataaagtgtggatctttcaaatgattcagatatgtcatgttaataatgtcatttttcacccttttgcattctgatgtgttttctcaagtgggagagaaaggggtggagttacatcaggcaagccaggaatgtatgcattcagcaaatatttattggctgtctactcttccaggcatgag

SEQ ID NO: 75561 - DNA, 1060 bp, Homo sapiens
ctcttgcttgattatttccaccagggtgaaggtgagaggcatgtgtattgctgggagattgggaaagatttcctggggcagttggcctttagcagagccttgagaggtgacctgggttttttatagagcagtggtagtaaaagcatggcgattttggaaccttgaggggtatggctggaggctgaagtacttggggagggaggtgaagttggaaagtcaggttggggtattgttggggtattgaaatatttgggctagggttatagtaggtaatctcagagtggtccctgccttcatggagcttacagtccatcaagaaggaagccctttaagcaaacctggcaaggtgctgccaaggagaagtacagggtttcgtgtacagtaggggacaaaatttgtttttgggggagggcaggtttttgtggggagggagggaattctatgtcagcagaggtagaaagggtgagttagctaagggttagcaaggggaaagcagagtacctgaaggcacatcgagaggttgaggggctgagaggctgagggatatccagtgcctttggaattgaaggggtgagagggcctttgtgatgagagagacttgaaaggaaggacctgggcccagtaaaggctgtggcctctgggagggggaagccctgctaataacatttcaaggcattattgcagactctaggtagcaggcagtgtcagccttctgagtaggttagtgaactaatccttaggacccagtcttgcttgaaatctccaaataggcttgttttcccttttgtaattcatttccctcctacctttgtctctcttcccctgccaaagaacagttgctcacaatgggcgtagcccccttctgtgcgatggcaagggtgaggtgagataacgtgatccatttaattatttgggcactcagtggtttgattttgaaacttgtgctggaaccagtgaatgttttggggttaaactccactggcagagcagttagtgatccaagaactctttcctgttacccattcagacaactgtgcctctggagccttgctttccctgg

SEQ ID NO: 75562 - DNA, 1056 bp, Homo sapiens
taacgtcgctgttatgttgatttttcctttcttgtcttttaatcttcctgttagtattgattaagggaaaagtccatatagctcctatctcctcactaacagtacttggtataacttgttccagcagtggcacttggtttagctaatccaaaaagcatagtccaacagcagtccaggaaaagtgccttttatttgcttattgtattagcttagaccaggtgccagctctaaggctttgatgaaactcagttgatttagacccttctgagagctggcatagctttacactgtatagtttgaaccttcctgtgagagcagttaagcctttttggttacataggtggtgaggtacatatgacccagagtttctgaaaaacattctgagcaaacaggcatcttgagatatcagttggtaaaataccaaaggacaaatacagcatcttcataagcagtattagatgttatatgggaaaaaccagagacctggaagcactgcagggaagtaattcaatcagcaggttctgctaatgtaataagcgacacaagggtgaaacctgagtagtttacatgtaccagaaatgcccttcagttgaattattgtcttatcatggttgcctgcctgtgcactactgttatgaatattaaaagacagcacagctcactttttccccagatggaaaaggcccaaatcttcatcaccttagtaatttgtttcctcctcttcccactccttaccgcctttagtcaaagctcatgctttgggtttattacttagaaatcttgtccgggataataaagcatacagacttggtgttgtataaaaactaccacactccagcctgggcgacacagtgaaaccctgtctcaaaaaaatgaaataaaactgctctttaatcgtgccgagttcaggagagagttgcttctctctttgcggtagtgaggagggctgggcggaggggatttccccctcactgaattttccttgctcctgtgcaatttactaattataaattagtaaattgaactgcaagtctcttgcccagtgtgagaggctta

SEQ ID NO: 75563 - DNA, 1054 bp, Homo sapiens
aatgtatcagctacacatggtgactattattaaattgaaaacagcctttatttttctgatagactatttttcaaaatctggaactgttgtttcttctggaccaaaagtaacttggtgaaaaaaagaccaagactaacagtgtaatatgctgtatgttttgcttgctaagaaaacttgagtggttaacaaccttggctttatgtagtaaagacctctgttaactggaatgcttcagaagaggcatgcttttggactgtggaagttttaggttaactgatgattaagcagaaatctttgtagaggattttttttaaaattagagtttgtgattctgctttttctaacacatcatatggagtctgcttgcatctttctttgatggatgaggcttacctcgttgatctttctgaacattagtgattgttgaataacactgtaaatttaaaagatgtagaaaactgggacccaacagaattctctgaaaatcccatttatacatgttattcttatagataaaattaaaacttaaaaatcaagtgttaaaggatgtttagctctctgtaaggacagattgtagggaaggcatttctgttatccagggttccactggttcacttagattctgcgtatttgagtttttgagtattttcaagggggtgtggtggaatgttgaggtccacagtgtctctggtcacacccggaggttctggatttagatagcatggcaacaaaataaatatgtttacttggtgcatctgcggtgcttataatttagaagcatcactgctgtcagattatatttttaaccttttaaactggcatttccttgtaatgcattgggctgttgaaaatgagattaaatcagggtttcaactgaggagaattgggaccagaaagcaaagctggagatgtcatatgtgatatatcattcttcagagctgtttagttagagggctgccttttgtttaaataagaataaaaataataattggctacctcagcccactgaccttggaaattgttacatcctctgatgtaatttattagtgtaact

SEQ ID NO: 75564 - DNA, 1366 bp, Homo sapiens
ccaaaacacaagcaaattccttctaccccattgtacttattcatttaaaatgaattacaaccatatctatggtcactttaaatgaaagccatttgaatatattcttgttaggtgcaaattaatctaatttcttcaaaagtagtcaaagcaacagtagatacaacaataatgtctccttaagttctattttgccttcacagtgaggtctaaaaagaaaaggacattaaatttaagcaaacctttgaaaacaactcctgttttgaaaacaagtttttgaaagtttctaagtcaagactacctacattaaagagttatatgcagatgccatacaatcctcagtaggatcatatgcctctttaagaggatgtttgtcaacttctccttatggaataacggcagggaagaagaatattgaagacttaaaagtacttttagtttttaactttatcccaaggacttaatagtgttttcaatttgaaattttggtttaaccacaagatggaaaaattaatgatgcaagaactggtgcccacaggatctaatgggcaagttggggggtgacttggtattatgggagctttgctgttcatcctgaggtacaggagggaaggccaagagaatgggaaagatgcatgaagctggcaggtttgctggcctgggcatggggttgctgacatagcagctgaacattgatttctatcctttttcccctcgtactctattgtttagttgtcctgtctgctgaggaaagcattagttcaggagtataaaaatagtcgttttgtctggtttggtgagaacccaaaggctatggcaaggcttggaccatcagggagggatggctgttcatagtactgaacagtttcctgggaagtctgggattccgttgcatagatgaaactaaaacttgtttcattcaacttaagacaaagtttccatttgattcataatgaaaatgcttaacattttccaggcattattctgtttactgtgtgtatgggtccgggaaaattaaatgtaggaagagacgacatcagaccagaatgttgtatgtgcgcccctgtgccctcagggcttttgtcaggacggacgttaggactggcaaggcaagattggctggcacgagaatggccagttgggcaactaaacatcttttcgtctttggtctgttaggttttttctgaggtggaatttgcctcacagtttttaggagataacttatttcatagaccaggtgttagcccattctcatgtggctatgaagaaatacctgagactgtgtaatttataaagaaaagaggtttaattgactcacagttcggcatggctggggaggcctcaggatacttacaatcatggcagaagg

SEQ ID NO: 75565 - DNA, 1047 bp, Homo sapiens
ggacggtctgtcccttctccttcatttaaatatttattcagttttttatatcaaaatggagtttgggatatttattttgtcctatgattgtaattcaaagaagtaaattgttatttacttttttgctcagactgtttcagctttggccattgttgagtttcagcatgttggctcctgtgtccttttgacatgccccattgggcacttccttgatttttagcagcatatgatgttttaggctcaccttgtattttccctgtctcagcctgcaatcaaccactttttcacagagcctcatttccttttattggaagatgatatttagaagtcaggatctgggtgctaattgaactcattgctactggattatcattgcttccagactatcttggtggagagctaggaaaaacatgcatgtatactagcatatgcttgtatatacatctatatttatttctatatacatgtatttgtgtgtgtgcatgtgtatactcatactgtactaccgctgattccagtctaacaccctaagaatcattctagccttctcttttcccttacttgtaacttctttcgtagacagtgagaaacttggttctcattactacagcatatttactaccttgttcaatcctattgtatcattgaggattcaaccagagaaacagaactagcaagagatatattaaaaagatttcttgcaaggaattggcttatgtgattatggggctggctaggtgagtccaaaatccatagagcagtctgccaggaaagacagactagaactcttgggcatgagccaaagctgatgtccacaggtgggattcttcagggaagccagagttctgctcctaagccttttcatctgattcagttaggtccccacaggctatctaggagaatctcctttatgtaaatataactgattatggactttaataacatctacaagataccttcatggcagcatgcagattagtgttcgaataactagggacaatagcctggctgaattgacacataaaactggccatcacacctaatata

SEQ ID NO: 75566 - DNA, 1003 bp, Homo sapiens
gacattgagaaagaagatttaaaaatagtcttctttacatattgtggacccctaagaataggtccatgaatctcccttggcgatgcattggttcagtggagagagaggtgcaaacatactttcaccatatgatgtgctcattactgtactggaagttcgtataagatacagtctgatggtaggagaaggtgtgaacattaggttgaaacttgaaggatgagaaggattttgccaggttgacatgtaaaggagagcatttccagcaggactaacagaatgtacacagtcatagggtcttggaggaatgggtggttctgtactattggaatatagtacaaacttgtgaagttgaaagtaacattctagcacagtcttcattacggaattattaggtttgcatgatgagagatcaattttacttgtgttataacattataagataaaggtcttctttttttttttcttctttactgaggtgttctttatatgccatacctcacctacttcagtacagttcagtggtttagtaaattgatacattactttatatgttcatcaccacagtccagttcagaatactttcatcaccatacattgttccctcctgccagtctgtggttaattcctgtgcccgtctcagctctaggcaaccactgatctgtgctttgtctctataattttgccttttctagaaatttcataacgtaggatcacacaggatttagtcttttgagtctggtttcttccacttaacataatgttttcattagtcatccatgttgtagcatgtatcagtacttctttttatgaccaagtgatattccattgtatatcaatggccatgccacattttgtttatgtattgatcagttaatggacagttggattgtcttcaagttttggctattatgaatgatgctgttatgaacatttgcttgcaactctttgcatggatgtatatttttctttggtaggtacttagtagtggaattgctaggtcttg

SEQ ID NO: 75567 - DNA, 1488 bp, Homo sapiens
atctagtaacaatgaaaagagatgtgaccctgttaagatttatgtaaaaatgtatgcgcatgtgtgtgttggctctaggataaagtgcaaatgttccatggtgtaaaaggaccttcacagtacaggccctgcctgcatcagttccctctgtgttctcatgtacagcctgcagcctattcttggggcttctcaggtggcccatgtgctcttgcttccaggcctttgcagatcttgctctggctgtctgggacaccctgtcctccccagcccttgtctgctccgaacatatacattcagcctttcaagactcagtgtaggtgcctcagctgcctgaaaccttcccacacaccttttccctcctctcctcctttcttctgtgttctctgagcacttttgcaaaccttcctattgtcctttgtccctagggactgtagcagtgtgtttgcttctgctcccctgctgaactgtgttctcctggtagcagggacttttcttacatgtttgtgatcctggtatctagtcctgtgcttggcaagagtgaacactccacaaggattttcagatgaagagggaagaggagtcagggaaaatgggggatgggagcagcagatacttgtgagaagtgagaggcagcccatgaatatcggaggaggaagtgtgtgggtaactgtgtctttcaggaaggttgagacccaaacccattcactgattgaaagagcttcaggagagaggtcacctccttagcttacttgtttcagtaatccaagctctcatgctaagaaaatgtagaatgacattttacccaaatcctttcaactagggtttaaatctttttggctttagtatgtatggatccttctgtgaaggcagataaaacattctaaccagggttttaataaaattgaaacgagttgtgaagttagatgctaaaatgggtgaacttactacataagctttaaacctcatatccatggttattgaaaagtgagggctttgcaaacagtgtgcttttccctgtttaactttcttcttatgcatcgttctgctttatgtattctggtaagatattccgcacactgcagctcgttctctgtccttttttatttctacaacttgccaagtttaatcacatgtggaattatgccttacaaaataagaatgcctgcctcaaggagcatgggagtctaggaagaaaatgctatgagaaaagaaatgtaagaatatatcttatcaccaagtatttctccatttggctcatggttcagtttccttggagattggagcccaccttttactttttttttttcttttttaaaactacatcacagtgtgaaatcttttttgttgctctggtagattaatttttacctgaccttcaggagttgtgttgcctcagttcatttccagattatctcactttgcagcatctctgaaaaatatcttaaaatctctaaaatattgtgtatgttatatttttattcttgatct

SEQ ID NO: 75568 - DNA, 1929 bp, Homo sapiens
ttttttctgtgtagatagttgttaacttggtgtccttgtgaggtgggacaatgggtggagcctttaattctgccatattgctccgcctcctcctatatgcagcatttcttaagcaaagagaaataaacgttgttgcgtttctgggctttatagtccattgggtcaggggaagtccatgcatatatgataggttaaataataagagggttgggactataatttcataaaaccaatgttaggcgcttattggcatatgggcatttccttaaacgcggttggaatagtgcatttatacagtgagttagggtgagctacctcaagactggtgccagattgcagggttttctcagagactgtgtgccctgcctttgagtctgtctgtctctagtgtcacgtcctgttcatctgcagtgtacagtctactttgatcatagtagttgcttgtgatttgttggtgcaagtgacagagcagttgctttggaaggaaggcggagtcttcagcctgtaatgaagagctgaccacctctggaatgtgatcctgtgatgctgatgcaacctccacttctggagcccacatcgcttccattccatgtggatgtcgctgtaagagttcaggctagttaagataaaccgtgacgtctccaaaatgtgactgggagcacctagcatcccccttcttgctctggtttcccttagaaaattcttattgacaaatacatttttaggtggcagacatctttttaagactccatctttgcactgtatgccaaaaaatgtcttgaatttaaaaactgtcagtgttgtctactggaaagagtatgaaatttggagtcagacagaactgatgtagctttaggttctgcctgacatttcctaactgtgtaagttcgtgtgtgatcagccattctgagccttttatctgtccactaggagtaataatgtctccttcacagggtttcttggcacatagtaagtgtacagcaaatgttattaattcccattaatatgtgaattaatatatgaactctaaactataaaacagaaaaaccctttattacttggttaagtttcttacacagcattttcattattctttgcagctcccaaatacccttactgtaaagaccaactgtttgctctgcatatatgaagagttaaattttcatcacacatttattaaataactgtttttaagtctccagaataaaaaagaaagttaagcctgaaaggctcttatgggctcgaattgaaacacccctgttgcagcagctgaaacaggtgtggcagcagcactcggacattttatttctacaaacttactggctgaaaagcgtgccagcccagggaacgttctgaccttctttcatgggacagtaactttttgcctttgtaagcagaattttgtctttatgactgggctctattctactatacaaaagatggttgctatggtttgaatgtgcccctcaaagttcatgtgttggaaacttaatccccaatgcaacagtgttgagaggcgggacctataagaggtgattaggtcatgacggctccacccttgtaaatgattaatggtgttatatcaggaatgggttcctgataaaaggatgagttcaatttcttgctctctctggtacacatgctctcttacccttccaccatgggatgaaacatctagggaggccaagcaggcctctccagatgcaggctctctgaccttggacgtcccagtctttagaactgtaagaaagaaatctctgttctttataaattactgagtctcaggtattctgttatagcagcacaaaacatactaagataatggtcctctcatcagccagccagcttgtaggttttcattgcctaccgtgtgtccctgttacactgtgccaggtgccagagatacagaaggcctcacttttttagaac

SEQ ID NO: 75569 - DNA, 1049 bp, Homo sapiens
gccactcttggataccgtagcttggaactctgaacacacattcaagtgcatctaccatacagggtcattctcaatcacattattgctgtcaagtgcacctgccatacacacagagctgggtagaagtgaagggcatacatagcaagccttgccagatcttgtactaattgtgtgtaggctacagtagtgaaaatgttcctctaagttgtttacaatcctggctgtaattggttcacatatgcttcctttaatatagagtgttcatcttgatttaagtgacatggaaatatattaaaacaaaacgggtttgtaatggttgttgactcatggatactttatagtagtcatcacaaacacgtttaagaaaatagtgtacatgattctgatctgcctgagaaaaactagaggaataagacttgaaataaattatctttttattctggagacatttttatatagctgacattcctttgtgctggaaatggaaacattaaaaagacaatgggaataacttacagtgataatttgaaaccattgtcagactgtgacgctgacttgactggtgaaacaaacacacaaagcccctttcttccaacttctgtttcccagtgggcttcacaagttcttgcttcccctgtccggccactcccttctgggtgtagctggaaaagtggagaaggcccagggatctgtgggacaggaacaagccaccaggcctgctgtctcctaaccttggtgttctgggggagccttggagctgtcatacatacctctgtaaattttaaatgttccttgttttagttttttattttttttcttgaaaagaacttccgccaaggtggaagcagagaatagttgtgttaatgtagcaatatgggtcatcagtaagaacatacaagggccgattaatccagagttagaaaatacaactgaaaattgaaatgctaactgtgatcctgcatgtcttttaagcactggtattagctaaatacaggaaacctgcttaaggacattatatgttttccagatgacttctaagttatttgaca

SEQ ID NO: 75570 - DNA, 1439 bp, Homo sapiens
gtgagctgttctttttccttcttatttttggtttagtttttcacttctgttactcacaaagcaaacattaggctctcttatttaaatacattttctttcaaaccacctaagtaaaatgttgagctttttgctgctgtatttaagccaggcagtgttactttcactgatttaagatctgaagcagcatacctacttatcatcatttcattatacagatttgtgtaagagtgtttaaagtaggttttaagatacagtatgtttaaaattaaaatttgaggtatgatttgcagtgtccactgaatacttcaagaaagtagaagagttgcttcattatatcacagttttgttagtttcagcaattaatctagtttgacattagcatttttgtttttctgtaatctttttttttctagcatatgtagtttcatcttttcaaggaccaacaactaattttgtgtgtatgtattgatacttaacataaattgctgctttgctgtgtggtctgggtagaattattcattgttttctagcaaaaagggacatttgtctcttttttcctgcatgtattatgtggttgggagaataatttctgtccccattctcccaagatgctcatacattaatcactggaatctgtgaatatattaccttacatggcaaaagggattttgcaggtggaattaaggtcatgagacttaaaatagggagattatcctggattatctgggtgggcccattgtaatcacaagcatccttaatagtgaaaggggaatggagaagactcatgagatgtgagggaagaaggagcaggagagatttggagcatgagagggactccacctgctgcttctggatctgaagaagaggggactatgagccaaggagtgcaggtggcttctagaagctgagaacagccctggcagctgtccagcaaggaaacaagggcttcagtcctgtaatcacatggaactcaatcctgccaggtccctgaatgtccctgaaaacagattattccctagaacctccatagatgctgccctgtcagccccttgattttggccttgtaagactcaggcagagaaatcagccaagcctgctgaacttctggcaaacagatctgtgacataatacattagtgttgtttttagctgctaagttttgtggtaatttgttataaccacaagagaaaacttatacatactattttatggaaaatcaaatgcaaaatacctcacattactgagcagctcttaatctcgtggtgggggaaatgaaaggttggggaagagatgaaagaattgagaggcagggaatgaggttttttgtttcttttaaaattcttttggatggagcattagagcaggaaagcttgactctagcactcagtaacttaattatctgtgtaattatctgcattactgatatacagtaattacaat

SEQ ID NO: 75571 - DNA, 1031 bp, Homo sapiens
ttcatatgaatagttatatttaaaaaaaatctcttcaagtcattctgtagtacttgattgaaatcatgaacatgacataccacttcatcagcagtttttcccagcattaaattattttattattttactctagtgtcacaaatctaagaatgtcatttctaaaaatttctaaaatagcattgataattaagtcttacaagttaggtagactgaatgttaaatttggttctcttaaaatgcagaagaatgagaattctgataagcagatcttacccagcattttttattttaagaagattttctttaaagtacacaaaacatacatgtagagtttgatgaattttcataaagtgaacacatccatttctacagtacccaagtcaagtaacaggacattatcaataccctcaaagacccccttgctcccagttactctcccacccccaagcagtaacagataacccccatcctgaccaaacaccacagattagttttggtactttgtacagttggatctatagtatagactttttgttgctgactactttcatgtatcattatatttgtgagcgaaataacctctgttggatatcataattgttcattgctatataatattccattgtgtgaatattcattctgttagccaatatgctttaacattttgataacactaagacctgttaagtttttgcaaattattaaaggtattttaacttagtttaggatgtaaagtcaaaaaatatggaagtcaataaaagctaccagtggtcacatttataacttgcagcaatttgaattgtagttatttgttgcataagtaaaaatgtgtcctcacttagaaaattggttagtctgctaaaacagtaatgattttacagaattgaatatttggaggatgaactctatggtaaactctggattttattctgaaaggtgagtgacagtccccgatgccaccccttttgtgaaatctgtggtgttctctagtgtgccctttccctaccttgcattggacttggtcctgacaa

SEQ ID NO: 75572 - DNA, 1068 bp, Homo sapiens
atggaaatggaaactgtcagggtaatgatatcttttctcctccaacatgtgtggatgaagttacagtttttatcatcatgaattacttttatttctgttttgcctcttactttttgggcccaggcagaagctttgcacagtggaggcagaaggagatccagaagggaattagctgattggatacccagagaggagtacactttaaaagcagagtccaagttagcaggcgagaggagtgactagcccacagggcagcttagggcagttcctggagacagaaagagggagagggacaaaggccagattgctgagaataagtagaaaaagagcaaagcctgaagcagcatgtggactgttgtcattcagcagtttgacagtttcattgtaaagagaagaatggtggtggtggtgttttaggatggaggaagcaaaaatgtgtttgggggtgaggttaataagccagtggtagggaggcaggcattgaagtagcaagagaggggctcagagtgagcaatattggtgaggggtaggaagatgccagtaaaaaacttaagattatttatttagttggatttctcctgaaggatatatcagttttctgaatgacaaatatgtgccttgcacagtggttttattttggtttttggttttgggtttttttgagacagggtctcactctgtcacccaggctggagtgcagtggcgtgatctcggctcgctgcaacctccgcctcccaggttcaggtgattctcccacctcagcctctcaagtagctggaactacaggcatgcgacactatgcccaactaatttttgtattttttggtagggacggggtttcaccgtgttggccaggatggtctcgaactccagacctcaatggatccgcccaccttggcctcccaaagtgctgggattacaggtgtgagccactgcgcctggccacagtggttgtttttaaagactcatttacaagatttgtcctaatgtcactacagtataattcccatcttggaggggtgagcatctgcagctgtgaggcacagagggaaggttgatgggggaggg

SEQ ID NO: 75573 - DNA, 1523 bp, Homo sapiens
gggcccagcaacctctagagtttggaagctggatgttcagcctttttgggtggaatactgtataggtgtttttcatttgtaagatatacatacaatgaggggcatagggtagcattttgaagtttgatgagtggggaaaggctgattggaagggtagatagataggctaagacagctcatagcctccgggattccacagcctcgggagaaatgaccaaggagataaacagtgcagtgcagcattgccagcgttgacagaggagcattgcggaccagcaggtgactgcataggcttcatactctcctgaatagccttttaaattttaatttagatattatgggcatcttagcaaatttcacttaatagtcacacatgttggtcagtaagtaataactgctttttttgcttagctctaagatgttggcatatgtcactcatgaatcacacaattgagcttctcttatctatgtgacagtctcacttctaatagagataacatcagaatagatttctatcagccttatttgagactcagcaattgaaacttctctttcctatcttcagaagtgtatttgctctctaggaaataattctgtagtgataggttttaatgtgtcttggaggctacacccttttcatgggcaccaaggggtttggacatttaaggatagacaaccctatactgttgctgtagcgaaacataacacacaggaaagcccgccgggggagcatgctgctgaatgcattgtgagggaatagactttgatgttcttttcacatgatttggggtttcctcaataggtaggtagaaggaaataatacttgtcttttagatttaggacttacttatagctttttcaaaacatcattagttcatgaaccaagactaaaagacatgattagaaacaaaataacttaaatcaattgttggaaattcatatttggtgttcaactgtaatactattttaatttaactctacattttggtagcaaaacacatgagttaaggagcattttaatttcaaaattaactgagtcttgagaatcagaatgagtcttgaagtatagcccagttttgcaaatcagatttttaattgaactcactattgtttaattatgcttgtcaggtcttgtcactgtcaccagcggtgtggaatttaggtacctaatgctgtgagctttagtcagtagcttaaaacagtgtcactgcaaagtaatgacactacagtgggttatagaaattatgcagttttattttgtagtcacatttcacgttgttatgtggtggaatatatatcacatttaagctaataatatgattttatttttatctgggaaatacatgccagtactactcaggaatttgcttaatctggcttatattttgcagagatgtcatctctaagctttcaaggtagcatttaatgttgctttattttttagtcagcattatagaaaagtaaatacaaaaaacttcatgcagttgtttatgtatttgctttttgtgtacccatgaaatcat

SEQ ID NO: 75574 - DNA, 1082 bp, Homo sapiens
ctgctgttgtaagaggaggactcctctggcagtgaggggaggactgcgtccggcttggccaggggtccaccagaggtcccccgtctgccactttctgagtgacagccaagcctgggtcattcttttcaccccactcactgcatcaggaaactgtgtagtttttgaggtttgcattaaacaaacatttgataccctttcattctgctccacattaaaagctagacatacatttcattataggaaaagcaaaaacatgtaatagaaaaaggcagtttatttcttattttctaacctttgggattttaaaattttgacagtcatctctctgttctctcctctcttggcccaacgtgctgtcacttctccgtggtaggattgcctttcccttctgcctgctccatacagtgttatactcaccagctcgcagatctgttagcaaatactgtttagtcaggctcttgctcagccagctaatacagagctactatttatgaagggtcattcaccagggaagcactctgctaactacttttcacataggacctcctgtaattcctccaaccacctcattaagttgggtattctaactattcctattttatatatgaaaaaattgaggcataatgaggacacctgctcaacatcatgtagctaatacgtgataaagctggggtttgagccctgttttgctggactccatagccagtggtctaccaaagaagagactgattttgtcccttccttggccagattaggtagttgtgatctatcattgttttctggcacatctcccttcaaataatgtaaaccttttctaaaaagtagctagcagcttttgcacctagagaattttttttgtctgttctgatgttcaattaagcagactagtctagtgttcaacatataagccaagaattgcactttcttcttatttatgccttatggcactagagcaaagaagtagttccaggtggatcttctgataataaaaatgattagtgttgagaccaacattgttacttctttacttgttgccaatttttacacatttgagaactctgtagttgactgtgtagtcagtt

SEQ ID NO: 75575 - DNA, 1060 bp, Homo sapiens
gaatcctacaaggacttccagaaaatataaacagctgcacagtttgaattatatacttcctacatttcttcagttttcagaagcacgtgattctgtcctttcagcagtgctgtgaaggagaggaggcacatagccctcgtttataagccaggtgaccgttaggcctcatgacattctgtgccatggacagctgtaacagactggagacaaagccgtgcctccacctgcaaaactggccatgctttctagaaagccgaagttgcatttcatagactgcaccagaggctgtaatacccacttctaaaaagaacaaacactttgtgaggcactgaatttaggccattgggaaggagaggaagggcctacctaaggaggatctgtgcccaggaagtgttgctcagtccctgagacattaataggagggagttcaggtaaggcagccagtggtcacttggagaaaggaggataagtgggttcgaggcatcagcttgccctggacctgcagtgttggcagcaggttccaaggatttgcctgccagctgttgaggctaaaaatctaggaataggcacatggttttccaaccccctgtactccacctaacacagtgctcaggaataattgtttcattttataaaacaaactgcagaagacttgtatttgccagatcccaaattggaaatgagtgtcttctctaaaactcctttgtctgactgccaaggtaactagacttatcacgatgagagactaggccaaaacacacacccataggggcccagcatactgttttaagagttctccctttttgtgtagatgctcaaagggaaattgtacttacggaaaccttcagctgtctgaaaccatcggtgaatgggtgattctatagagaagagttttataaatagttgataatttaaatgttcagattttattttaaccttcttttgcatggttatggcctcccttgagacgaattgcttggttccttttgtgtgaaagagggataacaaccctcaactgggagaatactgatgagcttagcatacgtatcctgataacatg

SEQ ID NO: 75576 - DNA, 2073 bp, Homo sapiens
ggctgctattcttttttagctttggactttttttttttttaatagtttttccacctccttttcttagttttgaaaaaaagtgtactgataaaaaactttaccaacttcctgctgtattatgctagaagctttatctgtgtcacctcatttaatcttcatggcaagatgtctttttcattggtctgcatatgtgtggcttaattaaatcatttcgtagctgtgattcgttttttccaaattccagaagttgttttgctggatgtagatcagaagtgggaacaacttagttcccttaatttgcctaaggcagattttccttaagtcgctattaaaagtgctcgcattgttaggtgaaccaagtgttgaatggtactttacaaaggtaagaacattaacatctaccacttagttgaagctcaccacgtgcctgtgccagacactgtctgaaacccttcatgtatttccattaaaacagctctatttgacttagaggaactgatatcatgccttaaaatgaaaaaagtgtttcatcaaaggcaatatgaaaataatttgttttgatggaaaaactgtctttttagtgcacagtgaaagcttaagaggatagggagcagagccagctctagtttgtacatattagaaaaggatgccctctctgggcagacactgcacaggcttggtgaatggatggtcctcttgtgcctctgattctctgacgctaggctgtgtggcgcagggagctgagtgcagggtagatttcagcttcttgtgcgctgttgtgcattgcacagcctggcctaactacatggcagctgaagtgtgtgtttgcatgttgtaggtggggtagagtgggcgaaggtgttgatggagaaagggcaaaggatgaacgaaggagaagggaacacgtacaggacaaaatgataccttggcaaatggtgaacaatcgaggacattatttgagaattgggaaggagaggaaggggtaaatggctgcagccgacccctgttcaaggcctgtaaggcagtttggtcctcccagtgacccctgatgctcgtgcctccgtccacctctacagcctgtggccaaaacccaaaggaataaagagggccctggaaaacccaagcaaattgcactattctcaccaccactgccgctgccaagggagtctttctttccttaaccgtaactccctctctggtcttaatttctaacttcagagcttaataatgcttcttcttaaggggcagaggaattcttaggctcccagtgctctctgggagaaggacttagagacactgggggatggtgtgaaatactttagagctttgacattctcccccttgactcatatgggggttccctgtcactgagtagtattcagcccataggtggtgagacccagcccttggtctctgaagaccatcctggtctctactcgcatgttgtcctgttcccctatggcttgcagatgtgcagaaaaaggccacaattgtggattgggtgcagtcataataataggaaagcaaaatatgaaagcagatgtagagagaggaaaatctaattgtaaaagagcctgtttataagttgcatacatgtcttgattatttttcttcttttcatactagaaaatatttgatcatttattattattaactccattgagggccaaatgcagatttcaatactgtgtttagtaactctctgaagttgcagaagggcaaaataagtcacagtaggtttttcgttcatttttctaatttaggcatcattcactctaatttcataagatttgaatgcagtttgctaaaattccagaaggagattaatttaccagttcgtgtcatataatacttgttttcccgtaccatccagcacccattttggcaaatagaaatatacaaggatggtggagatcgatgtactttagagtgtatttctgagagcaaatgacttcatagtctacaaaatagtggggcagtataaattcatcttatgtgaaaatatggatgaacatggcttttaaaaggagaaaagaaaggagaccgatgaatgtgtatatatacttttaaaag

SEQ ID NO: 75577 - DNA, 1048 bp, Homo sapiens
aagtcaggtcccgcccaccctgcctaaggaactgcagagaggtggcaaatcagcaaaaaggacaccaggctcttcttggccacttgtaggaagatccctttacaattttgactaaggagattttttttttcacagttgagttagtttgtgaaaataaagaactctgtagctcaccaaggtggagaaacgcaattcagaaaagtaatttctccaaggtcacttctttttttatgtcttgccatcactttaaaggactagccccactcccccatgtgtatacacaaggaaattgcagaccaattagttgtcttggcctgactctaatgccttttgcaagtagctttccagaagtaaaagtcccagtgatgtattcccatagaaatatttttcagttgtttatgtcgtttactacaaaaaaaaagattcagagtggatggagtacaactctgagtatttttctagtccggaattttttattaataatcggtgctgccgggtcatgcatgctgcaactctcaacatttcccttatttggttcagcttttagcaaaaagggctacagttcaccctgcagagtattaaggtttctggatttttttctcccaactgtggcccaaaagaattaaaatctgttaatataaatagagaacatatttatcattcctcgatagttaattatagactttggtacctttgtgcctcagggaagccacgtgatataactggttatagaatttcagggttagggtttaaagaaaggagaaagccattggaaaaatgatgggctccattaaggagactaatgaatctggatgcagaaatatgtcagaaactggcataaacatgattgtagtagaatttattttccagtaccaatagggaaattattttaagttattacatttactgtattgggaaacttgaggagaactctttagttcataaagcttcaatgtcttttttttttttttcatggaaaaactcaaacctctgttatttgggagctcagtattgtgtggacacttacgagagttttctgcttaattga

SEQ ID NO: 75578 - DNA, 1085 bp, Homo sapiens
tctgccagtataatactgaatttaagttcttggggatattagtttaagtaatgtactaactacttctgaaggctgaatttctaatgtatctcagaaactggatatgggaaaaatagagttttatctagacgtgcatttatttccaaaactggtgaggcacagcagttgagttctcactggagtgacccatgcgagacctaaatatccatttctgtctgttacatatttttatgtgccttaggttttacaaaaatcccttgctccatatttacccaactatagaatataattagagtttgacactcacctcccctttgagaaaaggaactgagaaaattcagttctatgaaagttgaaatattttgtagatatttgtttaataaatattgttagagaaatttttctaaatggaatagacggtttttaatcctaactggaattcagtacttttcagctacaaatctgacatgatgtgattgtgattggattagtttcctattgctgctgtaacattaccaccagtttcatggcctaagaccacacacatgtattatcttacagttccagtggtcaaaagcccaaaatgggtctcactgggctgttgtcaaggcatcaatagggctgtgttccttctggaggctctaggagataacctgttttcttgccttttacatcttctagaagctttctgcattccttggcttgtggcgccttcctctgtcttcccagccagcaatggccagtcgagtctctctcatatcatatcactgacaatgattgacctgtcatcctctttcacttataaacaccattgtgattacatcgtgcccacccccagacaatccaggataatctccccatgtcaagatcacagccgagcatggtggctcacacctataatcccagcactttgggagaccgaggcgggtggatcacctgaggtcaggagttagagactagcctggagcctggccaacatggtgaaaccccgtctctactaaaaatacaaaaagttagccaggtgtggtggcaggcacctgtaatcccagctactcaggaggctgaggcaggagaatcgcttgaac

SEQ ID NO: 75579 - DNA, 1033 bp, Homo sapiens
atgggttgttgttttaaccctcccagctacccttaaaagtaggtgcaattattattttccttttataaatgggaaaactaaggctaagctatgcccaaagtcacacaaagtagagaaatcaggaaaagaaaagtatattgacttcagaatatgcccccttaacctctacttttcgtcaaaacatttcatgaaattcttttctaaatccaccatcacatatgtagtgatgtttaaaatttatttaaaatcatgattattgccttgcctttattaatactgtattttattttttcctaaaagaataaagttgtgtattcaccttgagttaccaaactttaggtgctttaattttgtttggtttgatgttaaatagtggttgcttctaatatttttatgttcatttttgggaatgataaactgttttccaagtatatgccaatatggaaaatttgctttatcgtatatttgataattgtgtttacatgttgaatgcactattcttgaatgtttatgaattatattttcatcaataaacagaacacatctcaaaaccagtataaagcatgtattcttcttcctgataagtcttacattttactccatagattcatcacattgtgtcgtcttgccaaaattattttttgtaccacttgacacacacagttcatttatgggcagggtgcttgtggtgcttttcggggagggggtaggaatctggccttcactaaattagtttgtacgtgagtttatttcaaagatactgtctttaacagatgtgatgtgtgacagtctagtctaattaatattgagaagtatgatataaagggagctggtttttgtaaaggttaagcatctgctgacaactctgggcttgccattagtttgtattgcagacaacaaagccgtggttctcagacaggaacgtacttcagaattacctgggaaacttgagcccccagtgcaagtgggtcttagtagattatggaatttggaggtgtgggcaaggaatcttcatttttaaaaagcaggttaa

SEQ ID NO: 75580 - DNA, 1036 bp, Homo sapiens
acagttttaataagtttattatttaataaactttattatggtgcatgatcccttcaggcaagaccttacgactgtcagcatggtggtaatccgatagcagtgtggtctttcaactttctaaccaatacgatatttcagaacctgctttttttcaatagccttttaaatgaccctaatgtactgtgaacccagagaacaaactgcttaagaactgacaatgaaatatgtcaccctttctctgggtgacgcaccatgtgatagacgctgccaaatccactaaagaaaatatttatttgtattgcctcaagaggattacaatagaaaaccactattcaaacatttagtcattggtgcctaatctttatagctgcttgagaaaagggctacttttcaattaaggcctgtgggactcttcctttcctagatgaaaaccttctaactgttgctaatttttccgtaggttgcccatcctcctggctatcctttgttcacgctggtggctaaactggcaattacactgtttccttttggttcaattgcctaccgcgtcaatcttctctgtggcttatttggagcagtagctgcatcattactttttttcaccgttttcaggtaaagtagttgattagttaaaattaattttgagcagttggagatgtagatttcttatggctcaagtacatacattaaaaaaatcttttgttgcttggtttccctaacacatgtgatttcactttcttaatttataatactttcatatgcatttgacccctcaaatgattacacagttggttttgtttcctacagtggagtgaaggtgtcaccagttcattatcacagttctctgattaggcagaactaatgaggtttgtcattttgtgaagatgcagatgggccagtttaattcaacaatatgaggttcatcttttggtaaatggtaaatatcatttaattattcacagtattgctgacgagcagctgcctatcaggtccagggctaatacctaattatattgtattctaaatatgaacatgt

SEQ ID NO: 75581 - DNA, 1049 bp, Homo sapiens
gctgctaaaaattaatttgattaaattttagaaggcgaagacttgattctgagcactgtgtctgctattcttagagcttcagctaagattccattcaataaagaatagaaaattaaaataccataccttagagaatgcggaatctcttgcttaagggacatttggattttccagctcaaagagtattttagattattgccatagagaataatgtgaagctcttcctaatttcagaagtaactatgcataagtaacaaatagttaccaagtttttgtagttgaagaagaatggaaagtactggagcgttaatttccattcaggagaatatctgtcttgatccgtggttaattgatcatatatttctctcatacttgtattaaaattgcattgacttagactgcttaagcatattaagagcttggttcatttgcattttcttataagtagagggacatattaggctcaaatagcagcgcttcattttgaagggaaaaaaagcagggcaaaaactcttttttaagactgtagagtcttttctgacagctagtcagagttagaattagttcaaggaaatgttaataatgcactgcctggcctaatccctttgatatcaccaggtatcctcctgttcatgggttaattgctttaaaagctaaggcaatattctgagcggtgggccgcttcaccttttcacagctgttaccattgagtgacaactaaatcccatgtgtaagatgaggaagagctcaatctccaattgggagaaaatttatgtaaaccacaatcccttcagaatgtgcggaagtcatagactttcttgatttactctgcttttcccagaaagctctattgttcactttcctaagtcccatcaaccctttgtagcagaatatcacagcggcagcagatagcttgaaatatataaatgctatcatagctctgattaatagcagtgcttatgagtcaagtctgataacagtgcagctctccactcaatttcagatactgctaatggaatctgtcttctccaattgtaatatgagaaggc

SEQ ID NO: 75582 - DNA, 1010 bp, Homo sapiens
ttctaggctgactgatttagaacttatccctcaagcagcggagagtccttaagtttttgggctgggtagtcataaaggatatgttttaggaaacttgatgtgatgttatattgcagaatagattgaaaaacagaagacaaattagggaactcttaaaataattaagtgtaaggcagtaaaaatacaaataggaatgagtagacaggaaagtaatttggaaggaagaaataataatgtgttgaatcaggatcgctggaagaacgggaagctgaaagaaatgggaaactgctgattttttaagagaaagaaaacaaataaattgcaaacagaaaatcaaagtaaaaacaggtttactgatattgagatttttatttaatcatttaaaaataatgattgactaaagccatagaactaccctgtaactttttatacaaaaggatacagttgaaaatcaatggtttggagctatagaatatgataattgttggacgcagtaatgcttgctgaattttctaacactattagaaataggcatttcataatagctttcattttcatagttttagattaataaggaaatagaaagttgttttggtttgatatgcactagtaaattcatccacactaccagtctcaaaacaaatctctgaaccgagatccagattcctgattgttttaaatggtatgggttttgttggcatttgtgggtgagaaatttgtttctgagtgtagcatctgattcttctggtgttattgaaattcacattcccatcttcttctttagaaaaaaaattagttttaacttcaccgttgtctaaagaaaaaaaacccttgcaaagtaagaaatgcactgtataagatattgaaatcatcagatattgtgatcaagacattctttgccatatgctgagagatgaaaatagaaggtacctaggtccaaacattctacctgaagtgagaatgcatttttctgaataaatattttttcatttcattaatttttacaatca

SEQ ID NO: 75583 - DNA, 1055 bp, Homo sapiens
tatttatgaaatgtaagtcatcattatgtaagttagggtgcatttgaatgcaagaaacagaatacctgacttaaatgactgagtttttagcctcacatgagacgcagtctggagataggtgatgttaggattgataatatgagcagttcagggacgtcagtttctgaggcagtttttctgccattctcttgacttttccctcccagtcacaggatgcatgcccagttccaaacatcacaacctaaaacaaagcacagtgcttcttctggggtatctccctctctctatttattggaaataacatgtgccccagaagccccccagcagacctccactcaggccccactgaccaatactgagtcatatactcacacctaaactgcttattagcaaaggagaatgactagactgagaacattgcagcctgagctacctgatcaaaatgaagattgcattagtgaaaaagaagaaggtattcactgttgagtgggcaatcaacagtgtctgatacagttattctcacatagcaaggttattttgagaaccaaatgaggaacagtaaagtccatagcacacagtgggtatgtaattaatattaatatcctccagaaccagaactattgggtaataaagcctaattcagtaagtattttttgagtatttacagtttagacttagattaaaattaatttgtcatttgctgggtaatgtcttacataagacaagtaaaacataagcacaatttctcaaatgatgatatccgaacataacaaagctttggtggtgttaatgggagtctcttctttaaaaagagggaatgaatacatatcaaagtatagagttaagtatgtgttaagtatagaattaagtaaaatgattttttctaatataagtaaattatttaaatcaaaagaatgtgtaaacttgtaaggatatgtaattaatatagggctactaataaattcagataatttgaaatgccaaaagagtttttaactttgaggcctagattattacatgattgagcttctccagggcagggattatatcttatt

SEQ ID NO: 75584 - DNA, 1060 bp, Homo sapiens
tgctgcgtcttcaggcaagagatgcagatcctgaagtgctgttatcggaaaccatcagacatttccgtctgtactctcagaaagcaccgaatgacccacagcaagctgatattttaggtgctctaaagcacctaagaaaagaactgcaaagtctgagaaataggaaaaatgtctgagacagcaaaatatgaaaaacctgctcatcgttcagcttccaaaattctgaagtctggaagtttttccttcaagaaaagaaactgcataaaaaatttaaaactaagtcatctcccagatataagtatcatggtccagcagtactgtttaatggggtattcagtgactaaggtctgctatttatgcaaaattctgtttatcccgtgttaccaaattaccatttcagtgagaagcttttgaaaagtcttctgacttccagtctttcaccagatgactgcactggattagattctagaagagaatgaaccattttcatataactaaatattggtcatgaactgtgtaagggccatgcttattgggatcagttttaaagttaaattcttttgatattaataccagaccaaagacattttctgtttcctggaaaaaaaaaatgaatcatgttaggctttaggtgagagtacattttttacaaagtagctatagttgttacatagtcttacacttcaagctaaacaccaaatgggtgatattttgaaaaaagtttgtgttttactgtcttagatcgttcttggaaatcactaaaaaaaaaaaaagttaatttgatgtttgcttatttcagttgcagaaactggcgagtaaaaaagattttgcatttacttaattaattttatatttatgttttatttctatttggactcagagatctagacccaataattagtaggctcctgctgccaaaatgcaaaggggaaaaaaaggcagggattgggggggatggggaagtggcccaataaattcatttctgttacaagcatcttttatacatattactaaagagaacatagtaagaaatgcaaataatagttctttattttattat

SEQ ID NO: 75585 - DNA, 1084 bp, Homo sapiens
aatataaaggtcaagacacaaaggcacaattatggggctatactcctatcccagtgatccaacctcacagagtaactgcagagttgcaagtcttctggtacatagttgccattagatgaggataagtataataaaagatacatagaaataagccaaatctaaggtttaaccatttcaaaactttagcgtataagaagtatagggtgaagtacaatagatggaaatggcataaaattttttaatcattaagttcataaacgttgcaaactaataaatggagattatgtcctgtttttaaaataacaaaccataatcatcttctatttagaagtgttatctgaaagggtattttttgaaatgtaaccttttaaagaaggtacttgatatttctctcagctaaatgaaatattcccttagatagttgaactgttgaagatatctttaataccagtgatggttgttcacatataaaagtgtgtgtgattaaaactgaaaggggaacactgcttggaaaatcacacccagttttctcatccttggattatggacctaagtgaatcacccattaccctggatccttgagtatcagctaagacacaggaattcagggccgggagtggtggctcatgcctgtaatgccagcactttgggaggctgaggcgggtggaccgcttgagtccgagagtttgagaccatcctgggcaacatggtgaaacctggtctctacaaaagaaatacaaaaattagcagggcaaggtggcatgcacctgtggttccagctacttgagaggctgaggcaggagggtcccttgagcctgggaggtggaggttgaggtgagctgtgattgcaccactgcactccagccttggtgacagagtgtctcaaaaaaaaaaaaaaaaaaattattataaaaactcaagagcttttaaaaattactcttgcaaaagctacagaaactttaaagaggattgtttataaatggaaaatgattcatttatcaaaaaactagggttccttagtctgacaggtgaaagttttcaaaacagttcgttcttaaaagcataaaaaactgagttcaattat

SEQ ID NO: 75586 - DNA, 1074 bp, Homo sapiens
tgtaggatactttaaaaagaaaggtggcaagatcatacctctgtattctgaggcttctttaagccactctcgacctgccactgccttctgccaggaacaaatcacacatggaggaaaatattcctgaccctaatccagaaatcaaacagctgagaagtgaagagggcaaatgtggggataattgaatcctgcatccctgaatgagaacccagtatcatgccatggttatgagcccagggtcctgaaatccaagacacgtatgtggaaactcaggttctgctgttggccggccagtccctcaacctcttaaagattccatttttgccctcgctaaaacagcgtctgcttcatcaagttgctctgaaagttaactgagacattccatgtaaagcactcaactttacaaatgataaaaccttgataaaagttagctacccctaccattttctgaattcctattggagttacagccaaaaccaaaaaaaagttagctcttgatcaaattgtgctgaccattatctactaattattttgtgtgtatacaattcatcttccccaaaaacatatacattcctgaagggtaaaattcacatcttgttcttttgtatttcctacaggtgaccatttataaatgcttactcattcctgtatttgaacataagaacacaaaattcttcataaacaattttgaaggtgacagggacaagtagttagttataattctcaaataaagaaattaggccaggcccagtggctcactcctgtaaccccagcactttgggaggccaaggcgggtggatcacctgaggtcaggagttcaagaccagcttggccaacatggtgaaactccatctctactaaaaatacaaaaattagctgggcgtggtggcggatacctgtaatcccagctacttgggaggctgaggcaggagaatcacttgaacccaggaggtggaggttgcagtgagctgaaatcgcgccactgcactccagcctgggcaacagagcgagactgtctcaaaaaaagaaatagaggcaacgatgatgttaatcaagttagccagcagatttgct

SEQ ID NO: 75587 - DNA, 2212 bp, Homo sapiens
atatgatttgggggattatcttaaatgttattctgggcaagaaataagacagtgtcaagtgtttttagacagagcctccccaactttcttacaagtccaggagtttatatgagagtaccacataataggtcttcagtggcaggggaaattgtgtgtttagctgatctgcccatgtaggatagatttataatacgggagccattcttgtccttaaggaactatcaaaaccgagttaaagaattttctttcccttccaaggtatggtttaagaatcgaagagctaagtgccgccaacaacagcaacaacagcagaatggaggtcaaaacaaagtgagacctgccaaaaagaagacatctccagctcgggaagtgagttcagagagtggaacaagtggccaattcactcccccctctagcacctcagtcccgaccattgccagcagcagtgctcctgtgtctatctggagcccagcttccatctccccactgtcagatcccttgtccacctcctcttcctgcatgcagaggtcctatcccatgacctatactcaggcttcaggttatagtcaaggatatgctggctcaacttcctactttgggggcatggactgtggatcatatttgacccctatgcatcaccagcttcccggaccaggggccacactcagtcccatgggtaccaatgcagtcaccagccatctcaatcagtccccagcttctctttccacccagggatatggagcttcaagcttgggttttaactcaaccactgattgcttggattataaggaccaaactgcctcctggaagcttaacttcaatgctgactgcttggattataaagatcagacatcctcgtggaaattccaggttttgtgaagacctgtagaacctctttttgtgggtgatttttaaatatactgggctggacattccagttttagccaggcattggttaaaagagttagatgggatgatgctcagactcatctgatcaaagttccgagaggcatagaaggaaaaacgaagggccttagaggggcctacaaaccagcaacatgaaatggacaaaccaatctgcttaagatcctgtcatagttttagatcattggttatcctgatttgcaaagtgatcaaaagcattctagccatgtgcaaccaaacaccaccaaaaataaaatcaaacaaaactaagttgtgaaggaagggagggaaggtcatagccttcttaagcagaggtgttccattgttttagccaatccttggttgaatcttaggaatgaacagtgtctcaagctcattcacgtttcatgaccaactggtagttggcactgaaaaaacttttcagggctgtgtgaattgtgtgactgattgtcctagatgcactactttatttaaaaaataatgttcataaggagtcaatatgtagtttaagagacaatcagtgtgtgtcttataaatggtacatctgtggtttttaatctgtgctagacttcaaaactgtgatctcctgttattgtatgcaaccttgaactccacctctgcaggggttcttctgtgattaaataggttataattataagcaaaattcagagcaactgagtactgatctaaaaagattacctttggctggaggtgagctgcactgaaactttacgacaaaatgtctctggacaaagagagtcagagaagagaagcaaaaggacactaattcatctgtaatttactgttggtaagcctagcagtaaagagacattggtcaattgctctgaccctgatgaattattaaactgagatcattgtcgtttatgcttgcagatgttaaatggaaaagttatatatgcataaaccttttcttcctggatttggcagatatgtataattatattaaaatggttctagcacaacattgggtccagtttaattttacaccgctatttatgaataagaagcctacattcagcctttcctccccaaaacacgtttttcttaggacagagagtaaattagcaaacttatttttactttttttttttgctaatctatgcataaaatagatatgaatgacagtggtaggtagactttttgtgactttcatcaggattgctctgaaattgagtttggagagcctaacaacaagatcttgttttccttgcttttccctccctacttcaaacctgaacgatttcttaggcactttattagaatgttt

SEQ ID NO: 75588 - DNA, 1304 bp, Homo sapiens
aaaacaagatcttgttgttaggctctccaaactcaatttcagagcaatcctgatgaaagtcacaaaaagtctacctaccactgtcattcatatctattttatgcatagattagcaaaaaaaaaaagtaaaaataagtttgctaatttactctctgtcctaagaaaaacgtgttttggggaggaaaggctgaatgtaggcttcttattcataaatagcggtgtaaaattaaactggacccaatgttgtgctagaaccattttaatataattatacatatctgccaaatccaggaagaaaaggtttatgcatatataacttttccatttaacatctgcaagcataaacgacaatgatctcagtttaataattcatcagggtcagagcaattgaccaatgtctctttactgctaggcttaccaacagtaaattacagatgaattagtgtccttttgcttctcttctctgactctctttgtccagagacattttgtcgtaaagtttcagtgcagctcacctccagccaaaggtaatctttttagatcagtactcagttgctctgaattttgcttataattataacctatttaatcacagaagaacccctgcagaggtggagttcaaggttgcatacaataacaggagatcacagttttgaagtctagcacagattaaaaaccacagatgtaccatttataagacacacactgattgtctcttaaactacatattgactccttatgaacattattttttaaataaagtagtgcatctaggacaatcagtcacacaattcacacagccctgaaaagttttttcagtgccaactaccagttggtcatgaaacgtgaatgagcttgagacactgttcattcctaagattcaaccaaggattggctaaaacaatggaacacctctgcttaagaaggctatgaccttccctcccttccttcacaacttagttttgtttgattttatttttggtggtgtttggttgcacatggctagaatgcttttgatcactttgcaaatcaggataaccaatgatctaaaactatgacaggatcttaagcagattggtttgtccatttcatgttgctggtttgtaggcccctctaaggcccttcgtttttccttctatgcctctcggaactttgatcagatgagtctgagcatcatcccatctaactcttttaaccaatgcctggctaaaactggaatgtccagcccagtatatttaaaaatcacccacaaaaagaggttctacaggtcttcacaaaacctggaatttccacgaggatgtctg

SEQ ID NO: 75589 - DNA, 1057 bp, Homo sapiens
gaaggaaggcttgaaattctccttcactcactaaggggccaggaaactattctccttctgcccttttttgcctgcccgtcaccacttaatcccgtaagcaagggtcttcaaggcccgggttgctggtggagagagacccatccttgagcaggtttcaagagtagtcacgtggtgttgtaacccttcccttcctctgtatagaaatcctctcctattctcatggacttgtacgtgtgaaagcagcttagctcttggacagtccaagtatttttacagatgaaaaaatagagtaaatgacttgctcaaggtcataactaagtttggtggcagagtcagggtatagacgcagctggtgcttttaccaaataaatcaacacaaaaagaatgtattttccttgacttcttagggattgaagagaattttctagttctgagccatttaacagataaaatatctacataatgtctctagtgacacccctcttgttttagttcccctaaacttgaccttaaactggagagggaaggtcaactccagcttgccttgtgagtgagccctgtacagaattctctgcaaagtgtttagcacataaaccacatacacacctgggcctctccttcggctagaatatgtttatgaaagcgacagacatcagtgtcagctgcaaattgggaaaggggctttttcaaagtaggttagaggaagttttagcacttgcaaggcttgaaccaaagtcctcactaggagaaaacaaatggctccaaatggttggtggtcttgagcttggccttggtggcctcacttttaccacagttacggcacccatacagagagctcattcaaaagttcagctaaggatttgtcctccagaaaatgccagtagttcctcttctaagccccctcgtacaccaatcatagctccttcattgcagaacatgaacagggctggtaaagagaattgtcaagattgcagcagggggttgaagtggtaagtcagtaaacacagcacaggagactgagtctatgtgctgagtggcactactctaacaacacaga

SEQ ID NO: 75590 - DNA, 1049 bp, Homo sapiens
cttgaagacttttttggaatatgcttaaatatttgatgggtgtctattaaaagttaaatacttgtttgtttagctttcgttccttagacacatataatcaagattctccaaaaccctaataaatctgttacttacctcgaaatctaattacccagactactaattaggtgaaaatgattaccggaaatgacttcaaatgtggaataatagtggttgagcggtttttccaagtttgtggtttagtgagttggtattttagatgttaaacgcactgacattttaggttcgcagcagttgaaagtggtaaaaagctaagataattaaaatctctgccatggaaaggcaacagtctggggagaggtagatttcttgaattgtttctttgtttctcaccaatgggctttgttatcagcattatttatttagccaaagagttctttgtctctgcaaatggccccaatcaagttttgtttgagacaattagctagtgccagccaatgagtcctatgcaaatgtagggataggaatgcaatgtgtgcatttgaaggcacgggtttttgttcttggggaaggcagattgtaattgctttcttcgggtactttttttttttttttaagtttagggtgggggtggggaagacaggtttatctggtctccttccatcccctctagttccagagcagctgggggtgggggtggggatgggggtggggggagtgtctgcaagtcctttaaaagcctctgcctcgcctagtccgtgctctttttaagttagtgctggaacgtggaagagctgctgcctccgaagcagtaaaccagcccctctgtttgtttgtttgctttgcccttagttccactgctccaaacccacccaccaaggactctgaacctgtccaccccgggcgcatcaagatcttccagctgggtacccccgatttgggccgactttgcacctccaaacaaccttagcatgatgtcttatcttaagcaaccgccttacgcagtcaatgggctgagtctgaccacttcgggtatggacttgctgcac

SEQ ID NO: 75591 - DNA, 1039 bp, Homo sapiens
tagccattttgcaatggtaagggcaaaggagcccctggaaggatctcggccctggtgctttctgtgtgttactggctttttatgttggaatgtgctactttattgtatgatgtgtcaggcatttctaattgggtgagagctctacatgtaagaacatttccatatttctcaagggtacatctgatatgattttacgattctctatagcactgtagttcagaattttgcaaggtagtacgattaaacaaaaaatctccaatctccagtttagaggctgtttaaacacatatacaactgtattttaaagctgtcgcatatgtgtttaaacagcctctaagctggagatttttgtttattttcgcagcctccaaagaacagcattttgaaaagaaaagacaatacaaaaacataaagtctgtattgtaggggcaactaaattagttgtactgaggataatacaaactcctccaagaaagacatttataaaattatattaagttagatcttagggtagaaaagcatgacttttgtgctctgaatttaaatcagaaagaagttgcagttactaagtttcatttatggacttttgtgccttgctgtcttaagcaacgtaaatatgaaaacccggagtcctttaaagtcagtgagacctttatcttgtatccgccattttgaagcaatctctcatggtgtcaaagtttcaaagtagagatccttgcatataagtgccacattttaggaaaataaaggccagacttgcaaactgccagtctatattaacatctactttgaatctctttgctggggtggaggcggggagctcagctgaagaaagtaaataacttttctttttcttcctttcttttcccccttgagctctttttcttataggattgtaggaaacttgaaaggtagggagaaattctactagtttcacaactttgggtgtttgtgtatctactttcttcaaaactaaaatgtgcaaaaggcagttagagttaacaggaaactctgctgcagctgccgaggacccaaatgt

SEQ ID NO: 75592 - DNA, 1084 bp, Homo sapiens
aaggaaatttcggagtaaaggaagcaggggaaaagagggtaagagaagaactccctgtccatcattttaattatacaattagttcacatgctccggcccataatgtatattttaagcaaagcccagtgtctttaaagaacattctggtaatgtcggaggcctggatttgttgcctgctcgtccccccgtgcagcagcggcctgttttcctccccctgttgtgtgtttttattattttccctctggcttagatgtgtcaatcattctctccctgccattggttggagagtttgcgtcaaaaagttgccagagaggcgctttctcagcaaatctccctgagagcgggaccggcctcagctccaacacagcctccactgtgattaaaaataaaaattgctagagcagccctcactcgccacatctactttgtatgtattgcagaggggcccacgcgtgtttagaactctagccgccttcctcattttcgttctttaaaaaaaattttttttggttgtgtttgacttttcatggaagggtgaagactgcaaggtttctaactcaatactcttgatttcttttaggatagctggctatttggaatttaaaggatatttgactttttctaacctcccatgaggctgtaaggtaagtgtccgtctgtcttgtctatatccatatctacgtgtccccgtgtctgtcggccatcaccccagtacctccaatagaccgaccgatgcccctctgcgaacgtggagttctgtaggcggatgtattttttctcttacaaattttgaggtgtaataacgatcgttgcaaaaagaaaaatgtgatctagagatgagagcggtagtgggagagaggcagagagcgtgctcctgggggtcgtcgcttctgcaaaacgtcgtcgaaacgctgcgaatgtaatctggggtgttttggaaggttttgtttgtggttttgtttttatgtcaacgccgttctgggcttctcccgcgatctttgcgttttggcccccagatttggttggggtcgtttggatggatcccagggacctttttagagtccgagacaaaaagatgcagatg

SEQ ID NO: 75593 - DNA, 1033 bp, Homo sapiens
atttaactctgtattcttttagttcatctctaaaagatagagactatatgtgcatgtatgccatcattacattcttatcttatttcaaagagaatgcaaaaaaagtattcaaataattataaatacaatttatttttttaaaaccccctttctgggctagtagtagttactgttatttatttttgtccattttagcttcaactacttgccagtcctagaaattaatgggtttaatttcccctcgaatttaggacttttctagtaacaacttacactcaaatgtagtctttcttataaagattctccccctctctattttatttgctttccattcataacacagacattaccatgaaagttttcattggttatcgatggagttattgaatgtggtaatcaaacaacagattaaaactgagtctccatgaggtgaccagtgcatgaaggtttctttttttctgaagaaatctcacaggaagaattaaatgctacctcttacaaatcagtcctactgatctagtgtgtgtctggacacaccagagtctttgagacacatcctcaccaatagtactttaccttctgggtatgaattgtgggtcatggtgcctgtgcatagcctgtggtctgtagagaagccatattgattaatacttttcatgcaaattattcagaaggttgagggttttttttttaatccccaaacctctaaaaactcattctttatttttcaaatttggtctttttaatttccttcacagctaagaggatatgagagcccctttgttctggagctgctgattctggtattcaaggtgtttgtttgttccaaggactgcacttacgattttaaagtgccataaattcttcgtactaagctcctatggtctttataccaccttaccagtttagattatgtgatctgaagaatgaaaaaaaagtttttatgagactaggtagctattcgtattataaatatgaatttattaaatttaactggcaaaaagatctattatgagtaaagaaggtgaaaata

SEQ ID NO: 75594 - DNA, 1041 bp, Homo sapiens
gaatagcatgcatgaaggcttcatggacagcaaagaaggaaggagaactcgttaaattaacacatgaaatagcaagtcagagaatcaaaaggccaatacattgattaattcctatgatgatgtagagtatctattcagcagtcaattaaccgtttaacatattcttgatataaaggaagttaaaaaaatctccaaactcatataaagctataatccataattggagttttaatgcctctcttaatataaggttgaatacagagttttaatctattctcaaagaataaaatgctttacattttaatgaaggtgtggttttgataataacaaacctgagaaaaagtagcttttaattcgcaacactttaaaatcaaggaaactacctttgaacctttttttctaaatgaaatttttagcagacacatgtttttttagcaatgaataaaatggatgagaattcttttttgttctataagaagcagcaataccctattaattttgacagacaacttggcattagccattttaaaatccaacgtgggatgaagttatgcattactagtctctctacatttttgtcaagagatgaacattttgccagatttttaataatatgccaagagctttgtcagtcagtttatttagctctgcatggttatgccagtttttgtccaccaccccactgggtgtaacactgcccgccacagctcacataactcctcccctgcaattagacaaagtcaacacagcaatcactcccaaccgcccttgaggtacctgcactatcaacagtgcagattccgaggcttgaacaagctttgctttgtcactgcctccctaccccaattaggacttttttcagcccaggcaatttagcaccaacaccatgggtggaccagataactcttttaaaaaagcccgtttaagtcattcttctgcccttccccctccagcccaacccaatcaattctttctcctccctcttttcactacttcctccactgccgtcccctccctgcacctccccccagcccccgagaa

SEQ ID NO: 75595 - DNA, 1081 bp, Homo sapiens
gctgccctcagcagtaggctcagaaatgtcaattttaattaaaacatttattttcaaatacatttcatggttcatatgtagtgatatgtgcctacttcatgcaaatattcaaactgctgggctgaggaaattgaagaaaggcattttgataaagagcagtatgttcaaaacaaagagatgcaaagaaaagaaaatccacatcatgcttccatttttccttagtccacctgccacattgtttctcatggacttgcccactgatatgtaaaggccagggaactccactgtagaaatctggatgttagtgggtcatcgtgggcattggtaggacatcccttcactcttatgtgagtcctgctttgtgtacaattcctgtttacttcagtagaagaaccacccctcccccagtgtttccagatcagaagaaaacaaccaaaatagccaactcccaattcaaaattcttccaaactctgtctttccctgagtactattttaggtttgagtcattaaagctgcagagaggtgtccaaattttacgattaccttctgagctcacctctcctcttgctctctgccctgcagagctcacgcacctgccaaacttctgttgacttcccagggaaaccggtcatgacttcaacatggccaaaaatcactgaaacaaaaatgtggccagcttaaataagtggtaatttaggctaagaatttctgaaaattttgctcaaatttctgtaaggatttttatgaatacattttgatttaccagaatttagcattggaatattattaataatacaatctgtacatgtgctatgctaaaaaaaaatcattgtcattaggttaaaatcaaagacaaccagcaatatttatcaatgtgatgtgtcttttatcttgtagtctgaggagtgtgtttctgattaaggtatattctaaaatttgagcaaattattacatataaatacagttgcatcgattgctgctctcaatatgcttttaacctcttcggaggagccattaacatcacagtcagaaacacatagtcaagtccagagaatgtatgcaggtatcgtaattggctgt

SEQ ID NO: 75596 - DNA, 1074 bp, Homo sapiens
acctgactctctgtatgacctatctctctagccttatcccttgtctgtctccacctaaccctcctcgatttcctctgcaatgattcaaactccactttccctaattttcaaacactttatgtttgcacaagctacactttcaatctggatgctcttctcccacttcccaattctggaaaacctctatttatcccttactactcacctccaaagtaatttctctgacgctttccctgaaacttctaggcagaattgcctccttcctccttcctgttcctaacctaccattgtacttctaagcccaaactgagctctctagcctaccattgtactcctgtgtttaccaccgtgtgcttctaagataatattcaccacatttttttctgcatgtttgttttcctgcattagactgtgagcttttagggcagaagtcattcatctttgtttccccagggactagcattgcaaacggtccttagctctgtaacttggtatttgagggatgaatgattatatataatatactatggaaacattgatgatgcagtcactcactgtgctgttcgcgctgaatgaaacatttgaagcatcgtgttaacatagtaaataggcataggtgacatatgagagaggctgaagcagacctctttgactgtggtattcaggcttccttgctggctttctttgctgggggtttctttttgaggacatctattttttttttttttttttttcctgagacggagtttcgctcttgttgtccaggctggagtgcaatggtgcgatcctggctcaccgcaatctccacctcctaggttcaagcgattctcctcctcagcctccccagtagctgggattacaggcatgtgccaccatgcgcagctaattttttgtatttttagtagagacggggttctccatgttggtcaggctggtcttgaactcctgacctcaggtgatctgcccgccttggctttccaaagtgctgggattacaggcgtgagccaccgcgcctggcctgatgacagtctatctataggcggcatcagcaagagatcagagtcaggggaagga

SEQ ID NO: 75597 - DNA, 1029 bp, Homo sapiens
ttgcttactcagctactaattgctgagtgattatttaggctttatttgggctgttttcttcttcacagccagcaaaagttgcagtgaaaaccacatggtacaatttatgggaattcatgagttgtaattcattcacaattttacttctagatgaaaggcaatgagtatccctttaagtgagaaatttgacaaaaactggatttttaaggaagcatcacctcccccaaagggtaggcttcctttctgagatctcctagctgccaaggttgctaaggcaaacctttgcatatacaaatttgggtcaatgtgttgacaggatgtcagatttgtgtagctaagggagcttcagcatgaatattgagctgtatgccactccattgatgcccaaatgaacctgtaggtgcctatttgtgcctgaggctattggggtggaaaatagaagcccttcttgtgaaaacctaaccaaggtccacaacccagccttgaccagcagcaattggttttcagcaacaactgaaaagtaaattcaaagagatctgaatgatggagcactggtttcttttcatcatacagcctgtaatttcatgttgcaattatttttcctcataggcttacctgtgcgtatattagaagtcttcccggtgccaggaatcaacaaagagttgagtaacgaagaactaatttaatcagctaatttggagaaactaagtcttacaactattatttagttcatcaaaacaaataaatctcaatgagaacaatgaaatatgtgataattcttttttttaccagaaaagtactgcttgaaattatattttagggctatgaaaattttacttgagattgaacacagtaaacttcagatgacttttatattatttaagaaatagaagtgtgaattaaatagtattcaccataagcacttgttttaacttcttaatgttctgttacgtaacattttgttatctgggatttcactaattagtgtttctacatatgtatactacaatgataattgatgttataatt

SEQ ID NO: 75598 - DNA, 1020 bp, Homo sapiens
agttttacttgatatttgtttttaattattattttataagaattggcaatctattagaaaaccattagctagattatttgaataatatccatatcctccaatcatgtaagataatataatttattttctttgctccagtagacacctggggtatttgaaaccttgagcagatcattttttcacacttccctcgtcttatacaacaaaattatcttctgtaaaatttataaaatgaaaccaataataataatgtctaaaaaagaaatgtaaactatgaaaattttattttactgaagtttaaatttataattgttcaggtaaaggaaaaataaagaattctaaataaatagagattatagtacaaaaaatggaaataatgaattaatagtctgagtatattaatgcatttttttgagaaaagggaaaaatattgtgtctacatatcagtctgttgcagtaataaataatattataatttctgcttttcaccttgagctataatttctgcaaatttgtcagtgactttgtcaaaattgatctttacacatttatattcaatagataatatagtcagacttatcctttccctttgttgattaaagaacacttttggccgggtacagtggctcacgcctgtaatcctagcactttgggaggctgagtcaggaggatcacttgagcctagaagtttaagaccagcctgggcaacacagaaagtccctgtctcaaaaaaattaaaaaaaaaattaaaatcttaagaatatttttaattaactttagttttgaaatgtttcttttatatgaagcaaaatataaccataggaaaagttttaaacaattttggcagaaattcataaaaatcccattttacaataaatcccatgtctttgttccttcagaatcaattctaatggctcttaaatatttctgcagtagaaaaaaattaactataaataaaaattccaacactcaggatgacaggactgaagtaccttgaactctatttctttgtctttataa

SEQ ID NO: 75599 - DNA, 1051 bp, Homo sapiens
gtcctctgatgcatcttggaggccacagagaagtaggagtagttctccctaaagcagacctaaatcatggtcatgacttttacacttgttttcatgatattggtgaaggaaaaaataactttttttctcgtactaaatgaatccgcctattgagacccatttgaagagaaagagtgaaaaacatgagagagaagagagagaagaaaaaaagagtaaaaggtatttgatggagggaaagaagaatgagagggggtagaggaagaagaaatggaaagagcaaaagggcagagaaagaaagaaaaagtgtgtgtgtgtttgtgtgtgtgctgcacgcacgcatgtgcagagtgggtctgaaagagggacagaggaagaggaaaaagagaaagataataggaatcatcaactagattctctagcagctctcacttgcttaaaattagtggaaacaaatgatggtcttctccctagagttctctcaagttattttcccttgaacacaagataaaatgtcaacattctacttggaaatttagtacttaagactgtatatactgttacttgggctccacttattcataaagatttcagcattttagaataaaaataattttatttaaaagtgctgcctctattagaccataaaacttttcctctgagcagaacaaacaccaaagcaaagctcgtttttattgtcagagtatgatgccatttccataagagatggaagaagtccatactgcgttcttttctcctactaacatgagtgagcgacactacccacctgaataggcaggcttcacagactgaggctgaccaagactgtagattcaacatttagtagatgtcttgccagcatctatttcctgcttccctcttcccagcagtccctagtttccttttggggatcaacataattttgtggaagctaaccttactgcctcccatttacgggtgcaatagatgacctaggccaagccaattatctcatcccatcctcctgactacagcaatagaatcaagggtagaagtgtgaagtgagcagaccagt

SEQ ID NO: 75600 - DNA, 1097 bp, Homo sapiens
tattgatcattttgaaatttgttgctatatttctaaaatgcaggtggcttacctaacatgataaacactggatgttactgtatttgtttgtttatttgcatatttatgtctatcttagtgatgaaaaagtcctagaagatcttcaaaaagacaatatatttcagcagagaggcaaacattacacatttttaatcaccaaaagcagatctagccacagaactgggtcttgaagctgcttcccacagccctctgcagctagggatggcctccaggaggaccagccttaggaaggtgaagggtgcctcaggagcacccctgcccaattcaacaacaagaaaaaaaatgagagctgatgaataaaatggaaaataactttcccagacaagagagaaaacacttggcattcctgaggaacagctgcttgctggtagaagtttatgataataaactaaactgggtgagcatttcccgagaagaaatatttaattatcctgctcaccattatgaggaacttctgccactcttcaggttattatacagtaaataaccatttttctaaaggacagagctgttttaattatatgacaatgaatgcataattattatgtttgttaggaatgaatcacaacagacttgatattgctgctctggttagtgcatcttaattactttttcatttattttgcatataaaagcgatttgctaattgtctttgctgtaaatatgcaaaatataattagtcattcataattctttatgtgttatctaactgtacatttgtttctaaggaacatatattaaagtgtgaatatttaatgggcttttttgtgtgaattcttttttttttagacaaagttttgagtaaatattaggcacattagaattttaactctattcttagagaaacttgtgctgtgaaaaaatggagaccaaaaaatatggagttatgaagtgaatgccagactgtgtggaatttaaacatattttcatgtgaagacacagatggtgatgggaaatatcctttactaagcctttaaattaaccttttagctactcacccaagctacccagataaatctttaagcattaccaatttt

SEQ ID NO: 75601 - DNA, 1064 bp, Homo sapiens
aatatacacccacacccatgcgcccctctgcaacatcttcctcacctcacttgagcttccatactccatactgggcttcccctctctctggaggagaccatcctcatctcacatagctcttgaagttttggctttaggaccaaattgagggaataagaatggtcattgcagaaatcctgtaaaaattttaaaatattaaatttaaaaattacaattttatcacgcagaaacaactatatttttggtggaagttttttttttttttttttaatgtagtgagcaaattagtaaagctgaattgaggagggggtaaagtgttatgcccaagacacagaacttacattttgaaagaattaaatttgaaatgcataccgtatgtttttctattatacaatctccttgctactgtaattgctatttaataagagtgcatcagagaaactgtatgaatggaaacctgaccattaagcactgaataccaataggatatttttactaataaagttcaaaggaaaaatgatcatacaattgttgtttttgtaggccattaaaaatatatatgctaagaaggatagacttcatgtgagaaaggagtctctgggctggatctattataatagatgttacaataaacttaatgtgaaataggagtcaaatggaggcacaaagaagttaaataacttcaccaaaattatatatctaaaaagtaatagaattcaaacttacatccttaggcttctatagcctatgttttaaccactttgctctgttacctctaagaagatttcataaaagaggtcacatttcagctgagctttaaaaaggcaagtagcatttcatcagtggtggaggagaaggggaattctaggcagaagtaacttatacttgcagggtgtggaggcatgagtcactggtatatcactgaatggaaaaactgctgtgtgagtagagctcaatgtgtggggtccatcaaaaagggcaagttaaaacgaatatttggattggggttagcttatttagagcctttaggccgggcgtggtcgctcatgcctataatccgagca

SEQ ID NO: 75602 - DNA, 1126 bp, Homo sapiens
aagtcttgcatgagaaaaatttcaaaggaaattaataacaaaaccaaaacagttttgaagaacatgtgcacagtggacacaggaattgaacaaagtttaccatgattaacattatgttttcttagttatatatcacattgaattcctttatcaactctaataagaatctactgattagtgttctacattctgctttttaaagaaaaatttttgaaacaatcagacttaacagaagggttgtaaatactgtacaaataaaatttttcccttttgagaataagtcgctgtcatgatgctgcaccaccctccaatacttttgtatttccaagaagaaagaatgcttcagtataactacaatacatgaaaattgggaagttaacattgacatattactactatctaatcctcagacaccaatcattttactagctgtcctaattccttttaaggatctcagttcaaaatcatgtattgctttaggttgtagtggctctagtctcattcattctgacacagttccacagtctttccttgacttttttgactctggacatttttatagattatagggtagttactttgtaaaacacccctacatttggatttctgtttccacgtaattagattctgtttgtgctttttggcagacataccacggatgcaactctgtgttattgttgcatcctatcacatagtacacaatttcaatttgccccatttctgatgatgttcatttttatcactttcttaaggtactatttaccaggcttctccactttaaaactattacttttccctttgtaaatattttggaggtagatatatattaatagatacagacatatataggtcccccttatttatttatttgcagacagagtctcgctctgttgcccaagctggagtgcggtggcgtgatctcagctcactgcaacctctacctcctgggttcaagcgattctcccacctcagcctcccaagtagctaggactacaggcacatgccaccatgcctggccaatttttctatttgtagtagaaatggggttttgccgtgttggtcaggctggtgtcaaactcctagccttaagtgatctgcccacctcaacctcccaaagtcctgggat

SEQ ID NO: 75603 - DNA, 2144 bp, Homo sapiens
taaaactggaaattgttttgtttcaatgttactttttttcttctctcaattcagattccaatggtattacatctttttgatactctgcatgctctttgcaatcttctggtagttgccccagataatttaaagcaagtctgctcaggagaacaacttgctaatctggacaagaatatacttcactccttcgtacaacttcgtgctgattatagatctgcccgccttgctcgacacttcagctgagattgaatttacaaaggaattcagtgtcagttcctttacagaggaatgtcttatacttcagcagccctcggttgatagaaagcacaggagataccttatgacacagccaacattttgtgaaacaatgactggaacaaaacagcagccatacttacctttgaggttttatttaaagtttggataccactagctatattttgcttttttcccctcacattgaattttaattccattcttgaatgtagaaatttcagattctctaaaactacatgtcactgtttttatcctagaaaatgttgctgtcagaaggcaaaggaaatgttaccagtgttttcggttcttgtacttttaacatattccatttagaaattttgccattctgttttccattaataataggtgaaatacaggaaaactacatttgttattcctcagtttttaatgaccttttcagcatcaattgttaatcagattattttaggttttcgtaaataatttttttgcctctttcaaaaggttaacaattaagcatactttctgcagttggttgattggatttttttctgaggtacagcattaatactagtccaaaaaatgtcataaactgaactaaaatgatgaactattttatgtagacattaggagtggatcggaatacttctgctttctgggtaaaacttaaaagtttactatttcttatttggtaaatagattttaagccaattctagtaagaaattaataaaactaccttattttgtatttcacttaaggtggaggaccttaactaaaggaccatatttattcattattttaatattataagggaagtaaaaaaaagtgaggtatagtctaaatggtgcatataggaaatactgacagtgtttagcaacatgcagccctttgagatttctgtcgtaatgctaaacttgaataagatggaatggctgaacatgtggttagtcttttattttaagaagaattgagaattgatagatttggagatgagctttgcaaaggctgtttgcttttcatgtctataggtctgtcattgtcctttttcaaagcatttctgaagttattcctacttggatatagttaatggaattggcttaatttgatgacataataaatcacttataaaattttaaatatcaagtgaaaatttagaaaggccattactattctataaaccttataaacttgctctgggagaatgcattctaaattatatatagtgtttcagctcccattgtggtgttcatagtcttctaggaacagataaacttaagtattcaattcactcttggcattttttctttaatataggctttttagcctatttttggaaaactgcttttcttctgagaaccttattctgaatgtcatcaactttaccaaaccttctaagtccagagctaacttagtactgtttaagttactattgactgaattttcttcattttctgtttagtccagtgttaccaaggtaagctggggaatgaagtataccaacttctttcagagcattttaggacattatggcagctttagaaggctgtcttgtttctagccaagggagagccagcgcaggttttggatactagagaaagtcatttgcttgtactattgccattttagaaagctctgatgtgaattcaaattttacctctgttacttaaagccaacaattttaaggcagtagttttactggccatttaagctctttgtacagtgtcaatttgtaaaaaagaaaaaacgaaaaaaaatctcaaataaaacatgagataacattttaagacttccaaatcagagaagtgcttcaaattattttgtttggattaatttttaaaatgtaaagcatatacttgttgcttagttattttgtttattattttcatgt

SEQ ID NO: 75604 - DNA, 1092 bp, Homo sapiens
tgtatatggttttgcctttgaaaatccttagttgttaaggaattaaattaatgacagacttctgagatctttgaatcttgaagtattgcacaaagaatttttgccctctgttttgagcagacagataataaaaccaagagctctttcatattaagacctagagctgactttttctaatatctaaagtttaccaatagtaaaagagtttcatggtgataggaaattaaataactgatttaatttagcataaataatataattaaacataaacatagagtaagttagatgggttaaagaatgttgtattctcaattctctaggacattaaattgtatgattggacagatgaagcatattttggctgcagaacagaagaaaacagattttaagccagaagatgaaaacaatgttttgattcaatatactaatgtgagtaaaatcattcagtttgttaatactttgttaacattttcattggtgtatcctactgtgccctagatttttttcttttatacttaaagattaatgagaaactgtatttcctctttagctaagctggtatacattcctgtgtaatgagtgtagaaaaacttttataggcctgtgtaaaagtctgtgcttacgtaagaaaacaagtggagaagattaaaaattccatggatgggaagaatgtggatacagttttgatggaacttggagtacgttttcatcgacttatctatgagcatcttcaacaatattcctacagttgtatgggtggcatgttggccatttgtgatgtagccgaatataggaagtgtgccaaagacttcaaggtatgtgtacacaaaaacatcaaacttgcaaataggcccaggagcataagtcagattattaaaaatcactatttacttataattagtgaaaggtttataacttttgttgatattgtatgagatagattatcacattctacctgaaacagtgttgttccaattattatttttttttattttaaattttaaatttttatttattttttttccaaagagtttcatgatgttgcccaggctggtctcttactcctgggctcaagtgatctgctgcctcagc

SEQ ID NO: 75605 - DNA, 1111 bp, Homo sapiens
gaaagtgtaatcagttcttccattgtttgaaaaagtttgagaacgattggtgttaattcttcttcttcttttttttttttgagacggagtctccctctgttgcccaggctggagtccagtggcacgatcttggctcactgcaacctccacctccctggttcaagcagctcccctgcctcaccctcccaaatagctggaattacaggcacacaccaccacaccctgctaatttttttgtatttttagtagagacatggttttactgtgttagccagactggtcttgaactcctgacctcaggcagtccacccgcctcagcctccaaaagtgctgggcttacaggtatgagtcactgcgcccagccgattcttctcttcatgttgggtagaattcactagtaaggccatctggtcctgggatttttctgacttcagcaggacctctgtctcttaatctcttcatcttatgccaatctattatccttttcctagctttatttctttagttattgtgcttatatcacttggtccatcttttgaattactttcttgaaataccctaaagtacatttccttcaatcacaactgtcttacagaccctaacctctgatagatgcagtctcttttattcccataactggttgactcctcactgttggagaatatcacataacatgtacgttattggtaccactgcaaatctatgctctcatttctcagttggatctttagtaccgcttatccatccttctgattgtccttgtactgtgagactcagtgttgctcctacctgtttttcccaaccttggccattcttcataagttccctatctccaccggcagcattctgtacacattcagcaccccaatccaaaaatccgaaataaaaatgcttcaaaatttgaaacttgaaattttttgagtgctgacattaccctacaagtggaaaattttacacctgacctcatgtgacagggcacagtcaaaatacagatgcacagcacacggtttatttgagtatccacaagggaaaaaagacccacccaaccctcttcagctgtgataaatattttctgtgcatgtccaaatccccccctacaacaagcatgcct

SEQ ID NO: 75606 - DNA, 1112 bp, Homo sapiens
tactcttaaataacgtggatgccttgtatgcctcagtgtagctgaatgactttatttttaggtaaataccatgatttagaatgccagctgattcaggagtttaccagtgctcaaagaagaggtgaaatctccagaatgagagaagtagcagcagttttacttcattttaaggtaaatagtaggaattaaaaatgaatagtgttcaaggctatggaaattacgtaagttctatatattatagtctctgatttcccccattcattatgtaactatcacagtgataattttcactgttttgagtaatttgtacatttgatactctgtaaatggtattgaatgttatatatttaatatttaaggttttatattcaataatattaatattgaattaaaattaattgatcaattaaatattgatgaatttttatactttgataaagaaaatcatattgtctgcctttttgcttccacatattataatataggtgaaaagaaagaaaacgtgaccgtaaatatctgtaggatataggaaccagagagtagatggaacatgactagtaagagacttaaatccaggggacctcaggaggtaatacaaaagaattttgtattacggaattgtttacctagaatttgaactcgggagagaatccctgtgtaggagtatatttctgcaaagaaagtgcttaaagaaatggttcttccttcaatctgtttctttgatttgtatcagattagggaaggggaagctatttgttggacttttcattttggtaaaatctgaatgagtattgagaatggctcttgagacagtagtgcactttatattgctttccttactggtttttatgtatgatttattaataggcaaaaatctcattatggtgagcttaatgacaaatcagtttgttttaaacacattttattaaaatacatttagtttaaaaagtaaatttccaaactaccagctgaatacaactgtccagattcttgcaaggaaaaccaaatgctagagaaggccaggcgcaatggctcactcctgtaatcctagtattttgggaggccgaggcgggtggatcagtttagctcaggagttcgagatcagcttaggc

SEQ ID NO: 75607 - DNA, 1027 bp, Homo sapiens
atggtggcatgcgcctgtaatcccagctactcgggaggctgagacaggagaatcacttgaacccaggaggcggaggttgcagtgagcagatatcgcgccattgcactccagccttaagagatatctgtgctttacacacaagagatatctaggccacaagatatctgtggccttaagagatatctgggccacaagagtgaaactctgtctcaaaaaaaaaaaaaaagacagaaagaaaagaaatatacacatttctatattatatttcatcatggggctttacattaaactttatattttcttttagaacaagtgttataaattcatatgatcagtaatgacaggcatttaacttacagtaggatatatgtggcagtatgctctaaattatttttataaatctcgtttatccttttcgggttcataaacttagaattctgagatttacacctggctttcagcaagcaatgatttaaatttctttggaataaacttgaactacaggtttcattgggaagggattgtggcatcaaaaaaatcacagaatttcagtaccagaaagctaaatgtttatgttattattgactcattattggtaacaccccaaatgtattcttgttgctcataaagttttatttgttgtggatttttaaaggaaatttttttagggaagggactgtgggcacatgcagggagatattactaatttcagatatataattattttttgatatgcctaaaagttttttaaattattgcttttatttattttttcatagataaaggaagcagcagacatcattcagaagttgcacctaattgcccaagagttaccttttgataggcaagttcatttctcaagagctaatttgaatatgtggtataatttataaaataaaatagtatcttttcctgtatgattttctttgcccattaattaaacggaaatttattgagcacttgctggttcatttacttgctagtttattcactttgtacaagatgcagtgtaaaatagtttattgaa

SEQ ID NO: 75608 - DNA, 1033 bp, Homo sapiens
tttttttttttttttgaggcagagttttactctgttacctaggctggactgcagtggtgcaatctcagctcactgcaacctctgcctcctgagttcaagcgattctcctgcctcagcctcccagctagctggggttgcagggcccaccaccaaacccagctaatatttgtatttttagtagagattgggttttaccatgttgtccaggctggtcttgaactcctgacctcaagtgatctgcctccctcggcctcctactgacatattttttattcttttcagtttagtagcaagagagctctttagatgtctggtccttttcatacttagctaattgttttcagaatcatcatttggggctaaatggtgttgagtgtttttttaaaacaggatgaggagtaaacagctttttttgtttgcttttttgttgattaatgtactcacgataaatattattttaatagttaatggtataaaagtttgcagtttggttaacagattttcagatcatgtcacactaatgagcatgaattttgtagatcatctcgtatataacttctgttatctttagttagtagcaataagagtagtagtttagattataaactgagcacactgattgtattttatgcttatgcacatttttcctaggttgccttccaacatttccaagaactagatgagcacattagctatgtagcaactaaagtctgtcaccttggagaccagttagagggggtaaacacacccagacaacgggcagtggaggctcagaaattgatgaaatactttaatgagtttctagatggagaattgaaatctgatgtttttacaaattctgaaaaggtaagtgctgtcagaggataaaaccaaatcacagcattaataacagtgccctaattatgagctgcaataattgctttccagagttagacttcaaatcactgagtagctgacttattaaaagtttttattgttctgaaatgtaaactaatacagtttcttgtagattgctgatgaagtgttaatattg

SEQ ID NO: 75609 - DNA, 2172 bp, Homo sapiens
tttgcattcatatatgcttttcccttagattttaaaaatggaattactgttagggtatacgagcatttgtaacacactgatgttacctaatacttacccgctggcctccaaaaagattgtacctgttgacatttctaacaatactgagagtataaatttcagtttatcctttcttgccttgctcattataattaaaaaaaaaaaaaactttgtgagatttttaaaaaaggataatttgatcttatttgattactagtaaggctgtacattaaaaataatttttttgaccattttatttcttctacaaattacttgtttgtttactttgctcatttttctgttgagttgttccagttggtcattaatactgttctagtattttaatatcctaattttcattaagtaatttgttttgtttattgaagattttttaattgaaaaaatctgtacattttaataatatagatgtatttaaacaattagtaatttcattttaagtttttacctagtagaagctgttttaattttataagtaatattaagtacttgtatatgaaactttgttaaagcgtatttttttgtaaactaggagccttttgtggcagatgaatatattgaacgtcttgtatggagaaccccaggaggaggctctagaggtggacctgaagcttttgatcctaaaaggtgaaataaaaaaatttttttccccacagatctaatctggtacacattagtgttagaatagagatgactgttgagattgctttcagcattcctctacaaggattttagttaacatttggccaataaaagacaatacaacagagcattaaaagtttgagattttttctttgacgttcttttaaagaagcaatttaactggtatgcaggaagtaattttattgagtataagaatttgacatttcttctaatgagtcataaactagaaatgattatacttctaaaataaaaacattaaatacattgttttaaatatatttgtaaattgggggaacaaagtcactgaactctggaatgtatattattatttttatatagtacatttgccttcttgactattttaagtaggctataaagtgtatttctattctaggggtttattggggattctgggtgaggttttcattcacctctgagatgatccacgaaaaagtcaatagttaaagcctggctatattttcaaatgtcatgtttgctttaaagccatgtggcctggacaaaactatgaggaagttatgaaattacagaaagactttatcttttgatgaagaaatttctaacaagatgctatagaaaaaattaacatgatcatttcaagctcaaggaactcttcttattaagactatgattataagttaactggtcagttcctaaggattaataataggtagattgatacatattcaaactttcctctgttagattattagaagaatttgtaaatcatattcaggaactccagataatggatgaaaggattcagaggaaagtagagaaactagagcaacaatgtcagaaagaagccaaggaatttgccaagaaggtacaagagctgcagaaaagcaatcaggtaaacgttttgttaagaaatgggtattttatataggctataatatctttattttcttccagttttaagctcttaaaaaagtctagtcagatgatagtaactgtcaagatttctttctactgctttagtcccatggggtaaaatgttaatgaattgttatcaagtactcttggcattggctttccacagagtgttggtttaggatcacagtactcttcttaggatagagtggtatccagtttagtgtggtccttgattctcctctaacaatgcgaactttgaagaatgacacttcagtagacccctagttttaggaactctttattagcttggatatttaggtagtcatttgctttctctttaatcgtaaaacaaagtaatatgaaagcagctattgtctgaattaggttttcccttgagaaaacctggtctgggaagtttcacaaaagtcatgagggtatgctccaatgagaattctagtgtaactgtaggaaaaactgccttgatctgttttggagtaaaaccaaatcactagattggtcctggggctcagcaggccaaacttcttagtcactcttagg

SEQ ID NO: 75610 - DNA, 1050 bp, Homo sapiens
agcgtcgacctcctaggcaaaagcgatcctcccacctcagcctcctgagtagctgggactacaggcatgtgccaccatgcttggctaattttttattttttgtagggacggggtctcattgtattgcccaggctagtctccaactccaggacacaagtggtcctcccacctagggcctcccaaggtgctgggattataggcatgagccactgggtccagcctgggggaagttttaagaaggctttttatacctcatgcaagagggctgaccttactttttttgggtaagggtcagggagacagacaattttaatgttagtgtgaagaatggccttctatgggggaagaaattgttagctgggaaaatagggatcgtgggcaacctgacatagttcttgtcatttggtaagtgttccagaattatctgttgactgattaatctggccagatgaaagtctaacctaattcaatggtgacagagaagaaatttgaaaagaattttggaggaagaattaaaggaatttgattactgaggagttaaaattccaaatttgtaaactttgaaaagtaggtggttggtgattcattaactgtgacagagaaaattagaaggacccttgcagggggaagaaataatatattcattaagtatatatatacacacacacatatatacgtatatatacacacacatatatatacatatatatatacatatatacttaatgtatatatatacacttatgtatatatgtatatatgtatatatacttaatgtataaatatatacatatatgtatatatatacttaatatatgtgtatatatatacgtatatatatatacacacacacacacacacacacacacatatgtatttacactttgagtttttagcaagacatcctggtaaagaagtccacaaggcaaatggaaatatgaattagtaactcagaaagagatcacagttagacatagcagtttaggaagtatcactttatgtgggtggtaatttagccaggaggtggaagacatctctcagctctgcctc

SEQ ID NO: 75611 - DNA, 1122 bp, Homo sapiens
gacttcagagatattgtattttctcacttaagtgttgggagatatgctacattaatttctgtaattccaaaattgtgccatctgtttattgacacaagaacggggagacatttttcctgctaggaacttttactgtgtccctaggtactaagtagtgctgtggttccttgttttatttttcacatcttaaaaagggagaaaacgatgaagttgtatgagatctttaattaaggtatttgccggcaagccagctcttaactgaaaactgttatatatgttgtcatacagttcataagacattatcctttgagttaatcctgcttgacagttccagttgtaccttggaccatcttatgtatatttttatttaaatgtttgaccacatgatttcagtaacttatttggaaatatgtttgatttttttttttcccctctccctagcggggaaggggaggaggtggggaaatatatattttgctttctggggtcctgctattaggttaagtagtatatatatacgttttatatatatatatatatacacacacacacatacacatatatatatataacgtatatataacatacatatatataatgtaatttagtgactctagttacatggtagccagtaagattctgtgataatagagacagtagcccttagactacccttaggccagagggtttttaggacaaatttaaacgtatttatagatcttaaaactgacgtgactttttttcttgactatatgtagcttgttgcttcatcataattaaaagcataatagttacaattaagtttcaatagttataattaagaagtgcatttatcttttctggtactgctatgaatccagccctacagtggactctactcttgagtaagttttcatccccaagtgaaaagttgatctcttggccttggagggaggaggaaaaaaaatcctgtcactgctcagtttcctgtaactactgccatagcatctaggttgtagtaagagtcacgggaagtatctttttctcctgcttccctttcttagtcccagctggagaactgtggaaaacggaaggcaggatgtagtcaaggatgtttggtttttatgcatcctgattttcatg

SEQ ID NO: 75612 - DNA, 1263 bp, Homo sapiens
caaacctcgtttctactataccatttatctcttgtcctagttgtgaatgagtaggttagaaaaacctactcaagctagcttaagtagagcaaatttattttgagaatgcaataggcaatctcattgccatttaaggataagaaaagaagcagacacagttcttactgggactagaaccagaaaattagtatcagcctgtactcaaggtccaccctgtctgtcacatctctgcttctcagtctcctctttcaactggctttctctgcttacacatgaccttacagctttagggcttgccctgtataagtagtctttctgtgtcttacttcacatgtaccagaaataatgattggctcaccccagcctacaagttgtttcctcttcagtcagtcattgatgaccaaccaagtaagttactgctgaacgatgggattggagaactcatgggattcaattggagcaacaggagctgtgggcaggttggcagtaatcagtatgcctactgcatgccctatgcggcagatcagagaacatggagacggggagcctggacgagcaagtataggaacaagaatgcattgtacacctttgtaaagcgcttttctcatctccgaaaacaaagagagaagaatccctatccttaagatgaatatagattcatcattgctgttaccaaaacaacttggaataatctccaagtcattaaaagtaactcttttctcagttacttttgttgttttagactcattaacctgagaattatatagacatttatgtttctttttaggtccctgtcccaccaattttgggtttttatcaaatgaaggaggaagaagtacaactaagaataaccattaatttaaaacttcatgaaagtgtgaaaaataattttgaattctgtgaagcccatatacctttttacaataggtaggaataaaatgcatattgccataatttctgtcttccttaatacatttccactgtcccacagtaaattgtctttgtcttttaccttatttttaaggtctgaacaattttattttatttaaatgaatgctgattttcatgatatagtcataaaaataatctgtttacctttaaatatgcctttatctttctagttaaacttactagtaaattatacacttaagccaatgtagcttcctcagggattatttttctaccggatttatttctagcaatttttccatatacaagtcaaaccaaactatcaacaacctggtgaattagccaattatatca

SEQ ID NO: 75613 - DNA, 1075 bp, Homo sapiens
aaaattagagacaagccattctgtaacatattaatattccatatgaaagggtaatattgtaataagttaataatgctgagttagtgtagtgtcaacagaaagagaaaagaagggagaagggagaaaaatgaagggactgctgtaaaagctgtgataaaataaagccttgaccactaattaaatacagagacaaggaatggtgttgttccaagatgatattgtttaaaaaaaaatggaacttaaaccaaacttgacgctttttaagagggtagagacgtgaatctcattcattcattgttttattccaaatatctagtccaggacctaacacataaatatttgctgaatggatgaatatacctaaattattgatatggagaaaattgggaagaaatgggtttcatatcatattttttgctggcaatagcaatatagcccattgtaaatgttcagtgggtagctaaaaatctaaagcttgattcttaagagaaggctcagctgtatacaggatttaggaattagccacagagaacaaatagttgaggcagtggaaataaataagatcagaaaaggataaaataatacaggaagattaaaaaaaacaaatgagggaattgaaggagtgattagaaaggtagcaagaaaacataaaaaatgtattaaagacatcaagagaaatacagacaattaggggaagtggtagtgaagtcagaagtatactgatgataattcatttcttctatcttggcttcacttatgtccagaagctttgtttcaaggattattataaaaattcctacttcagatacctttcagaaaaaaatgtggaatgttaccacacattctatgtccttcaaaagtaggaattacgatttttctattcattcccatcaccaaccagttacactcacattgaaagcatgtagcacatatttttgttgactgaatgatctaagtgtgttttacagtatttcagttgtatggaaatcagtcttgtcataacttccagcattaagaattataccaaaaaagcacgcaacagccttttattatcagagataatttgggttgcaaa

SEQ ID NO: 75614 - DNA, 1136 bp, Homo sapiens
ttacgtgctgggataccaattgcttccatctttgcacgtcagttcactcagcataccttgcagtatggattagagctgttagtgaagtgcgtattatgtgttaagtacttcataatgacagccttacaaaaaaatggccctaatgcaaacggaaaaaaaaactgtgtgtgtttttgtatatatatgtgtgcgcacacacacaattcaagtttagtacttgtggtttttattttgtgaactgtgtaaaataaattccctaagactgggttaagggaaaaaatgtaaccatgctttttaccaaataatcaccttaatttggtacatttctctcttctttctagcttcattttaggatcttagattacacacttactggatgttatgcagatcagcattcagttcaagtttttgcatcaggaaaaccaaaaataagtgcacgtaagttacacagattcaaactaacttaagggaattaaaatggtgtttgcagttattacctaaggtaaaatttgaatgtaacagaacttagagattagagaataatcccaatttataaaattctgggctgattctaccccacataacagtttgtgtactttacactgccctctgccgccttcttgtttataaagtggtctggataagcaaagattgggatagaggggaacttcagtgtaaaattggatttgtttttctctggttattcagagatgtgattcacagagactgtgatgttggacagacagggcttaagcctggctcagccatttcattagctgtataactttgggcaagttagcgaacttcttgaagttttaattttcttgtgtataaaatggaaataatagtgcgatttacctcaggattgttatgaggtttagataagattatattgacttagtatgatgcttagtgtatagtatagatttagtagatactagagatgattcttatttaaaacttttaaatatctttagcaaatgttgcaatcaataagcattatttagcaccttctctattctatcaataggaagacaataaaaaagacgtttcctgattttagtatgtttaatggttggtaaagtatagatctatatgtgtgtacacacacacatacacacacacacacacacaca

SEQ ID NO: 75615 - DNA, 2045 bp, Homo sapiens
gattattacatctggaattctaaagcccctgctccagtaacatatggatcattattattgtaatagtctcatgtttaaatgggattatataatgataacagtttaaagaaaatcataatcttatatttttaatgtggatgcatataacctgtgagtgaaaaatcactgaatgatttaattgtaaaagtagtcttatgtggtgtttgtagtctgatagagcttgaaaggacattttaaaagctaatgtctccaattttgttaaccttcgattttatgccagtataattcagaacatagaaaagtaatgattcacttgggctcattttagactggtcctgggtcaccctgccacacttgtttcctagtgtttctgtggcagacattgctaatcaattacagcccttttctgtactgagccttggataaagggtcaggctcctttttagttcagagattcaggcagccactcccagtgggttgtagataatgtgcaagataaaaactattttctcttccaaatctaagtactaagctcctagtataaggtgttgttacagaataccagagaccatgttagagacaactacatctcttcaaaaaacagccaacagagacaaaggaaaagtgtttaaatagtaagctgttcttcttaatcagaactatcctattgactaataaataatctgcataattctacttaaggtgtgtaatctctgttctagagttagtttttaagtaagcttgttaatctgccactttgacattttgcttaggatgtcagtagccatattaagatgtgtagaataccttcagaagatgatcatagtgttttgtaatcatttaatgtctgcagccaaatttttaaaggtaatttagacctaatactgctcttgctgtgtcttattaagttaaaattaatgaatgaattctggtaaaaattcaaaaggcactctgtgagtagagagtatcatttaagcttattttagtcacatgtagtatatatctccttaaagctgtcactctcactttcttaccattctcttgatttcttcagaaaccatctagtcatcatctttatactctacctgcttctgcaattatatatcatattatgttttcagagcagttcattgtcaagttggactttaagtgaccattcaagaaaagatgaaatctcacgaacctcaaaacttcattcatgtctttttacaaatgagaaaaaaaaatgcattaaagattaatactcaatttgattatatcttgggttctgttttttaatgagtgttctaaggaaaagcttagaaaagctgctaactcctcagaagaaagcatgatagtttaaaggtatagggcatataaatttaggatttgaaatatgattttttaattaaggtcagtcctactcataaactcattttctgcaaagcattatcatggcataaggttctatgttcaaaattatcccaagtaacaaagaaaaaaagaataactgcctgaccaggattttaacttgttattctagcttaatcatagataatcagcagtgaaaactttccttttgaaagaagaaaatatcattccctataagttatttgatctctcttaaactcaaagcttaacatttcacttatgttgataagttaatggtaatggagccatttggaatcttgattgtataaatgtttaccaaatacactaaggtaagcaagaggcatttatctagtgagtaggcaaagatttaatataataatcccctaggcaaaagtttataagcagttagaaaaatcagtgaatcttctatttgacatttctagaaaccggaggaaaatctagggtgtcctggaaaagtgatgaggtgttggggaacctgatgccatctgttgccattccattctaacatagtgctacagaactgaaccaacttaggttttcatcccattgagatcagctgggcacactgtgatgcttttgattttgtctagaaacctgtcacttcaggataatttctgaagacaaagtctgtttcccgtttggtaggtgacctg

SEQ ID NO: 75616 - DNA, 1482 bp, Homo sapiens
tgaaagatgctttgcgtttgcagtgaatatgagcaactacttccagtgaaagatttggatagtgtcagaccttctctagatgcaaaattgctaaattcccttttagtgccaaaatatgattatgaaatctgatgtctatcacataggtaattattcttcaataaactcgaaaggttaaaaaaaaaagtgttaattttttagaatgaactccagaaaagatcgttcatgattttgtaaacgcttcttttctccattttttactaaacaatattttaaaaactttttagagccagcaatatagtacttaggcaatacccttacggtggtggcaatttttttttaactttttaagtaattgattcaaatgtcaagtttgaagcagtcttgtcaggaattctgatgacaattatttgtttaaaaaattttttttattaaacattagtctgtcccataaaatcgttttcatttttttcacaccaattcagtatttctactaggttaaaattatggtgtttttatacattgtatgatttaagatctttcaaggcagacatttatacttggtaacaattgccaatttttttttctggtttttgttgtagtatttcaaaatacttcgtagacattgatagactcctacactacccctgggagctaggtaggtggaattatcatccaggccttctgtagggactgctgccacaacagagtggttgttcctaagacaaaggtcaaaaaaaggggtgttaataaacagtcctcaggtttaagggacttttttaggattacatcttaaattccaacaaatcagatttaggagttactgaaagtgaaattgatccatccctcatccaaactttgcaatactttcctgttctgacatcatttagatagttagctgtattatcagattagaaaccattgtaccaggctgctgaaaggaaaaggaggcaaaaagctaaacatgggatgaattctgaaccttttaacctggctgaagtacgttggtccctgttatgcaaataccttcaatcctctgctaagttcagtggaaataattttcttgaatgacaggtttattcagcaaggattcagttggtgattaatccccctttgatctagggtatttcacttaactaccagttacctcgttctgacaaagtgcaactgagattagggagatcactagaacactaccagggtgtgcgtttattctctataaccttttaaagcaagggccaagaatgcaatttattttcagtatttgaagatgtaaagtcctgtctgctaagttagaaagtcaattgaataccaaatgaagtttatttcttacgtaatagaacaaacatttctttttgcttcgcctaacaatgatattaggaaacataggctttgaagaaagaagaaacaaagactacattctaagtattgcttctagttttgtttcatgcactagggtatacttaactggccttgacataa

SEQ ID NO: 75617 - DNA, 1113 bp, Homo sapiens
gcattttgcccaaatttgctccattggataaggtatcctaggctgcagctacacatttctgatggcagtgggtatattccttcatcttccctgggttgcgtctctgccacaatgccaagtttctctcatgtttgaaaagagaaaaataaatgacatcgaagcctggatttgatcctcagaaactcccggagaccactcccctacactcaaggagcttcctgacttcccagtcctgcataggagggcccccaccctccagggaggcacagttggtagtgccagagagcttcttaggaactacacatattcccatcttttaatagttacttctctttgtgtcttctatttctggcaaacacatttgttttacatttttaatagtgatttaaagttctctttaaataaatttaaaaggaattcatataaagaaaatgagtaaatcatttgggtagagtatagctaacataaaggttaaaactcaaatgagtgcacagtaatcttgggcctttgtgaaaaccaaagattgatgcttagggaatccaaaagaaagataactttttattatcctacgtaagatagtttctcaataaagcctttggcaggcttagtaagcaatgtagtcagtggagaatatactctggctgtagcattaggcaggccacagttcaaatgccatctctgtttaagaaggtctcctggggcccagggacctcatttataaaataggaaccttacatcttaagactggtgtatgaattaaatgatgtagcacatacaaagtgaatgcgacataggtgatgcctgttcattccctttgactcccctcgaatatcaatgtcagctgtttctattaatgacttatgaactgaaaataggtcataattatttacattccaattattgtttgtaatgtattctagtataatagggaaaagccaagtattaaatcctcatgtttactgcaacacatagaaatcaaaagtttatgtcaatggcagagtcaggtttagattttcatctagttaagctaaccagtgccacctcacctacacacacacacacatattagtatatatatgttttgtaacagattattttcctctctggtttggt

SEQ ID NO: 75618 - DNA, 1028 bp, Homo sapiens
gtgggtagtttgtcagagggttgagtaggcaatataagtgctaatattagagggatgtggctaattccatgtgcctccagaaaaaggaaactgcactggggtttggtcattgaagaagaaactgtttttaacagttgtgtcatgcctcattttatagttcattaaaaaaaaaaaaaaagctctaagaccagcctggccagcatggtgaaacctcgtctctactaaaaatacaaaaattagcctggcatggtggcaggcgcctgtaatcccagctactcgggaagctgaggcaggagaatcgcttgaacccgggaggcggaggttgcagcgagccgagatggcgccactgcgctccagcaaaaaaaaaaaaaaatagtaaaataaaaataaataaataaaacaaaccctcaagcttaaaataagtgaagactccggaataaaaatctccatatgaataagcattcaaccctgtacagaaacaaaaaccttcaatgacctgagtcccatcttctcgctaaaggagagttttccagaggtccggcagaggagatgtggccaagcttcatctgggcgcaggtgcagccgcgcttccacagggaaagaacaatgtctggagtgagccagcactggtttggtgaaccccatggcgactgccagtcgtttgcaggcttttgtctattctttgtgtactgtttgactcagcttgagccaaaataatcagcagctaaagctggagcctacctttttgcagagagcacagtgtttgatgtttctggacatttttgcaacgtgtaacccctaccctgagctcctgctgccttactagcacttccacatgaaagtacaagactctaaaacggtaccttctacacactatattcccatttatgaggcaagcagacaacgttttctgacagctggctgtccatctggtgtttgatgtgtggcagaaaagcaccatggggtaataagggagatggatgtttttctgaggtggcaactcagtgttcctgactgcagactccctt

SEQ ID NO: 75619 - DNA, 2991 bp, Homo sapiens
aagaactgcggtccccagcccggtggaggcagcggcggcgagcgatcccgcggcggcccgcaatggactggccgagggcaccgagcaggaggaggaggaggaagacgagcaggtgcggctgctgtcttcgtccctgaccgccgactgcagcttaagaagcccttcgggcagggaggttgagcctggggaggatcggacgatacgatatgtccgatatgaatccgagctacaaatgcccgatatcatgagactgatcaccaaagatctgtccgaaccctactccatttatacctatagatattttatccacaactggccacagctgtgcttcttggtaagtggatagaataaaaagagggtgaacccagcagtgatcgagactgtgcggggcagggagtgagggcccagaatgtggcagtggatatctcctgctgcgtatcatagtacgttatatgatgtcaagtgctgtacacattcctagttatttaatgaaattgttttgaaggtaagacttcatgattcgggttaacgtgatactagtgtaactgcagcaagcctgtatggtggcgtgtttcactggggtgggggtcttgtgtcttgtttacattagattataatcgtgtttaaccgtctttaattacccgcccgcatcctcaaacactttacagtcatttaatttgaacatggttctgttcagatacaggccttattagtctctcgattacaaccataatcagggaagagtgtatgcataaacatgttgtggtgaacatggatgtcagcaaacttggtgtggtcatattggagaattaaatcttacaagcattttcggtaattatggagatgtttctctttacttcaactggacaattaacagttgtagccagcctgctttctggtactccattccagaaagcgctactaacacttctggtggctgaaagactcctgaaacttgaacaaaatacccttttgtggaatgtagaaaacttgtgtgaaattgttaccgatctgatttttttttttttaatttaagaaactggttgtagatgtggccaaacactagtaacactggcttgtgtagagtataattgacaataatattacacgtaagtgaaagacttttggacggtttttaaaaattaacatagtattggcagtaccagtaatttcttcacaataatattgacccatttcagtctgtatgaaccctttaacttaaacgttgactgcaggtgtatgctttgtatcatgtgctcacaagcatattgtttctgttgaattttactacagaaagatgacatccttttaaggaatattttttaatatgtgaagggaaaagccaccattacttaatgttttagcattggcttagtttcacttggtaattccctgcaagatattttgacaatacttatctttttgattctctagcttggtgataatttgaaaatgtaacctgggtattgtagataatggtagttctattttctgtcttaacttgcttaaacttcaattcagtacatttgttaaaactgtgggtactactttatattcttgaaaactgctctttcagtattctaagcattgtatcagaatagttctaagacatgtctgtgtcaatgaatatgagaaaatgatttatagcactattataaatgtcatatcaaatgccactgtaattgctaaaaattgtagatttagttgtaagttaacccacagaagtagatgattgagtcacatttcaagttgaaatagatgtttttctgtcaattccaggaaatagttgtgtatatgatatttagtcaactttgagtcctgatagttacctaagcctctctcaacttgtttgctattttagactctggtcaacaatattagtaaactttagatttgattttatgtagaaccctcccaattcaccagctaatgtgtatgttagcctttagtagctcaagtttgtttaatattctgagtatctagaattgcgatatgcacaagtggttgacctataagatttactggtgcaagtatgaatcaggaggtattaaacaataataaaacagtaaaaaaacaaccaggccatttaaaactgaagcctttatcttggcatacttttaaatttaagtttcccataggaactatttttttaaaaatacagatgcgtaaatgtctgtttattttaaatcatatccttttagaactgaaagccatcctagagataatctagcccaacttaggttttgttctgttttgttttttgattgaaaaaaagttaagaaccaaagtgacttaaaatgtttcaatctccagatatttactgacagaggggtaggttttgttttgttttttgattgaaaagaagttaagaaccaaagtgacttaaaatgtttcaatctccagatatttaccgtcggaagggtaaagctagaacccagttctcctggcctctcattatggtaacaaacaagaacctgaaaaatgacatacccttgatccattcagtgaagattattgtgtcaccaagttatcttcaccaagggacagttgcccttacatcaatctcaagagattaaaaacctccaaaatgttccgttttccgtggataacctgtaatgggtcaatggagtatatggggttgaaccttacaaaattgccaatacttgattaataaaaatgatagcttattatgattcttcctaattgtaaaagatgtaaaaaaaaaaaaaaaaaaggacaaatgtgagacactttcagttactctgtacttaaccattttatctttacctgttttcatagtaacattttcagttgttggtatctttttgaagttcttaaacttactctcagcaaatgtaacatagtacttccatttatttgttctaaatttaactttttggcttcctccagttttctatttgtagtgttctagaatttgggaatctctcactttatttttttcatagttttatagactgacaaccctttggc

SEQ ID NO: 75620 - DNA, 1319 bp, Homo sapiens
caataccttataaactgtgctttttctgaaaatttttaatttttttttcctgatcgaaatctaccattcaggtgtaaatatgtattatatctggctttcactaaaactttattattaaatttattttcatttttttcttttattgagatggggtctcactctgtcacctaggctggagtgcagtggcacgatctcagctcactgtagcctctcccttcctggctcaagccattctcctatctcagctttccaagtagctggaactacaggtgcatgccaccacacctggctaatttaagtaattttggtggagacagggttttgccatgttgcccacgctgatctcaaacccctgagctcaagcaatctgcctgcgcctgcctcccaaagtgctgggtttacaggcatgagccacagcacctggccattattactaaatttaactgaatatatttaaatttacattctgctgatgggcaagttttacaatattttatgtcctaatgaatagactttttctttataatcattttttttttgcatatttccccttccagaaccttaggtctttgttgcaaataattgtgattttaagcacctcatatgtaatcttataaagtacttgaatgtttaccttgtggaatcttgtcttttttccctaggctttaatagtaagcataaaaaattcatgttctaaagaatattgagaaattttaacactggaacatttaaaggagttaggggatttagatttctgaaacttctgtgactgctgtcttgcaagagttcccattatcttcccccgtcgaaaatgcttaccaatggttggttgttgttttctctggataattgtgcagtacctgatggcaatgtattcttcataactgtttgtttatttttaaggccatggtaggggaggagtgtgtaggtgccatcgtttgcaagttggatatgcacaaaaagatgttccgcagaggttatatagccatgttagccgtggattccaaatacaggagaaatggcattggtaagaaaaatattattttatggaaagaatgcctaagctattttcatttttgttgtgttttgaaataaaagacttaaatgtaagtatgtagaaatgaaagaaactaagggaagaaaattaaggcgggttttaatttttaatttcaaaatggtatttttaaaaagttcttaaaatgaattttttctttattaatgttttgtttgacagtttttcgttttaacaagtagccgatcatcagctttcacctgcagatttttttaatcacattcaaaatgctttgcattatgctaag

SEQ ID NO: 75621 - DNA, 1183 bp, Homo sapiens
ctttcaaacacaatagaacaaactcctgcttgtggcaaataattatgtctgagaaaaaggagtatattgggagataggtctttcaagaggaaacatactgttatgtataggttctgttggcttctcttagcttatagctaaaatttttcccatttaatttgaggtaatccgtgtatctggattcaagatagaaactagcatttgacatttctgtgcttacgaatattataatttaggttatctttaagaaatacatttttccttcattaatactcagatctatattctaggtactaacttggttaagaaagctatatatgccatggttgagggagactgtgatgaggtaagtctttaaaaatgtttaatattttttatctgggcattattctttctgggtatttttaataaatattttataatttattgcagatttcattgcagtgttactatacaaatgcagcttgtggggaaaattatattccatttaaaaacacatgaatttttgacctagaacaaattttaaaatggagctaaaatttcttcaaaatgtgtggggggaatcttagacattttcagtacacaattttggtattcagaggctttatcatcagttatttaaggtagctcttattacagactctgttataatttgcttacatattggccttagtttctgacaatgggaaactgtcagtctatatggaggacatttcacacttgaaaataatcttttcagaattaaataatgacaatgttggctagggggaagacaaccacttttaaagagtagagctatctgcgcattaacataagagcattttctctcttcagcttgtttgtaaggtctgatggcagatatttctttgtatcctactgcacggtgtttctacatatagtaggtgcatgataaatattggtgatgattgggaatgttaacatttactgttgcacagtgtggaagggaacaagtataaactagagaagtatagatgtctttaacatagcagtggtgactaaggaggagcaaagttgtactagtacttttatgagtaatagaagtagcaattgtctttattattagaggtcagatgtgccttagagaattctcaaaatatgtgaaattgggtaagtttttttaaaaggttgaccttaataaataatttgtttagtgacttaaaag

SEQ ID NO: 75622 - DNA, 1048 bp, Homo sapiens
cattctcaggctccttgttcacattaggctctattctgacagatccattctaagtggtggttatatgagaaggcctacagacatagtgggtggcacagtgaagtcatcctgggatttaaaaatatctaattttactccaaagaaataattcacaggtgttgaaggatctcacattgttcacagcttttaatattataatgcaaaaggtgcagtcgccaaagctttacatgactggtaactgaaatttcgaggagagaattggatcagatatgttcatgagtataggtccatgtttggaccatagccacactgcttgtcagctcatcgagaaaagtcaggtttcacaaaagttgcttaacagcttggagaaatcttcgggataatagatcatgttttgatcttctgcagatccagtgaacaggggtgttaagagcagagagtattatgttccctatgattaaaccttttctgagttatcctacttgctatcctaagttactacttgtgaggcaggctatgtgcttttgtttaactgttcaaaggtttggatagtgttggcttttcatgtaaagatgtcaggaatgatatgaagatttttattgttttggtctcaaggttaaattctaaattaatgatatattttatggtagaaaaacttcatttccagcctaaaaagctaatgctgattcattcattttttcttttgaaacaatgaatgttacttaatctttaggctgacatcagggatagctttgtgaactttctccttttgtatgattatggttttgcagtttgtgaatacctctgtctctggattagataactttgtcttggtataaaaattttgcttatctgtgtccagtgttattcagatcgaataatttgccatacgaactcttgtttactctttagaagatatggtagctatttggttttcctttgcttgttaaaatactttagtctttaagacccaattcaaataccaacaactcctttaagtttttcttgatccttctggacagaatccatttcacttttctgttatttt

SEQ ID NO: 75623 - DNA, 2957 bp, Homo sapiens
ttttagacatgggctttcaccacgttgcctagcctggtcccaaactcctgggctcaagtgatctgccttgacctcccaaagtgctgggattatagacatgagccaccaaacctggccaaattgtgttttttttaagtgcagagagaaattgacgtttacttaaaccaatttgtttgctgtacaacttgtattttaggttttcttaggagcgtgttttcttgatcctgaactgttaattacttcattttagatcttttaaaggtttagatttagcattggtccctgctgttgttgggcttaccagctaggagagatgacataccactcatcaaatgttgaataagaatgtgtcataggaacggtgcagaatgttgctgggtgatataaaaggaaaggggcactgtacccaatccagaagtgacaaggtagggccaaaagagaggaggataggaagagcattcttctagacagaaaacagtttatttgaatgttctaaggtgggaaagatcatggtgggttccagaaactgaaaattcagtgttgagcatggaaagcaagaagagagagacctaaagcaaagctgaggccaatatattgatggactttttatgtctcttgatattatttttagattgtggactttctcttgaggacaagagggaatcagtaaacggttttaagtagagaattaacaagagcatcaccctaactctagagagaatgggagacctcttgagttaggaggctcttgtaattatagtgagagttgatggcagcttggactgtggtatatcgagcatagaaagaagaggaccacttagagatttaagagggagaattgacaataatcagtgcttggatgcatataggtggttggagaggaatgaggttcaaagatgactcctgggtttcaggtttgaggcattggtgtggtggggggtgatcctgtttactgagatatggaattgaggaggaagagcagattatgagttcaattttggatataagttgaggtactgtctttattatttgcatcagttgtttgcattcttgtcagactttttgatagcttgagaaagaacaggaagagacttatgcttcacttgggcctttgtttaattatactttgccatttcccccccacccactccaaacacttgagggttatgacacccaatagtaactgtggctcactgtgttgatagttctcaatgaaataagttgagaaacaattgaaaaggcaaatagagctacgtgtgtaaaagttgggaagatggggtagagggtgttagagggaggtaaaaataaaatcgcagttttcaaaaataccagttattcattgtcagggccactggctcagtaatatttcaaaagacttaaatgaaagttaatactatgtgttcctctgttaagctttgctatatagaccagtggttctcaaaatgtggtcccttgaccgcagcaacatcatcatctagcaatttaaaaatattaaaaatgcagattcttgtgtcctactgcaaacgtactcataaactctgagggtggggctcagcaatctattttaacagacccttcaggtgattatgatacactgtaacattttgaatacctcttgtctggattcagcaaactttcttggtaaaaggcccactagtaattattttaggctttgtggaccataggtctttgtggcaactgctcagctctgcccttgtattgagaaagccaccacagacatcatgtaaacaaataaacatggctgtttgactaaaactttatttacaaaacagcaggcacatttggcccaaagtctatagtttgcagactctggtcgagactccagacaaatatggtagttattgccagaataaatgacatattaatgaaaatacagaagttggaagtcaatctgaatagctgcttataataatatagcttattattttaaggaaataaaccagcacttttgattgttgattttattttcatctgtagtcattttacctttccccacagggaaataattaatctttgttttagtataaaacatactctcattgctaaacatttcaaactacacaaatcagtagaacagaagataaatctgcagtggtcctccaagcccttgacccaaatataatattacaatcttgatgactgtttttgagttctttctgtatattatttattgttttcactatcaatttttaaaataatgtatgattttttaaaaaattgtttagttggtaaattattttttaaattgtgtaattataacttagtttttttctcatttctttgaaggttgttttggaaaccgaaataacaaataagtccgctttgaaactttatgaaaatcttggttttgttcgagataagaggctgttcagatactatttaaatggagttgatgcactgcgacttaaactgtggctgcgttgagaaactgacatcaaggaacaactatcatccgcacagaatcgacctttgcatgcaatgcaatttgtacagaattgctttgcaggtggatttagtaatttccatgcagctcttacctgtcagtgtctcattgagtgtcgcacaatatttgttgcactttggcatggcacatttgttctgaattaaaagattgttttaaacttcaggagttcttttggtaccaacaagatgtgccagttgatagccaagatttatgtgttcatttgcaaagtctgctgacaatgttatttacacagtgatcattttatcacagaaccagtaagtggaacataatttttgttccttaaaaaagccaatgtggattgtaaaagtctttaagtatactaacatttcacacaaaacctgccctagttttctgaagtgggtgagggagacgcttcagttttaggttttattttttcaatattaaattttccattcttgaatattggtacctcagtgattagtgaatgaaa

SEQ ID NO: 75624 - DNA, 1717 bp, Homo sapiens
cttaaatcactaatagggatggttgtaaagtagatagatcattggttcaaccattttagtgtttttgccagattgtcaatgaaaccatcatactgaccttttcctccaaaattgccaaattgactgaactggttgggtgtttgtaaagatgacgttaactgtgtgactaaaaagtcagatggttgccatattgtttggaatatgttgaatgtcagtgtatgccttatgtctttaattgggtatgcaaaaaaatttttacttaagtagattaaaattttaacctctagcatgaaaacccagcaccaacactgaaagactccattcaggttgaagtagcctcaaacagtaatttactttttgataataggctgttgtttttcttaaataagcttaaaacaattctatctgaaattggtagcatgggttcacttggctacaactgagcaaaatagatgcaactttcttttaatggggtgctgcctctttaggactgactgtactatccactgacactggtttggcagttggtactgctgaacatttttatacatgctaccatgaagctatatatgttagtattgaagaagctaacgggtatactatcatttttgatgtgtgggctgattataatttcctgtatttcctgtacattgggatgaaactactttagcaaagtccacagatcagaaaccagacggtagtttttgaagttgaaaccagcaaaataagaaaaaataaaaaatcgattttaatattttctgcctctttcccaaattacccttcccacttgctcgacaaatctatgtaaagcagtttgttttttcatgttttaactttaccttgccctgtgttatggtactggctgacatgtctaagactggatgtgtatatttattatggtgtctaaaaatcatgaagttcatcacttttcaggagtatagataaaatcaaattggtagtacatcagagttacttttcagtgcaccatgacatcactaaaatgagtgctgtaatgttacagggctttcaggtttgtaaaaacataaccataaattatattgacgtcagatatgagttgagtatctataaaatatcacgtgtatctcaaaatattggactgctgtttgactggatattgctgcataattttcttctattgtcccatatccttttggagagagatttaatgggatttgaaatgtgcaagctgtctaaataagatgcagtcaaataaagtatggttaagttgtgtttgcatttttcttttagatacagctgtgtgcattttatgattgggttgttttgcttttacctactaagtaaaacagcaacaaacaatatattgtttcccgcttcctgcctttcatctaagagttacggggaagaagtattacataattgtcatcactgttgtgtgttctgacaaagtaaatttgaaaataacatgaacttgatttttctaaaagtactcagtcaactcatatgtcagttatcggtacattttccatgtgttcagtcaaaagtttatctttttagtctgtttcatagcagtttatttctaagacagtttttattttaatttacttttttgtctgtacactgccactctgtaatgttccccccaccccatcccacccttggtaagacaccaaagtaaaatagagcaatatccaaagagctttttgcccctgtcttgtgaggagctttaaatagctgt

SEQ ID NO: 75625 - DNA, 1517 bp, Homo sapiens
gttagatttattttttgagacagagtctcactctgttgcccaggctggagtgcggtggcacaatcttggctcactgcaacctctgccccctgggttcaagcaattcttgtgccttagcctcctgagtagctgggactacaggtgcatgccaccacgcccagccaatttcttgtattcttagtatgagacagggtttcaccatgttggccaggctggtctcaaactcctgacctcaagtgatctgcccgcctcggcctcccaaagtgttggaattacaggcgtgagccaccacgcccagcctatgatattctttttataagcaacttttaaaaagttttttaaaagatctcataagcatatagcactgctacactttagatcactactgtccagtcacactttatataaggatagatgtgtccttttcactccccagtatggtagttactagtcacatgtgtagctactgagcccctgaagtgtgggtgggatgattgagctgaatttgtaattttaatcaaagttagccacatgtggcttgtggctactgtattggacagcagagctttagataagcagtaataacaggaagggagtgtttgtataggttgaaagataaaatggaaggatcacaattaggccagatgtggtggctcacgcctattatcccagcgttttgggaggctgagatggtagtttgcaaccagccaggacagcatagcaagactgtttctgaaaaatcttttaaaataacacaactaaaaattacctctgagcaagagtatagctgaactgtttatactgacaatatatttcattaatacagtgtttgaccactttccaccccaccaaccactgcccttgttatgtagcctttctgagaaaagcagccctttcagattttattgttggaagttccttgggttgcagagatgcagattcaagtgccaaaagttgtttctgatgagacttacctttttagccttaaaatatttgtatagttggctctaataatttctcatttttgatgaatttgaaatcatttcacttctaaatgagattggtcatctcatgagtggtcaagttggaacatggaggtctatcatgtttttaacctccaagatccacttatggggatgaggccaaaggccaatgttacttctagaagaaccagattaatttttctgccttccatcaccgcagtgtattacctttgaccctcgctggtcatctggtaagtgtagttcatcaaaagagcagaaataggcatagtaaacacctggacacaaagacagtgccaggcttggtacaacctgttaacactgttgaggaaagagctcaaaacatgcattactttggggattaagtcagtgtttaatctcaatatgaaacagacctagaaataacaaagaccactgaagtgccaaatttatcttctaatactactatttaaactatgcaatatgggggttataatgaaatagttttagtctatgtaaggtttttataatgctaag

SEQ ID NO: 75626 - DNA, 1637 bp, Homo sapiens
gtttacagtgtccatcctcaagttttattaatctgtaaactaaattttcccattccttgaccactcgatactccacttctgtctcccccacccaaggaaccttgccaagttagctataaagttaatttattggcaaagccaagaacacgaatgcaccttttcagtcagagcagcctactgatagcagggcgaatccgggccaaaaagcagggacattttaaaatgtaggcaaagataatccactagctcaggctaagagtttggttatttaaacaggcagaaaaaggtgaagaaatatttgcagaaattttgtgaattgaagtaggggcttctgaatcttcatctagaatgattttatttttacaaagagcagtttttaaatgttataggtaccttttttgctaagtttagtttgcctttaccaagggaggattatggttggggtctatgtgtgtgtgtgtttgacttttaattgcaaagtatcgaattctcattgaacagttatgtaactgtaagcctcaactttttttcttttctttcccactgcccgccttcaaggattaactaaattaactaccagattatgtatctggatatctggacagagggatgcctgagaagtaatcttaatccttttggttctaagtcagcataacttctggaaaatgttttgggtaaataaagggaaaccatagcacaaatactggaaacgtttgccagcatcaaaggagaagtttaaactcctaactggaagacaccatttagtcacctcgctgactgatacttattgagcacttactatgtgccaaacgttacacctggcaccgtagaaggaaacagacacctctgctcttgtagcatcaaatagtctctgaggtccaagatagcagaaatttggggaagcaaacataaagtactaatcgaagacctgtgaggccctggagagaactgtattcttgagcagacagcagtctccgaattctcttgggaacctaggaacacttaaataggtattcagatgtgcagtgagtcagaactatggaaggcagattttgaaagatgagttagaaagcaggggatagttcatcttcctagtaagcattttaaaacttcttaactgtataattaaactaatgcgaatgtgattggatcttttcagcagcctaattctctctttcaggtcagtattttgtagcatgtctctgtcccttctcttaaaaaagttctaaaggcattggtgtgtgctgtggattttacgtgtgtgtgcgtgcgtgcgtgtgtgtgtgtgtgtgtgtgtgtgtgtgtgtgatccccttaaaatagtctgttcccccttcaggaatgaaggccttaaaatctgcccactgctgggatgggagtgctactggcaggcaatcctcaggcatcagcccctttaggaagtacaccagccaatgacagctgctttgctcaatgttatgcccttagtcaaggcctggttgatgtggatgtgtaaaggctcggctccctcacaattctgaaggggcatccagtgccagaactccctaagggattggctgagccttcactgagattacatcttagttcagcttccctttcttctctaccgtgtttcctatgagtacttcctaacaaaa

SEQ ID NO: 75627 - DNA, 1626 bp, Homo sapiens
ctacagctggaaagagtcctgtatgttctttcttttttctttttttgagacagagtcttgctctgttgcccaggctggagtgccgtggcgcaatcttgactcattgcaacctccacccccgctgctgccgccccactgctgcctagggtcaagccattcttgtgcctcagcctcctgagtagctggaattataggcgtgagccaccatgcccagcccagacctgctttcaaattaaaggactatttctccactgccatcttaggcaagagtggagactttgtagggtctaaaaggtttctcaaaaagcattgctgagcagaggatcctagagatggagcctaagccgtgtgcccagcaagtctagagggcaggccgaggggtctgtgaccttcgtatcaaagaccatggaccctcgtggaaaacaacatcccaggagagtagagagtatggtcagttaagaaatctggtctaaggaccagtggtggaggagggtcacctgatttcaacacagcattatcatgtggtccttctccaacttttccaaggattggtttatgatccacaaagaagaggaaatagaaggaatctacatcgagcatataatttcttctgtctcttacatttaacaaatagccattatctatgtgatttttgcattcttcttgatatgtcacaatcatttaccatttaaatggtttaactatttcattcttgccctcaaatctagtaaaatgtaggctccagaaggttttgccatctatacccatggtctctctctccccagcagcacaccatcttgaatccttggggaagcaaatgctccagtttgaagtgcacagacttagtgcatgctcttactcattgttctcagtgtagcccttatggacttgtgtccaagaaagagaaatgggactgattattcacataaaacagctgtttcaccaaagtatccattccttaaactgagggcacgagggcttggcaatgagtagccctgccgtattggtgctggtaaagcgttcttgttccatatcaccttgagaagttatagaccacaggatgcagaggcagcagaaagtggtgatggcaatgcagaacatctagaagcacaagcaaggcactctgggaaacccctcattcttacagggagtaacacagaagggatatggagctagagtttacattatgctgcagattgctagggtggaccagagacaacctgttttgtgagatattctggtgatcctttgtgcctgccctttccccaggatgttaagacttgagcacgtagcaccctcaagctcttggatgcttccaacttgtttcagtggaaactattcagaagtacctatttgacatattcacaaattcattttaggcgaaagcttgttgattagccaaaaatctcaatgtgaatgcctctcaaacatagcagcaactaaatactggaatatatgaaggcagtaacagagtccggtgtaatgtcaggccttctacttgccgtttgggggcattctgagagcagagaagggatcttaaagagagtggcttccaagccctgttccccacattccagttctcgccattcctgtctcatagctgatgagggagaagatagactttat

SEQ ID NO: 75628 - DNA, 1062 bp, Homo sapiens
tttctaacaggtttctctgcctctgccacccttctctcagatctactatggtggggatttaggtaaaatgaaataattgcagtagaagaggggaaaatgcaatagccctaaaaggaagcaacaatcaaatttaacctatgggcaggcatggtggcttaggcctataattccagcactttgggaggctgagctgggaggatcagttgcttgaggccaggagttcaccagcctgggcaacatagcaataccccgtctctacaaaataaataaaaagtaacaatttatcttagaatatatacaaataatatgaatttatccagaggtacttgtgacttgttgctgttgataattgacacatgaaagtttgcaagtgtttaataaattagagtcaacagcatccctataataatgtcacttgagctgacttgattctgataccctttcctatttgaaagagaaatggataaggttccagctgaccctccagaaacttagcaaggcagtatgtcacaccataacaattatccgttgagtattgaggcagaaaaaattcctgagagctcctgggactgaattgggaagcaaggatcatgatttttcttctagtctggtcctggctcttagatgctcccattttatttttggagacattgttcaggagtagctatttgacatatttaaaaattcaattgaggaagaaagaatattgattgagtcaggaattcctaattaaaaacataaggaaaacgaaattggagattagtatttttcagggtcttttctaaacaacctatttcttctgccctttaaccaaaagaacaactaagggtaatgaaacacttaccagtttgccacagcagtgaggcaatcaagggcagtatgcaatgtgatgtgagtcaaaactatggcccaagatatcttttattggtagagcagttctcctctttcttggttttgtttttagatgggtaccttaaatggttttcgatctgggtacctcagattttttttttaactgacatggtgtatttgttaaaggattttgaccctacattattactg

SEQ ID NO: 75629 - DNA, 1393 bp, Homo sapiens
ttttagcatccattgatgattcatgaccgaatcaattgttaccacgaaagttgctaaatggtaattttttaattcctacattatgatttggcattttgttgtaaggtagagttttccttttcctcccatttcattatattttcattcctttatttatataaatatggactcaaggatttttaccttgttcaatgtgtattacctgttagtattattatttattagcctctttgagctggctcatatgttcttttgacatgtccccatcattctttgagcactgactttctggtacaacaagaagttctagtcttattggccatttccctatcaaagccctggattcagtcatttgtttagagttctggctctttttagtgaagaacgttatttataagccatgatctcggtgttcattgctattggggtgtcattgcttttaggccttctcagaagactagaaaatatatttatacacacacactcacacgcactcacatacatacacacatacacatctttctgtatccatctatctatctgtctttgttaaaaactgataccttcaattccaatccaatatcacagggtttatcttagcctcttttacctacttataacttcctggttccgcactgaaaaatctggctcccattagcctcaatacatttatttagatgacggataccaacgtcccgaggatgcaggctgcctctttggccccggccccactgaccatgctaaatatgttggccaaatttttgccccaattaagggaaatggaaggggaaaagatggtgtatacatttttctttaattgagcctgaaatggaagttctgctgctcagtgtaatgtaaagtatttttcctacttacctccaattcaaagttcaaaacagacaagtaaaacaccaaaatgagatgttcacattcaattgttatagctagtgattgacttggcaagtgattatctactgtgcttattcttattatcagagactgatataatacctactctactgaagccattaaagtcaatcattttattgcataatggacagatctacctattttagtgcaaccaatgcacttgattaatgtgggtagttgcttgatgacttgtgatatggggaaaaaaaatttttttttaatgtggttagaaatccaaagcaaattttaaggtcttttgctaccaggttacagttcttaggttgcactgcctttttaaagttataactaatatttgagaattaagcatttcaatatacttaaacatcgtcctggatggaagtattatctcttgtatatagttcttgaagcctttagtactttggatgataaccttgaatttgctcaaccagccctcacttttgtgatcaagaaaaaacctgta

SEQ ID NO: 75630 - DNA, 1088 bp, Homo sapiens
aacactgtattttccatctgcatttggttgaaaaaaactgtgtataagtggtcccttgcagttcaaacctgtgttgttcaagggtcaactgtgtatatatttatatatatgacaaatatatattacccttaaatctctgaccagagacagtgggtttctatttagggtttcttcatgtaactgtgtttcatcaaggatttctgttgtcttaccatttagacgaggaaacgttggcagagaatcacctatattcaaaaattgctggctttgacaatatttttcttctgtatatctgttgcaatctccctgttcctgggctttgagactccgtgtagttttgctaatgtagttttattatcacaattatacccctccacaagtgatagttctttttaggccagtctttattaaccagtttgcatttatcagaagactttcagctcatttatatctgtgctaatattttaaataaactctgcagtgggttgatttatcaccatagaatcagatgatcacaaaggatttcagaaatcctctagtcttgcccttgccccaccgtagtagttctgtcatgacaccatccttgatatatggaaagttattttaatattttccaatatttacagggaggattctaggctacagagtaaagtgaaagagatgcagagtagcccaacagattctgcagaggaaataggaaagacaaaaagattaaaaatgggagtaaggaagggagaataagttgtggggatagactctgctatcagaatttagtggacagtatatcttgtcctgatatattcacaacctagtctgtagaggatcaccatgtaataactgggcatggcttttggtgcctacctccaattactctattagtaattaggcattattttgaagactcagtatgcctttcatagcctatatttcggacgccctgtaaaacattaagtcagggccgggcgcggtggctcacgcctgtaatcccagcactttgggaggccgaggcgggcggatcacgaggtcaggagatcgagaccatcccggctaaaacggtgaaaccccgtctctactaaaaatacaaaaac

SEQ ID NO: 75631 - DNA, 1797 bp, Homo sapiens
gtacggcacttagcttctttttttttttttttttttttttttttttttgagacagagtctctctctgtcgaccaggttggagagcagtggtgtgatctcggcttactgcaacctctgcctctcaggttcaagtaattctcgtgcctcagcctccccagtagttgggattacaggcatgtgccaccactcctggctaattttttgtatttttactagagacggggttttgccatgttggccaggctggtctcgagctcctgacctcaagtgatccaccctcctcagcctcccaaagtgctgggattacaggcatgagctatggcctgtaaagtgcctggccacactttacattttatgtgtgcttttatacatgttaatttttacataaactttacatggtatacaataactttattcccattttacagatgtggaaactgaggttcctggaggttaaataactagaatttagctatattctttctctctctagaataaaattatatagaaaaatatacagttaatatttattgagaggctatcatgtgtcaggtactattctagggacaagaaaaggtccctgccttcatggagcttccatttagtagatgcactactgggactcagggaagggctttgaggtcagttccggtgctcttcccaccctctgtgttcattcatgtcacagcttcagcaaagggtaggagccacagaaacacattaaatctcatagacttgtacaccaaaaagagtgacattcactatgtgtacattatatatcatttgtgtcatatgattgtatatgtaatttattataggaatgtatgtaaaatacatgtaaagcgtgggagatttcattttaaagatgcagtagaaagcagcaactgacttttatctcacaagagagccacaaccctcatttcacctttcaacaggggaacaagaatgggccagtatgtcattaagaggagactgctacagaggaaccttaatgaccagaccctgatagtagaatgcttaatgaccagaccctgatagtagaatgcttatgtaagtgtaagatcttagctacactccatttgtaggagaaagcgaactacttttagaaggcgtggaaagaaatcaaagatgctctctgggaataagcaaaaaggaatcatcgctaggacaaatgccgagcacagaggtgaaggctgtcgcctcaggagtcaggtgccccgtgagtgcacgcctgagcagcttcacctctcactggctggctgtgaccttgcatatgtgactggacctctctggacccagactcttcatctgtagaagagaggtggtaataattttcaccttgtagagttaatatgaagattaaatgctgcatttaaaattcttagaagcacttgtaaatactagctgtatccattattatcccagtatcctatacttttacatgtacagggctgcacagtgaacactgcagcacagaacagaatgatatcctttggaggcattgtaatctctctatcatcaaacaaatttccagtgatatttgctttacttctctttccaacaacttcagcaataggcaagtgagttgatgcagacatgttattctaaaagtctagttaattatgatatcattataataggaagagttagaattccctctctatttcatgctagcaaaatctacattttctaggctcattttgtcacgtgtatctcacacacacacacacacacgtacaggagttgttacaaagaaaaagattctcatacggttaaagtgttgaaagagttctcaag

SEQ ID NO: 75632 - DNA, 1063 bp, Homo sapiens
gaaaaaaaccccagcatttattttgcaagccgctgtaatacaaatgcactgggagtgtcctatttggggtaataggtatatctaactcccttttaattaacccaaatttctaccatgtgcatataggataaagagaaggaaggaaggaaggaaggaaggaaggaagtaattaaggaattccctcagtaagtagcagcaaaagcacaaagaaacaagtcatttgctcccatgttctagtttgtgtaaaagcacaaaaaaattgatgtaaaaaaacttacatattccacctagtaaagcaaatatcctactttctcttttcaagaagcagcaggaaaagatcacttatgtaagtgataaccatcaacaatttgtaatatagagtataaattcttcagatggatgttgctgagaggtgtaaccttttgtgggttaaggatggaggaactgaggagtagaaacagaagaattatctgtggggggaaaatcctgttatcttttttctcaaagtgtataggtataggaatggagtgcaagcaaagttgcaggcaaagtgggcatccacttggattattttattacctttaaggtgggtagatcatctgctctagtctcaaaagaataaacctggcatcagttcaggaaactgaggtttttattaaccagtgtcatgtccatctcaatattctcttcctaattagcagtcaaataaaggaagggaccaaaagcatttgaatcatttctctaattttatgtctcatgacatggccacagcatttgtgtagttcagacttcttcatgaccagacagactaaagtaggaaattataagtagtcttccaaaaaggaattttgatacaaaaccttcaatggtcattttcctttatttccctctttatgtaagaggtaaaggaggaggaataggaaatggttttgtggttgaaccaatcgaatcccaaagatttgattggttctttgccgaggagggtgaggatggctagagactctatcttcagcaaaccaagaacacttgatattgcttctgactgaatcagtatttattgaat

SEQ ID NO: 75633 - DNA, 1064 bp, Homo sapiens
attgcatttctaaataagtagaaataaaaataaggccattatcgtcattatgttatattgttaatccttttactgtatttaatacaaaaaactctttaatttgtcaaattaacttaatgccatgaattataagtaaaagatggttatttcattttattatcttatttttttcctagtgagaagctggatggaaaaattaaaagacaaggtaagaaaagtattttcttccattggtttatttttaggggcatatagctttattaagcaaaagatcttcagagtagtagggctttggtttattattctgattctggtaatctatctaaagattcagggcaacttgcagtacctgcaaaaaagaagcccttccctttaaatcccttcttttagaatacaggagacaccttattctttggagcaccattcactcttataaaagtgtaagaatttaccttgtttgatatgctccacagaataatatcattgacatatcaaggtgaagtttctttttgggaatttcaggattgtcatctcattccatctgtttttttttttttttttctaatatgagactctctaggtgtgtagtttatcacagtgctgccacttagtaggtattgattagctgacctgtctggaatggccaactacagataaagattttctttttttgcattaattctgccatctacatagtgattgacaacgttaacttccaggttgatattgttcattttcttttgattttcaatcctctccaagttttcacttttggttacttggtaattttaaactgaattactcataaagatattgatggagtcctgaattccttgttgtagccagtgtcaggtcccattattacagcccagctcagatttcactgggatttcagctaaatggaaatcttttcagtggtcagatattgagttgccttcaattcaccagtctcaatatatttctgttgatggcattccatatcttttttattacctgcagtcaatttccctcatatttgaattattaatattattttgctacagcttaatattaaagaatacaac

SEQ ID NO: 75634 - DNA, 1067 bp, Homo sapiens
tcagtaggcaatcttctatttacctttgccctatgttcaagccatggctttttatcagtggaagcccccaaatttatataaaggagaagaatgcttggggaccttgtcttgatgctaaagtggcttatcaccttacctaaaattgagaatgaggagggactgagggtagagctgatgggctttatggttgctaaagcctcggttatatctcaagatggcaaatttttgattcagcagatctggtaagcaagtcacacaaacttgactttgcactggaagcttgatgatactgaacttcagaaagcagtaaactttctgttaaaaataaagtatgaaggccaaactattttctttttcaccaatgaattgaagatcaggtagtgcaaatgtgagaagagatctcatgagaatgagaatttcagtttccctgagcatgcacttgttgctgctgggtggtaaaatcatagatcagaaaccttggtgctcagcagaaacttcaaggttgcttaggtaaagagaagtgattttttttttccgcttcatgatcaagcatagggggaggcaaatactttttttttctcccctggtgaataatgggaagcaatgttgaatattattgctttcctttttgggaagaaaaaggaagacacattgagggatactttcttcctcatttatgtgtcatatatttccctatggttgaagttcatgacagccttctcatcacaagagttgtgataatgtggtttatagtttatcagtattattagcactaataaataaccctggcaggatgtacagttgattgcaggacgttctctttgcatcttcccactaggtatctagtatcattcctaaacttgcaattaactaaagacattcttaatattacttgaaagtagagattagggtacctgggctctttgcacccttctttgtaaatatcagtgcagagctttcagaattaattgcttcttagatagacgattaatgttcacttagccctgtgcaaagaagtgggtcattctatttattggaatcttgctgttctgtaattacgtgaagag

SEQ ID NO: 75635 - DNA, 1055 bp, Homo sapiens
ttgagcacctacaaagtgtgtgctgtatgttctgaaaatagtgagaggctgacagataaagagatacatagtcatggggcagagtgtggtctcataaatgtgaggtcagtggctgagcaattctatagtgagggactgaattatcacttatcaccagggcttgctttgagtgggcagccatctcatttgaggtgtgacttcaaggatgcgctgtctgatcctctaatttatatcagccttgctgtcctcacacagcgcctgctttccaatattagagccttcctttgcattgatacgtgtcttcagaaggccttagaaaaatgcagaactgctatctgggtagaacaactcattaaaacattatcatttattatgcactgtaagggattaatttatcaggttcattagctgctaatttggcaagatgaaagggagaggaacataagatgcatgtgttttgaattggtaggagggtataatgcattgcagcctaagtgtgggaagtaggccttctggaaacagagcacttgactgtgaggaagtgagacccttagccctaaaatatgtcagcactctcttctcttcctccttttttcttattatccatttaaaacacttaacatgtagctaagattgactacttaatatagtgcaacacagattgtggcagcaaggaaaagatgctttgcaaaaaatagtgggaagtgtgagatttcaaacagctcctcattgcaacaaatgtcagtgtattttgatgtataacatgttaagctatggcctaaaggtttgctcgaagctgccaagactaacataattaagtatgtgtatggaatgagtggaaggaaagaaacctcagcccaatgtaaccagcacaaagagagatggtagattggctaaagcccccagatgactgctctcaatcttggctgccagtggaatccatttcttagaactcctagagagctataaaaattattgatacctggatgctacccctataaaacaactgtcttaaaccgaatctactggttgtgccccaggggtgaggcagcttc

SEQ ID NO: 75636 - DNA, 1026 bp, Homo sapiens
aggaccgattgtattgcacatttgtctggctttctgtagccttctgcttttcagcgttgccacacaatgtctggccttccccaaaatagaaaggaggagggagatagcacatgttcatgcggaaaaagggcagtccgataagatgaacaccgatgacctagaaaatagctctgttacctcaaagcagactccccaactggtggtctctgaagatccaatgatgatgtcagcagtaccatcggcaacatcattaaataaagcattctcgattaacaaagaaacccagcctggacaagctgggctcatgcaaacagaacgccctggtgtttccacacctactgagtcaggtgtcccctcagctgaagaagtatttggttccagccagccagagagaatatctcctgaaagtggacttgccaaggccatgttaaccattgctatcactgcgactccttctctgactgttgatgaaaaggaggaactccttacaagcactaactttcagcccattgtagaagagatcacagaaaccacaaaaggttttctgaagtatatggataatcaatcatttgcaactgaaagtcaggaaggagttggtttgggacattcaccttcatcctatgtgaatactaaggaaatgctaaccaccaatccaaagactgagaaatttgaagcagacacagaccacaggacaacttcttttcctggtgctgagtccacagcaggcagtgagcctggaagcctcacccctgataaggagaagccttcgcagatgacagctgataacacccaggctgctgccaccaagcaaccactcgaaacttccgagtacaccctgagtgttgagccagaaactgatagtctgctgggagccccagaagtcacagtgagtgtcagcacagctgttccagctgcctctgccttaagtgatgagtgggatgacaccaaattagagagtgtaagccggataaggacccccaagcttggagacaatgaagagactcaggtgagaacggagatgtctca

SEQ ID NO: 75637 - DNA, 1077 bp, Homo sapiens
tgtggtggcgggcatctgtaatcccagctccttgggaggctgaggaaggagaatcgcttgaacccgggaggcggaggttgcaatgagccaagatcgcgccatcacagtccagcctgggcgacaagagtgaaactccatctcaaaataaaataaagagacccccaagagctccctggccccttccaccatgtaggacacagcaaaaaggtgccttctatgaaccagaaagtgggccctacccagacaccaaatctactgtcaccttgatcttggacttcccagtctccagaactgtaagaaataaacttctgttgtttataaaaatccagtttattatactttgttatagcagcccaaatggactaagaaaaatgggtttgaaaaccctaaatatcatcattaaatgctgaataccagttacttttaagagttttttaaagtaagtaaataattttcaatgaaaatatgtcttttagctctttttcttcagcgaggcggccgggctgcagacgcagagatgcagatctttgtgaagaccctcacgggcaagaccatcacccttgaggtcaagcccaccgacaccatttagaatgtcaaaaccaaaattcaggacaaggagggtatcccacctgaccagcagcgtctgatatttgctgggaaacggctggaggatggccacactctctcaggctacaacatccagaaagagtccaccctaaacctggtgctgcgcctgcgaggtggcattactgagccttccctccgccagctcgtccagaaatacaactgcgacgagatgatctgctgcaagtgctatgcttgcctgcaccccggtgctatcaactgccacaagaagaaatgcggccacaccaacaacctgtaccccaggaagaaggtcaaataaggctcttccttccttgaagggcagcagccttctgcccaggccccatggccctggggcctcaataaagtgtccctttcattgactggagcagaaaaaaagaaaagaaaatatgtattttaaatgcttaaatcatttgttattctctgccacaactataaaagttacaggcaaaa

SEQ ID NO: 75638 - DNA, 1625 bp, Homo sapiens
ctgtggtataggggaagcgctccgggcctggaatccctacgcgtccctttgggtttagcacgatgagctcaatcggcactggggtgagttcgctgtctgtcggtgtaatagtttaacctaaggattggggttgaagggaactcggacagaccacatggggttcgcggacccggggtgctctgagaccgccttcggctgggtgggccatttgcagctgtttggagaccggtcgtctttatcccctatatgctaggcctgcgtctcaggtgaccgtgactcctgaagcttttcagcgcaggtgtagccggcttggcgtcgccgcagtgaggtttggagccgctttggattgctgagtcactttcttcagccacttagggaaaccgaaagtggaaactcgtggggcttgaaatagtgtgttctcttgagaaccaccgaggcagtgagatttgggattccggggtctggagatcgtgctttttgtggactgcgtttgcagttcctagggtgctgctgattcacaggccttctctgtctttaagtgtgcagatcattgaccgctcagtttaagagtcactggaaatcctgtcggaacagaactaataaaaatggtctgaaaaacaatctgatgaatccttcagtttttcctttctcgtttttcctatacaaattacctaacagcgcttgtaggcatttattccgtaaacgtttaaatggttacttaggaacttaacagcttcagacttttcatagactgttgaggattttgcagtgggacttgttaacttgtttggctttcctttgttaaacgtattgcatatgtgcagtcagtttactccttttatgtacttctctatatagaaaatacagtttctaaaagatttattggttatttgcactagagttattgaataatgagtttctcagttcctcaatttctacttcttaacaagattctcatgctcagccttaagttcaagtaccggtgttctaaatttgataataggcaacttatgtctggaatggtttaatccattcagttatgaatgctaaagttctgccatacttttcttggataagtaaatgctcaatattaaatcttgtagcaaactgactttgcaattatattaatattaccttgaattaatagtatttcattctacaaaccttttaaagaatacttgataatgtaaccatgtgggatattttagtaacaatggtagggttaatgatctgggtttaacagatcaggaaacagactcagaaagtaccactgctgaaggcttttcttctgtcttcatttctcccaagaactccagatacgaatatttgtttgtctgcttgacatgtctgttcacttgatcgtttaatagtcatttcgtactgcatgtgaaagtagagctctgggttttctcctcaccttgccattttgcatctactacagtcttcagctcagtgaatggtcatatgaaaaaatctgttattcatctttaattcctttttttactttactcccagaaccaacgctttagcaagtttatttttttatttttattttgtttgagacggagtcttgctctgttgccaggctggagtgcagtggcacgatcttggctcactgcaacctg

SEQ ID NO: 75639 - DNA, 1030 bp, Homo sapiens
ataactttttttcataactttttttttgtttgttttgttttgttttgagatggagtctcgctctgtcgcccaggctggaatgcagtggcacgatctcaggtcactgcaacctctgcctcccgggttcaagctattctcctgcctcaacctcctgagtagcagggattacaagcacctgccaccacgcccggctaatttttttatttttagtacagtcagggtttcgccatgttggccaggctggtctcaaactcctgacctcaagtgatccacctcagcctcccaaagtgctgggattacaggcgtgagccaccgcactgggccagagagaacttttttagtaaacatctattgggcactgagttagtcataaatgtggagacacaggtgtgaagtcacattgataaaatattagtgatatgataaagggacaacaattagggaacggactctttctggacaggaggcaaggaagagtgtgagatgtagggagacttggtagttgcaagcacaggaactggtatgaaaatacgtgcgccagagagagttaagtatgcttggtgtgtagagtatgaggtttagagatgatactgatgtaggaaggggtccagtcatataaaagtctgtgctccatgctgattttcttcaaagaaatgttgaaaggctttaaaatagtgacaatgagctatatatcctgaaggataagtctcatatcggtagaaaatggaaggaaatgacggtagggatgggaattgaatagttaaaatattccgcatataagatgatgtgtaagatgctgctgatttcttttctactctaaggcaaatatagttgtcccttggtatttgtgggggattggttttaggacctcccatgaataccaaaatccaaggttgctgaagtccctgatataaaatggttaagtatttgcatataacctgtgcatatcctcctgtatgttgtcatctctagattacttgcaatacctaacacagtgtaaatagctgttacactgtattgtttagggaat

SEQ ID NO: 75640 - DNA, 1022 bp, Homo sapiens
tttgaactagaactcagctgggttggtgaatgtaagttatttttgtacatttatttgccttaggaatgatctgtaccacagctaatttacaactgagtgtcctttctaatataatgaaagctaaagcaaatttactaggttgtctaatgaagggaaagttctgcttaataattgacttaagttgtgaacacgttattttttgaaacatccatttcatggttttaagatactatgctataaattaatgctcaggatttataaatagcataatttactttcatttccataagaacttaatatgtaggcacatataatctcatgtagaagcagcacacaaaaatattcgagtattactcatagtacaactttgcaaccttaggtgagtcagatatgtggattgggtagatcctatggtatactgcaagttacaatatggtactcaatttaaaattcatttacacatgtggcttaatttacagtaactaatggaagacatgaaattgttccaaaagatataagagaagaagcagagaaatatgctaaggtaagccacagcacaaaaacttctcttggccaggtacagtcagggaatcacttagcccaggagtttgagaccagcctgagcagcacagcaagacccccatccctaatttaaaaaaaaaaaaattctctaaccaaaattatgtgttgaataatataaatagactggggtggtttctatgaaataacactgagagttcagttgaactaaagatagaaattttctaggttatctctagtgggtaaagttgccttggttccaaaaaaaaaaaacttgggaggtttagactgcaaagagttttttaggacttttaatactttaaatatttgttcttttttttttttttttttttgagacggagtcttgctctgtcacccaggctggagggcagtggcaccatctctgctcactgcaacctctgcctccagggttcaagcgatcctcctgcctccgcctcccaagtagctgggattacaggaac

SEQ ID NO: 75641 - DNA, 1004 bp, Homo sapiens
actaaaatttaaaaagttcagatatagttctttccccagtgagaaaagcagatactaaaaatcactggcaaggtctattaaacgtgtatacaagctgggcacagtggctaccgcctgtaatcccaacactttgggaggccgacgtgggcagatcacttgtggtcagcagtttgagaccagcctggccaacagagtgaaaccccatctctgctaaaaatataaaaattagccgggcatggtggcaggcgcctgtagtcccagctacttgggaggctgaggcagttgaattgcttgaccttgggaggcagaggttgcagtgagccaagatggtgctgctgcactccagtgtaggtaacagagtgagaccctgcctcaaaaaaaaagtaaaaaagagatgtgtatacatatacttgtatgtctacactgaactataaacatgtgctttggggaggagagaacataaattctgacaaatatggaagggaatttgggaacatttcctggacacctagtggaagacccctccaatgagtgaattcaggagaaaaagcttatcaataattatgagtaaaaaacttctgagattccagtaattaaaacaaagtagattatgtaaaaatatgaaggacagaatttacatgatagtgggaatgcatgcaacagacaactttctcaaagtgtggttcgaagatcacctaagtcagaattctacagatttgaactcactaggtaggaagagggacccaggaatctgtattttcaataagtatctgaggtaattcttattaacactctaaaatttgagaatcactgatttggaaacaggttactaaaaggagaatagggtaagagaaaaggttacttttaaagtgatgacacttagggcagggtgtgatggctcacgcctgtaatcccagcactttggaaggccaagatgggttggtcacctgaggtcaggagttcaagaccagcctggccaacatgatgaaaccccgtctctacta

SEQ ID NO: 75642 - DNA, 1951 bp, Homo sapiens
ttttatgggaaaattaagcagatgctccagtttgagaaacctggatctgcgatctgtttgtggtaagtaattttacttagttactcttaggtaatcaagactggtcatgttgctcgtgtgtgtgtgtgtgtgtgtatctgtgtatcttttgaaaaatgataaccgggcatggtggctaaaacgcctgaaatcccagcattttgggaggcagaggtgggtggatcacctaatgtcaggagttcgagaccagcctgaccaacaaggtgaaaccctgtctgtactaaaaatacaaaattagccgggcgtggtaacacatacctgtaaccccagctacctgggaggctgaggcaggagaatcacttgaacccgggaggcggaggttacagtgagcttagatcgtgccactgcactctagcctgggcagcaagagtgagactcgtctcaaaaaaaaaaaaaacatagaatttgttcaactgtgcagttgtttctgtacacgagtatatattgagaagtggaaatgattgctgtgttgaatgtagcagctttcctaaagatttagttattttatggaaagttacataatttacttatttgtaaccaaagcagactttgaaatttctatgttgtcttttgccctattcaatttttatttatttatttattttttgagacggagtctcgctctgtcctccaggcaggagtgcagtggcatgatcttggctcaccgcaacctctgcctcccaggttcaagcgattctcctgcctcagcctcctgggtagcttgggactacaggtgcatgccaccacgcccggctaatttttgtgcttttagtagagatgggtttcaccatattggcccggctgctctcgaactcctgacctcgtgattcacccgcctcgtctcccaaagtgctgggattacagggatgagccactgcgcccggcaccgtgtcagatttatctgctgattttatggccacatggagtcatagataatggttcgtataattcaaactggaatgacagcgtattttaggattcagattcaagcaaatatgagttacataatggctttcctacaaggatctgtgctccagaagcttaaggtcaataaaagggagaatgtaattacacatgtggaaagttaatctaagtagttatttcaaaatatttaagcaatctatataaccttatttatagacttacatggctcctgataatagatttgtcaaagttctgtatacaatcagatctagtggttcttttaaaagagacaaattgctttagaaagcagagcagaaagaaatttataatggttattaaaggcttttcaaggatagtgagatataatgtgtaaaattagaaggagagaagacattctaattggatgaaaggttgtgagcaagaatacaaggaaatatgtatttgggacagagggtaaaccaggtcagaaaggatgattggctgaagattagggaaaattgtgtggccaacctacccctgtttctagggttagctgcacatcagagtccaatggggtgttacagggttctagagggtcttggaagattgggagtaagcagaaattgaccattatttttgtcttgtcttatttcaagttttacaaattataatggaactaaacaaaataaaatgcagccatgcatggtggctcacacctgtaatcccagcactttggaaggccaaggtgggcagatggcttgaggccaggagtttgagaccagcctggccaacattgtgaaacctcatttctactaaaactacgaaatttagcctggcgtggtggcacgtgactgtaatcctagctactcgggaggctgaggcaggagaacctgggaggtggaggttgcagtgagccaggattggaccactgcactccagcctgggcaacagagtgagactgtctcaaaagaaaaaagaaatcactttt

SEQ ID NO: 75643 - DNA, 1032 bp, Homo sapiens
tggcggcggagtgtcccatggaaacggaacccagaattgcagccaggggcttgcacgggggcggggcagggtctgtccaaggcgcttgcgctaaaccagcttgtcggcgccattttgtctcggcagcggtggccgtagctccatcgcattttatgtttctggcgagaagggaacggagttttcatcaggtagattggtttttgtgcggccgtcctccaccgtttcctccaggacagcacctagtcgtggccggaggagtctcagagctgtcagaaaggtcagttggaggctatggttgtccgattgactggggggatggcgcagccctagcggcaccggcaccggaagtgaaggggccgcaggcagccatggtaaacttctccctgcggcggggtggggagaaggggcgggatgaatgggggcgaggcttcctctcccgccgagataaagaggtggaggagaggcaaacgtctttcttggaggttctctttcgggttttcgagaatgtgagagattttctgggttctgtcccactgcaatctttcctgtctttggaagtgcatttcggggacttgccatgttctccacctgattggcaccagctgtgggagccttcttagttaagacagggaagaagtggttcttagaaacatcctgcatgggtagaggtttccgcgtgctcctcacgggataaagctatgaggaaactggagaaagcgctggctttctggatgctgaggaatttacttgccagcgcagacgcttcttctgtgaccttagacaagggtctgtcactctgcacgaggcttatgctactttttgaaagcaaacagtggttttgcagggactgaaaacatcttagacaaaaggacgtccccgataagatagacgttgatctttttctgttaacatcttatattctgttaaacgaaacacacatttttaaatagcggaattggagtataaaattgactagttttatagaatggagtaatttttaaaatgtgacatatcgtcagtaatccacgtgga

SEQ ID NO: 75644 - DNA, 1024 bp, Homo sapiens
tagtgttaatattagtagcaatatttcttttaatttgaaaaatttcaggaagctataaatgaataacttagttttatgatatgtgtaatatgaaatattttttctgtttttttcttatctttctgcttatataatagtagaatttttgaaaaattttgtatcgagacaaaacattattaatcactgataattttgaattacaactttaaaacattttatcatatcaggacatcagtctataaaatgaaaggttgctaatcaagtatttagggtatttttcaaattttcaatgatattaataagcaagtcattttaatattcttaatgcttcaaacacaaccttttaatgagacttgaggttggagtagggaggcatagtaatgacattcacagttttatgttcctttcaccaggcggcagatgagcctgcctacctgacagtgggaaccgatgtcagtgccaagtaccgaggtgccttctgtgaggcaaagattaagactgtgaaaaggctggtgaaagttaaggtaatatttgtttttatgcaatagttttattaactctagattgaagaaatttggggagagagagactgcaaatcagcattttattgagtcattatatgaaaaccctttatataccaaacttaaaggaaaagcacatcaaaaataaagaaataaaaaactcaaaaggagaaattattccaaaatgctaccatcaaaataccatgctcatgatatttcctgtcatttggctcttaactatttgtggtagcatacttggactgtaatctattttctcccctcatttaatgttcaggtagagacaattttagtgtttaggacaatacaaatacaacaggaattatgttttcaagacagtgtaaaaaagcatttaaaaagtttattttgtgactgggcgtagtgtctcatgcctgtaatccaagcactttgggaggccgaagtgggcagatcacttgaggccaggagttcaagagcagcctggccaacgtggcgaaaccctgtct

SEQ ID NO: 75645 - DNA, 2022 bp, Homo sapiens
ggggtaagatccagtaattgtgttttaataagccctttaaatatttctgatgcatgttaaaagtttaagaatcaggttgggcacggtgggtcattaatcccagcactttgggaagccagagtgggcagataacttgaggctagaagtttgagacccacctggccaaaatgttgaaaccctgtctctagtaaaaatacaaaaaattagccagacatggtggtgcaaacctgtaatcccagctacttgggaggctgaggcacgagaattgcttgagctggggaagcgaaggttgagaccctgcctaaaaaaaaaaaaaagtttgagaaacattgactagaggagtgtgatttgtaggttaaatagatgtatctatgattattataaaatttatgtttcagttttcttgatgaaccttcaagtattaggataggatgtcaattgacattcatttctttttgtttcatacagtgtttttatcatgtcagctatataggatttgattactctatatttatttgggattctttaacaattcaaatttggtattgtggctcttatttacttaaaattaatacaatgattgttttaggaggtcttaccatacattacctagattttgaatttatttggaccatctattatttggaccatagtaaccagccatctgttacggatggttactttatgtctttagatgtgtagtagaagggagcacttgtttgtatcagtgcatattacgattattgcttagcttcactttataaaggatcagagttctggttttaatttgtttacctttcatataggcaatacagtttgatactgttgtttttctttgtgtacttggtggcaatcagaaccttttgtgacttgataaaaagcaataaaggcagtttttttttacagtaatcattaaagattattatatagttcatttagtaaacagttattaagtgctgataatatgcattgacacttgctaactgttggggatatagcaatgaagggaagactcagccctcaaggagctcacagttaataagagaatgtaataagtattacattagcaggggtcaccacatggtgctaagaaagcataaattaaagacattattgttatagtgttactataaatgtatttgttttaaaagtaatatgcaaattattgtgcaaaatgtttttcaggtactcctgaaacaggataataccacacaattggtacaagatgaccaagtaaagggtcctttaagagtatgtatgttgtacggtttaaaatctgaaataatcatagatttataccatatttactgaatttacatttctacatagacttaacattttatgagaacgttaatcagaaaacaatacatatgaagggtttaaatataattagtataaattgtgatattgcaatggctgtattctgttttagatactaaacatcttctagaagggtaatttaatatatataaacatgttaagtttttcacctacctttctgttttgaattcttgaactggatacctggctttgtttttcacattgttgctgtatctgaggtgatgtttagccttctaagttgagtatcataaccatcaatctttggttgttctaatttaccaagtaaactatgttcacttcctaattcaatttaatgaatacctagattatgttttccatgcatttctggccatttgtttatgtaataaatctgttatatcagagtaccactttggttaatatctgatatacaaaggtctggaaactgaaagaaggtcaactggtccatccctatctctccaggtgaacctttatctaaaaggtaccttaaatacaaatgctgaatccaatattcactatttctgtgaaagaaaatggatgctattttggttgtcttataattttacagttcttcgatttaattttcttgaaggcaatgtgatatagtggaaaagctctaaagtaagatttaagagactgggctgtcatgctggactctgcatattattttctctttctgaa

SEQ ID NO: 75646 - DNA, 1086 bp, Homo sapiens
cagtgtgtaaagtaggggtaataatagctacctaacttttgtcaaagtgttttggagctcaaattgcataataaatagataagtactatgaatgataaagatctcagacagtgtaagatagaattatcataagtatggtgtttatttttcttagctagattatatagttggtgggagtgatttggtttatttgtttaaatttggtaaggaaattgggatttcacattttaggttggagctattgttgaaacaaggacatctgatggatcttttcaggaagctattatcagcaagttgacagatgctagttggtataccgtgggtaagtaattaagtaatttaacacagatttgatttggaggttgcatgtatctgtgttttgtggatacactgaatcattgtgttggtggagaaatatatattatttcctgtcagtttactggatatagctgactaaaattctaagaatgccctgtaggtaacaaaaataattatctcttacagtaagttggccacttttgtctatttcatccaaaaatgtacttctattttaggttactttgatgtttcttttcaagaaagttagatcacatgattgtgatcactttttctataattacaattaaaattgcatagttgcgatcgttactgtattgctacatattttatacaagggtaatgtagatgttgccagacaatttacagatttaaaaaatcctgaccatggtagattcaagaataggtgattgttaacttagtttttgatttttgatacagtgtgggtgctcatattaacagctttcaaggtcgggcatgttggctcatgcctgtaatcctagcattttggaaagctgaggcgggtggatcacttgaggtcagaagttcgagaccagcctggccaacatggtgaaaccccgtctctactgaaaatacacaaattagcctggtattagtggtgcatgcctgtaatcccagctactctggaggctgaggcaggagaatcgcttgaacctgggaggcggaggttgcaatgagcccagatcatgccactgcactccagcctgggcgacagagtgagatttggtc

SEQ ID NO: 75647 - DNA, 1009 bp, Homo sapiens
gccattggtgggaaagtaaattagtatagccatcatggaaaatagcatagaagttcctcaaaaaattaaaaatagaactaccatatgatccagcaatcccactcctgggtatataaccaaagaattaaactagtatgtcagagatgtatctgtattcccatgtttattgcagcactattcacaatagccaagatatgggataaatttaagtctctatgagcagatgaatgtataaggaaaatgtgatatatatacataatggaatactattcaacttttaaaaagaaggaaatcctgacatttcttacaacatggttgaatccaggggacattatgccaagtgaaataagccaggcacaggaagacaaataccatatgatctcacttaaaaagtcaaactcttattagagagtagagtgttggttatcaggggtgggggcagcttggttggggtgggcggggggtgagggattaggtaaatgtcggttaaatgatacaaaatttcagttagaaggaataagttcaagagctccattgtacaacatgatggttttagccaataacaatgtattgcatacttgaaaattgctaagagagtagattttgagtgttctcaccacacacaaaaaaataagcctgtgaagtgatccacatgttaattagcttgcttagccattccacaatgtatacatatttcaaaacatgttgtataagataaatacatactattaatgttaaatttttttttttttttttgagatggagtctcgctttgttgcccaggctggagagcagtggcgcgatcttggctcactgtaagctccacctcccaggttcaaatgattctcctgcctcagtttcccaagtagctgggattacaggcatataccatcaccctggctaatttttatatttttagtagagacggggtttcgccatgttagccaggccagtctcgaactcctgagctcaagtgatccacctgcctctgccttccaaagtgctggga

SEQ ID NO: 75648 - DNA, 1024 bp, Homo sapiens
agctggtacatgtgtagtaggttatcatgcaaataaatagaagcagtagaataattcaatagcaataccaggagtcagtttctggaagttaggggtactctaatattaaacttttgtggaaaaatccataatactttttttaatcaggtttttgttcattcttctaggattgcagttaatttaatatttatgctttgactaggttgctaatgagttaagaaggtggttctgtagtgatagaaatcaaaaaagcagatggaaatacttaagcagtcgtgggcagccatttaacctgtgtttttggtatctgtagaatgaaaaatatggcatggtatgctcattgtaaaggttttgaaaaatgactaaaataatggttcttacaaatattaagctctaattaatagcaataatagcattctgtgcttttaagtttttatttcattagtgtgcataaattctctgttatcttttgcttattatagtgtttgatgatggtgatgagcgaacattgagacgtacctcactttgtctgaaaggagagagacattttgcagagagtgaggtagggtgacacggatggacgatttggattgaactacaggtactgatctagaggtaaaacgtaatttaattaatctatttcttatacagacacttgaccagcttccattaacaaatccagagcattttggaactccagtaattgcaaagaagacgaacagaggaaggagatcttctcttcctgtgtgagttttttcatatatggtatcattttaattacaattattataaccttaaacaagggattttgttaggatggctaaattcatttgggtaagctttccatagcatattgtatccttatgttagacattttaccctgagtggaccttgttcttaattattcccaatatttgcccaggaatgataacaactcttacttctaatagattatttttgttttaagttactttgccgaagttttttttgttttgttttgtttttgattttgttttttgagacg

SEQ ID NO: 75649 - DNA, 1050 bp, Homo sapiens
gtacattaaatcttcacaaaaacctgcaagatattattattctcaatttatagctgaggaaaatgggaacagtaatgtcttgctggtttttgtattagataatgtatagaattttcttttttgttgttgttgttgttttttttggttttttgtttgtttgtttttttgagatggagtctcactctgtcacccagactgtagtgtagtggtgcgatcttggctcactgcaacctctgcctcccaggttcaagtgattctcgtgcctcagcctctcgagtagccaggactacaggtgtgtgataccacacctggctaatttttgtgttttagtagagatggggttttgtcatacttgccaggctggtctccaactcctgacctcaagggatccacccgcctcggcctcccaaagtgctcagattacaggtgtgaaccactgcacccagccgataatgtatataaatttattagtgtgtaataagtactcaggacatgatatatatttaataattcaatacccagtattttatttctaagctaactccatagacttctactgaaaactccttcatacttattttataattttaacaagttgagttatctggtttctcagagtgcagcagattggaagatgtgtcaaaaggaaatacaggaaagatcagtagatgcagtcaataaagaaaactgtggagtctcacagctgagaagtctatgacaagaaaaaaaggactaaaaccataaaaatataatgaaccaagtggttttgagccatttaataagagttaatagctctgcatactttaataaactccaacattatcaatatattgcaggatgtcttaaaaatgtaggcttggctgggcacgttgcctcacacctgtaatcccagcactttggtaggctgaggcgggcagatcacttaaggtcaggagttcaagaccagcctggccaacatggtgaaaacctgtctctactaaaaatacaaaaattagctaggtgtggtggcatgcgcctgtaatcccagctactcaggaggctgaggcagga

SEQ ID NO: 75650 - DNA, 2054 bp, Homo sapiens
ttgtgatcaaaacagtgaaattaaaaaagttttttgagttatagttctctgtgaaaaatttaatgccataatatattttatagtgataaaaatatttcaatattactgtctagtaaatgtgcttttttactaaaatgaaaaataaatttcacaaataataaaatagacattgttgtctacaagtgttgaaaacatcatgctgatatgaattaccccgtactatctgtaggaggattgtatagattgaaatattgtgaatgtgaggctctcaatgtactttgagtatatacaacttcagaattaagataactaactttgcccgtatttcctcttcttaccttttgttaaggactaagataaaaacattttatagacaatattttgattttgaggtttttatttttctatgtgttaacatgaactatttaagtgataatttttattgaataaattgttttcctccccttcttcttgataattagttactctatagcaagaaaggacattaaggaagtagacattctcaatctaccggaatctgagctctccactaaaccaggtaaaataaagatgaattaccctattattttatgttgtggctctatttggaaaatagcaaataaagcaagactgatactctctggtaccaccattttaactgtttagagttgatatccactcttacttgatttttttttaatgtctagatacaatatttgatttgtgattagataagtttaacttttcgtattttaccattgtctcacagtattccgtaaagtaataacaaatgtttatataacattataacttatgaaatatgttaaagcttactgtatcattttataaatgacagccgaatttgaattcagatctttgattctgaatgccatgccttttctattgttctatgctgccaattccatagcaactgctgaagtacattttcactcttagggcttcagaaagcaagcatcttcttaaaaactagagttgttcctgataattggaaaatggatataagtgaaatccttgagtcatccagtagtgatgatgaagatggcccagctgaagaaaatgatgaagagaaggaaaaggaggccaaaaagacagaagaagaggtggtaggtgtaatttcatgtttgtaacaaaaacatcttaatactctctagtgaaaataataccttcatatatttttccctctgtttagattctctattatttgtttctgtccgtttctagcattgcttaatttgggtgttgaggaagcattttggctcatagcatagtgtgtaaatcagaactaattcttagtaagagattacaagaaaatacttttcaggttagttaatcaacaagtgcaaactggtttttttggggtcttttccaaaacaacccaggagggaaaaaaatgtaatttttaggtattttatatgtgtaactcatttaaactactaccatatgaagtaactgttgttatcctactttaaaggtaaggaaagggagattcagaaaagttaagtaactttcccaagctggcacaactaaaatgggtagaagagggatttgtactcaggtctggcctgtctcaactttaaaacctctttcagacatttcacaatatttcaaggataattaaggttaaaaaaaatcctatccaaaccccaaagaaaatttcatttggcaatttgataaatcatagaaaatatttagattatatgttctaagtgctaatggttttctttataatattgccatgtcatttataatatgcatataattgtaggaaatcatccatggagtacttcatgattgcttatatgaatactgttgtttattctgcagtgttgtatcaaatgggataaactgtctagtacatttttggttgttacggggtaaaagggtttaggggcaagacaaagacaatgaatttactgaaaagggggacctatttgagcatgaaaaatattggcctggaaaaatgtgggattcttgtttctgttttaaatacacaaatatgaatttatgaaatgaaacgagtatagtcatatgta

SEQ ID NO: 75651 - DNA, 1019 bp, Homo sapiens
atgtctgatttttatgtggaagagaatgtaagtagtgctgtataaccctgcggatgctatgccctaagagggaaagcaaatatttgcaagtcagactgaaaaatgtccagaccctgtactgattaagtagaaggggaatctaaccactttgcatttgaaagaaaatgcagcatataggtaagatttttttgtgtgtttagttaccattttgattgccaaaaacgggattaaataagaattttaggtattgatgatgtagctgatagggaaggactcagaaccaagcgatattctttcttgtaaaaaagacagtaggagtctatttttagaatatcaatggatgaaggctatttttctgaaacaagatagattctgaaatgaaaatgataatgagacagtttggcaaaattcaggatttaaagtcagaatattaaatgtgatttttgtattttatctgtatttatttatagattatatgttttcaggctaattaggccacattttcagggtgtgaactgttgcaaatctgtgatttagcttttgttttttaaattaaccttaggatcttatattgtccaatattgaagaaagattagtccctttatttttgctaatacttttaattgctgtccgttccagaatgcattttccctacccccccccccccaaaaaaccctgaaattttaaacaaagagggtaaaaagagctttgtaggaagtggcagagggagattataaaatagtaaattgtaagtagtgctcttattacaatgattaatttcataaatattgtaatgttttattcaagctgtgagtatacgttagtataaaagaatgaagagcagaggcaaagctctgttacctattgtttgcaggtaatagtaaataaatttttaaagataaggaagcttacaaggatagtatcttaaaatgtgtcacctaaattatgagcctgttaaaattaagtgaatcaggatgcttttcatctactggaaaataacagcaaaattacagaattta

SEQ ID NO: 75652 - DNA, 1026 bp, Homo sapiens
tatcttaactagccttaataaggagatttgagattctgtgactttacatgaaagagcaccttttccacttaatattaatttgaattcctaagtattggtagttcaggatttgagtacaagatatagatctcatgctgttactgtgtgggaaaagattgaggatctgacagaaagtaggttttatctatattgattactttaaacttgaactcaataattatattgaaaaaatccctgggggatatttttatgggtattacttaaatgtttttgttaagaaaattttgtattagaaaagatattactggatttttcacctttgaaattgatcaaaaagtccatgtaaacataagtaatcatatcaattattcatttattcctgatttatatttactttggataaatataggagagttttctaagggtaaaataaatggatggttgtttagaaaacttgagtattaaggggaatgtgaccagtgttagcttttaaaatcattttggcttataataagtaggcttataggttgggcccttttaaaaatttcctatttagtaatgaaaatttgaattcagtgaatttttaaataactactgccatttctgtaatactgggaattgtttagggaccactgatacattaatgcctaagattatattccagtattgtaaaaaatcataagtacttgagtttgtttactcatggaaacatgaatattatttttgatgtttaaatcatattatttgtgcatatttatgccttgtagattgtaaaggcatttgttggtggtcattcaagattactttaggtataaacttacagtaaatgctggataacttaggaaatccatgctaaattggtggaatttaaagaatattttaaatgtaatgttaatattttaagtatatctaataacttaagttgccaatgaagcatttctaagcagatcctaaaaagccaaccttccatgaataattgggactttagcttgcaatcatatatgacaactgacttgctaaaatctt

SEQ ID NO: 75653 - DNA, 1148 bp, Homo sapiens
tataagtgccttactatgaatatatcatctcttatgtgagccctgaaattttctgtaggtgtaaaacaggaaagaatagtaccactctaaattttatgattaccaaattccactgggccttcagcactattggtcagttcccaatttctgtaagcaaatcattatttcctccattaaaccaataatcctatacccactccacacaacttcataaagaaattgggagcttcagatgcgagcatgctgtaaacctgtttgcctgctctctttcgctcaaggcacaattgatagtgttttgtcctccctataagatgagtctctcaggttatgctgtggatctcattcccttcctcttttcaggaaaagagagactatcgactctctcttttcttgcatctttaacttactcctttcagttatatccttctcatcagctttttaaaacatgcttacatctctcccagccttctgacaacccctccatatttcctccaccagtcttcagacaacctctgtgctttcctctccagataactacattccttcttcatcgtcatggccagaatgcttagagttacatacactgttcatgacctcccctttactcttaactcactgtagtgtgtcttgatttcccacaactaaaacaactttactaaggtcaccagtgactccaacaaacttttgtactaaaccaaacacatttttgtcttgatcctatttgactgttgagtagtattcagtacctctgacatacctaacttcttagaatgcttgatatccatgacgacatcacatttttggcctacttcctatctaaaatgatataatgacttgatatctatatgtacatcaaagatgtctcttcttagctcaagacatttatatcaaaccaatgaggattttatctttttttttttttttttaagagacagagttttgctcttgtttgccaggctggagtgcaatggcgtgatctcggctcaccacaacctccgcctcctgggttcaagcaattctcctgcctcagcctcccaagtaactgagattacaggcatgcacctccatgcctggctaattttgtatttttagtagagacggggtttctccatgttggtcaggctggtctcaaactcccaacctcaggt

SEQ ID NO: 75654 - DNA, 1039 bp, Homo sapiens
tttcatgcttcagccttcccagtagctggaattacaggcatgtgccaccatgcccagctaatttttgtgcttttagtagggacgaggtttcaccatgttggccaggctggtctcgaactcctggcctcaagtgatctgcccacctttgcctcccaaagtgctgggattataggcatgagccactgcgcccagccccaaagtgaactttctagaaccttacaacaaatctcctagaaccttctctttatttatatatatatatatatatataattaaaaccgaggtttagagaggtttcagaattttttacaagcttttaagaaaatgttctctcctcctctagactgtaagatctgtgaaagcaggggatctcaggatttttgttttttccttttcctaccagtatatatacctaacagctatcaacacagagcttgcttggctcatattaaaccttcattaaatgaatgaatgtggattatgcaattgttgtagtaaattactctttgaaacaaggtggtgggagatttgttataaggttctagaaagttcaccttggcagggggaactaagggataagatatctaacttccctttataatatctcttttctcaggctgtgtactctgtaggcaatctcaatttcttacataattttgtgagtttataaaataaattattttttgcttaagccatcttgggatagttttctgtcacttgtagtaaaagttattgagtaacaatgctccttgcttgtattttgttccacttactccaggtatcttccttgtggtgttttcccttcgaattcattatccataaacatctttataaaacataggcggttcctgatggtaaccctttattggctttcagcaccttcaggacgaagtctgggttttttatcacaggcctttagaagtctgcctgatcatgatgtgacccatgcccacctctttattctcccttccattattcttccatgatatgggacttcttatagctcccctgctgccacttagatattgttcagaaggtg

SEQ ID NO: 75655 - DNA, 1012 bp, Homo sapiens
ttttcctcacgctagaagttcttaaaattaatgtgtgaagtggttcttgggctactgaattacctattttcttgagttaactcattggcagttaactttataaaagcaagatttttaaattcacatggggaaaaaactgccatctcttaatctgagcattaagtaatgaccttcactaactactttatagtgattattaactttgtaaattgctgattttggttagaacttatatttaaatttctttatatttggtaaaagtattttagtgttataaatcattatgaatgaatgtactaaaataatgtaataaaagatcttactccctttctcttgattgcctcatggttttttattatatattttgatcaactacatgcttattgatcctggctgtattatcagctattagataacacaattttaaagtgcctgttgccctctggacaccgaagactcaacatttattgcttgagcattgcctttgttttgaatatggctttgtaaagacaaaaatccaggctgggtgctgtggcttatgcctgtaatcccagcactttgggaggctggagtgggcggatcacttgaggtcaggagtttgagactagcctggccaaatggtgagacccccttctctattaaaaatacaaaaaattagccaggtgtagtggcacactcctgtagtcccagctactcaggaggctgagtcagcagaattgcttgaacccaggaggcagaggctgcagtgagccgaggtcgtgccattacactccagcctaggcagcaagagcaaaactccatctcaaaaaaaaaaaagacaaaaatctgagctcttcttttagaacagaggagagtaatactctaagttatgatcatttatatggaggaaacatatcagtgttttgtttttctctagtagtgctaaactttaagaattttaaaagaagctaaatcagtaattatgtatctagtttccttccctaagaattacttctggaattattttgttatc

SEQ ID NO: 75656 - DNA, 1016 bp, Homo sapiens
tctcgagtagctgggactacaggcacgtgccaccatacccagctaattttttatttttctattttttgtagagacgggttttgccatattgccgaggctggtctcaaactcctggcctcaagtgatcctcttacctctgcctcccaaagtgctgagattacagctgtgaaccatcatgactgtctagttttggattttaaataaatcctagaatcagttacacctgacagtagtaaaatatttggaattaaactgttcatacctattttacatagaaacaagtgagaaaatattttgatacaatttagttttccctgtcacttacaaagctaaagaatattctgatatttcagaaatagaaagtgaccagttatgttaatctgcatacccactaattactaatgctatatttgtggcaaataaactagataaactagcctgatccttgttctcagcaaattaaacataataggagaccaatcgttatctgaaaaagatgagatttctaatataggtagaataatagaacaattataaaccatcatactccttgccatttgttagtcctagaaaatcttaagataaattggtcctaaacattctgtgtggccttcagaaatcatccttcagattactgctaacagtcttaacatttgtgtcaaagtagtgaaagtggaaccagggtataaatcttatcttttctgttgtgtttgtttatgcctaaactttttttttttttttttttttttttttttgtgacagagtcttactctgtcactcaagctggagtgcggtggcgtgaacatggctccctccagcctccacttcctgggcttaagcagtcctcccacctcaggctcccaagtacctgggaccacaggtgcacaccaccacactcagctaatgttttccttttaatttttgtagagacaggatatcaccatgttgcccaggctggtctcaaactcctgagcccaagtgatcttcctgccttagcctcccaaagtgctggggtt

SEQ ID NO: 75657 - DNA, 1071 bp, Homo sapiens
tatataaaaaggtttaggttgacagatacttgtgattgaaagttatttcagcgcatctaatctgctttactccatttcttatgttgtcctgatttcctttccaaaatcaggatgcaggtagtgtctgcgattatgatacatattacagagctacatcttttggggtgaacagccttcatatcaaaacttatgatagttatgtttagctatcacaagctcagacgtctcaggacggcattttatgatcagtttttctgtttatgattctatctaaaacaccaagaaaatagtaacacagaaaagagtaacaaaaatttttttaaattactgggctttactttttaaaaatgtgtttaataacatgaattcaagttagatgcaaagactgtaagatttcttaaatgaaatattgtttgtttaggtatctctatggttttgaggagtactgccgttcggcaaatattcagttcagaactgttcatcaccatgaaccaaaagtaaaagaggaaaaaaaagacttagaagaatcaatggaagaggctctcaaattagatcaagaaatgcctttaacagaagtgaagagtgaacctgaggaaaatatcgattcaaacagtgaaagtgaaagagaagagatagaattaaaatctccgagggtgagttcttaatactagttttatctggtttaagtattatttaaaattttttattatagccattttcatatatacacaaaagtactacagtgaacctagtttattttccagtatttaatgctgcttagctagctacttttttcgaaatatattgtatattatttcctctacctgaaaacccttccttctgttttctgtttatattcgatcaagtcattcttgtctgggatgaatcccagatattccttttccagtcttctgctaaagtatcacctcattgaaggctgtcttggtcaccttatctgaaattgtaacctgcctcctctctttggaactctcagtccctctgatgttgttctttctgtaatttacttatttattctgtttattgtgattatctattttgccccactctaca

SEQ ID NO: 75658 - DNA, 1068 bp, Homo sapiens
agtcgagaaataataaaagtgagataaaatgatgtagtaaacaaaggagaaaatttttatttcttttttgttgttgttgtttacttttttcattcaaacagattctgacagatatttcttaggtagtatatagccaaagtagacctggacataattaagtaattctatcagttattcttttactttcaaaaggaagagaaaggtacctttgagttggttttcagggccacgtttcaagccagagacattgctatgaaggttaaaggaaaagatattttttcctgcttttttcccctttatagtgatagctattttaaagcttttatcccctctactagggacgaaggagaattgctcgagatgtaaattctattaaaaaggaaattgaagaagagaaaacagaagacaaattaaaagataatgatacagaaaataaggatgtagatgatgactatgaaactgcagagaaaaaagaaaatgagctactactggggagaaaaaatacaccaaagcaaaaagagaagaaaattaaaaaacaggaggattctgacaaagactcagatgaagaggaagagaaaagccaagagaggtacattatcttatgtttgttctccagaagcacctgtctggggtacaacagcgctttgttcctgcttagagattcaggtttgagggaatgttttcttattgggacttccgttcctcttgtctaatgaaggtgagacacattgtgaagatgatgtgtattgcctttcggaattggagaatatactggtcgcaccattttaatagcacttgtgccctaaacagtggcctcaaagaaggctgcgccacccagtcaaaagaaaggtcctgcagttgacagcagggaagggagctggagaaaaatggaggaagtggacaagaggaaacagcgacagcaaaaattccattttaaaaaaggtacaatgtgggaaagctaacaaacacatgggtgcacagtactagagatgtttctgtgtgttagctttaagacatttttctttttcaagttattgtattagattatgtggcatgcacccctgattc

SEQ ID NO: 75659 - DNA, 1045 bp, Homo sapiens
attttctagaaatttgagttgttaagccaaatttgggaaaactgacctgccattgagagaataaatatttggaaaaataggatgattggtgaatgggagaggtaatttgattaaatacaaataggcacaggagctatcacaattacatatgacctaggttagtgagtaaaaaaaagttctgtaatgaaatataattaggattaggaaaagtaggaggaactaattggagttgagtatagtgagtatagaattttaaatatttggacaaaaaatttaagcaaaggtgaaaaacatcaaaatatgtatattgtaatatgtatataaaacatataatacatctatgtaaaatgtgatttaaaaagactgtaactcttttgtaaatggacaaagatttattttagagaaaatttcacagacttgaatgtaagaacaatattatctttaagtagtttttctcatagagttttgaatttaccttatcactctattattggaaggtgccttccaagagaaaacattctcactacaaatgggctgtcaaagcttcatgtcaggacccccagggatcaccaaaataatgccctatatttattacagagcccagtagtacttgttgagcttttaatgcttgtgacactagaatgatctttgatgcagttctcctataagtctttacaggattgatacacaatattttattataaaaatattaaaagtatttttagctctccctgtgttaatcttccttatacctgattatcaatacaaagaaaagccgatggaagatgagtaaacaaatagaattcaacacaaatgtaaagctttgttcttgtggtggtatcctacagtgtcaacaaatgacctaatactcaaatttcttttctttgttagggctgggaaacctttaaaatataaattagtttaaaagacatggttactaaggtagatagcccttgttcattattttgcccaccaaaaaaactagtcttgccaagaactattctaattctggtagtaaagcagatttaagataattcagttacag

SEQ ID NO: 75660 - DNA, 1056 bp, Homo sapiens
cctaacaggaaccaaagtgaaagtaaaatatggacgagggaagactcagaaaatttatgaagccagtattaaaagcactgaaattgatgacggagaagttttatatttggtacattactatggatggaatgtcaggtaagcaagaaactattttcttactattgaaattttttcgatgattaaatagaacatcaacttaatgttatgaagagtgaaagcaaataatggtacatatttacaaagcacaccttggttctgaattttccaagactttgacattcctgctgttatactagcagtgtcaatgcttctagccagagactaccaggatcacacctgtagttagaacaagttacatttattactcatttatagtgagggagaacacacagcaaggggaaccatagggcatcttagtaatatggtgttaaatgaatcaacagaggctcaaggcaccatctttgggaaaacaataattcataattctgtggagacatattactgactatgagcagggagccaggcctgcaacttccaaccgtgcaagtgtttgtttcattaatcagaaatcaagcctatgtcaagcactgtaataattctaagtcgactaattaataaaaaagaacgttagaacttacatttgatcttccgttagatgattttggggagggtttaagaaaggcagggcatgggggctcttgcatgtaatcccagcactttgggaggtggaggcggaaggactgcttgaggccaggagttcaagaccagacctggcaacatagttagacccccatctctacaaaaaattaaaaattagcctggcatggtggcacgcacctgtagtcccagttacccagaaggctgaggtgggaggatcactggagcccaggagttggaggctgagatgagctatgatcataccactgtactccagcctggatgatagagcgaaaccctgtctcataaataaaaaaaaaaaaaaagaaaaaagagattttgctccatattggatcctgtcaggaagttggggtaattatagttggttttcgtaataaa

SEQ ID NO: 75661 - DNA, 3074 bp, Homo sapiens
gtccttcctagatactatctcaaaccacttaacaaattaacttcatgtctaggatgtctaggtactaatcttttgatcttttttaaggactattgtacctaaatatgatactggggaatgttgcaaaatagcttttcatatagatttgagttagtaatatgcaacgtaatatatttttgcttggagcttagtttcccctccccctcaaattcttggcacaaatgttatgatttgttttatttcagaaatttctacagggaggtattcagaggtacatgattaaagatttttattgttatttttggtaagatttttattgtaaaattacattggtaatataaaaacctgtataatataataatatttcctcttacagactcttgttcatctgatagtgaaacagaagatgctttagaaaagaatttaataaatgaagaactttctcttaaagatgaactagaaaaaaatgaaaatttgaatgatgataagctagatgaagaaaatccaaagatttctgcacatatattaaaagaaaatgataggactcaaatgcagcctttagaaaccctgaagttagaagttggagagaatgaacaaatagtacagatttttgggaacaaaatggaaaaaacagaagaagttaagaaagaagccgaaaaatctccaaaaggaaagggaagacgaagcaagacaaaagatctttctttagaaattataaagatttcatcatttggccagaatgaagcaggaagtgaacctcatatagaagctcatagtcttgaattgtcttcattagacaataaaaacttttcttctgctacagaagatgaaattgaccaatgtgtgaaagaaaagaagttgaaacggaaaatactaggacaatcatcgccagagaaaaaaataagaattgagaatggaatggaaatgacaaatactgtatctcaagaaaggaccagtgattgtattggatctgagggaatgaaaaacttaaattttgaacagcactttgaaagagaaaatgaaggaatgccatcattgatagcagagtcaaaccaatgcatccaacaactgactagtgaaagatttgatagtccagctgaagaaactgtaaatattccactaaaagaagatgaggatgcaatgcctctgatcgggcctgaaaccttggtttgccatgaagtagatttggatgatttggatgaaaaggataagaccagcattgaggatgtagcagttgaaagctctgagtctaactctcttgtttctattccacctgccctacctcctgtagtccaacataacttttcagtagcttcaccacttactcttagtcaagatgagtctcgaagcgtaaaaagtgagagtgatataacgattgaagttgatagtattgctgaagaatctcaagaaggtctctgtgagagggaatcggcaaatggatttgaaactaatgttgcctctggtacctgtagtataattgtacaagagagagagagcagagagaagggtaaggactttctagggaaaagtaagtgtttatatgaaaccaaaaatcaaaactgttgagtttcaggtactgttgatctgtaaagtactttctttttcttttctctcttcttttcttattaaaaagaaagaaatgtcagtgtagtctgttgaataatatacttgctcttttttttttttttttttttttcaacattctctctttccccttatttcaggtcagaagaggccaagtgatggaaatagtggattaatggcaaaaaagcaaaagcgtaccccaaagcgaacaagtgctgcagccaaaaatgaaaagaatggaacaggttggtgtctttcaatgctagcttttgtatagtgttagtatttttagcagtttgttggcttgttttaaacataaatggagcaatactatattgttttataactgcattttcatttaacagtattatactagatattttgccatttttattcttaggaactctagctcattctttttaacaactttaggaaagtattcaatagtttatcatttttaaccatttccccgttggtgagcatttaggtttttttgtttttttgttgtttttatattgttataaactttgtgcatttgtgcacttatttctgtaggataccaagaaatgtaattgttaggtctgttgcattttgatatttaagaattttatttataatctgagtcaatcttttttattatttataggacaaagcagtgatagtgaagatcttcctgtcctagacaattcaagtaaatgtaccccagtaaagcatcttaatgtatctaagccacagaaacttgcacgatctcctgcaagaatatccccgcacatcaaagatggagagaaagataaacacagagaaaaacatccgaattcatcccctaggacatataaatggagctttcagctcagtaagaagcttatagaaaacttgatagatgaatactgtaaagtggaatagatcttaaaatatcaacttggattaatgttaataaaataaggaataatgattaactatttagatattccaaatattgccttagcaagaatcaccacatgttgtcttaagtataaatctgtgtcttttcataaaactgacttgataaatattgacttacaggaaggtctccattaagaagccatgtatgatttatataaatcagtgaaattgaagtgccctttgtagcactaacaattagaaatagccagtagttatttctattatgtaactagtagtagtgaagaaaatgtcaatacagggaaactattctgataactataattatagataggtcagggttagtttgtgttgatgttttcttatgtttttctgatcatttaagtaataaatgtttagtatagaaaatttgggatctaaaaataattcttaatcatgaatttaattcacgacttccttgttttcagtcttattcagcttactgtaggagattttaataaactaaagcttttgttgatttatgagttagacgtttgatagaattgtcatcatttttctcacagaattattttaaaatccaaattaacttc

SEQ ID NO: 75662 - DNA, 1035 bp, Homo sapiens
aaccctgaattacaaccacagaaagcactcaactggtttgacattgctaagtatatcctgtatacttttccaggctggattgtatctattcccctctctcttcttttttcttgttgcaaaaaataagctgattaataagtgaaggttaagcagcctgccatatttgtcataatttttcctctttacttttgtttttcgtttgttgtgatatagaacaaagggcacttagcaaatttgaatttgtataataaagctttcaggtgttacagaaatcgtagacaagcaagtgcacatgataaacatcaaaatattacccagctgaatagttactgctgcactttcactaagatgtatttgaacacttggtgagtagggggtttatgttgtgttttttttcattatcgttttttttatttttgtggaagcacttgctatttagaactgccaaagtatatgttcagcagtgtgcccaggattgaaggtgtaaatgggacaaaataaattgtgaaaggaagtgtagttgactgaaaactacagttgtaataagtcttccactttttataggatttttgagcacaaaattatgcaaatattttaatgtttattaatgtttacagtggaattgtgaataagttttcagtggactatcttatcccttgacaaaaatattttgtcttttttctatgtaatttcagagtttttattttgttacaaaaagacaaaaatgaaatatataacaacaatgaagttatttaacaagatttctaaagctgaaatttttgtgtaaaataaggtattatcttgcaacttgttaaatatatttattcagacattggatgttgtatttttatgtattttttaaaatattaataaaatttaaaaaaagaaaattctaggttaattcactctttggatgacaatagctctcagctgtcctttttacaggaggttgcatcctgcagccttgcctgtgttaaagggagtctgtctcagtccatcaaacagtatagaactataaatgggcatctggatcat

SEQ ID NO: 75663 - DNA, 1037 bp, Homo sapiens
attcaaagaaaagcaaactaccccactgattcttttagaatacatgcattttaaaaaattcatatttttgtgttgcctcttggatcttcccttttcattcctagaccacctgttcagaacattgcttacagaaatatttaaaaatgacacaaagaatatccatgagatttcaggaatatcatattcagcagaatgaagccctggcagccaaagcaggactccttggccaaccacgatagagaagtcctgatggatgaacttttgatgaaagattgccaacagctgctttattggaaatgaggactcatctgatagaatcccctgaaagcagtagccaccatgttcaaccatctgtcatgactgtttggcaaatggaaaccgctggagaaacaaaattgctatttaccaggaataatcacaatagaaggtcttattgttcagtgaaataataagatgcaacatttgttgaggccttatgattcagcagcttggtcacttgattagaaaaataaaccattgtttcttcaattgtgactgttaattttaaagcaacttatgtgttcgatcatgtatgagatagaaaaatttttattactcaaagtaaaataaatggaaatatcactgagcagttgtttatactgtatggtaccatagtattctcactggactgtggatacgttgaaatgtttttcaatcaggatcatcctccaagcagtcctgttcattcatgtctgcctcaaattgctggtgaatacataaaatagttacttgctaatcatttcaatgcatgatccttttcttgcctcccttgtgtcagggtgggcattacatatacttttctttttttttttttttgagacggagttttgctttcgtcacccaggatggagtgcaacggcacaatctcagctcactgcaacctccacctccccagttcaagcaattctgctgcttcagcctcccaagtagctgggattacaggtgtgtgccaccatgcccggctaacttttgtatttttagtagaaatggggtttcac

SEQ ID NO: 75664 - DNA, 1024 bp, Homo sapiens
atagtaaaaaatttaaaataagcaatttggtgactagtggaatagttaagtaattttaggaaaacagcaaaaatctcttgatttcctttatttttctttttattatcattattattattattatttgagatggagtctcactttgtcacccaggctggagtgcagtggtgtgatcttggctcactgtaacctcaacgtcctgagttcaagcgattctcctgcctcagcttcccaagtagctgggaccacaggcacatgacaccacgtctggccaatttttgtattttttgtagagatagggtttcactatgttggccaggctggttttgaactcctgacctcaagtgatccacatgtcttggcctcccaaagtgctgggattacaggcatgagccaccacacccagctttttttaattatttttttaagcccaaacttcaccatcttggtttcctttataaccctcctaggaatggggctttaaacaagcagcttagcaaggtagcagagcaaactatcttaaaactggagattttgatagacagggcctttgagtcccaaactagcattagaaaatctaattctctggccgggcacggcggctaacgcctgtaatcccagcactttgggaagccgaggcaggcggatcatgaggttaagagatcgagaccatccttgccaacatggtgaaaccccatctctactaaaaatacaaaaattagctgggcatggtggtgtgtgcctgtagtcctagctactcaggaggctgaggcaggagaattgcttgaacccggaggcagaggttgcagtgagccaagatggcgccactgcgctccagcctggtgacagagtgagactccgtctcaaaaaaaaaaagaaaatctaattctcaactgtaaggttctatggtcattaatgatctgagaaattgggggtggtggcatacaattacatacacagatttataaaatacgagcagtgattccctaactcttcagttagactaaaaacatttgtttataga

SEQ ID NO: 75665 - DNA, 1790 bp, Homo sapiens
cttggggcattcctcatatatgtcttttcagattttttagtaacaaccatcatttatcaccatgagatatataataaggacaagatgtgtgtagaggcagcacagggtaccagtatgaaacttagagaacatttaaagatttcatactttcgactgggcacagtggctcatgcctgtaatcccagcactttgggaggccgaggcaggaggatcacctgaggtcgggagtttaagaccagcctcaccaatgtggagaaacccccgtctctactaaaaatagaaaattagctgggcgtggtggtgcatgcctgtaatcccaactgcttgggaggcttaggcaggagaatcgcttgaacctgggaggcggagattgcagtaagctgagattgtgccattgcactccagcctgggcaacaagagcgaaaactccgtctcaaaaaaaaaaaaaaaagatttcatactttctgtctctctgacctcgggttgataagtcaataaataagaattttaacccaaagaaatacaaggatggaattaaaaaaaaaaaaaaaaagaacagattttggcattataagaaggaaatcagctctgtgttattttttgatgtgaactgtagaaagtccagtttgctgggtgtcctcctgaggtgcagtgagtgtactgtccttattcgacaattcaaaaggctcaggtctagtagatgaccttttgaactttcagctaggagcctattggtaaacaaagttccttaatgcatattttattacccttgtattttttttcaagttctcacaaaacagtgatttcatttaatacttctttagaagttgttttaccagttcttagatcttttcagactgttttctgagtgggaatccagaagaactctagcttggaatgcttgctaacagtatctaccacgctgcatgttgttctttggcaggtaccagaaagttatacaataacattttttttctttattattaaactttttattttgaggttagtgtggattgaaatacacttccaacaattaacacaaaggtcccctgtgtcctttacccagttttccacaatggtaacatcttacaaaactggagtacaatgtcactcacatccaggatactaatattgatacaatcaagatacagaatatttctattacaaaggtcttgtgttgccttcttatagcaacacctactttcttcctactccttccctcatccattccttaacccttggcaaccatatgttcttcatttctgcaattctgttatttcaagaatgttgtataagtggaattatacagtatttaactttttaggattggcttttttcctcagcagaattttccaggcttttgcaagtatcaatacctcatcctttttattgctgaatagtattacaggtatagatgtaccaatttgtttaaccattcacccactgaagaacatttgggttttcagtttttgattattaagaatagagtttctacaaacattcacatataggatttcctgtgaacacaaattttcatttctctaggacagatgcccaggaatgcaattgcagggttatatgggagatgaatgtataacttctttagaaactgccaaactctttacattcccaacaggaatatgtaagtgattcagtttttccatgtcctcactagcatttggtattgccactgtttttgtttttttgttttgttttgtttttatgttagccattctgataggtatatagcttgttttttttttttttttttttgagatggatttttgctc

SEQ ID NO: 75666 - DNA, 1348 bp, Homo sapiens
cctgggctcaagtgatcctcctgcctcagcctcctgagtagctgggactacaggtgcacaccaccatgccggctcatttttgtattttttgtagagatggggttttgccatgttgcccaggctgatgtagaacttttgggctcaagctatccacccacctcagcctcccaaaatgctgggattgagccactgcacctggtcagtcacttagcttataacatatatttggctatttggaaaatatttttagatagatgatatgtgtcataatagcttataagacattttataggtcttaaataggtcattttataggtgcaatggggaaaatactggattttgaagtccaaagaccttagttaggctccagctgtccagttactatctgtataagtgacctcatgtaagtttcttaagatttctgaaccatccctcccagaattagtaggaaaatcataagggaagtgtaatgtatacttatacctggataaataaggatagcatgacattaagtattttttttaatagtaacacatatgccaaagaattgtaacctcagaatagaggaaactaatttcacttactaaaaaggaagaaactttaaaaaaataaatgattagccaatagaagtttacatttcattgaaaagactattagaacttgaaggggacttagtaatcatattacctcatttttcaggtaagaatcaggccttattggagacattcaagcaaaggttggacaactacttttccagaacagaaaggaaactcatgcatcagaaaaggttagagcttgatgactgataagatctccctttattcttaagttccctggttctaggatatattttgtttgccacaagaataacagcatcattgtaatcattcccaagatctaagccagtgattcttgaatttgcttatttcttctctccctctccaggtttcagggatataatcagaaggtaacccctgatgggtctttgccacagtaacataaatttgctgtaatatatggaaactaggatcaaataaaagaacaaccacattactgctacctgttctcaccatcaggtggtttatgtggctggtggaatttgttagtctaagcttactattaaataactgcgaagtgaatagtgaaaaatttagaagacctcaaattagcaagtaactctgaaaatcattgatttactcagtcatctccagtattttctctgaaccagttgcctacaattatgtataccataatctttttttttttttttttttttttttgagacaaagtctcgctctgtcacccaggctggaatgcagtggcacaatctcagctcactgcagcctct

SEQ ID NO: 75667 - DNA, 1038 bp, Homo sapiens
ttactgctcccacgtgttctttcccatctggcggccgcggctcctgtccagaccctgaccctccctcccaaggctcaaccgtcccccaacaacccccagccttgtactgatgtcggatgcgagagcctgtgcttaagtatggtgtctgttctctgccgtgagaatccggggttcccggacggggggtggcaggctacgctccaggaaagtggcggggtctcccgaggaggccgccgcacgtacctggagcagtggggggtgcgaagcgggacagcgcttcgccgggtcgggtgcagaccttcctggagatggtgtcacctgggcgagggtaggaactttaggccctgagccacccccaacccggatctggggagtcggggtcctgttttgggacactgaattagactataaggtatttacgatgtgaccttgagctgcccgggggaagatcctcctttaaatgaaaatcgtctttagacataataccaggtctaacaccccttccctgatctgctcatttcccaggatgcgctacttagagctttccctttacgccttactggaggctttagaataatcaaagcagaaaatgtaatccgatctaaaagctaaataactaattttatttcttttacatctcggcagtctaccttcatagaagtctagacttaaaatggactttaaagtctgagcgcggtggctcacgcctgtaatcccagcactttgggaggccaaggcgggcggatcacgagatcaggagttcgagaccagcctggccagcaaggtgaaaccccgcctctactgaaaatacaaaaaattaactgggcatggtggcgcgcgcctgtagtcccagctactcaggaggctgaggcaagagaattgcttgaacccggcaggtggaggttgcagtgagctgagatcgcgccattgtgctccagcctgagtgacagatcaagactgtcttaaaaaaaaaagaaaaaaaaagactttaagggctcagcgttaaagacccttttaattattatttttttgtaactt

SEQ ID NO: 75668 - DNA, 1555 bp, Homo sapiens
ctagaagaaaaagcaggtaccatcagcgaattctaaaatctcctaaggattaacttcggttattttctgcttagacaacgctttctattcccgacttcctctccaataatgacccgaatctgtcgaaacttcttggaagcctaatttacctaatcccacgtccctaacggtcttcggaagcgaagcagtgtcaacagtccctggtaaacacaagtagtattacaagtcgggagctcttcaagtcttggatgagactgtagagcggtcttgtgcggcaatgtgctaccttaaaataaataaataaataaacccctgttatgtccggagtttgtttccacccggagaggaatggaagagcaccagagagcgcttagctttctggttggatgttttgggtgagtttcttggcgcgcatgcgtgttgtgtctcaagggcgggtttgaagggaagtgggtgttgacctgcgggcaactgacgctgttgtcagattacacccacgacggtgcgggtctcgggcgttctggagatacgtaggggtgaatttatgtttccgacgattgcatctggaggggtgtgtaagactctgtggctgaagaaagctattacgcttcttatgtgggtcattattttaaaaatagcatttcgcttttatttgcttgactgcctcttctcaacaaattttaagcccgccactacatgtgtttggttttgccctaccagctctggggttggggagtgcactgttatggttattgttgctcctgtggccattctcttgtcatccccactttcacattttggcgtggtgtattaatagactgagtgggattaatgggtaaatatgactttatagtcagctctaatcctggattcaatatcagaatttagattttcagctttgtggatgttcgacattttaaaaacagttattgcaaagaggtgaaaattttgttctgaagtcttaaggaaacagagaaagtttttccgtccttaagtgtgggacttgttttgtgaccaacaatatgaaaggctctgaggtcagcttggagaagaaaaaaaagattaagatgccagtgaagagacttcgtgaggtagtttctcaaaatcatggagatcatttggttttgctgaaagatgagttgccctgtgttcctccggcattgtctgcaaataaacgtcttcctgttggaacggggactagtttgaatggaacatcacgtggtatgtgattccatgtagtttttcaaccagttttagtttagtaaatctttagtccttatttgtttaaattcccaaacgtaagatataagtctagtttgtacagatgtttgaaaactgaccctgtttcccgggaaaatggccaggaagcctataaaatgtttgaatagatggaatgaatgaaactttaacgtcccctgttgtgctttttttttttttttttgcattgacttttgcatatttttttttttatatttatggtggatacacttaacttgtataatgtgctttattttcccccacgtagtgttttttatagttttcccccaaagtagtg

SEQ ID NO: 75669 - DNA, 1054 bp, Homo sapiens
attaaaatataacattcaggctgggcacagtggctcatccctataatcccagcactttgggaggccgaggtgggtggatcacttgaggtcaggagttcaagaccagcctggccaacatggtgaaacctcatctctaccaaagatacaaaaaattagctgggcatggtggcacatgcctgtagtcccagctactcaggaggctgaggcaggggaatcacttgaatccggaaggcagaggttgcagtgagttgagattgggccactgtactccagcctgggtgacagagcaagactctatcttaacaacaacaacaaatgtatatatatgtgtgtgtgtatatatatacacacacatatatgtatatatctataacttaatgactttctaaattatatattttttaagacaaaaattcagaagaatgtactaaaataagtttattatacttaatatatcatcataaagtagacattaatttgctataattttcaagacttaacagggtttatcttgagcttttcatgtggttgaagataatattttattggaatgattatatgcataccaagtaaagtttagtaagtactccctgcatgactaaaattgagcacgcagcaaattatctagtgagagaccaggaatgagtctataaactattagtttatagataactttacttctttaagcctcaatttctttacctagaaaatattttctgttgttcaggataaaatgagatgacacatttgaaaagcacattgattccttaaggagtggctcctacttagtcctaagtacttacctgccatcatccatccttccataactaaatctgtaacttaatgactttctaattttggaagaatgaaatctgctaatttagatgtcttacttataaagcttataattacagagagagttgaagttttgtttacatactggatatattagttgttcagtaaatgcttaatgaaatgaaattagttgagtctgtttcatctgttttatgtagagggatctcaacacacttttagaaattctgtaaaactataa

SEQ ID NO: 75670 - DNA, 1033 bp, Homo sapiens
gcttgagccactgcaccgggccccatttcaggtattttaataaatagtgctgaaaactatgttgtcactctagtttccatttatatacaaatgcatatattattgctgctgctaagcatggatgtttatttgagtactcactatcaatgattttcaaaccttgacctcaaacaaaatcctaccatttaggatataaaagatgggatgttttggtttaaaattctctgattcaagtagaggtttagggtgagggcctctccttcctggtcttctcttagccggctgcaatggcccctgagccatgtctgtggtagaaaggacagcactgaggtttagaatggttaaggaaaatgattaaggtcacacagcagagtcaggcttagtcagatctttgtgcttctacatctttccaatggcatcactgctgctactacagtggatacttgcaatgtaatacatatttttcattgtttattaaatgcagtaaattatgtttaactcctctaatatttcaatgtattttatcatctaactctttcaaatgatatttgaaaataataaaataatcttatttcttctagactcattttattagtgctgcactcaagactagtagttttcagcctgttagtatgccctcctccagagcagtggaaaagtattccgtaaaaccagaacaccctaatcttggtagctgtaatccatctttatataacacatttgcttccaaacaaggtaaaaatatgtagttctctatgaataaaaaatgtcagctgtgaattttctttgtgctacataagctgaaaacatatttcctgagcagtaggagtttttgttttataaaatttatttataggagtttttgttttataaaacaatttttttaaatgttctttttttaaaattgtgtttctcaggctaccttgtcttagataaaatgagttctttttttgcgtcaagtaatttttagtttattttgaaattttttaaattatggattatgttcttaactgattttaattaatctcataaa

SEQ ID NO: 75671 - DNA, 1011 bp, Homo sapiens
tggcctaaattgtaggctactttgtaggctataaattttttttttttttgagatggagtttcactcttgtcgcccaggctggagtgcgatggtgtgattttggcttgttgcaacctccgtgtcccaggttcaagcaattctcctgcctcagcctcccaagcagctgagattacaggcacgcaccaccatacccagctaattttttctatttttagtagagacggggtttctccatgttggtcaggctggtctcgaacttccgacctcagatgatccacccacctcagcctcccaatgtgctgggattacaggcatgagccactgcgcctggcttttaggctataaattgagtagataatcatcataagaagctaacttaggccagaatacaaatatgtgagatattatatacaagagaaatgaattagtatttggaaaatgatactatatctcttctatttcaggaaatgtaagactattggaacaaattttgaataataatgattctttgacaagaaaaagtgaatcatcaaacaccacctcactaactaggtcaaaaataggatggactcctgagaaaacaaacaggtaaaaacaagagattggaatgaaaactagattgaaaagagttttgttaagatttttcaaatttctttgggacttttaataaattatagcattgcttcttaaatttatcttagatttagttactattttttgatgctaatatatcttccccctttctataatatagctatgaaatgaatatctcattttttcaaaatgcaggttattaatttctaacgtatggattattcatttctgattaaatgatatctaggatttgtttcaaaaataatccaagataggttaggggcaagtaagttgggagtatagataaaatgaggctagccaaaagttaatgattgttgtagttaaatattgggtgtatggggttcattttagtattttctctatttttgtgtatatttgaaattttacataataaaa

SEQ ID NO: 75672 - DNA, 1414 bp, Homo sapiens
tggactaattctgtgaagtctgtattctttgtcatgtgctcccactgaagtctctgttttgttagcttagtctgccagtgattggaaagagatttccttaactgccttgaactgataagtctccctctctttgccatggattacgtgtgtgtgtgtgtgtgtgtgtatgtgtgtgtgcgagtgcatgcacatgcatgtgctagagcatgcctccagtgcctggcagattatgagtctgttttagcctttcacttcctacttgcacagagcctcaaggtcggaagtgagtgattaggaccttcccaggtctctcttgggcatgtacatagccctgtatgtggactagaaggcatgaccttctagattcctaggaatatgttggagcttttcaaaactccactttggacatttcattgcctagatttttaacatttgttgaccacaatcttgtttgccccaactagtgtcactacctcacgctgctgagatgttaaacaattgccaccgttttttgaaaaatgccctggggatactttctcgctgagctagcagtgagtcagttcaaataaagacaaacactatgaatgagacttttaggagagcttgaaaccattctactgtctttagtggttgtgaggctgttggttttcgaggccgccacagagttgggaatagggtcccgagaatgaggcaagttaaaaaaattccataaagcttgctcttcttacctagagtcagccatttttcttgaataaatgctcctggggttcttgcaagtctttaatttccagaggttagaaaaacttgattttgatgatttttgctagggttctcattgtgcttatggagaagcagattttcagaatttcttactccaccaatctggaagtgcttctggatgttagcttcttgaaagcataaccttttcctgctccttttctgctacatctaaacttttctggttagataattttgtctcttgtgattttctgtgtttcatttgtttaatcacataactgattaattccatagttcaattttaataggataccatttagtaatatagctaagactgtatcaaagatttgtgtaatgaaatgtttactgaatttacaacaatttaggaaactttttcaaaaatcttctgtagcgttgaaactctaccttctcaaagatttccttcctgtgaagagctagaaacaactaaagtgactatgcagaagtctgatgatgttcttcatgaccttggccaaaaagagaaagaaacaaatagcatggtccaggtaaagtgggaatggtcttaaaattgatgattagttaagataaaaattaaaaaggaataaaagagttataaagatagaaattaggaggaaggatgaagaaaaagcactgaaaaagatatgtcagccacatc

SEQ ID NO: 75673 - DNA, 1603 bp, Homo sapiens
gcctcctgagcagctgggattacaagggtgtgccaccacacctggctaatttttgtatttttagtagagacagggtttcaccatgttggccaggctggtcttgaactcctgacctcaggtgatccacctgcctcggcctcccaaagtgttgggattacaggcgtgagccaccatgcctggcccacattagtatttctaaatggaggaaaaacactttgattgccaagtattcttttgtaagtcttcagtttgacaaattgagtccttagaatatattggtataatgtatggcctcaacaatagtgatagctgttattttgattaaaggaatcgttgtgagtttagtaactttctggtctttttttcttttaagccaaaagaatctctgagtatgttgaagcttccagatcttccacagaattctgttaagcttcaaacaaccaatacaacaagatctgtattgaaagatgctgagaagattttgagaggagtacaaaacaataaaaaagtacttgaagaaaacctggaagctattattcgtgcaaaagatggagctgccatgtattcgcttatcaatgctttatctaccaacaggtaagaggatgttggcatccagggttatttatgagtctgtcagttccactttcttcataatttttttctaagcactgtattttcctattagttttcatatttttaaaaggttctttattgactttgaagatgtggaacttataaagttggaatttggatatatatatatggtggtactacttttttctggtggaaatttttcttttaattttttctttctttggtacatatcttcttggatccacatgtgcttttcaaacatttatccttcaaatatttgatgaaaactaataccatgaaaacaaatagcaaaggtttttccttttcagatgaaggatattaggcccccattctactatcctaatatcctttccttttcagatgaaagatattaggatagcaggttcacaactagataagagttagatctgatccaagtcctgctcaggacagtaagtgctaatttaagaaaattcctttttctcttttatagagagatgtcagagaaaattaggatcagaaagacagtggatgaatggattaaaactatttctgcagaaattcaggtatgtcttggaaaaaaactgaaaattaagtgaattctcagaagataatattgattccaatttacaggcattacatttgttttcaaaatatttcttatataaaaatccacttatttttaatttaattgtcactctttatatttacttagtaataagtttagctttgtttaacaagtatattatctccacttatattctggctcttatttggcaaattgttggacaaaaactaaaacatgaataatctgaaagaaaatttagcaaaagtgtttggaaaaagaattatacttgcaaagatatttgaagacagtggatttaggagcattgacccgccaaagtaaaaataccagagtaatgcaaagagaaaaaaaccaacgagatttactaagtttacggaagtcagttccagatggaaaaacagcctctttctcacaaccacaatg

SEQ ID NO: 75674 - DNA, 1904 bp, Homo sapiens
gaagatttggagtctagttttcgctctacagctaactggcaatgtatcttactcttttgcaatgaatcccatgtaaagtatatttgtttaaactttcacataattttaatttatatttatctcagttttgttacaaaagtgtttgctttttttgaaatgtatttttaattttttaaactgttagcaaaattcatatggttcaaacatcaaaaagtataagaaggtttgtcatgcaaagttgtcctgctacccctgcaacccttctattatttcccattccccactccaaaagatactagtctttttagggttttgtttatttttccagagatttttgatttttatatatccaataaagccaatatcctttatttttaatgcatttaaaactgctaaactgtatttatatagcagcaaaaaataaattctaatactttctgatgtgaaagcattactatttgtagacattttaagtaattttaactttggttatgttaaggatgaactgtcaagaacagattatgaacaaaaaagatttgatcagaagaatcagagaaccaagaaaggtcagaatatgactaaagatattagaaccaacacacaagataaaactgtcaacaaatctgtaattccaagaaaacattctcaaaagcaaatagaagagcattttagaaatctacctatgaggggcatgcctgcttcaagtttacagaaagagagaaaggaagtaagatcctaatctgttcttttaacataattgttgtgttataattgatcatttcctttaagagataaataatgaagcgaatgtgaaggtgttttaaaaatatgaaggactatacaaatgtaagctatctttacactattgatacttagggttttggatttataatgtgaaaagcactgaacaaaatagatagttcctttcttatgagatctcacaccctggcatcatgattttgtagttatagcaggtataaaggtatatctagagatcatctagtccaaaaactagattctctagtttatggtactcaaaattttcatttgcgtgtgtgtatatagtttatttttcagtttaacaaatgcatgtttagtgcctagtatatgcaaggcgtggtactagatggtatggaggaaatttttttgactgctgtaactaggctataagtttctaagtgccaaacatggattgttgagcagatcagtaaagcatctaattcaatgcttatacttagtagattctcagtaaatgctccctttctgtgacatttagattatggttgaaggtgggttcagaaatatataaaattatttaaaggttaaggttgttgtatttttattgtactggagtataataaatatgtaaaatgtgtttaaatgtttcttgttggtgctgaaaatatacttagtaatgtaaaaattttcatgtttcttaggtggatgatttttatatttaaagcttttcaaactaatgcttgaaacctgttatctagaatttaagggctgttgaaaacagaggttattttttacttaatcattcttgttataatacttaagctagcaaaaggaggctttagaaaaatgagataagtgtttgatgactgttttcatggtgagttgaataactttgtacacacaggggcttttgaaagcaaccacagtaatacaagatgaagattatatgttacaagtctatggaaagccagtttatcagggccatcgaagcactcttaaaaaaggaccatatctcagatttaattctccatctcctaagtccagaccacagagaccaaaagtaatagaacgagttaaaggtaaggaatctcatttttaatgtttaatctcatttcttaatagtatcagtttaatatgtaaagtttctttttgctttttatttattg

SEQ ID NO: 75675 - DNA, 1872 bp, Homo sapiens
gtcattgctgttcttttgttttgattaacaatttaagtatgaatattttttaatgtaagagacttttttatttttgatattatgggttaatttcatgtcaacataatagctctctgtttaaacatatctcctagtaataaaatagctcacacttttaaagttcttactgtgtgcccggtacagttctgagcactttacatatattctctcatttaatccaccctataaagcacatggtaatatacaaattgtatagctaagaaaactgaagcacaaaagggttacataatttgtcaaaggctacacagctagaatggtgccaggattcaaacccaggcagaggcagtctggctttatagtctgtgttttcaacaagtacactgtactacccctctttactttgatatgtagaagtcaagtgggactttggaagtgaaagtttttgacattttaaaatgtggatagtattaatagctttctattagcctttattttgaggtttaaattagatagtgatgtgaagcgttgagtacatataagtgcttaataaaagtcactgggtatggtgagtatgtcgacagtgctgatgatggagggaggggtgattgtcagatagggcttttttaaatatgagaatatagccattaagatccagatggtatattagacttttccctttttttctgaactagttgacttattttttctcctaaacttcttaggacaaacccaaagtaatagtgataccatgccacctgctggagtgattgtcagcaagccacaccctgtaactgtgactacttctattcctccatcatctcgaaaagtagaaactggagtaaagaaacctaacatagccattgtagaaatgaagtcagaaaaaaaggatcctcctcagcttactgtgcaggtatgccagggtgcatgagtagaaaattttaaggaagaaaaaatttttttgcttaacgttagtacggaaatccattatattgcttcataaaaatattgcttttgatcatgactcttttttttaaatttatttttattttttagacagagttttgctcttgtcgcccagtctggagggcaatggcgcaatctcggctcactgcaacctctgcctcttgggttcaagtgattctcctgcctcagcctcctgagtagctgggattacaggcgcccgccaccatgcccagctaattttttgtatttttttttagtagagatggggtttcatatgttggccaggcttgtctcaaactcctgacctcaggtgaatccacctgcattggcctcccaaagtgctgggattacaggcatgagccaccatgccccgctggctctgttatttttaaaactgtgatattaatatgatgtttctgtcctgttttgcatgatttaagctgctcttctaggccaatgacttatatacaagtggcttggtgatattccaaggggaacaattgaactgtgtattataattaattttaaaaagttaatatatgtgacttatataattaatacttcaaactttacactaacatatgttagaagacttgaatgaatacaagacttcaacaggctcatgtgggaagaaaccctttgacatttcacaaacatctacccttcggcctgggatccagctgtagaagctgaggtcttcactaggtctggacaaaggtgaacatgagtatttacatgcgactttctattgaccagtcaggaggcaactgtaggaaagcattcatgaactgtggtaaactttttggctgatttactccaactcctgtattcgtcttaccatccttgcttacttacaaataattagaacactccagtccttagactgctccaaggttcctcttttgattg

SEQ ID NO: 75676 - DNA, 1045 bp, Homo sapiens
ccaagtgatccctctacctcggcctcccaagttcgggaattacaggcgtgagccaccacgccagcccaaaacaaattttgaattgtttatgaacttgaaagtttgtttcagatccttacatttataactatttggaaagtgataatctttagtgtaactttttggtaatttaagttgtgaaactctcatgtgaagaaagaatttctgtcactttggtgatgaatctttgatttacatgggaattatagatatcctaaatgaattttatagtgacagttgggagtttatattttggaatgttaccttgttatcccactgttgacatgatacaaaaatatgcatttcttcctggcatttatttgcttttgaataatgaagttatggctttactacacagcaaaatagcactgtaacttaccccaggttttgtttattgtaagcaaacttggccaagggtacagttttaaaaggagagagaataccagcaatctttcatgatcataagtaatgaaatagaactgtccgtaagtgacatttgtgcttaattgaattttttcatcagtatttttttttaaccttctgtttattgaaacttctgtgataacaagcaataaatttttggactgtttatcattctgctgtcagtaagaggctattgcatgactacattttatataatgaggcctaatgattagatttgtaaaatgactattttgttttttttcctgaattatttgattctgtatccatcttcatgtgagttcatatatgtttatacttagagatctacacatgtaaacactttcctttatcttaattctggaagagaagtctcaattatatcaacctgttgatcaattaagtgatattgctgatggagtcctttacagaaaaacagctgattaattttttaaagctattgaaatgttgacctaatggcttggggactagcttggatttcatttactaattaaatcaattctgaatagggtattaaaatgattaaaaaggaccatgtaattataagcttatactataggtggaa

SEQ ID NO: 75677 - DNA, 1049 bp, Homo sapiens
tgaaatggctgaatattaatatagtcatgaaaattaggtttagaagaaatttaatgatataaaaagatattaataatgtactggcatataaacaaagcaggatactaacaatgtaaccccagtttacaagatcttactcaaaagtaagtaggcagctagcacagtggctcatgcctgtaatcccagcactttgagaggccaaggtgagtggatcacctgaggtcaggagttcgagaccagcctgaccaacatgatgaaaccccgtcactactgaaaaaatacaaaaattaggtgcgatggtgcacacctgtggtccctgccactcgggagactgagacaggagaatcgcttgaacctgggaggtggatgttgcagtgagctgagactgtgccactgcactccagactgggcgaaagagtgagattctgtctcaaaacaaaacaaaacaaaaaactgtgcataaaacaaaagtttgaaaaagcatacataccaaattaactgtgtttattgctgaacctaggattataggtgagctttatcaattttttaaactcttacatttttttctaaattttctacaatgaacacctattatttatataataatttttaagaagtctattaactgcactaaagaaatgttctagaagtctcctgttcccctttcccttcctgaagatgactttggaaataaattttttctttacattttaagaggaaaactacctataatacagcctatatgtgtattaccgtgaagaaagggcagctggacatcttttctagctctgatctgatatggtttttatgtgtgcactcagagtggaaatcaaacagtttaggtacatgatatgccagatagtcattggcccaagtcttattttgagtttaggagttcttttaagcttttcattagactaatctgaaagattttaatttgatttcataaactatctcccacaaggagattctgtttagtgtgttttatcttcttcagaggtactttttttttttttttttgagacagggtctcactctattgcctaggc

SEQ ID NO: 75678 - DNA, 1026 bp, Homo sapiens
tggtctcgaactcctgacctcgtgatctgcccatctcagcctcccaaagtgctggaattacaggcatgagccaccgcacctggcccaaataatatatttttaaaatggtcagaggacagacagttcatatacatagaagaaatacagatcacccatgtacatataaaaagatgaagatgatcaacctcatagataataagaaaaaaagttattgaaattgcatttttactgatcagatcggcaaaactctaaaagtttgataaatctgggggaaattgtcattttcctaccttctggtggtagtataatatagtaaaatcttgtagtaggaaatctggcaatatctattcaaattaaaaacataattagtcctttaatagagcagtcccacttctgggaacttattccatagatatatccatatatcatacatatgaaatgactgaagtcaagattatttgataactctgaggaagggctctaggtagaaaggacaagagtaggagagagacttaattttcactatccttttgtaccttttgaattttgaaccatttgaatgattacctattcaacaaattaatattaaattgttacatttttccttctccagtactttccatctccctgctgtcttcatctttccctaactcccaattcttcttatccttccattactttttatatactcagtttgtgtgtgtgtgcaaaaaggctgattttttggtatgttgtcaatcacttaaaatgcttcctttctgttctatgcctttccttcatgtctgtaactgggtttgatcatcagctttatctatttaatctttcagtcttctttatttttaaaatttcagcttttatttaggtatagggggtacatgtgtgggattgttatatggatatactggacccaggtagtaagtgtagtacccaaaagtagtttttcaactcattcccctttcttccctcctgccccctgccatcatagtccacagtgtctgtttttctcatgtttatgtctatgtgtgc

SEQ ID NO: 75679 - DNA, 1004 bp, Homo sapiens
gatcgcaccattgcactccaccctgggcaagggagtgagactccgtctcacaaaaaaaaaaaaagtatacaattgaatagatgcttagactactttaagtatatggtggtattaacaatgatgtcttctcaaggtattttttaacgcttcactaaatttaggaattatcacattaatggctaccaccattgtcattattattattaattataattgccattatttgtgtgctaaaatggtaagggatatctgaagcaatgtatcatgccatcctatggagttctttactgactactatctttttctgtccttttaaaaaaaaacctttaggagatgatatgcctgccatcatgcttgttaatactccaacagttacccctactactacacctcctccagcggcggcagtttttaccccaactttgtcagatatttccattgataaattgaaggtatcaagcccagagcttcccaagccatggggtgatggagacctgccactggaagaagagaaccctaactcacctcaagaagaacttcatccaagagctatgtaaatgagaacatactcactagtaactgtacatttcaacttatgtttgacttatgtgatccattgaaaacatagaaatattatacaaagctttataaaccacagactaccttatactttgaaagaaagaactttcataagtgttgagttttgaaaaattatcaaattataccttcaccttttttcttaaaaggtttgaaatagctagaaataaaggtatctattatattgttaataaaatagaaaacaatttctccctattgtggatcattatttactatgatcagttaacttttatattattttatatctctctgtatggaagagctttcaagatggcctatgattaaagcatgaaaacaacttttaaaaatcttgttaattatagtagtgcagatttaaaaaaatattttgctaaaggagacatagtcttcgagtctgttttttatat

SEQ ID NO: 75680 - DNA, 1092 bp, Homo sapiens
aagaaggcataaatgagatatctttattttcagagaagcattactaacattcggcctattagtgtacaattatagcatttttctcctctctttgaactttttcaagtggcaaagcatgtttaaatttatttaaagtaaatagctaaaccaaaccaagactaaattataacttgtttctctttttctacatttgaaactaaattctaatgttgatatttttactatgcctaaatcacatatgctacaaattcataataaagtcaaatacaatagtacaatctggaaaaaccccaaataacttgaaatcatgtaccagtgggcattttatctatacatagctaggggatagggacttataatctggagttaataaactttatttcatgaaaaataaatacaaatactttcaatgaatttaaagtcatgttaatatctgtatttacaagataatctactttgttggactctgaggcccacactgttcctcattgttgggatgggcctattttgaggcatgaggaagcctatacagggtgctccagtgagggtcttcaataccaatgccctcgccaagtaagccagatgtcagcccaaaggcaaagggacattgaggtctatagctgccataccatacttctgcagtttttcatttttgcttgtggtccaagttgcagcattacagtgctttgcccccattgccacactgtggcattactttactgcagaaatatgaggaggaggctgtgacccaaaaacaatgatatcatataaaacatttatgattcatagtagctcaactgtgtgggacagactgtttgatttttatgtttttataatctccagtttatgttgtaccaaattatactgtggtttatatttgaggcaaagatagagggcttttattatagacaaatggaaatgagaactagatgaaaataaagagttcatctcctttccaaaaatgctaatatcatcatctcatgactgataagtttttattaatcttaaattgagaaaaatgcaattgttcgaaataatttatttttattaattgtctttatgtttcttttaggaggatgatcctcctagtga

SEQ ID NO: 75681 - DNA, 1042 bp, Homo sapiens
ggagctcacataactcaatattaagaaaacaaacaatccagttgaaaaatgaacaatagatttggaacagtcctttacccagagaagataatataaatggcaaataagcacataaaaagattcttagctgggcgtggtggctcacgcctgtaatcccagcactttgggaggctgaggcaggtggatcacgaggtcaagagatcgagaccatcttggccaacatggtgaaaccccatctctactaaaaatacaaaaattagctgggtgtggtggtgtgcacctgtagtcccagctactcaggaggctgaggcaggagaatcacttgaacccagaaggtggagtttgcagtgagccaagatctcgccactgcactccaccctggtgacagagcaaaactccttcttgaaaaaagaaaaaaagattctcagcagagttagtcattaggaaaatgcaaaataaaaccacaatgagctaccaccacacatccattagaatatctaaaatctaaaaggcggtcatgccaagtgtcggcaaggatgtggagcaactgaactctcatactttgttgattgggaatgtaaaacgatccaacccctatggaaaagagcttggccatttaaaaatatacacccaccatatgaaccatgcatttcactcctagtttctcaagagaaactaaaacatatatttacacaaagacatgtacgtgaatgttcatacaaccttatatttgtagtaaccaaaaactgaaaacaacacaaatgtcaatcaactggtaaatggacaaattgtggtgtatcctgtacagtgaaatacttagcaaccaaaaggcatgaactatgaatacaaacaataacatggatggttcttacaaaagttatgttgagtaaagaagccataccaaaaaaaaaaaacactgattttatttatataaaattttagaaaatgcaaactaatttatagtaatagcatttcagttattttggggtgatggtaggagttagaggtggaaagggcaagaaggagaagataaaagggtgtg

SEQ ID NO: 75682 - DNA, 1058 bp, Homo sapiens
aatctgggcaatcctgcatgtgcagactgggaaacccaagtcttatatctcatataccatagtaatttttacagttccacagatgaaaatgaaatgaaatcaattccatcattttcagaaaagatatcttttaagaaatctattattattattataagagcaaaataaaacaggatcactcttttatataattacaaaatatttttaaatatgtgcatgacaaatgctgtgtaatacacctcattattttcagtgtccctgatgggctccttatccttgacctaaaaatggtgattccaaatttaagactttcttgggtatattttttaattggaataaatacagaggtcaaaattactcttgggtttctaagtaagaagaaatgcaattacttgtgaattattttaagctcgaatgctatttgctctctgttaaaatggtaaaacaaattactcgttatggaatatatacccacaaaagtctttcagtaaaatgttattgctaaaatgtatcttaaaatctaattgttagtctttgttacacttgtcagctcagaatggtcaggaacctttttttgtgataagcctcacagaggctatggaaaacaggagcacttttttcttgggaatataattgcagtaatactgtaccacctaatggagtcagaaaaaacaatttatgtagaaatatagttctgagagccttgcgattattgccttttgtgtcattctacctacattacacaaagtaggacttaggaagtcctggaaatcatatgttggatattttctaattactgtgtcagcatgatcaatcattttctaaatttgccagtttcctgaaatagcttagcttatgttcatagcactttagaggaagcagcataaaattagtttctattggtgtcacaaaagaaatgaaatatttatctttggcaaaaagacctgtacaccaaacttcaattaatgagtacaagaattagaaatcaaaactttgtttagtctaaggaaaaacagttctttaaactgtaaccacatggctgtttcttgtttgcatca

SEQ ID NO: 75683 - DNA, 1454 bp, Homo sapiens
tgtacttcacagcacagattaacagcatcataacggagccatgcccttagtatccagagtgtcttgttggcctgagacctatatgtgctataggtttctctcagttaactttccgattctctggccataaaaaagattttttcctcagcctattttatctcaatactaaaaatttgctttgctataatagtgtattgctcttctgtgctccctgccagctttatgggttgtttcctacggattgtattgagtaatatgctccaggctggcctaggaagaagggagattctaaacctctttttgtaattattaaattcttaggtaagagaatctgtgaaaacttttcacctttgaagaaatggcccattaatttcctttatttgatacaaatttcagattttctcatgaccctttgcttcccccccccatctgtgatgcataaagataataatccgttaaagtatttcctattgatagtcattaaaattcagctgtttaacttccttctttacattcaggccactagatcaaacttctgtttacctggttttatgagaataacggtgggagtgcatttggtttgtgttcttttagtgaataggaatgaatcatgattatttctatgcttaactgattttcttctgaaaaaataaatttttatgtagtttcaccaggtgatatggatcggacacaaattgagcttaatccgtacctcacatgtgtattttcaggtaagatttttactttaaaagttcttgaacttggagctgttcagattttttcatttcctgatgattctttctctcataataatcaacacagtagaaatactaatagcaatttttaattcttctgtaatatctgtaaattcaccccaggttacaaactcagctctccaaaaggcgtaagttaggggacaggaaagaaaacctatcgtttcgctttggaaagtttataaaatgatgaattaaaaggctgcaggtgtggtattcagagcactaaggataagactcgagataattccatctgggggaggttatttgttgggacaggacagtgtttaaactttgaagtcattttaaacaaagtgaagcagctggaacctggcataaaaagaaacagatctttcacattaacgattgctttttagaggaaaaaattggagttgtttttacaggtgtcggaacatttattcttcctataagaactgctttgtttttaccttaaattataaattttaaaataagcatttgtcaactcatttgaaaaataaaaaaagtaataggattcatatgcctaaaagatattttgggataagatcattgtaacattttaagttaccctttctaaaacatgagtaaggaaagaaatgtttaatagtgactaattctggaaagcaaaagtaaataaaatattgcatactatacttaacatcaaatgatgaggcaccttct

SEQ ID NO: 75684 - DNA, 1098 bp, Homo sapiens
ggggttcagagaagttacgtaactttttcagtctcttattattttctatccctcttaccttttacctatttttctttatagtacttagcacttcctgttatattagatgtttatttccttacttgtcattcatcccctaaacccaacagaatgtgtggccagtgaggttagaccctttgttttcttcactgctgtattctccagagtctagaacagtgccaggcacatagtaggtgcacagttgatatctgttggatggatggatgagctcagctctgccctgttccagaatccattctcttatcccctctgccttttactccttcccatacagaagcctcacatcagcagtctgggtggggccattcctaagtgacctgatttggaccctactcttgatctgtcatgaagagacttgtgcttaaaatttcatcaccgctcccaagtttgttggtgttcttattactgcctagtcagtcaaccaaatctgtcatttcagagtgaaacttggttctttataagtactaagtctccatccaaaatatcttgaccctatttccactgccaaggatcattagttcttctatggactatttttatagatccgtctcccgtctctctattttccacacagctattaggatgatttttacctcttttttttttaacttttattttaggtttgggggtacatgtgaagaaggtttcctgtataggtaaactcgggctgtggaggtttgtcatacagattatttcatcacccaggtattaagcctagtacccaatagttattttttctgctcctcttcttcctctcaccctccagtctcaagtagatcccagtgtttgttgtttccttctttgtgttcatgagttatcatcatttagttcccacttataagtgagaacatgcagtatttggttttctgttcctgcattagtttgcaaaggatgatagcttccagtttcatccatgttcctgcaaaagacatgatcttgttcttttttatggctgcatggtattccttggtatacatgtaccacagtttctttatccaatttgtcatccatgggcatttaggttgattccataccctt

SEQ ID NO: 75685 - DNA, 1050 bp, Homo sapiens
ccttttttcagcttccataccggcaagcaagactcaatacaatgggatgatttgtcaaacagtaaggagttttacatgctagacgaccaaaagaatgacaattatgcattcctatattgctgatttgcacgaaggcactgaaatgagaaaaaaaaaaaactttttggaagagtcatgcccaattctaggttgctccccatcaaattctcttctaccttttaaaaatatttccagtttatcttacctgcagtcttcctacccttactctgtctctattctgctcccctccatgaccatacccaaacatatacacttctggaacatgtttagatttgactatggcaggggagtttggagggtgggaggtgtccaggctataacatcttcagcatggcttctagatttcattcagatctgctcagatttaaaatgattacacacacagtactcatcattttgccacatacaccgccttcctattctcaagaaccttacccacctgtgaccacagctaaatctccaggcgttgttcagccttgtcaggctccttccaacatcctgatgttctgttcccccttgtctccatgctgacctgttctgaacctctgggcttggattcctgctcctgtccactatgcatacatcacagactcttcataagggaggtatagttacattccaatatgtggtgaagggagcctgcaggcagagccacacatgtggttgctgagggaatgggcacataaaaagaagcccctcttcaacaatcttcttcaaatagttcacagtctcaccactggccatccaaaagcacatttagcattcatgtcttcaacgtctttctatcacggtcttaacaagcatactgttgaccaggcagggtcgttcacgcctgtaatcccggcactttgggagaccaaggtgggcagattgcttgagctcaggagtttgagaccaccctgggcaacatggagaaatcccatctccacaaaaaaaatacaaaaaagttagtcaggtgtggtggacgtgcctgtagtcccagctacttgg

SEQ ID NO: 75686 - DNA, 1025 bp, Homo sapiens
ggtaactctgaaatgtacccctagttatgggctctttgccttttcctaaggattgtttgaaataagaccataagattaggacaccaaagtccaatgaatcaaaattggccaaaaaacaaacaaaaaatctccttttcctaaatgattattcattttcctgttaagcgtgaatatgcattatttcttgacatgatgttaattccaacggtgtttttatttgtagggttttatgagctgagtgatggggcttcaggatccctttccaattcctctaactcggtgttcagtgagtgtttatccagttgtcattccagcacctgcttttgcagccccttggaggcgaccttgagtctctcagatggttgccccaaatctgcaggtaagaatttttagcactgatagaaatttttaattggaaggcatcaagggcccttaaaaggttatttggctccagcacctttcactggtggaaaaatgaaggttcatcactttgcggcatttagtgccatacttacatctagaactcagtttcatctaggtgagtatctagaactattccagtaccctttgggtgctacttggttatatattttgatagcagcaagacactttatctctagaaatcctgtcccaatattgtaggtcttgagctctgtttctgagcctttgctgttaggttgtctgtattttctttcattttggaactgttttcttcttttaattatgtaaagctaaaactcagccaggtgcagtggctcacacctgtaatcccagcactttgggaggcttaggcagctggatcacctgaggtcaggagttcaagaccagcctgggttggcccggtgcagtggctcatgactataatcctagcactttgggaggccaaggtgggtggatcacttgaggtcaggagttcaagaccagcctggccaacatggtgaaaccccatctctactaaaaatacaaaaattagccgggcatggtggcacatgcctatagtcccagctactcgggaggctgaggga

SEQ ID NO: 75687 - DNA, 1502 bp, Homo sapiens
aaacctttgtcaaaattaaggcctcacataacctcaagaagaagatcctccgctttcggtctggctctttgaaactgatgacgacggtttgagtgacatcattggtgtagaaagtttgtgtgtttttttttcttctccctagttgccaaaattaaaaaggtggtgttttcatttttgtataatactttaatggaatgctttttaaaaaaatataaaaccaaggtaaattattgtttcatcttcacgtatggatgctagtgcctttaatggaaggtaaagaatgttttgctagttagaagtacatattgaggttttaatggtggtgatagtgagttttgtggcaccagctgttttttattttaaactttctgagcatccggcaaggtacaggttttgatgttcaagttttattgggataagatcttttgatcccaaggtcaggtggatggaatttttggatttatatttgttccttgagtcttcagggcagtgtctccatgagggttttcctgttgaggggcaccacatacaatagtgtgaagtaggtatgaggggcagtcattgtattctatagtttttttatgtagtctacatttctcagatgtatccccattcggttttattctcagaactgttactagactcatgacttggaggccaaaccttaaatccagagatagcagcctcgatagggaccttaaaaggattcacaaaaacttttgccacacttggtgcctaggccctgttcctaataaccccttctagggccgtttatccaacatttagatgccttcttttccctccctaatttgtagccagtccaacctttcattccttggaggatttagttttgggataaaattttggtccttgggcacagagacattcactattaatgaagtaacccttgggcatgactccaatcccagaattgctcactgagcgctatgccaccgaagcgttgacctgaacatattagtgcaatccagtccagattggacctttgatcctatgtggaagggctgttttttaagaaaaaatttttggtaaacagtattgtgtaaaattgctttttgtataccaatatatgcatgttttgtgcatgagtagtacttgtgttgatactcctgttgatgttaaattactatataatataaacagtatgtgtttttatatatcattgtgtaaatttaatataacatatgcagtaataaaccatttgttttactgctgttaagtttgttatttgggtataaaaccagatgtttacacctgtaaatcttgtgctggttattggtgttatttgtgagatttatgttagacctattctagcataagaatatcatttgcaatatagataggttttagtattagaatggacgatgagcaagcaaatgaaggaaagcagacaacttctagttaaggtactttaaaatttaaggtaaattttataggtgtcatctaaggaaaatatttctgaaaagaatcccttctcccaactt

SEQ ID NO: 75688 - DNA, 1057 bp, Homo sapiens
gagcccagatttacataggggtgtaagtgccaggaagcatgattggagggatatctttggagacaaactaccacaggtacctaacattggttatgttaggtccatatgtaacattcaataaattcttatttagtgaacagcccagaaacaggagataaattgttttctgaaaaagccatttgacctttaatttcctttgctggtggcagggggatgggagcgcgccatgaaaaatgagactttggcatagctgcaatctaatcttggaagagcaagcaaccttgaagaaattcacttatgggtgtaaatatatcctactgacaactggatattttattccaagattctattatttttagttatctaaccaatatttttctgtttatgttcattctctgcctctgaatagggagagagctgcactgatgccagttctccaatcacacatgctattgtcaaatgttaggaagtaatttcagtgccattgcttatcctggtctagctcacaacatttagaagtttggtgttggttactatgacagcccatcttctcaggagagacctagatctcagagtttctttctgaatatgagttgggggcaggggcaaccattgtgtctctggctgactcagtcagggatgtttttgtcaagtctgctttgggctaatgtgtaaaattgatccatcatttcccacacaataacaacttcttctgatagcatccaaatagaaaacacatgttgctgtaagattccattaattcagctaaaaattattgctcatttcttatatttaagattataccacatgctttccagaagcttctatgagagaggagagataagacatgtatagataccagacagcctatactgcatataaatgatatagatgtgaaattctacagcaattcagaggaggaagaaattactcagactagggtggcattcgttggcttctgaatagagttttgatagataaatttgtccaatttcagagctaaaaacagtcttaacacagagctcaacacaagtgggaaaggaatggggctttgtta

SEQ ID NO: 75689 - DNA, 1022 bp, Homo sapiens
ccatcatcagcacatgcaaggctgcacagtaaggctggcagccagcaccttctctggctcataggttggtggagtcttcaaacaaaaaatccttactgctataatatgtattcatgtatctcctttctgtttcttgaggtttataatttgtgttagtttttttcttacatttttagtgtctttttattctacctatttcattttctaacctcttcactctcactcctgaatcctaaattaatcacctttatttttctcattttcttccggaagcctcttctctggtttctccttttaaagcctctggagttctctctacattcatttggcagatgttactggctaagttattcattcatgttaactggcccagctgtgtaggcctcttcttgttttgatgtgaattggaccgtttgaataaatatgttttaattttgtcattaaagagattgtatacaatttgtttgaaaaggatgaaatatgggtgccttgttcttttaaagtacctaaatgatttttttgtgcacatagcttagtcttttggatttatgtgtcaatcaattgacctccttatctatattcatccatccatccatccatccatccatccatccatcttccacttattcttctatcatgtctttttggctatctaatcttaccttccctatctttaattgaaaacaacattgtgggaatttaacccccccgccttgctacaattctctttctcatgtgtactttctatgtacatatttcaaatgtgctgttgctttccctgtaacagttagaacatcattatgtccctctaattttaacacaaattgcttgttttcattgttgtcatttttgagaataaaacatttagtcttggcctgttaaacagaattgccaaaaaatatttgtatatctagtctttttctctgaaataggcttaaaaaaatctacttctgttgatgaattgaagctcttctattttctggaatttaaatgattacaaatgataccctgtgagttcatcc

SEQ ID NO: 75690 - DNA, 1042 bp, Homo sapiens
cttctgtaccccataggaacatatcatgcctcacacatatactttacatagcaatgtccagaaaaaagaacatttaaaatattgtccccaagacatgctgtaattcttgaagttaaatgttaagtggtgcaattaagttaaagaactcaagtttctgtcgaagaaccgagttagggaagcttggttgaaagtatcttaccaccattaaaagtgctaggtttgtatgagcatttttgtagaatttcctgtacaaaccttattggctgtcacttaaaagagatagtgtgaatgatcctttctgagcctgaccagcttccttgtcatttaagcattggctatgggatgaatgcaggggccggttgccacagcaacgacatcttcagtcaaggtgatgagagaaatcatttctctctgaatgctaataggttgtcactttagtcttaaactggctgtttcccactgttttcctgattgccatgaagccagagagattatttacagattaagggctgctatttgatctgatcatctctgtcctaatttatgctggatctttcaggagaaagaaaaaaagatttgaagcaaaatgttaaggattatgttttcagaaatttgaggcttgtgactttttctccagagaagtaagacttttccgtagtactgagaaggtcacttttcaagcagagaccatccagtgttgaaagtagtccagccactgcctgtaaattacctgccctgtaaaggctggccctttgccagtgctgagcttggggctagatgtaagggtggttctctcactaaaaggcagtgtgagtttgtgaagatgatcatccgaagaggaaatctgcacatgagactttttaaatcctggaagttacttgaaacaaaggattttagtttttctcatcctttactccaaaacacaagattcaagaccttattcactcacggaagtaaaggattgttgagtaaattatgcttgtgtgataggataaggagataattgctgtgtgggccgtcaccctttcattcctgaagagag

SEQ ID NO: 75691 - DNA, 2131 bp, Homo sapiens
ggctgtaaggctgggagggggcgggtcctgaagggggcgggaataagaggcggggcagaagggcggaggagtgtgtcgggagatgtagttccgcgagtcccgacagcaaagctgtcccggctccgctaatagattgggaccactactcccaggagtctgcgcgcccgaccggagcgtccatgcgcagtgggagccactttgtatcctatcaggcgaggagagggtgatgtcacctgcgagttagtaacctacgagcggctgtgaaggaaactgtttaaccggatcccattgtacccagagtgcagagccgcctttccagcatgcaggggctgctcaggtaagggggacgctcctccttgcccgccgcactcattcattaagtggcactgctcagtggtgcgggggtgggcgtgcttccgtgggctgggcgctgggttcgcggcgcgccctcctgctgcctccccggagctcccgggccagtaggtaaatattaaacccgtccttcaggttgggtctgggtgggaacgggaccgagacagctctcggctgcctagctgggggtgggaaaatggctgcagcgcaacgcaaaccgaggcagcagggaggaagacgcccccaaggactggggtccctccctttctttctaaggcgcccggctggccgaggagctggcggggtaacactcgccgccttgctgaaggctccccggggctggggccgcgggtactgcagcggcgtccgcgagctcccggcccggcggctccgagagggagaaccccgaggcaggcttggtggacacggcggtggcgacagggaaggagggactcgtgtacccgttcgcgtccgagcagagcccccagtgcccctggcaccctcacttccagccccattcgaaagggacggagcgcctgtaattcagactaagttggacctaaatgtttcaaaacagagagaagggaaatcgggcgttgcggagggagagcagggtgttggcggccggggaggctgcgccgcctgcggacccggttgtgaggcaccgcagagggcttttgccgcccgtccctctcgggagggcgcatctcagtctccacggtcccttggtgtagagcacctgggctggggcgaagcgcctgccctgaagccctgggccaggaggtggtagcgcgggggtggaggtgtcggataatctaatgattaggctcgctgtggggcaggagggctggataatcgggtttacccagctggttctgaaagccaactgcttgtgatcggcttgccctctgagtggagacgtgcaggaggcccagagctctcagtcctctggatgttctttgcctttcctagtaccttcatttgttcgtttactcattcatcaaaccctgctaaggtctcaagttgttcacggcctggctttgcggagctacctctcgccccataacatatttagtgatgcctgaactccattcccctctccttcatctccactttctggagagcatcaagagcaaatgccaccgtgaccgttttgctggtagtttcttgagattcgagcaggacccagtgaatcgaagcggagttgcctgcaagatgaatcccgttgccatggcgactcctgccttcggaatcttagccgctgccactgctgtttcgattcgatgtggctctgcgggcagctgggagggagtggctagtgggtgtggtcaaacgctcgccctggcccagctgctctctcctcctcgcccctttcacagccccgggactctcccctttctctcctaaatagcttggacacagttctaaacccctttcccttccccgtgccacacctcatcacgccacctctctccctgaaactaattgtttggcgcctttttcctgaggcaaactctgaaaattataatttgaaaaatctcttccccctttcgggctagccgcatcatttccccaataaggtagtttatggtgttggaggcagctttgtcatgaaaggcgccctcccctgttgtgcataaagagagctctctggtcaccagcaaaggccctcaatttgctctaggtgcagctgattggaagtgattagggacaattaataacggctggaagacactgcagtcccttgtggttctcataa

SEQ ID NO: 75692 - DNA, 1170 bp, Homo sapiens
ctatgattggagatccaaggtctattatttccactgatagttctgtcatccgtggtaatattccccttagcttttctatcaagcagtttcatttcatcataaaccaaaacttgtctggcataaaaggccttctatgtatttgaaatagacatatttcctaattatttgcttttagaatacattcactcacatcgactgtttctttgtagttacaatttcttattacccctgaaccaggcatttctagatttctctcagttgcactatccttggcccagataatcttcccaggaggtgtgtgacacgtgaatagggagagacaccaagagaaagatacccagaagcctttgccaggccaccagtgtctcccagaagagctgggagacaatagtcctctcacctgaggcagagccgttccgtaaacaggatcagttgtttcaggctggttgatgtgaaagaaatgtgaaagaacatttgcccaatatttgtaacatgttaccatccagtagtctgattctgtgggttttcaggagcataaattagtaaattagtgaggaggtgtgataatgaagagggtgtggtgggtcacatccttgggtggtgcttacaggagctccatgaataggtgctaaggaatttgaatcctggctttcttgttttgtggacatgttctgcttgttaaggggtgtgtgtgtgtgtgtgtgtgtgtgtgtgtgtgtgtgtgtgtgtggttttgagctactttgtttaaaaggctgcttttagtgttggcactatggtccttaaaacaaataaggtgtttacaagcaaaagttctgattgaaagtgtttcattttgtaaatatttgggagatggcataaagagaaacttgaggtcttgtgtgaaaacactttaaagttgcagctgttggaccagaggaaacatgcttttccaacaaagcttggtatccttgagtgccctaggtgtttggttcaggaaataatcacagagcttgtaactgctgtggggccctccctggcttcaagccgtgctctggtatttccagtgttaagtctatccttatattgccggaaacaaagcaaggtgtccaacttgggttagcaaacttgttttctctctagaggggacaccagtcaaaatagaagttctatattctgttgtgatttttt

SEQ ID NO: 75693 - DNA, 1064 bp, Homo sapiens
ctctactaaaaatacaaaaaattagccgggtgtggtggcgggtgcctgtagtcccagttactcaggaggctgaggcaggagaatgtcctgaaccagggaggcggagcttgcagtgaacggagattgcgccactgaactccagcctggactacagagcgagactccgtctcaaaacaacaacaacaacaacaacaacaaaaccctcaaagtttagaggaaattgattgcacaggtactatttaagaaactggtactgagagcattttctctatttctgtatgtggcttggaggtaatgtctggttgacagatcaggctagggtggatgatacccctcttgaagatgcattcacttagcaagtgtactgtcttttatgtagattatattatttagagtggctgaggctgctgatagagaccagcgttgaagtgtggatctgaagttcaccccctttctctgagctgtcaccttgtttgtagccccactgaaacagggacagacgaacatgagattcaagttgattttagtgacctatatttcatccagcagattttttttttcagaaataaaaggttaccttttaattttttagtatcctttccactgttctaggagcagggggagaacagagcatttcagggagagtttgcattcatagtccacaagtttgcatacatagaacatgtgtctaaaaatgaactgaatgttaagtcctagaagcacagcaacaagtgtgcagagccttccccatcactcccaattaatctggggttaccaaatacaccctcagctttggtgagcttgttttcctcattgatgtttaagcgttcctggtttttactctgtctgtgactttctgcagtaatggctgtccacgtctggaatgtgcttccctctgagtgtctggattatcttgtgctttcatatctagctcaggtgccacagcttccacgaagccttccctgcccttcctccttaaagcacttagcttgaccacacaacacttacagctaatttgataccgatattgtatgtgaggtgcctacctcatgccaagccctttc

SEQ ID NO: 75694 - DNA, 2442 bp, Homo sapiens
tttggagctctcctttgctgtatgaacgatagacaaattatttgaaaaaggaaatgctcttatattacaactctaaatctgtttggagcctgtccagcattagaccttatttgttaagtgaggtaacttttcactgggttgaatccctcatctgataaaagatcttctcaccctgaacagggccacagaagcctgtgttgagagttaagagggcccataatttctcagcctccctcttccctgtagtcttttaacatacattgtgaaagctcttttgaaaagaaaataatgaacacttgagcagtagtcaaacatgtaatctaatattggatagccttagatattaaaataaactttttccccccacctcagaagagatacttttatttatttttacagtggagcaaatttggtgccaaataaacaatttctattcttttaaaccatagccacagttgtgaattaaatggggaaaaccagggaagcaagttcaatttccaatgcagttggtgcgatttcgtgacttacaatagatcttttccttttggcttaaaactagatattgtgccacttagacaatatttaatgaagacaattgactaaaacacaaggaaataataggaaagctatgccttaacggcatattgccaggaagggaaacatgaaaacaaaaggcttgttagccattaggctacacaatcataaaattttttgaacagacattgatttcagaaggtttttcttttttcttaatcattcatcttgttatacttttttttttttttttttttttgagacaatcttgctctgtcgcccaggctggagtgcagtggtgcgatctcagctcactgcaagctccgcctcccaggttcacgccattctcctgcctcagcctcctgagtagctgggactacaggtgtccaccaccacgcccagctaattttttgtatttttagtagagatggggtttcaccgtgttagccaggatggtctcaatctcctgatctcgtgatccgcctgcctcggcctcccaaagagctgggattacaggcgtgagccaccgcgcctggcctcatcttgttatactttttaagtatgtcattcacctttagtaataacctgggtttattctgttctataaattacaccaggattggggttttaaggctacctgtatttctgctggcacacaattaaggtcacctattaaactggtctttgtcatttttatgtctaaaaaaaatacctgcagtgtgattggaaaatgttgcctatctgatagacttcctgaatttaggcttacaagagtagatagcccagatcctagctttgggcattgttggggtaatacagatgcccatcttttattttctgagataggttcttatattctggcttgttggctagctcagtttgttagtgacatacaaaccaggtcaagggcatgggttagctttgccttgttttggagccacaaactgtacctgtaattctagtcagattttttctgtatcttttttttttttaaattaatcatgcttttggggactagactgtacattgtggacatatcagtgcacagctatcactactaagggcaaaaaaaggtgccatattttaaagcgaactggtaggaaaaccctgtaagtgagaggcaagactgccagcagcttgctaaggaaccgtatgcttctgacagttgtcctcctgtgaagattaggtcaggactaggggcagcttcttgaaagtttgccaaagccaatagccttgatctttttcctttcttggcagaatgacagatgccatcaatgtgtgtttgggtgctacttctggacttactcttagataaagttctggatatttgtgcccaagaagaagagtaaaggatggtggtcaacattattcaccagatgagatagattgttcatatgtgcctaagcttaaatttgtattagtttcatagagatttggtaaaaccaagcagggaaatgtttagacacaagttagaacccgcagttctgtaacaagaggtttagaccagggacccttctaaatccccagaatgtactacaaaattaattgtaagaaatgggccgggtgcggtggctcacgcctgtaatcccagcactttgggaggacgaggcgggcatatcacaaggtcaggaagtcgagaccattctggctaacacggtgaaaccccatctctactaaaattacaaaaaattagccgggcgtggtggcgggcgcctgtagtcccagctactccggaggctgaggcaggagaatggcgtgaacccgggaggcggagcttgcagtgagctgagatcctgccactgcactccagcctgggtgacagagcgagattctgtctcaaaaaacaaaacaaaacaaaacaaaaaaacaaaacccacaaaaaaactaattgtaagaaattaaaggaaa

SEQ ID NO: 75695 - DNA, 1118 bp, Homo sapiens
cagcctgatccggaaggaggggtggaaatacttaacctgcttttaatgcttctgttaggggataaagagattttacaacagtgatgtggggcaaacatgtgggtgacttttctaatgaggaaggaggataatgctgagtaaatgtagattcaatttacatgtaacttctgtttggtagagtgtttaatcacacatgtttgacaccttgaatgaaatctcttcacctgtcttttggtgctttgcaattgcacagagaaaaagacacactctttgattttaggttcagtttgggtaatcgtggcaattcctttaaactttccggacctctctttcctcattcacagtgtattcacatagaataagctatcttctggataaaaattctaaatttttgggaagacagtatcctcttaaaataatgacctcacttatgtggcactgtgtactcatcaaagtaatatccattgagtttccctaaaatggagatcggtgagggagaactccgatttttcgcccccagttttcagccttggctgcccctgccttggcatggtgtcctgagatcctgttcttggctggagctaagccccatgatctgatccccagtctcttctcaactgcacaactcaggagttttgtaggatataagggatgaaactcgacagagtcttttggtgatcatacagttctgtttaaattgatcatcactttttagtttctacttaattgtttttctttttttaaatttgacatgaggtcttgaactcctggcctcaagcaatcctcccgcctcagcctccggagttgctgggattacaggcgcatgcaaccgtgcagggctgatcaccactttaaactggagtctgaccaccagggggtccacagagtgaatgtagccagctgtccatgttttgcttggccagcacagtattatttttaaaaaggagtgatattttagtgagcatttatgttctgatttgtcacagaccttaccacactctagtgcctaatgcacagccacttagtttatgtgatatttatctccttggcccttgaagacattgagtttgtgattcctattttcaactaaattaaattgggatgaatgtctcttcaaa

SEQ ID NO: 75696 - DNA, 1016 bp, Homo sapiens
ttcatgtacatctcattttttcctctaaataaacagagtatgacatgcacaaaggatagatgtggtaattccttaatatttatggaccacttgagatatgagaatctttgttataaagaaatttttgttgtagtagaatctgatccatgtttttctcatacatcctaatcatgagctagggtattagaggataaaaagctttcttatactttatacctgctgtgatgacaagctaaggttttggtgatgcctttggcttggtcacaacgtgctttcagtgtgttcatttgattattttgcagcatgtttctgctgtagaagtcttcatattgtaaaaagcattcaagtatgaactcttgcctataaaactaactgtgttggataagaaatgttttatttaacagggattatgtagctcaaggtttctcaaatttggattcatgatcgtctgtgaaacactgtattaaaagttaaattgccaaatgtttaggtactcacttggtgttgatgggatcataaacccatgtgcaaaggtaggccttgagatactgtggtgttatttggttataaaatgcttatgaaggtgtattagttttattactgcataatacattaccacaaacttagtggcttagtagtctgcacatgctgtggctagattctctgcccagggtcttagcaggcaaaaatccaggtgtcagccaaaatgctgtagtcttcagctggggctcaggggcttcttccaagctcatgaagtgttggcagaatttatttcctgtgaccatgggactgaggaccactagctgtgggccagggactgcttttagcttctagaggccacccacattctgttccacatggcccacattggcagttcacagtgtggatgtttgctttcttccatgccacgtggagaacatctctctgatttttttccctgcaatcagctggagaagaggctgatattaaagggctcccctgattaggccaagcccacccagggtaatcttcttttg

SEQ ID NO: 75697 - DNA, 1882 bp, Homo sapiens
ttgcattttaaaaatttattaaatataactttcctccctaggtcatttatatttttcctttcttaaatggcctgtttgcgaatttatctgtttaaatctcaatgtttttgaaatgaccagaaatgggagtaattagcaatgcaaataagccagcacttttcataaatataataagcagtcattaaaccctttggaaggaaacttacgatatctccaggtacattttaaatgatctaaaatatttctctgtgattaagggtctcttgcttcagtttcgcataattaattatcttaacataccctctcctcattatctggagggaaacctcaggctagcttctgtcattttcttgccagtttgcatttcctggagtttgccttagtgttttcttaatcttagtagttttctgctgatggtgtgactgctacaaagaaggcttttctgaaggcataaaaaccagggaaatgatacatagtttttccactggactaaacttgtttggaaaataaggaggtagaacaatgaaataatccaaatattatgaggagagagggagaagtttatattataatgatttatgtgataaaagaaatgttatgcccagtatattttgtttatacatggtgttgtaaaacagatccaaatgcttgtctaaaatatttgcagcattgcctgtacagcacctaaattttacaaaatgctgtacttacggtccaattgcctttttgtcaatatatcataaaccaatattgtaggagaaatggtttttcttttaaatgctttaggtttggtaaagcactttaggtttgctttaggtaatttaaacagagaaataaatcttcttccaagcacagagagcttcatgtttaaaattttagatgattgtaataatcccagtaacagaatataatgaagtgtttcccagcacactttagagaagacatactgagtattatggttctgttcagattttattttctgggactctattttaaagtgctccatctgtatttaagaaaacacatgcatgcacatacatcctgtggcactctcttctagggcaggtgttggtgggtaggtccctgtgcatttgtttgggggacacgtttgacccagtggtgtaatagttgttacaagaggattctctggaggaaggctgctgctgcagaggaggaagtcacatttgtcttctcccaaaacatcaactcattgtcttcctagcttgcaaaaatgaatatttctccccagttgatttgttaatttcttgcatcattcaaatgccagatgattggactctacacaattgaccgaaggaacagaatttccaagagtgtcagttgcctttctgagtaaaataatcagacacttcactcacattctatgaataaataacacctccagtgtaaaatggattatgagatgttttatcttaattttctatatttcttgaatttgcactgaaaaaaatcttgtgaacaatctttaatataacacagaataatgattttaaacagcctctcccctgctatgactagtaaagttgtggactaaaaatattcaaacatatttttctcattaatgatgagttccatattattttatgaacttctgaaagataaattttaagaaatataaaacactccttttattttctgatttagccattcctccttaattcttattttaagtgaaatatgtgattgctagattcacattttgtaactttctttatgtaggtttcattttttaatggggctgattctaaatggataaaactttgatacatagtttctaagataaaacatcattaatttttaccatgactggtagctgctattggcttgcatttactgaggttctcatgtttctactatttaggct

SEQ ID NO: 75698 - DNA, 1041 bp, Homo sapiens
aatgtccgagtcaagttagaacacaggtctctgctaattgtcatatcttagatgattgcctgataaagatgattgtctggcgtagcttggagtaccaatacaggagacatgttcttcccccacttcctattccttccactgccatgctagacaatgcttatcaaaggtgacattctttcctacccagcttggacatgcctcataatcctgcccaagcagcattctaatagccacagctagtaaacaagggatctaactagtttgtcagtgtaggtagtagaatctttaaatttttttttaaaggccattgttagtatttttaagagatcaatttacatcatttatttcagatggaatattgtttatttctctgtcgcagtggctcccaatcttttagaatgttcctttttaataaaaaagaatcagattctcacatgaccttgaatttctttaacactttaaatgaattttacttttatcaatcgcagcatataaattcattggaaaaataggcatgtgtatatgtatcagacattcacatgcttatgaatgaaggaccccttgtaatacttctgcccctgccccccattccacacaccaccccctccccaggagtagggattagaaatcgttagtctttccattttgtcttctgtggtttcagttaaagttctaaagacgtattttactaaaagtggaattgactttttgtattcaggggaacttgtcagtggttttcatattatgtgccgtggagtcccaggattccagaagatgcctcaagggagacccctcccttcccccgtatcccttccagctttaagcagcctgtctgctttaagctcttatatatattgagattctccatgagatttcatttgtataaatgatttcacagcttaccaaaaaaaaaaaaaaaaaaaaaaggaaagagaaaaccactgataatcccaccttgtttcacacatgattaaatgcaatgcccagagtattttggggttatcctgttagttaatgttgaagccaggttgaggactctga

SEQ ID NO: 75699 - DNA, 1084 bp, Homo sapiens
cagacccctgacgtgcttctttcttccttgctctcctcaggaaggtcatcctatttgaagagatacttttctgttaactgtggaaaagccagatgtctcactttaggcaatagtttcaacttcgtttcttcccatgtagtttgacagatcgacctcaaccctgacccagacaactactaatctgctttctgtctgtatggatcaaccagttctggacatttaatataaatgaagtcatgtaatatgtggtcttttttgattgacgtctctcatctagtttaatgttttccaaaggttcatccatgtcatggcatgtattggtacttcattcttttttattgcaaaataatattctgttttatagatataccacatttttttttattcatggacatttgggttgtttctactcttcagctatcatgaataatgctgccgtcaacatttgtgtttaagtatttgtgcgaacatgcgttttcacttctcttgagtaaatacctaagtatggagttgctgggtcatatagagacttggtgtttaacaatttgaggaaatgccaaatggttttctaaagtgactgcactattttatatttccaccagcaatgagtgaaagttcaggtttctccatatctcatgtgttttttaaacactgtattctgttgtgtttataaaatgtttcctcttgtcttcatagatgagggagtcagggacctgaatgataattttggaggaaatgaaacagatgaaagtgaaataaattattttcatattggctcagtgtagctgtggaaacctttcagccctgagcctacaaaccttcctgtttgactggatatgacattaccaggagttttactttcctgcctttattgtccctggagagaaaaaagaaatatgtcttttccacagctagacatggaaggttcaaacaaatataaaggacccctgagttattaacaattccatgggaacatgtgcttggtgtatgcccagaatagttcctttcaaatgattctcttggtgcttctgcactgttcttcaccagagtgtaacataagagctgaatcaaggcttgttcagtc

SEQ ID NO: 75700 - DNA, 1040 bp, Homo sapiens
tggttgcaagcaagagaaactaaatttaagacaaacacacacacacacacgtacatagcagaagaatatggggcagtctttgtatctgtaaggaagactggaaagcataggagactttgggcatttagggttccaggaagaaagtcaatttctcacatcttaggtctgctcagcatcacatttctagcaggattgggggtgggatgggcctgacatgataccaagagtgcagggaatggaggtgggtcattccttgtaaagtcaatctctgtatgctaggcaggcaaaaacaacaacagatttcagtaggattctcagttgtctgaaactagaagcaatttaacgtgcttattcactagcatgggttaagctgccttttcatttttgctgaagtagaagtttagaaagatggaaaagggaaggatcatcactagattgggaaacatttaccctgcaaatgcaataggagggccctttcattagaacctgggaatggactgggacactaagtagcatccctgtactattttaaagtcctgtggatggctacataggttggcattgcccaactccagtcacatgaagtgcagcatgaatagtgcctctggagttgtacaagttatagttccacctttccatgtctctgtttgtcagatttttcccccaccttgttttctactttaattaaaatgcctagcatacatctgtagaatttccagtaaaactgactgttttgaattaaaatattgagttgcccagaataaaatgattatatggtatacctttaaagtgcgtcttttacattccagtttaagcttctggttctttacagactcccttacaaatactgttggtgctttcataaagtgacttgtgtacagaaataggcttacatgtgaacaaggatggtgtgaacaaggatggtgtggtgtaccttttcatttccttttctttgccccttactcctgaaagtatgctttcagggaataggaggggaaaagtctctggttccccattacagactgactatgtaggtcacc

SEQ ID NO: 75701 - DNA, 1094 bp, Homo sapiens
ataaaatatgcagaaaaatgggaggattcacatataggcttggattctccccatgtctcattatctcgattatgtgtcacctcgtgcttgttccactttttccagttttccagaccagatctggtgctccagaacatgattaggagaagctgttcacattgtaagccctttcactaaacttgattcttttgagggtagggataggttgtgtttccatcagtgctgggcacacagaggacacgtagtccaaatgtgtttgagttcatagagcacccataggggcacccaggactaatgaatgaatggtactccttgttccacaggcaggctatcccagtgagacgcggggatttcttacccctagtcattgctaccagtttgtatctctgccacacaccgaaacagttgaggcaggagtcttctagaaaaggtttacctgcaagtaaagacaacttagagcatagaacttggttactagtagaaaccctttgaacttttttgaagaagtcctggaattacatgtttcaacccacaagttgttttttcttaccactttttttttcttctaaatcttaagggaagaaaaaaaatcataggctgtaataatgaaatcttttaaatttgtggcatgatgggaaaatgtaatcacagtgtcaacattctgtcattctctattcatctttctttatggaaaaaaataattacggtggttttcactgacaaagttccaaggatctaatggtttcccatgacataagttagatgttaaagatgtgtaacctataggtaatatcagcttctcagaaaatttagaaatgatactcttgcccagtattgtgtctccctcctccgctccccaacttccaagaaaaaaaactaaaggaaggggaaattgtatttttactattggttgaaaatggttcggagtatcacttgacttttaatgaaatctggaaattcacttaactccaactgctttgtcttcccacacatttcgaatgaatgttaaaaggaaaatacctctgtagaaacagggctatttttagatttcactcatatatttgggtttcatcactcagattcttttccctcag

SEQ ID NO: 75702 - DNA, 1304 bp, Homo sapiens
ttagcaagcaagtattaaaactaaaaagcatttaatgggctgattttgaagactcctcgcagggtgtttcttccatgtgtgccattttgcccagccctacatgtcagcagtggaagatattttgatttagtatgtttttaccaaagacactcccacttttcattgagcgaatgatgcattttgtagtgtgtttttcattatggttagaggagatcttccttgagaccagtgtgtcatttggcttttgatttttgtgagttgttacctctttagtcctaaactgtaacttcatcgtgcaaggatttaaccctaagcatcaccctaaatgatgtagcattgcatgtcaggtatttactaattcgtctttatgacatactgatatgttttaaaagcctatataatacccttgatttataaattcacttcacattgctcttcagagaaggtgtaggtaaaaccaagaataaacatacaaacaagattaaaatgaagacccacactgacttactatctgtcctggccctttgtgtatttattctactctcatttttgaagtaaatccagtaggaagatttcttctttctttacttcctaagagatggccaacagtggagttctaagttccaaaaacatggtaacagtaaataaagtagtgtaaaacctggttgattaaacttcttggttgaaattaagtagaaggaggcttaatcccaccttgtgggttagtttctgcttttagcaagccctcagaggcacttcagtgaaggcatggctctggctggtggtttccatcctgataggtggccatggctattttcctgtctataaataactgttcaccaggttgaagtgaatgccaaataagcttctcccaccaccacccatcttaatagtagaatgtttgagataatggaacagtgataagggtaaataaatttagcactgtcaacctaccagcataaaccttagctgattttaaatttaaggcccactattaactctcttacccttgcaaattgaatttcagctgtgatgtagttgagacaaaccacacaacagatccgtcatttctctttgtgaaacagcaggtacctgggtgtgcctcttaccacttccttacaaatgggtcccctcaggtggctgcaatggaactagactcccagtagcctttgttacttggaagtctgattggggcagcacagagactcctgtaactggaagcaaacactgcagccgaggggggtgatgcttagaggcttttttttttttttccccccacaagctaggattcccttacccaggag

SEQ ID NO: 75703 - DNA, 1005 bp, Homo sapiens
tttgtctgtctcctctcactaaactgtgacctctgtgatgactcagggtgggtaacgctcatctgtctggttcattgctgggcctccaacacctagaacagtgcccaaaggtgttcagtgtatgtttgtagaataaattaattaatttatttgtaatataagtggttttgaaaactttcccaaacttctcttgtttcatgtacttaatggagagcagggatcagcaatttttttctgtaaggggctatgtagtacacttattaggctttgggggctaaaagatctctgagacaactactcggaaagcagccacagacaatatgtaaacaggagcctagctgttatccaataaaactgtatttaccaaaactgttggtgagggggcacttagcatttagcccttgggccgcaatttgcacacccctagcatagagtcagttttaacctacacgtgctggaatatatgtggaaagggtggattggaagagtggttgtcttgattacaagctcagttcatttagttttcagccagggaaatgtgaacatctattcttgttctgtcagaatagaatgtatagtgaaaactatttgtagcatgatggagatagaaacattccaaaagagagacatcccgccaggtggtggaatacatattagaggctgttgaaaaattaaatactgatcaagcacttaagtactgcaggattgtggaaataccaagagaaatagttctaagaactgaaagttgaaaaagtgtattttgaccacccctgagcaagctaaacaatataggattgcatttaggctaatgtggaataatttacataagaagtgaatttagaaaatgaagtgatctgacctcatagagcattttgtcatatactttttctaatgaaggaagaataaactcaaggatatttacgctattgggcctacatttgaaaacttgaatttataaaatattttgtgccaggattgatataggccttattgcatctaataaga

SEQ ID NO: 75704 - DNA, 1005 bp, Homo sapiens
atgagtctctcctcagctaggtcgtcagctccacagtaactgaaactaagtgtgatttcttttgtttcccaccctctggagacagtcctggatagcatcagttcctccttctgtgtgttcccatagcacttgtacttactgtgatcaggggcagttcagcctcttcttatgttcttgatttttgaaaggaacagagtatagcttattcaattttgtattcctaacccttcacgtataacccctgacatgtagcggcttactgactgttcagatgaacagagtgagtaaagctgtaactgacctaatgaaacactataatattacttctgaatatttttttttgcgtctctagacacctcctggaagtataacatattgttcttaaaaccattaaatgtatcgctgacacatggtaatcatttatttcaaagataatttgaatggtattcttgcatcagagactttcagagaaggagcctaaggctaccctttattagataattctaagatgggctggctgacaggcaatgcagaatatcgaaaaaaggacagcatgaatttgtccctgctctgctgcttaggagtgggtgaccctatgcaggtcacataagtgctcagatagttactcagctgtaaagtagaaataaaagcaatatctgattgcctgtgcctctctctttttctctcagggttgttgggaaaataaaatgatactgtgcacacaaaagtacttagaaacccataaattactttatgaaggtaatatactattatgctgttgtgaaacagggtaatgccctatggtgctaacacttactttttttgtggttatataaaataagtaatccaacctataattaggacaattggctgctacccaaatagggcctcaagttccacctgtcacacccaaatcttgcaaaaaatgattataatgcttaaacacagtctccttattgtcactctagtttttttctagatggaaaaagagagaggtgtagctag

SEQ ID NO: 75705 - DNA, 1029 bp, Homo sapiens
taaaagctccctgctcagcaacaataatgacttttacattctagcgacttttctttatctttttagcaccatacataccgaaacttgaattacttccaagctccaaggaatgattccctgataggcttatttaagactcctggaaagtcaatctggcaaaatttgtttccaaaatgggaaccctttgagaaaggaggtgttacattactcatgtcaatttgtgaacagtaaaaccaatacagtcttctgtaaaacaagacatttgtgtttggatttatggctcgatttttcagttcactgttaatttgattcttggaaaataataatgctgtagcttgaaagatgtgagattgtggctagaggggggtatggcttgagatgagacaggtagggtttatgtccttgctgaccgcccccagttctatggatttttattattacttcatctctcgagatctttctttattgtaaaactatgatatcttcctatcacgcatatacaaattagctgaaatgatgcttgctgaaggtcccacatagtctctgaccttggagaggtgctcagtaaatgttagttcccatctcatttagtcaagtggaccatgaatcagggttcttcaaatctttatgggacagaaatcccattggaattggcttaaaggggaaaaaagttcattgaatcactcaatggaaagttcaaggggtatttgactgaggcccagtatatctagtagttaaatgatgtcatcaaaacctcctcactccccatctcccttgtcccatctctcagttctgcttttatctatgctggcttcattttggggtagcttctgacacatggtggaaaaagcaactattgtaaatttctggtattatatggtgcttatatgtcatgattccaggcaaaaaagaggcaccctctcatctgcggcatccagccacataaagatctctggtcgtctttgtgttgtgtgccatccctagatcagtcactgtccaggggatggagtgacttgattggcgaagcca

SEQ ID NO: 75706 - DNA, 1055 bp, Homo sapiens
atgtatgtagaaatcatgaaatgaatgtataggagttaagcattttttctactgtgtcttcacgtggatcaaatgcatccttcaaatgcaaagactaattttcctccctttgttattttggggtctcttttgatgtcataccacctcttattttggcattaactttcatgtcctttgcctttatcatttgtgatcagctgctgtgtttccatttggtgcccttttgtaatttatactttcaatactgtattgcttgcttgtttaagtttgggtcagaagccatgaatgtgacaggatacaatgtattgctatttcagtagctttagaatcttcctttaagtagcaggaccttgagattaccaagtgaatttattcctgtggagtcaaactttctaataaatatccaacaaaatattacctaattagacacttttagtcttttatataatattcctagggccaccacccagcaagtagatgttctaaagataaggatagtaatatctacttctgtagcaaaaaaaatacaatggatttaagaaaattctaaattataccatttaggtgaaagtgagcacctggcattctgtcactaagcaatgaattggggtgacattaatgtacagaattgtctctagtgaatggtttggtagcttttcccccatcgccccattgtaaattgatgacaaatttaaaagaagaaagtcattgctcatattagtgttgtacagttgaacagattgttttcattttgaggactaacaattgtagagttgagtgtagtaaagtggaaaattgcagaaatgaaagcattctataaaccattctttaattactttcagagcatagctattcattgacagtggcctgtgtttctagaaagacaaaatgagacgctgaagaactcattgcttatctctgattaattgagataattaatggacttaaagtgcattgaaagtgcctagcatgttgaagagggttgataaattaaagttatttaaattatttttcaaatttaccatttagccatttttctgtgtacagttcaaagc

SEQ ID NO: 75707 - DNA, 1075 bp, Homo sapiens
tattgttactcctttaacataccagaaaagattttttaattgagtgtaccctaaatcatttaagcagtactgtattgaaagcttcccgtatttagccactgatgacttttgcctgtttaacaatattcctcagaatctgaagtctaaatattaacttctgtccaaatactctggcttggtaagtgagtaggagtaataatttaaaatagaactttccatgttatttcacttagaaaaaattttgcaagagaggcagtctctttagtgtttagttgtcttgaattatccaataaagcaattagtgttcacacctaattatttagaaaattacagagttgggtggagaggacatgttgggtagtatcagcttccttcacatttccctcttgatgactgtggaatgatgttttgttttgttttgttttgttttgttttgttttgttttgttttgtttgactcaggcttaagtaaagagtgtagtaatccacttacagtaattaaaattcagtaaagatctttctttgcttattgtttgtctcctgcagcttcagaagtgtttgtttagctatgtgaataacttcccaaggatatttagcacatggagaggaatccccagtgagaaaacacactctttcttgccgccgctggtaatttctgttttggttgatgattagctttgtttaatgaaaagagattatatatgtgaccagtttacacactcaacacatgtgcttttgtgttcttggctgctagtcttataatttcctctaccccttctccatcctcaaggtctgtgcattatttttattttgtatagggcaagcaggtttaaagtgcagattaaaaggaaactcctttgttttcctgagagtccatccctcatttttttgttttgttttgagatggagtctcgctctgtcgcccaggctggagtgcagtggtgcgatctcggctcactgcaacttccgcctgcctcccgggttcacgccattctcctgcctcagcctcccaagtagctgggactacaggcgcccaccaccacgcccggctaattttttgtatttttggtagagac

SEQ ID NO: 75708 - DNA, 1062 bp, Homo sapiens
gtacatacatattgctacaaatacagtttttaaacataatggtgctacatgtatattgttataaacctttctttcttctctgtcttttattctgaatatgttcatttttttcatgtcagtcccatggacctagtactttctttgtaaccctgggcatagggttctttagcactatttctcaaactttgctgcacattggaatcacctatggggcttggaaaaatacccatgcctgggccccaacaccagagattccgattttattggtgtgtggtacagcattgttactgaagtatgagacaacatttattaaaacattcccctactaaaagacacatgattctctattacaagttaggaaacctgttttctatttcacagtcataatgaacacctttgttgatacatcttggtgcctgtgtatgaatgtatctgcaggtcaaattcttagatatgcaatctagaaagtgtaagatgtggatcaaagggcccgtgcattaaaataataacagacactgtcagattgccttccactgaggtggtgcaattgactttcccatccacaggttaggagattgcccattgtggggctgaggttcttccctcagtcatctttcactccgccgtgtttttttttttttttcctttaagtttgttgtatttttagaggatcgtatatctaaatgcttatgaaagttctcaacatgaagggaggtcgggcaagttctgagtcaaggcgttatttctctaagtctttttaatgtcatgtctttggaagttttatagctgacataccaacttaatgcctttaatcatcagagaagatgtgtagcaatacctcctagagccacacagcacctgaaacaggacagtgttagaggcgactgtcctctctactgccttatttctatacttcatcttgcatacagttgaagcgttcatcatctttccatatgcctcttttgaacatccattatgtaaaatttgtaagtagaatctttacaaagggcagggtgctgcttttgaagggagttccagtttttataatgtgattctgtcatt

SEQ ID NO: 75709 - DNA, 1160 bp, Homo sapiens
ttcctgatggagaggatgttgaaacctgcggggaacacacaattccctttcagacgtttctcctataagctttagactatatcccgtgattttttttttaagctccaaatagtatttggcatctggtgtatttgggaaatgaaaccagacatgaggaatgtgagagaggagagggatggccaaggagagaagcaaagtagtttttttcctttcacatttttcttgataagacaatttgggttaacattattgtgttgttgcaatgcaaattacacatcagagccctctggaaaattgcaaaatgtgaggtaaactgcagttctgaaaacatgggtgtggcaactaaagtggagggtcccccaacctttctctttaaagatgctcttattgcataactctgttttcttgtccttctttttatggttgtgacatgaattctattgtttcagaaattccagagaccatttatagtaccagaacaatgactatattttagtgttgagattataattcttaggaaaattcaatgtcaaatgctgtctatcttgattcatataatagaagtggggaagaacaattatggtccccactgcactttgcaagtggatgtaaaaactctcacaacttctaaccaagttggtggctctcaggaactaattgtccctccctccctccctccagcatatcttgactgccatttccactaaacccctctagctagaggaaaaccttggcaattggattcctcagtctggacagtcatcttataaatgtgtggcagaagtcctgatggatcaattaaaatagtctgcatatcagcaaaaatctgttttgtttatgccaaccttaacatttcactcatgtattaaatactgattgtgtcttggtttgtggaaaacaaactttacttatcacatatattgtgacttgacattatcaaagggaaagtattagggagggttttcttgtggactgtaggttgttctccaatgttttatcatcataattatcatcatccacattccctaaaatttggcctcagtttttgactgttgctacattgagagtcttgcctgttttgttgaagagcagtacaaatgactctgacttctagctaggccacagatggattggatttcttactctttgctaaggaaaat

SEQ ID NO: 75710 - DNA, 1049 bp, Homo sapiens
ctgaggcttccacatacaaattacctgtcaaaggcaatattttggtacttattgaaaggatttcaattaggttcttaagtatagtagactctgtgtcttattacccatctccgaaactagccaagaacttcatattcttttgtttacagaactgttgggattttctttttaagacttgaaaaatgctctggactgatttttagatcttaacgttacccccgacttctcgcccctcctcagtgcagccagaatgtaatataacttgggtttaagtgaaacttgtagcatgcaaaaggaaaactattgctgtttatttattctgtaaatactttgattgtacctctgtgtgcaaaacactaagtgacatgtgccatgtcacttttcctcccgattcttcaatgagggaataaagacccagacctcgatttacagttaactgttggctgtacatgatggaggtcacaaaatgctaagagagcccagaccatatctagttaggcagattaacaagactgcctgaaagagatagctggaaatgagctttgaaggctgaatgtgggccgtaggaccctgcatgagctggtccttgcctattttagcttacttaattttcttgccctcatttcctggtagcctgaacactgccttcctgccctgtcttcctggggaacacttccccatcccccacagtcatacagaccttgtcagtagtcccagaatgatctctcttcagtttaccaaggataagatatgggacactggcctggcttctgagtgggatgtggtccctgccctgaggacacataccagagacaaatattaacagttatattttaatgagataagtaatgactcccatgtcctaatgtacatcagcgctgctgctgcctacctgtgttgggtacaagaattgagattaggccgggcgtggtggctcacgcctgtaatcccagcactttgggaggccgaggcaggcagatcacgaggtcaggagatcgagaccatcttggctaacatggtgaaaccccatctctactaaaaatacaaaa

SEQ ID NO: 75711 - DNA, 1112 bp, Homo sapiens
ccacagatagtttgaaaagctggtatgtagattaacctaacttggatatttttgataggaacatttttgcatactcatgctcatttccccctctaatataagcagataatcatatcaatgggttttttaaatctcactttattaattgtgaaaatagtatgtcttcaatatgccaacttaggaagtgcagaagagtctttttgtttgttaaaacaaacaaggtaatctctacatttgtcacagaactaactgctgcctgtattttgttatatttattttgtccttttatcctgctcatatatgtaaattttttctcacaaaaatgggacactgtattgtttattctttatgtgtttgcatgtcattaaatattattttacaaagggctgcttggtagtctgttatctagttgtaccataatttatttaccttttctgtatagtccttcattacaagcacttattctatgcccttatttgctcttgcagataatgctttggaaatttctgtgaaaacatttttgataatatctctgaatatttcctaagcatacattttcagaagtagaaatactaggtcaaaatgtgtgaccattttaagactttgataaattgcccttcagaaatgtagaactgaatttcagctatcagtagcagtgggtgtactctcaggattggtactttcagggtgggaggatgttgctagacaaaggcaagagcgagaaggaatgagtagtctacttgggtggaaggtgagaggagcgcaagatgtttatggggcatggaaaatggcctgttgagtaaagtgtaggatatttttgaggaagtaggaaagacagaaaagttgagctgaaatccactgaaagccaatttagaatggtattggggagccattggcagatttttcagcagggatatgagagccagggctctgctctgagaagatggtggcatatacagcacagtctatactataccactcattccctgtacccttcatgccccttcctacctcatgcctttgcttgtactgttccctctgcctaaagaccctgttttccatattctgtcaaaactccactcatccatcagggaccacccccagatcctgct

SEQ ID NO: 75712 - DNA, 1034 bp, Homo sapiens
gttctaaatggaccatttatattgttcaacagacactagagaatactattcattttgcatgattctttggtcaaggacatactgtaagctgcgttagtgttctccttggttaatatctgaactgaccatgtcactccaactcttatagaccagaattcatttataaagcagaaagataagccaatatgagagaggttatgaagctgatgtttgatttctggtctcctgcgtggagcgatgggcctattgccaaccagagttggtcgggaaaaaggaaagatgactcctaccagtgtacttacgctttatgatcttgaatattttcagtgtttaaggaatctcttccttctttgatctccactgcatgaagaactctgttgcaggtgttaacaaggaagtttgaaatagaaagccagaacctgccccccaaagatctgacagtagtagaaggagatccattatgaagaaggtataatggcaacaaaagaataatcacaaattacctgtgtgtgtaatatgtgttgtgtggtgtgggtcaaggagatgaggaaggtggttagggaagactttatggaggaagtgagctgtcaacaggaattgaaggtgagaagaaaagttggggggaatccatgttaatgactgtctcagtcatcttaaactaggttatgctgtgatagcaaaaccccagtggttgcaacagcagaggcttattgcttgctgtgctgtgtgtctactgtgggtctgctatagttctgctccttcctgtcttctgtcctatacccaggaagggtggaggaggaaaggcaaacctggcaaaccattcataggctctaagcttatgcttggaaataacaggtgtcacttgtgcccacatttcattggccagtgcagatcacatggccacacctgagtttgcatataaggaggcatccttcttctgtagagactggtaccacaagtcatgtggccaaggctgaggtcatggggcaggcagatgacacatagtcctcttctagggaggggcagtgaatcat

SEQ ID NO: 75713 - DNA, 1015 bp, Homo sapiens
cagagtctcattctgttacccaggctggagtgcagtggtgcgatctcggctcactgcaacctccgcttcccgggttcaagcgattattttgcttcagcctcctgagtagctgggaccacaagcacgcaccactgcgcccagctatttttgtatttttttttagagacggggttttgccatgttggtcaggctggtctcgaactcctgaccttgtgatccgcccacctcagcctcccaaagtgctgggatgacaggcatgagtcaccgcgcccggcgcctgccacattttttatccattcatcattttatccattcatcattgatggacatttgggctgttgccagtttttggctcctgtgaataaagctgctataaatatccatatgtaagtttttgcatagatatatgttttaattcttgcaagtatatatgtaggagcggaattaactgggtcatatggtaacactgtgttgaacttttgagaaactttcagactgtttcaaaatgactgcaccattttacatctccaccagcaatgtatgagggttccagtttctccacgtctttgccaacacttgttcttattcaccccctaccaactgataagacaactgcttttaaagctgttctatatctcctgaagaactgaggacaaaataactcgggaattgtgtgtgcgtgagttgtcaaatagaaataaagtctccctgctaacaatttttaagttatttgggatatttacaaataaaacctaagttaagagtctgtttaatctctgctaaccatatattttatacctttcgagaatcaattcttttttactttttcctctccctctcacctctacctcctcccctctcccagtcttcctctgtgctctctgcctcagtcaaaataaagaaatataaccaatatgaataacactcacctattgaaataagattcagtaatattcttttctacaggtttttaaaagtcttaaattatctcagccaacctatccgaagagtccta

SEQ ID NO: 75714 - DNA, 1164 bp, Homo sapiens
ctctctttcaagaacaacaggcaatggggcctgtcagagggtgaagggtgggaggagggagaggatcagaaaaaataactgtgggtactaggtttaatagctgggtgatgaaatcatctgtacaacaaaccgtgtaatacaagtttacctatacaacaaacctgcacgtgtaccccgaacttaaaagttaaaaaaaaaatttatctagtaagacttgtcaactgaagttgtactagattataggtgtaaatactggaaatttgggtggatatttggagatgattctaacatgtttagaaaaaagcttattttagattaccggaaaactgttggtgatgcagactattaaaacttgaagtcactctaatgagtttctagtttaacggtaaaaaagctgaataaaaagcctatgtgtttagctgcagactttgtctagccaactgaatatagtctgcattgcttgctattaagagaaaaaaggaaatagtgtaaaaaacacttaaccattggtagtaagaaactagaaattatttctattagtcagcctttgcttgtggtgtttctcacttcttatttttatgtatcaaatgaaaacatgtctatcagacacagagaatattactgtgtaggtggtggtgagtcatattgtggtatttcatgtaatgactaagaatattggcagaaattttacaggctgaaaacctccaaggtttgttctctgtgtttaccaatcccttttagggcttaaagctctctcttgttttccatttatgtttttcctgactggttgggagcaggtaataattcactgaatgcacctctatggaaactgacaaaaatcttacctagctttcagatttctaaccaccatcatactaaaatattattctcagagtcattgcagttaaattttaagtgcttctttggcaattcatgattcccagatgagatggtcatttgctgtaatggggctggatgtttatatatttaatgaattatcatagcttaatagtacattttctccatgcattttataaaaatgttttctgtttatttgctgccaaagcatcacccttcaatctgccattagcttcttcctcttgatgttgtacttattatcaccatgtcatgtgtctttaggtcacagcttcttccccttgatgt

SEQ ID NO: 75715 - DNA, 1046 bp, Homo sapiens
tcaaggaccattaaaaagcaaaacaaaagaaaacaaaaaacaaaacccccaaacacaatcacatacaaatagcgagttgattggcaggctaacctcaagggcctgtcttagcttctttctctcgtttttcttagtcctcctgcccattcccccacctcaatcattatttgaatgtcctcagaccttatctaaatatatatttgtatgtatgtaaagagttagttaactcattagaaatagatatcctgaatttcttagtgacttctcttattagccaaaaacttgtattttatctcattgaaatctattgattaggtagattttcaaataataaatgctttagatattgctttagaggttttataaatgatcccatatttcagtttagctaaaatctctgaaaagagctttttcttccaaagtgttagtctttcaactcattcaagacccttattgtatattatttcaaaattccttcccttgctttatctagcaaatgaatccatttccttcgattgatttgtagcatgccaattgttttctgatttatgtaggtttctctacagaactgcctgcttattctacagtgtggaattggtaaggtttctttgtacagaatctcttagaagtggggcttaataatgcactttgttacggatgaagcctagaactttagttcccacagctgggcttccctcagaggtcctttcttcttaataataaaaaaaaatcttttctccaaaatattataaatatgtaaaatatataaatatataaaagtataattaatatcatctccaagaagaagagccttttaatctgttggttttagtttttgagaaactaaaactttctctggagaggcatgatgcttgatgcaaaggtttctccttttatctcttgcttaatcattttcctttgacttttaaaactctatccatagagaataacatgaaaaaaaaattctctgaccaatgaaaggagctcggccacccaagtctaagatgtagtaagatttagattctatactcaactagggtgcttcc

SEQ ID NO: 75716 - DNA, 1035 bp, Homo sapiens
tcagcagaagcagaagttatctacctgtgacagcaaaacatattaaaaccctttgctttgaatttctaggttttaggaatcacatgtttcttcacacctctgctcagttaacaaaaactgtgctgtagtgaagtaaaggatgcactcttaatagtacagttctctctcacacaaaccaaatgttacccccaaaactaagcaagttactattgaactgtttgaataattgacctgattgttgagaagtgatttatgtcaccattattttcccattcatcaatagttaagtgcaggtatgaataacaggaaattaaaaaggaagaaaaataattacttcacatatataatagctgtatgccaaaattctaacattttaaacatgttccctcataatggaattttctgtaaaaaatccctcattgcttctctggttgttcattgtgttgaaattcttaatagctagtttttgtggttagggagtaatactgtatgtgtgtgtttttgtgatgtaactgtttaccttgcccttgaaagtagcaattgatttgtgtttaaatgatgaaataacaacagtacagttgccacctctgtgtcaggcattactgcatgcttagttgatttgccaatcctcacaacagccttgcaagagaaatgatgtacctctcctggagatgaggatatagaggcttaaaaagatcatgaacttcccaaaggaactagcatattttaggccatgactaggcactggaggtgtgggtgttaacaagatactgtgtaaggtgataactagaagcaagcctggcaaactcagttgggattataaatggaagacatcaaagacaggccgatgagtggagaattaattttgcaggcaatgtggaactaataaagttttttgaactgggagctcaaaacagcacaggtgctccatttttaaggcagtggttctaaaatgtggtcttaggaccagcagcaacacctgggaacttactgaaaatgcagtgtcgtgtaccttttcctccctgttcaatccta

SEQ ID NO: 75717 - DNA, 1061 bp, Homo sapiens
ggaaaaggaggagacgagatgagacatcggtcttctagttcttcccaatatctttgtgagaaaaggggtaaactgggaagggaagcagtggctgggcactgggcctgaagatgtgagagggaagagaagttagatgtcttctttcttttactgtggttgattaaatatacagtaaagtgagcattggatttccagggacccactttgctaggtgttaagatttgggagagggaaccagtaaaagtaaaaaaactagacttcagtgacagtattactagacttcttcagaagtacctggtttagtcttctgcaattgagttttcaactccagtgatgggttcaaactggcatttctgctcttatgtgataagagcttacagaaagtggcagaagtagcaatgattagaaagaaatttgtctgcctttcctccctacctctctaaaggctatataagggaagcacagtagctgcaggacaaccagctttctagactctgcaggctctgaaattatctgtcttatctacatagtccctggcattgagagatgaggatttgtgtataagcccagattgaaacagtaagaaataacaagcttggagtatctggtgtttcactcaccaaagcaatgcagttggtgaagggcaaggcaagttagtgtgtgatttgtttgatgtgtattgagtatcttctctggggcagagaaaactagacagagaatctagactcttggttagattctgaggattaaaaaaataagccaaatttcttggagtggatggtcctggtaggagaagcagatagaatcaaatagtaatcaaatgttgtcataagctccataaaagggtaagcagacaggctctggggcacagaggaaggagaaaccaacctctaggagtgtgtgtgtttgactgagacaaccattcttttaccactttgacccaccattggttacagcagtgagagttgatgttgtgctttgatcccgtgatctagaaactggctcctttttcaacatttgagctgtgttcacatgcactgtacactttcctctttgatttc

SEQ ID NO: 75718 - DNA, 1046 bp, Homo sapiens
gtcctcagggacagttaaccttgcattagcacttttttctcattctgaggatgcatccctgaatggcatatgcctttatgtgcttactgttacccctgattctccttttagcttaattactcttttccaaagggtcctctcttgttatagccttgtgttaaacattatattgcaaatcataaacacactttgattgttttcccaagggctggttacagaacatcaaaacctactttatgacattctgaaaggtgggtctggtagctacaaatgtggtagcaagatgtgaggcagcaaaggccattgacaccactgattgaatttgcacgatacataagggtttagcgttgtgtgtccaaatatgttaatttacaaaccaactggaccacattgtacctgggtctttagcactccatggtgacatgtggatcaaagatttggctcttaacaagctatgtaggaataatttgttttatgtcattgcacactgttgtgtcataggcacagtgcctgcctgcaggggaatgtggggttgtatcatttctgaaactaataattggagaatatttctttttctttgccatgaaactgagggggagttgtcatataaattggtttcagatgttggagttgtactgcttgagaattttaggcttcagtcatatgccatgctgtgaagtgctttgccaaaataatgacttgttaaaataaataaagtaagtgtctcatagtttgggaagtggactgtaaaatctcagttcttagttctagctaagtgttgtggctgctttctcagatataccaggtgcacataaaatgtattcccccacatcccctctaaccaccccccaactccttgtaaagtcagctgaggcttgttcaggaaagaagagggtgttggagcagagggctcctgaacccttacagaaatgcggtgatattgttgctcttctctttgctgctcttccccacagggtgactaggtctctgtaaagtggcactcttttcttgcttttcttgcttttctgggtgtgtgattttgggga

SEQ ID NO: 75719 - DNA, 1026 bp, Homo sapiens
cctcagtcatgggacttgattttgttttagttttggaaatttgccctactttgggggaatggagagatctggcaccttctgcttcattttataggttcaaataccattgaatatcactgtgagttttggcttgttaaatacattggtaagagtggggttttgctaatactcccttttaagaggaaagaagggtttagcatttatactaccactatagctattttattaacatgttaaagtataaccaaggcctgtttttaaaaactcatcagatttcctaaacgttgtgaaactatgggagtgtaatccagtctaacttcaaagcctctgctgtagccttagtccccatcatctggcttcttcaatctccagatgaaattcacacaactgcctgagttgagatatcagttactgccagcttttaaggcactgtaagcaatagttactttgcccccttgttgtgactacttaaaaaatagttttgaaattgcatttcttttattccacctgtgtagacctgtctggaaagatttgcttacagaaagtgttttttcgaggcacagtataggactgaaattaaatgccccaccttgaaaccactctcctgagggttgggattctgacatcaggatatagagctctactaaaagagatgttaaaacctagtaggtagtcactgcttcattatgagacagtagctgtgtgtacatggcataacatcttctccactagggtgggatatccattgtcctcaggtggtctttgaatgtgaagctaaagaaccaaaattttccttttcaggtctgtttgatcacacaagtgactcacatagatgtgcaaatacgcatagaaatccctgaccacagtgccatcttctgctgggctcagtgttcaggtggagccagaggccacagccactgataactgattttttttttttttttgagatttggcttcaggttggcacagatctcccatccacagaagccctggggggcttaggggctggctccaggtcaccctgct

SEQ ID NO: 75720 - DNA, 1046 bp, Homo sapiens
caagtaggcagtctgatcatttatagccaacatttaaaaataaatacgtcataccttcgtgtcttctaaaggcttgagtgggtcattgtctgggtgctctggaagtcggatgtgtttctaggtgctgtgtgtatatgttgggtggtatgtcactttttttcccccctttttaggaccaggaagaaaacaagggagctacaagttggcctgaattctacattgatcagctcaattccatggctgctgtaagtagacttttatgttctttgacacactgtttaaaatgcaagtgtagtacaaagtacacagttgcacaataaattcgattgagtatgacctaccaaatgtcagtacctttccaaactccatcctaaacattcaatgctggggaaaggaaagagggtaggagggatacttggcaaagtgatttttccagtatgttttaaataaaatcagcacacactgcaatataattgagtttaatgttgtaagtgaaaatgtagtttgaaatctggcttgtgttcaactttaacttgcaattgctcttaccagtcactcggagcttggttatggcagcactattttaaaagttaataccattttaaaataatatgattaagcgatttctttactatatccctcccattctctttcttactgagaacttggttatttcctggcatcatgattttgcaggggaccaagtactctttactcatataatagatcaggaattcataaagcaagtggtttaatgaaaaggcgtcataataatagtgctgagatgtcctcggaaaatctttagtacatggattgttggttcagtaattgcttaatatgtattctcaatgcctaaaatatgaattctaatcacatggatgtctgtgatgtcagcattgccagcagcttgagggacacctattcatcacagctaaaattcacagcagaaaataagtcatcaacctttgagccttagtagcttaaatcccatccctgttgataagaattagaggttgcccatagtagaatgcagtctttgtctcagt

SEQ ID NO: 75721 - DNA, 1056 bp, Homo sapiens
aatccttcttattcaaggcatctcacacaatgccaaagatgagaaaagggtgatctcagcatttgtatgaatatgctaacagaatgtgagatttgtgatgaccaccagggattttctgtgcatctgcctaagcaataataatttggagccatttatatttcctgcatataaaggctattttctgaattcttgttcctggctgttaggaaaaaaagaattgtttctctttctaattaaatttgcatgtttgttatctaatgagaagttgcttatttgttaatgaattcccttctataaatggggaactactaagtactgtatggatttttcctttcttcaagtataggacagttagattaatttgtcctttagtgacttaatccctgccttgtctgaagtagacctggttcatttgtgtgctacagggtctgtgatgtgccaacatgtggcccttctttaagggcctcctctctcctccatccagctccttggacaattctttgccacattcttgagtgatctacattttaactgctgtgtgtttggttcccaatccaaaatccttcccaagagcaccacaagtctattaaattgtcagtgactttgctatactttttgtgtcaaacacctaagaaagctttctaatgttccttttaggactgagccaacatctttccagggtcaaaggtaaaaggcattaatagtccatgaattagtgaggcctcaaaattcctgcatacttcagggaataaggagatctgatgagaccagaaaccctatgctgagttttctgtttttctcaacattctgattgccaccaccgccttgcatagttctggctaatcactatgatgtctgtactggagaattcttgataacacacagcagaaatcctgagatattgtacctggagcagtggaaaggcacacaagttctccaaatcctttcatggcccagcagctagactctttggttgtctgcttagggcattcttgaaggagtgtttgtccacattgtcatcacccattgtctgcagaatcagcagcaactactaca

SEQ ID NO: 75722 - DNA, 1180 bp, Homo sapiens
gagttcaaggctgcagtgagctatgacagagcaagaccctgtctctcttaaagaaaaaaaaaaaaaggattggggtgggggcatgggaactgtatgctaaataacacaggaacagcagatggttttaatctaagacaagatatgtattccgagtattctcttgcttctaattttttatgaatatatgatctgttgtttggttctttgtacccattgagatatgtttatcacaaatggaggggttttttttcacacttttggttagaactgactattgggtctgtgccaaggaagaggcaaagaattaaaaagacttcatcaatgtaagccttttggcactttaggaactaaatctttctttcccctgccctctagacttttctgttaggggctattataaaacccaaaggcacttaagcatggtgcatttctcttcatgacaggtttgtaaccagattcatcgacttggatggcctatcatgtatcctcaactttctaaagaccatggactacgagacctcagagtctcgaatacatacttctctcattggctgtataaaggcgttaatgaacaactctcaaggccgggctcacgtcctggctcattctgagagtattaatgtaattgctcagagtctgagcacagagaacattaaaacgaaggtggccgtgctggaaatcttgggcgccgtgtgcctggttcccgggggccacaagaaggttctgcaggccatgctgcactaccagaagtatgccagcgaaaggacccgctttcaggtgggtgttcgctcagccttcttcactcaccccttctttaaagtctgctcaaacacgtgcttttcctgtccctgaaaggggaatgttacttgagatgtcctcttgtggtgattactcacagtgtgactttaaacattcccttcttcttaggtttaagaaccagagaatagagtatactttcaatagttgatgaatctgggcctttagatttgcagaacttgaaaatgtggtcttgcatcctatatgtcatatagcacacatcttttgaacccaccaaactgggtgttccctgaaaattttacagcttgccattcttgaattaggatcaatattaataatttttcatatttcactatattacttggatgtaaaaagcaagcagagataatgaagcaaaggcttt

SEQ ID NO: 75723 - DNA, 1031 bp, Homo sapiens
cgttactaaccttatgctcattttatgaatttttttatactcaaaagttaactttttttttttttcagacggagtcttgctctgttgcccaggctggagtgcggtggcatgatctcagctcacggcaacctccacctcccgggttcacgccattctcttgcctcagcctcccgagtagctgggactacaggcgcccaccatcacacccagctaattttttgtatttttagtagagacggggtttcactgtgttagccaggacagtctcgatctcctgaccttgcgatccgcctgcctcagcctcccaaagtgctgggattagaggtgtgagccaccaaaaagttaacttttaaaatcttacgtttagacaggattacactgacccatagaaagccaccctttttctccttaagaacagtcctaaaaactctaatttcaaaattcttacatcatacatacatgtatacaaaagcctttgcttcattatctctgcttgctttttacatccaagtaatatagtgaaatatgaaaaattattaatattgatcctaattcaagaatggcaagctgtaaaattttcagggaacacccagtttggtgggttcaaaagatgtgtgctatatgacatataggatgcaagaccacattttcaagttctgcaaatctaaaggcccagattcatcaactattgaaagtatactctattctctggttcttaaacctaagaagaagggaatgtttaaagtcacactgtgagtaatcaccacaagaggacatctcaagtaacattcccctttcagggacaggaaaagcacgtgtttgagcagactttaaagaaggggtgagtgaagaaggctgagcgaacacccacctgaaagcgggtcctttcgctggcatacttctggtagtgcagcatggcctgcagaaccttcttgtggcccccgggaaccaggcacacggcgcccaagatttccagcacggccaccttcgttttaatgttctctgtgctcagactctgagcaattacatta

SEQ ID NO: 75724 - DNA, 2182 bp, Homo sapiens
gtcctaatgggttctggctcctgcacagtgctgattacattgggtgcacaccagggattccaagccttggttttatgacagccaagtatgtgtgtctacatggcttaaagggtgttacaaaattttttaaatgaaacaaattaaaattttgattttaaaaataaaaaatatgccttacaacctgttcagaaaggggtagagggtacctctcaatcaaataaatgatcattgcatgtcaaaattccataactttgggaagcattggtgcagatgttataaacatctctggtttggtggctttaaagggtgaccaccattgacaaatattcatcctagcttagaaacaacttgaagattttttttcactattcttttcttttttagacaagaggagtggcaacactgttcagtactggctactactagatagaattatacagcagatagttatccagaatgacaaaggacaggaccctgactccacacctttggaaaactttaatattaagaatgtcgtacgaatgtaagtctcttcttattctgctgctgtgagataatggtgacaatgtaagatatttattttatcctacttcagagtaacagctgggagagctgaaatgttctaggggtcaaatatgagttactgtacacatgcactatagctaagtaacatctggtcttaaatgggtttcaagcatgcactgaggattttctctgcagtagactatttttgtacctggggagaatgcagttagcagtggaccttttatattttttgtaataaatgctccttgaactcttacacaggttggttaatgaaaatgaagttaagcagtggaaagaacaagcggaaaaaatgagaaaaggtaaataatgaggccctgataagaggctgtgttattggttattgggtgaccttgatttccatatattttggaaatttacattgatgtttcttgttagcttggtgcaggcagcctttctttttccatcttttaagggcattttgcactgagtttcttaaattgagctattttagttgtcatactgattctcaaatattttatccttttattataatcatgtaaatgttttgaaaagcttatagcatttgctgttcagtattccttaaatcaaattttcttaactactaataattcaaacccttcccctactccgtcatggctctttaaatcatactgggttttaagaaatgtaataagggacttgaggaattatccaaaattttaaaagagaagaacaggtcacttggtttcttttttttttttttttttttttttgagatggagtcttgctctgtcacccaggctggaatcagtggcgccatctcggctcactgcaagttccacctcctaagttcacgtcattctcctgcctcagcctcccgagtagctgggactaccggcgcccgccatcacatccggctaattttttgtatttttattagagatggggtttcactatgttagtcaggatggtctcaatctcctgacctcgtgatccacccgccttggctgcccaaagtgctgggattgcaggcgtgagccaccgcgcccggcctacttggtttcaataacccaattctgtccatgaccttgatttggtaccagttataaaaagagaagtcattcagaaaatcagtgaccattgctgagatatgtgttacgaaacattagctggccagctattagtgtgtatttgaatatgtctttgatattatctcttagtatcaaatgataggagagacatttatgtccatcagtgtaccagccatacagagaaatgtatgtaattttccttcctgttttaaaatattaacaaattgaagttggcctctttgtggaaataatcatactgccagctaccatgctctcaccatactggttaactgacttccttttccttgtccaagttattcactcacagccaatgaaatacaatagcattcaccccaatatttaatgtgctgaaaagcaggtcccagagatgcctaagcatttccttttctctcatcacatttccactgagcagaaaagcagggccataactgatatcagaaaataccaattgtgaactaactactgttatgttacgagttcctcatatgtattcagattgctcccaaataagtgacattgcacatgcattttaaaaaataaat

SEQ ID NO: 75725 - DNA, 1006 bp, Homo sapiens
atatttatttttttccttgtattgctaaaggaccattttaatgacaagattctgaatcaactaccaaacagttaccattctcctccacaagaagtcactcaaacttttgttctgtgtttagaactgtgagtgtaggctctcttcttcagtctcttacgtagttaataataacattgttcatccgaagcccactccaagcacaaacatcatttagcctttgagttgctccctttgatggagaagaggaataatatttacctaataaagatcctcataatctctgccatcatcctcagtcaattttcttttagagaaaatgcttcagctttgaagactctcctgttttcatgtccaattgttttctcgtgtagagcacaatgagctacaacagaaactggaaaagaaagaacgagaatgtgatgctaagactcaagagaaggaagagatgatgcagaccttaaataaaatgaaagagaaacttgaaaaggagactactgagcataagcaagtcaagcagcaggtggcggacctcacagcacagctccatgagctcagcagggtgaggtcttccgctcagctcacgggcagctgccaaggcctcactgaccctagagcccctcacccttaagtagagaacttcatactgggggaataaaatctgaaatggctcatgattcatcacaattaggagactcactccctctgctatcatgtaggcagcagaggctgtttgggggtgcatttttaaatactgtacaaatctaagagcaaaggaaattgcattagcttcttaaagtgaaaactgacttcatgaaaaccagactgtctgtgatggtgcaagaagtgagagagatatgaatgcatcccagacaagtacttgagtgtcaggtacaaaaggttgatgcactggagtccataaaggcccaaaagagtccattcgactttaccgatcctttaaacattctcagaagggtgaatttctctataataaacattttaggccaag

SEQ ID NO: 75726 - DNA, 1151 bp, Homo sapiens
agcaaaaacatgtgatttggtgcctgctggcactccacattgacaaggcatcactatgtgagccccagtcacatctgtgtggtacctcttgttcttcaagagggcatcgtgatacagcctcttaaagttagaccagaagagaacacagcaaggtggccaggtctggagagtttcagaagaaaaaagaaaaggtggagtaggatcccaaataatcaaagccttgagaagagaaaacttgagtccagtagtgtgagaagaaagattcttaagtatgactgaagaggtggaatgatggagagagcagagttcatcctaaacaggaacacacgaatgctgggcctcttacggggctttccttgggctttactgagaggcccttaactcccagatgaatcatgggtggagcatccttaaacaagcagcagacttcctagttggtttccttggcttagtccccaagaaagagtgtatcagaaaagaaatactgagcaccaaaagagtagatggactcaggctagggggagaaacaaaaactaagggtttcttgtttcattttgttttgtttttcaaaatggcctttgatacatctgaaatgggggggaaaagccaatatttaaatgaatatttttccttaagaaagggaaagcttttctgcaatgccttttatgctactttaataaaatacaaaaatagaggcggttgcctgccatagtgacatgaacccttaaaacaggagccctcagctgcccacccctactgtaagtagaaaggcaaacttgggcaatgctatacacaccaaataagggaagatgaaaaaaacacaatgaagataaggcattggccaatagaaagcaaaacaatttatccttcaaaggacaaaagttgtctttagagtcctcacgtggcagggactgtgaccagactcattcctgattggctgcaacatgctgcctctttctctgtctgctgtcctgagaaggtgtctccttggccttgacatggaatcttgatccattttagcaaatttcctgataattcaaataatcttctaacctggctacatgtcccattgctttcccacttcagttttgatcgctgatactgttccatgctggttgcctaatatgaagatttgagaacgtagagaagta

SEQ ID NO: 75727 - DNA, 1525 bp, Homo sapiens
tgtcagttacctcttcctcgttccctttttcattccaagtcttttctaaaaactatttccagaagagactgttgaccttgtatgcttgaacagtcctggggcagttaggacagggccacgaatggctgcacaacacacgtatcactgattttctcttaattgcatgttctttttcctcatacctacctgtagcacctacaggcattatttgcactttataggggtgctgagggttaatattactgacttgagttgttcaacctgtcttttctcaatccttccttataacacaagatgacaggagattattttcatcaaaaaaagtttatttatttatgtatttttggttttcctattaacagtaggaatagtttcctcaagttgatgggattgattttctcctgcttcaagtaaaatcatcatgttgaataaatggagccagtggtcatttcaaagaggatttattcctttcccagcttgggtctttctcaggtgttttaagccctgtcttttctgaatttgattttccaccattgaaaattgggtacagcaaatgtcatcgtctttctctaccctgaatgcttagtattgtgctcttcatggtattcagccaaattttctcatcttcatcaactctcattgatgatcccaggggcataaatcatctcttaccctacatcacttgtttccttgactgctttgactttcccccatttgttgctgtgacttctgaactgcatatatctgatttgccttttccatgcctctgccatggctgtaggatttctttgtgaacagtaactccaagcaggtaagtgagctactacctaaagcttgcttaatataactccttggctcactgtaagcttgaaatctcttcgttatccagggttttgtttttgtttttgtttttttacatagtgtaatctaatgcctaggtaactccactttggatttcaactcttaaatgagtatctagaggttcgcctgaaattttagcatgagacagttgacatttgatcacctagtgcctcacagtataaattccatattgcctttgttttctaaactgttacacagttctagagttctttggtttctttactttttttttaatgctaccgttattggtacaataatttatataattgtttttttcctcctaattcctgagtgggaaatatatgaaaaaggcttgatggtgtatataagacttggactattgtcttctgatagttatcaagtactttttatagattgcataggctgcagttgaatttagatgcttgatatgcttagtgtctgagcaagccagattgcagtcacgtcactacaaattcattttctttttaagctgcaaaaatttaaacagtagtacagactcatgttaaaaacagcagtctgatccaagattttgtagtttgtagaactgataatgttagatgttctccataaattcacgaggcttagtaggaaagtacgtagaatttttagaacttaaacagactttagaggtactacttta

SEQ ID NO: 75728 - DNA, 1023 bp, Homo sapiens
tctttgtgggccacattaagagaaaccaaaattgttttgaattagagctagtgtttagtccagacagcctctgggggttgaggagcataaatatatacaatttcaaaagcaagaagttctgtgctccatatggggagctaatgaaatgcaaatctgatacttcaagtattgttctcgctctgattttcaactccttttcttttaaatgcaaaacagaaggactcagcagaactacaccataaaatggtttcttcaactcggtgtgaaaaggacacagaactaattttttttttttcttacaagcagagctctcctcatgattatagatgttttcacagccagttggttttcattagtggcagtttcagccctccctattgttactgttccttggccttgcatggccacacaatggtgtttggacttaaattgactcaagggcctctagtgtcctggagtctaaggctacccagttgaggccctgatgctgcgagtcggtttttccctgttgtatactttacccatgccaacttagctaaattgttccatttaagtagggggaattttctaacgcgatattctgggaacatgttcatgaggcaatgattgtcccaagaatgacgaaaaccatctgaagaagtctgccaggacaagggctgctgtaacggcgtaggggttataatggcaacacagctcacataaggtgatagaacgggccttatttgtcagcttaaacaattttgcattttgtctagatgctttatttgggtttgagaacatgaaatagaagagaatggtatgagtacagtaggattcccaaattttttccttctcttccctacttaatggcacatgaaataacattcagtttaaatagcaaggtggatggttttaacataatcgggtcccaaatctagagaaaaagacaagccagaggcatccttggtggggtgcctcatccagcttcacctggggcttctcttctttgctgcctttgagtgcgcgctttcagttgttcagccc

SEQ ID NO: 75729 - DNA, 1022 bp, Homo sapiens
cctcttgtgtcataaatagcagtaaatttaaatgccaggggtagcaagaatgggatttacacccagtcagattacatctttgcccatggtatcttgttataatttttattatccatgaccaagcagccagtatttctatagcatttctttgtagcctctccaacgggatcatgggctgtttggcatctttgtctggttgtccccaaataacaatgttgttgatctcgcacatattctagggattttcacctgtctctgccccctgccccttggtctgggccttaacttttctgtgctctgtggtgatagtctctgaatgctataagatcgttccatccttctgtctcattgttttggggatgggctcacattttgagtggttttggtcaataagtccacgtttgttagagccaggtctacctaaggtcagctgtgggcacaagcaactatgattctagactgaactccaggttgcatctgtaggtgtgccctgttccaagagcagagaataagggtattttgtgttgttaacagtaatcctgagtggtgaagttgctctgggtagagtgcctgtctgtttgcacgtgtgttttccatggttctcactgatgtcctcgaaggtctcagacaccatgcagggaggaatgatgtttgcagagtcactccctaatggaccagccccgcccctgcaacctctgcggctggaatagtcctgggggaaatccctcacatttgccatggagaaactcttcatgctgtcctttaaaggttttatttaattatcaaaatagttaatgattatgttctcaagtctcttggggttctctgtgtatgaacggtttaaaagtatctcctgaacccaaaatttattttgagagcattttctagctccttcacgtacccttccctcccttgctgtagaccagtcacacagagtctttgctctgggacagtggaggtctaggcagtgctctgcccctcccaggtgaccctgccttcgagttgctgcacccaatgtggta

SEQ ID NO: 75730 - DNA, 1677 bp, Homo sapiens
ggccttgctactccctgcctttgcctaccctgccctgccctctcccactgatgttaccactgcccttccacctgcataagtgctgtgctgcccgttccagaccccggcacatagtatacactctgcctggaatgtattccagcctcacacaacacctgcctgtaattccaattccctctctctgctgatgacacccagactaactgccttttctgaggtccctcagttaaatccaacaaacatttgaaaacctactaaatggatcgtctaattccagcatcaaattctggggagagcctcaaagtcaagaaggtcaatgttttaaaaaaaaaaaaaagttaagggcatttgatctagaaaacagcatgagtccacaggtcttgcatacacatccaaaacgtgtgtaccttgaaaggaaatcagacacgtacagaagcactgtttcagttttaaatattttactatttcttccacatcccatgctcatttcttccttcaaaataaaatacgaaattaaaaacatcaaatcccactgtgttcctctcacccagctctgcatggaaggggaaaaaaaaagattgaattagataaaccagaaaaataagaaaatggaatggaaactacaaatggaattattcattccagcatgatgtaacagaaaaaggcacagagctgggagtcaagagacctaggttctatttctaatcactacccacacttgctttgtaatcctgggtgagtggcttactctccctggacctcagttgtatcatattctgatgagagcattgactccctaaggtccttctagtggtctgtgaaaaagaggttccagtagagaactcccacaattctgatttgagaggcagtagagaacagaaaggtgccaggaatgaatcttatacccatttaactacttccaagtaaaaatgaaaagatttaatcatttctattgtatcttaacctgtgagcagagcttatacactcaacaagagttaacattttatcttgggacagattaactgaaagggtgaaaaattactacatggatttaagtgataaacctcagttttaatattcgtgtgtacttttcagctcttgaaatttgttcctgaaaaaagtgacattgacctattggaggaacataaacacgaactggatcggatggccaaggctgataggttcctttttgagatgagccggtgagtttgaaaatgctgggaatgtgaagatgtcacttccctttctaagcttcatgaattttcaattcatgttgaattgtttgggccaattaacctggcttaacttgaaagctttttcattctaaaaatcttctcaagtctgagtgatgtggaatttgttctgtttatgtcacttcttgtctatggatgagccacggtgagggttttttcacaattatctctatttctgggcccctttggccttatcaagtaataacttttcttgattccagtcagtatcattctcctcaccagtctgatttcttgggatagtgtctcatacttccaagtagcttagcatggcaaggtggttgtaaaacaaaaaaaaaaaaaagaaaaaaaaatatatggacagactctgacaatgtcagcctcaagcccccataactgaacaaccagggtctagatgtcagatcatgacacatgcagacatcac

SEQ ID NO: 75731 - DNA, 1021 bp, Homo sapiens
tgactcacaccagacaagtaagtgtttgtaaagaaatcttggagatgggattgctattctagatattcctcagtgcttatgactgatgagtcagccaagaaaggcctgagaaaggataggattttgcagctgtctatgggtgttggtaacaacttgagttggctctccctgtccttgttctttgcttctggtgtaagcgttttgaaagtgctcttggtaacccaataactcagtcttacatcttcaatatctgttattaagtgtgtgaatttagaatgggtatcactgaaacatcttgatttcaaacaacgaaacacttggtaatcatgtttttatgtgttttgttttgaagcaattcgttctggctcagaagaggtgtttaggagtggtgccctcaagcagttgctggaggtggttttggcatttggaaattatatgaataaaggtcaaagagggaatgcatatggattcaagatatctagcctaaacaaaattgctgacacaaaatccagcatcgacaagtaagtatgagatcttccaacacttgggggagccaggtgtgtaggtccaggctcagatttatgcctctctggtcctcctcagccttcatgacactgcattcttcagttggaacttctctttctcactactttcttcccttctctgacattgactcttctctaaacctctctcatgaccgcaggcatctcccacattcctgttggaccaattatccttcatccatttttggtccactgggacatcatctgttctaagttttgctgttgtttttgttttgtcctgcctttttaaaaaattattttttgtaaactttttattataatatactaagaagaggtcagtcatcacaaatgctgggcttgataatttttcacaaattaaacacacctgcataaccagcgcccagatcaaggacagaatgttaccagcactcgacatctccccatgacccctctacagaaaactgtgttccacagaaaagaaaaaaaccgatagttgg

SEQ ID NO: 75732 - DNA, 1077 bp, Homo sapiens
ttaagaatagctgcccttttcggtggaataaacatccctcactctccaccccaccccactccactccacccaagcctactagttataaacctgcagggcacaccccattttagggtggatccactgggaaggtaaacttgagcttgtctccactggcagtggttcagattcacttagatcacccatcacattacccagattttgaaagatgctcattatgggccacaaatgtaattcttatcctctttttagaaattgtgtgctttttgacatatatctatgcaatccccatggaggctctcccattattcctgtctcttgagaatccctgccttacatgatcctccaaattttgaagttaatgcaggtaatatagcattattgtgggttctaccatttgagcatataaatcatatgcagatattaactattcatatatttatgtagtttaaatgaaaataatttgaatgtttaatactcttcccttcttcaattgtagaaacattacccttttgcactatctcatcactattgtggaaaataagtaccccagtgttctcaatctaaatgaagaattgcgagatattcctcaagctgcgaaagtaaagtaagtacttacagtgagtgttagtttcttaaatcacttggattgtgtgttagccattgaggtagtttgcactgcatgaagtcagtccttctatttgttttcccctgatcattgtatgaaataaagtttgaatctcatccaagtcactcaaatgtattacaaggttttgaatatatgtttgttctagcttctttggaatactgcatgcaatttttaactttcatacttttaaagggcaggtgttttaaatacaggtaggagcaccttagttaaataaagatgcatggctaagcaaatagaagacctaagtgtcagaacattgcaataattttcacatatgcacacatactcccagaaaccaaggcggctctttaatgggaagcattctttatgcaaatgaagaaactaaaaataaaatggaaagttgccaaacttttaccacaaacttcacaccacgtttcagagactga

SEQ ID NO: 75733 - DNA, 1885 bp, Homo sapiens
aaatcatttttgattgcaacttaagccattaccttgtaatagtcatattattggggccttagtgaaaagcagaacactgattatacagagtacaatgtgaacatgattgcagatgaacttgttttctttctgttttcaaagggagccaagtatggcaagagatttatttctacatgaagtaatttgctgaagtgagatttttttgagtttgaaacataaaatatttttgtacagatggaagatatttctattctatttttaacctgtaaaatatacctgctggctacagaaaacaaacataattttatacctacatttcatgagtttaaaatactgttgtctttctttgagatctgagcatggaagggaattttaaacatttaaattaaaataggatggacttccaagcgtgaaatatttaaacccatcttatatttaatatgtgtaagtcacatgttgattgctaaaacattgctatttacaacagcatgactgagctggacaaagaaataagtaccttgagaagtggcttgaaagcagtagagacagtgagtatttttttgttgttgttctaattcctggtctcttcactatctctagtgctggtggttttcagcagatgggttgtgttggcatgtggtatgcccgggataaacatttattgattaaaaaataagaaccaccaccacaagaagcaaaggcaggttatgttcagcctggcaacttgattgcaggcagcaggggtcgtggataagtcactgcagcaggaactggaaactggacctagtgtgccaccaatttatctgtaaggcaggattcatcaggatgagtgggctgggctagatgatcttcagggacgctctcagtttccaagtgctgctaatatatggtgttcactttcggtagagcagtagaacttctctgtagaacttctcagttgtttttgacttggtcctttggggagtatttactaagcagacagtgtagtacatgctctagctgagggtcacgatgactcagaatccttgtcctccaggtgttgcaataatcggagcagccacttccctcagcctggccgcatccagataagcagagtgattacggaggtgccttaaggaagcagcgggttgagggtgctttggaggcatgaggaacaattggcccctattggaggaagcttctcttttggaaaagaagttgtttgagctatggcttaagagggtagggtaaacttaggtgcatagagggaggttatcccaggcatacaagacaacctgggcccaggcctctgaggaaggaaaaccagtcaggctggcagactggacctggtaggatgaaacgtgcctgttggcacagtgccctgcgggtactctgcagatgcagctgccagcgagagagggggcagggatgagaacaggctggcagagtagcgtccctggtgtctgtgctcaaagcagccatagcttgggcctgctctgggtgaaggagacggatttgcaggcagcttggaaaggtgcctctcataagtatccttcagatcatttatcagtaatgctgtgaggactctcccttcttttcgtttttgaatcacaaaactgccatagaaagtagttgaattaattaaagacatacctctaataaaaattaaagtcacaatgtctaatttttttttcaataaattaaggagcatgtgaggtttttttcctttttttttttttttaatgtagggagtagggggcagtattaaaaaaaaaattctactgattgaactttttctcccagccccagagggtccatggtcattatgatggccctaaagcctggctctgacccctgcttctgagccaggtcagagcaaggcctggggtggaggcttctggggaaa

SEQ ID NO: 75734 - DNA, 1041 bp, Homo sapiens
tctgatgttgaagaccttctagcagaagctaaagacctggtaagtttcccccttgtgcactgagtgttgtttgaccgggctgggcttcagtgtgatactttcagttattattctgtacgggaaatagcaggagtgagatccaaacttcgtggtgcaggaaataaagtagtagataattactttccagattccattgttttgcatgacataggtgtattttcatttccaagactgtgattaatctgaacacaccctttttgtctgactggcctatgttgcctttaggttagcaagaccttgaaggctctgaatggtataagaccagcaaatactttgacagttttctcttggttgaaactggcttgaagtacttatctctgggaaccagaaaagagtagatgatgaaaaccaggggcagcatcaaatgtgcaatcaggtgttactaaagccatgtgcctaaattacctctatgttgtaatatgctcatctgagatacagccttggaggacaggatactacctgtataaatctccagcagaactcgctaaaagagatgcattttaattcacagtctcattacaagaggtttttttttttttcagtaagacatttatttttatgatttctgctatttcacattttgtgttcccttggaagagaaatttttgttggttaataaccaccacctcttagctccctcagcttcacctcactcctctctatctcaggttgtttcctcttccaaaatgcattcacattcatatacaagacaggtacacagtctctcattttctatcctcttctcattctttataaatgatattaacactcttccccaccccattggttcttttactctacccatctctcagttgccacaacactctgagtcttttgtttcgaaacttctgtaaatggatgttatttttctctggtcacctgtttggttgtagatatggatgattgtttatgtaaatgtacacacataccagttaaagttcaaaagtaggctgttcacatgcattagctaatctcagcatt

SEQ ID NO: 75735 - DNA, 1046 bp, Homo sapiens
tataaaataaatggcaatatatgttcaaatggctgctgtcagaggtccaacctctgatatcccacagtggaaatcagtcaactcatgtcagcaaccaccattcagacctccactgtgaaagcccccatccatgttttatgtatgcctcaccactttagagtttgtgcttcataaaggaagagactccccctgttctgatatcccacctgagcaatatagcacctacttcatcaaggggctcaaacatttttgtgtgtgaactggctgttgtcagcttgttcatcacagtagccagcatcgcgcttctctgatgttgaagatcttctagcagaacataaagacctggtaaattttccccttgcacactgactggggtgtgtgtgtgtagggggtggaactttaatctgggcctggttttctttagatttctaagattttgatatacatgacgtcatgatcactagaattccttgataaaaagatcactcaggatggcttgaagtatgtgaacttgaatgttttagaaatccagttgtagactggctattgctattttgttcataccagaacttttataagttagcatataaaaccatggagcaagctagaacactatatatggcgtctgaagaatgttatgtttttgcccaaagaactcttttctaatagaatatttccaaataagtaaacattgaaaacaactcctcagtgaagacagaaatggtaaaaaggacacttttgttacaagtttaaagatatgaaatagtaactgtaaaatatatataaatataagccaatacttgttttatttaaaaataaatgttgaaaatatttaaggtagatggtattactgagatatcagaagaatctaacaatataacaaaggcaagtaaagcaataaaaaaaccaattataagctgtttgggggcactgcataaacacagcatggtctaaatatgaagaaaacttaaaatctggaaaatgttaagtagttgattgggcgtagggaaaaatgtatttgactttgaagctaggaacactatcct

SEQ ID NO: 75736 - DNA, 1798 bp, Homo sapiens
gaaaggggttctaaagcaaagaatttggaataaaattgtattctcagtcatacactttgggttgcattaaagattccatactcagttgctgttttctcactgagaccctgaaaatatcttaacaatagcagcattatttgtgattgggaaaagcagctaagaggcactggctcccatttgctttctatattgaccatatggcaccagtaaatgatattaaactacttcaaagacaagttaaaagtacaagtttccctccccctgctgagtttgctattagttttatgtctagggtgctataccctacaatattttgtttttactactgtttagttaataaaaagtcataggaggtcatcatacatgttaagctcaaatgaggtagacaggaataaatggtttcaaaagctgaggagtattacaatttttactttagaaatgattaatagacatgttcagcagctgaagataaatataggctcactaaaatccatcagttatatttgactcagccgggtgcagcggcacatgcctatagtcccagctactcgtgaggcttaagaggaaggattgcccaggagtttttggctgtattttgctgtgatcatacctctgaatagccactaaactccaacctgggtaacatgtaagaccccatctattaaaaaaaaaaaaaactaataacatatgcattccagcctgggcaacatgtaagaccccatctcttaaaacaaaacaacaaaaaaaaactgccgggtgtggtggctgaaacctgtaatcccagcactttgggaggccaaggtgggcagatcacctgaggtcagaagttgagaccagcccggccaacatggcaaaatcctgactctactaaaaatacaaaaattagccaggcatggtggtttgtgcctgtaatcccagctacttgggaggttgaggctggagaatcgcttgaacccgagagacagaggttgcagtgagctgggatcatgccactgcactccagcctgggtgatggcgaaactccatctccaaaagaaagaaagaaataaaaataaatgagcaaacaaaacttacgtttgactcaatctgggctttggtctttctcaagttatttatatttgattgtggaattctcatgaaacattgacttcttaaaaccatctttttcctagtttactaaagcagtgaagcactttggggaagaggctggcaaaatacaaccagatgagttctttggcatttttgatcaatttcttcaagctgtgtcagaagccaaacaagaaaacgaaaatatgagaaagaaaaaggaggaagaagaacgtcgagctcgcatggaagctcaggtgagaggatgattaattgaccaattccacctcctagaagttctatgactgcagcccagtcaaaggtatttagagagcactctgacctggcaggaaggaaggcttcaatgtactctctagaatgctgtgggactttacattggtgttgtttctcttgggctatttaacagtgtatattcaaagccttaaaaaaaaaatctatccacatcctttgctctggaattccatttcttagcaattattttaaagaaataatcataaatttacacaaaaaagggcagcattctttataatagcaccaagctaaagacaacctaaatgtttaccaaaaggggatgagttctaaatgatataacagccatataatggaatatttatgcagtccttgaaagacatgtattcaaagaataatgatacagaaaaagatttctacatgaaatctttttctgttttgt

SEQ ID NO: 75737 - DNA, 1620 bp, Homo sapiens
gtccattgctcctgcaatggagaccccatgttccaattccccctttcttgtgatatccaaagggggttataggatgagcatagcttggtgtctggagcattaccatatttcaaggaattgacctctactgcaaacaaaatgcaacattttgacatgtctcaaagaggttatttctttctatttgcagctcaaagaacaacgtgaaagggaacgtaaaatgagaaaagctaaagagaatagtgaagaaagcggagagtttgatgaccttgtttcagctttacgctcaggagaagtgtttgacaaagacctttctaaattgaaacggaatcgcaaacgtattaccaaccagatgactgacagcagcagagagagaccaatcacaaaacttaatttctaattttccatgaatacttttttttagaaagctcattagcagccctctaaagtgactagaacgtttcattacactgccttgcaatccaaacagtggcaattttttccttcatctgtgagtgaatgtgtgaacgtgtgtatgtaaatgtatgtgtgtatatattaaaaaatgtatatagatgtctgagtgttgtctggagacctatacgtatggttaaaaagatttatgttaatgtatgtgctccaaaacctttcgtgtatgcattcacattgagtgtggctcattttctttccccgaacgccatgactgttcagaagcacaatactatctcctgaaagagataagagacattccctagattcaaaggcaaaacagaagaaacaaacaaacaaacaaaaaaagcttgcaaaatattttatggtttccaagcttgatatcctttaaaattattttcattgatggaactggagttgttggaaaaacatagatttaaaatgatttttgatagctgacattgtgatgttgatgtatcacatcagtaataggaccagctttgaatttctgacattggtgtggggatacagtctgtaaatgtttattgagaacatcttgcacacaatttgaattatgtagaatgtcaatcaagtttttgtatatttaaaagttggacatcaattttttcccctgatttcatcaagttatctctgccaagtgctcttgataatttcttcagatttttggaaaaaaacactatataaatgcaatccatgctttttttaaagaacaacattgccagagtatgcttgttctaacaatatagatatataaaccttaaaaataataaaatatctcacccaagacttaaaggaagaattctctgaagggataaagattactaaaaaaaaaaaaaaaaaaaaaaaattaatggggtgcctttttgttatagtttctattttctgttttgtaggacaagctgcattttctgtaaatataggtctggactaaaggatacataaagaatgcacaaaatgtcaacatcagcagagatgcccagatctatttatctctaagtatatttgaagtgattgctgtttatatgttgtcattttaaaattgtgtgtcagtaaagctacctgtaaaatttcagtccaaaaaaataaagctctcagggagacatgaataaaatcaatgaacattagaaaataaaatatagatgcttaccatta

SEQ ID NO: 75738 - DNA, 2154 bp, Homo sapiens
taacaaatatttattaagttcctactatgtaccaggcatagtagggctacaatggtaagcaagacagagtccctgcccccaaagagcttatattctaatggggatattaagggatgaatagaataccaatgtgtgcactgtacaggaatcatactatttaaaaataatttgtataaactataatgcttagcacagatggcgagttatctgtgctatgtgaaagctgtgaaatagtgctctaagagttgtcaagagctgtggttttacatcttttcctcattgcaaatttagtgactttctacacactatatggaaataaatgactagcaaataaaacagtcataaatacaaagcagaggttgcactcccccaatcccgagttaacccaggtctgcaataacaccatgttaaaggtgcagatagagacttggctcaaaaaggcttggagatgaggaagattggaatataatgatggttttgtctgttccttaactaaagtgcctctatgtatattcttttctatttgtagcaggataaatttggtctggctcagttttggaactgtattttgaaaatggctttgtcttacagtttaaggaatagacaggtggagggaaagtcacataaaggagcaagtttgtgtagctgtccctcttgccccttttaatcatcctcctttgatatggccatcctggtgggcctcctttgccatttccatttttggtttctttccctgaaaactgtgtgcaggtaattccatgtgccattgttgaaaagaaaaaaaaaaaacaaaaaaaaaacctactttttagattggtgctggtgtaagtagccacttttctctcttgggtgtgtattttaaactttttttgtttttttaaattaatgccaaaaagaaaatgcataatttgtaaacttaattatatgtcttatatcttattagcttagtagttggaaccacttagtctttaggtgcaagactgttgttagatagtactgagaaaaaaaaagtatgtgttatgagactgtacatgtttttttaaaaatagcaatatgcaataaagagatgaattcattgggtgtacatatatgctttctatgaattattaaaacagtgtcatcaaactgctttgcagtttccaccattgaatttcaattttgcaaattgttcactgaatcggaaatatatacctgtttttaaacttgtacttactggacctagaagaatatagttttctattatggcagcattcagtatgttcaggttatcatatgccacctctttctatacttggtttatgtatgagttatacaatttcttgttataactcatgtatggtagggctactggtgaaattattcaactagagtagagaaaataatctctagtctctagaatcaaagcctttttgttttgaggcatgtttttcttattaaaaattaacttgatatgggtcagtatgggaaatggcacccatacagatcaagaaatttgtttatcagtatcctctgaaagttgaagctttccctttgtcctacatcacatttgctgcctagccacccttagctcaatttaagttcacgttggaaacaaactgccccagtgactgataaaatacccaagcagtccaaacactaattcttatcatctttggaatgaactcatgatgttcttgtaatagctgaccatcttgttttttatcacctcactgcatggcttcatagtaacaacgttctgtggagctgacactcagataggagagacccttctgcatgttagacaaatgttatattcccacccacaaactcagccactgcctatttgtatatttgggtatggaattatgtacagaaccacctagatcctcagttgaccttggtgtattaatagaaaggggggagaatgtgaaattttcagatcatatgcttcattgtcttcagtttccccaaaacaatgatcactgaaggaaatgtgcttctgacagaggggtgaagttatgtgatccatccagaactttgccccttttctataacctaatgtgcattttttttgttagtcaagggataacctttattaaaatactgtgctttcgacacaattacagtcatgtgtcatttaacaaggacacattctgagaaattgtgccaaaagct

SEQ ID NO: 75739 - DNA, 1233 bp, Homo sapiens
atgagaacctagttgtcttctgttaagccagacatgaaacaggtttgcaaaaatatcaaacaatgccacttttctcataattttttttgttttggcaaacagttattttcacaaaaatgtgttattcatatgttaatgtataatgggttatttttaaaatgaagtaatgaacagatatatccaattcctaatacagtaaatattgatagatataacttatataaagaaaaactctttggggtcctcaaatcttaaggtataaaagggtcctaagaccaaaaggtttgagaaccattaggatttggggtttttttttgtttttttgttttattttataatagtgttttatttgatataataggatgtgaaagccctgaaaagttgtggaacatcaaatttttgtaatggaataaaattttaaatgtgctaacagctaagtaatgaatcttatctcagtagtaaatgaaatctactacagaatgatctacattcagtaaattattctactcataaagagtcctttaacatagcaaacaatctatcctaatatagctgtttttaagatttggtgtttctgaatattagagtttccttaaggatctctacatcatatagtgatctgaaacatgtgaaaccatttatgttgtatgcaaaaatttggaacatactgtcttcaaaatctgaaatggaacataaaaataacaacatacatttattggatacttcactgtgcatcagtttccaagctaagcacttgatacatgccatctcatttaatcctcacaagaatcctacaaggtcagtactgtgctgttattatcgtttttcaatagatgataaaacggagaattggagaagttaggtaatttaccagaggttagttagtgagtagcagatccaggtcatgaaggtgggtctctgaacagaccacatgctgttaagcattatattatattgctgtcagacaaagcaaaaggtcaatgaggctttatattataggagctgttatgagaagaatctgggattgcaatgtccccccaaatagagagggagccgagagaccaaagaatgactcagacaagtccaggttggcaagtagatgcatttattagaacttccatataaggcactcctgggaagcagctgaacaactgtggagacccatcctgcctcctgactctaagctgcttttaagctaattttctggctctttgcctactgtgtatgtgtgat

SEQ ID NO: 75740 - DNA, 1062 bp, Homo sapiens
ggcgcatgtagcgccgcttggccagcagggtgggcccagacacctccggacaccccgccagcacgatacgcaagggctcgccgcccgtgtgcatgtccaccaccgacagcaccggcgtccctggatcatgcgggggcagccggggcaccgccagcgcgctctccatggtctgcgtcgggggagacgagtacggtcccgcagctatggcttcaagcccgaccctcacccactgactccgcgggaggagggcgggacgctaaccagccacgtccggggggcggggtctcggagcctaaacccggaagcgagggaggaacttcggagctgtcgcccgggttaccgggaggcggagccgccgagctcgctgtggcccggatgttcggtgcagctgccagatccgctgatctagtgcttctcgaaaaaaaccttcaggcggcccatgggtgagtggtcgccaagatcccgggaagcgtttctggtagtcccgactactttcctacacggctggcctcgggctcggctctttgtaggcggccttcggttggcggcgcaggctcgccccttgaccccgcccgccctcgggccgggctccgcactcctgcggggttggggtggtctgtccgcaacgggctactaggggaggcgcgctgtctgcggcgaaatgccaggtctttgttgtttggtccgaaatgtctcttcagtcccttagtttaatgtcgagggaacacttgcttgagggttgacttcggaattgaaaacgcgggtgatagtgcagaaaaaacagtaaagcagaagcaagttgctgcataatttgtctactgcttcaacctcaaacgtagatttatagcgcccgtcacaaagggcaggaccgctgcaaaaaaatggaatcttaaaactttagccatcgttcgctaaaggaaatgaaaggagaaattcaacagtcgcttggagcctgggttttgcttagtaagtgataggctgtttatttcagttcagtttatcatactggttttcaggccttggattttgagaaactttagattattgatattcacgtgtatt

SEQ ID NO: 75741 - DNA, 2084 bp, Homo sapiens
gttctgttatgaacataggtgataatgataattgtgtgtctacatgtgggtgcttaatgtcctgactgggcaaaatacaaggtggtgaccctctactggtgctctaatttaaaaatatatgtatatttgaactttataatcagttaaactcagaagtatcctctaatcataccgggttaggctttgagtcctggagatagatcctgctctgctggttgaggaccttaatcataaggcacggtattaacagcaaggttccaggataactgtctgcagtgtcacagtgtaaaaggagaaatgtaaatttaaaaatgcttcaagacttttgtctaatacatattattcaaaaatttgaaactgttatttttgccaaatgcttcagctattattgcaattattttttataatcacaaaagatgttactatactggcatttgtttttaaaaagctgtcgatattcaaccagcatgccttggactttattgtgggaagaccctattatttaaaaatggctcaactgaaatatatggagaatgtggggtaagtcttatgtttgtatcttatttcattttgtaaaatctatttgcttttgaaatattttcacatacaacattttttgttattatactcattaatttataaaagaatatggaggaccaggcgcagtggctcatgcctgtaatcccagcactttgggaagcctaggtgggtagatcacttgaggtcaggagttcgagaccagcctgaccaatatggtgaaaccccatctctgctaaaaatagaaaaaaattagctgggcatagttgtgtgcgcctgtagtcccagctactcgggaggctgagacaggagaattgcttgaacctaggaggtggaggttgcagtgagccaagattgcaccactgcattccagcgtgggcaacagagggagactctgtctcaaaaaaaaaataaaataaggaaatataaaagaatatggaggcattaatatagtcattgttcatgttggcattttgatgtctatattattttttaaaacatttaataattttataataatttctaatttatgatttggtaccgtgtcttgtacagtaagttgaacatcatgaatccagaacatttatctgcagttattcttatataatgttaataactaggtttttcattgaatgttagtcaactattttagtaacttagtaaaaggaatcttctaagagcattgtacaaatatagcacatacaatatagatttctttttattttacttatgccctcttttttatttctaaaagctgcacatgtaaacttaaatatttaaactgaaatgggatgtcttatagaatgatttgggggggtgttaatgttgtaaaataatatctgtacacaaaatattggttttatatattataggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagaggttagcacatttctatgaacatatctggctggactaatgttggaataattatcactcagaagaccttattaagtaattatgcttcttctgttttaaaagtggtaaacatgtttttctttatcttcagattattcttaactgtgacaagaaaacttaacaatagggcatgacttagtaatttttaagggaactgtccttagtctgttttactctcagtgatcttgaaggaatacttttacttctcaactataatccttattggttttctacacaaaattggttatgattacaagctatttattgttatggaacacattctttgtaatttaatttaatactaataatctagtatgatgtagttaaaaatgatatagctgtaacctaatacaaaaactcatattaacatattaaatcagcacacatttactaagcactgcattttatgtttggaagatcagggaaggagatataaaaataactgacatggcttatagtcataatcttgtggagaaaacaagtg

SEQ ID NO: 75742 - DNA, 1036 bp, Homo sapiens
gtaaaagcagtttggtacatggttgcctctaagggagagacagaggtatggatggggaggaacaaagatgtagttacaaattgttgacagtgttctagttattgggtaggagatgagcttataatattataattactatactttctaacaaacacgttacataccatcttttatgtgcatattaagattaaaatgatacacagataactaagaaatttttagcaacaatttggcaagatactaaagatgcagggtagatataatttctgcttttctgttacacatttagataatactgctacagtgttatttatcccttttgagaaaaaaaggttatactcgagtagtttttgacttttcttatagatttagaaatctgtatcttgacacatgtacatgttttattaaagccatttaaatattgcaatttttctagtaatcatgcctcttttccttctctagttccagcgcacttttccaacacatcactgcattatttgaatgcagcatggcagctattatcaccttacttgtgagtgatccagttggtgttctttatattcgttcatgtcgagtattgatgctttctgactggtacacgatgctttacaacccaagtccagattacgttaccacagtacactgtactcatgaagccgtctacccactgtaagtgtttatttcgacttaagatcattgtttttttttaaatctctgaggattattatagattttatggcgtttggagacaaaaacaggtgtgggtttgagttctgggtctgccagcggctttattaccttgaacatgtaaacagcctcttgtaacttcagttttctctttggtaaaatgggaataatgatccttataaggtgtcgtgaggattaaattaatccacacattctagataccatataacttacatataggaggcactttatagtaaatggcattattacagtgtttggattagtgttttttctttttttctccccaaataagtgtaatttctgttagaatgttttgttttcaaaatat

SEQ ID NO: 75743 - DNA, 1050 bp, Homo sapiens
actggtactattctagaatgcagaggagagaagttaattatttacattcactggatgccttaataaggcaaggttcttcaaagctggcccaaggatagtttttacaattttttatggttaaaaaatcaaaagacttatatttctagatgtgagtatgaaacgtatgttttattgtccataaagtttttattggaacacagccgtgcccattcatgtatgtattctctatggctgctttcccactacaactgcagagctgggtaatcgagacagagaaatgcagggctgaaactatttactatcttgccctttccagaaaaagcttgctggccactgcctcagaaccttaggttgtaagtctcacagaactggttgagaaaggatttgactctaaggaaaattactatttgaatttatttgatggtttattgagaaaatttgtttcatttccaacataataccaatgcttatctttcagattacgccttcccatacattatattagtgttatctttggttactctggctgtgtacatgtctgcttctgaaatagaggtaggaagtctttttttcctttgttaaagactttttgataaatttgacaattcaatatcagaatagtccatatgatatgatatagtacaactaattgttttagtaatctttggctgattgatgccacttggtagcttttggcttgttaactttatgaaaagttgtgtactggactatatatttccctgggaaattagcaaaatagtgaagtagtcaggcccaactatccagcatgaaggagaaatgtcatttcacataattttcccatgtagcaaacatataattattgaaatgttgaaacttattaacagtattttgagaaaaaccataaaaatgttttatatttagaactaattttaaactttattttacaatggcaacattaatagtcatcagtaattgtgcattccatatccttctgtgttttatcacaaattttattttcctgattatggatgtttacttttaccccataatgtttgggggatttggagc

SEQ ID NO: 75744 - DNA, 1050 bp, Homo sapiens
attaaggattaaaagaaaatcagagtgttcatgtgtcatttctgcccccttactattcatgcagcaggctccaggaatgttagaggttaaggaggttgggtttctgtacctcctatttcccacctgtagatccatagcaacagtggatcagggcaggaagcaagcacataaagtggagtttcccttctagttcgtatctttgagaagaaactatagtgtttccaggagtgaatgatggcatagactaggacttaagagacatgatgacgtagctttcgtctgggtgcctctactgagtgcttatatgaccttaggagcctcactttcctcatctataaagtggagtggctagactgagtgatttcttaagtcttttttagctcaaacattttatgattctgagattataaataatacattttatattaagttatattaaattacccagctgacttagcctgataatctgtatttctcttttctttcttttacaaaattatatagaactgctatgatcttctggtcagaaagaaaagacttattgttctcttcagccactggttacttcatgcctatggaataatctccatttccagagtggataaacttgagcaagatttgccccttttggctttggtacctacaccagcccttttttacttgttcactgcaaaatttaccgaaccttcaaggatactctcagaaggagccaatggacactgagtgtagacatgtgaaatgccaaaaacctgagaagtgctcctaataaaaaagtaaatcaatcttaacagtgtatgagaactattctatcatatatgggaacaagattgtcagtatatcttaatgtttgggtttgtctttgttttgtttatggttagacttacagacttggaaaatgcaaaactctgtaatactctgttacacagggtaatattatctgctacactggaaggccgctaggaagcccttgcttctctcaacagttcagctgttctttagggcaaaatcatgtttctgtgtacctagcaatgtgttcccattttattaaga

SEQ ID NO: 75745 - DNA, 1050 bp, Homo sapiens
tgggaggctgaggtggacctcatgaggccaggagttcacgaccaccctgaccaacatggtgaaaccccatctctactaaaaatacaaaaattggccaggcatggtggcgcacacctgtaatcccagctactcaggaggctgaggcaggagaatcgcttgaacccaggaggtggaggttgcagtgagcagagattgtaccattgcactccagcctggacaacagagtgagactccatctcaaaaaaagaaagaaagaaagcaaaaaagaaagagacagagagagagagaaagaaagaaaaggaaaggaaaggaagggaaggggaggggagaggaggggaggggaggggagggaagggaaaagaaaagaaaattgggaataagagacatatgtattgtaagtctgggtaaaagtgataagaggccaagaaaacctacttaagttgactaaatgaaaacctgacaagaaagtggaaaatcatctgaggagtgggtaccaggccaattacccatgtattattattataacattcttacatttttaaaaatccaccctccttggcaataatcactattcacttctgaatatttttttattctacatttgaacatattggggttccatatgaatgtcccattttgacacaggcgattttaattcctatccccatatttgtctttgctaaccagtagacaatttttgttcccattgtagtcctttctgtaacttttggtcctggccttctgattcccatgtctcttctttcatcatctagaagatacaaattctggaagttgttcctgcttaaagacctgggcggattccttagataatgaccctctactcaccaaatgcaatacaagactcaaaacccaaaaagatgattctgggccaggcacagcactttgggaggccaaggcagaaggatctcctaagcccaggagtttgagattagcctgggcaacatagtgagaccctgtgtgtttttggttttgtttaaaaaaaaaaaaagattctggatatataaactttggaccttgggcacagggttg

SEQ ID NO: 75746 - DNA, 1155 bp, Homo sapiens
cacagaatgtaagcaaacaaaccatgttgaacaaaatggtttagtccacatgtcagctccaggggctctctctctctttttttttttttttaagacagagtctaaccctgtcacccaggctggagtgcagtggagtgaagtggtacttcacagagtcctctatattttcaagtttgtttcaaagtcacataattcaggccactgtatggatggtgtagcccacagagctacacccatcgcgatatggtcaatggagattcaatagtcttttcttatatgtgaatttgtgaattatcctcaagggtggaaaagattcttccaaaccaaagtggaatgacagtaagtgcccttggcacagccatctgtctgctcacttgtgtttaggaatccagatgccaggtgagaacccacagcaaccacagcttggtggagtgagccacagcggctcatgtggcggcactgcgggagctcagctgggtgtgtttggtgtctcctgcagctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaagtgagtgcctcagctgaggagccctcacccactgaccaggggcttttaccctcacctgtatttcagctcacagatgcacttgagtcatgtttctctgagacccaacagacctcttagagtctcccctaacaccctgtctttgaatatctaacatttctggtgaatttctgaaacaaactcgattattcttattccaatacttattgctttgttgagttttcatatgtatttactattaacagtaatcataatccaacaattacttaatcctctcagcaatatcagaaaggcacagcaggcatttttgtccctatttacaggtgggaacactgaggttctgagaagtgacatgacatgctcaaggccaggtggccagtaaatagcacgaaaccaggactagggtatttgggtctttatttccatgctttctctagaagtttaacaccaa

SEQ ID NO: 75747 - DNA, 1010 bp, Homo sapiens
gacagcttggaaagaatgggaatgttctagtcctagtggttagacctagcaaacaggaatcacattcatttctaaccaaggaaaatgttaagccctccataaggataaagtagtttttgccttcagtccagcccgaggaggagtcattcgggaatagtataattccttttgtctctcgtggaagaaaagcagcagaaattgctgttggctgtggctttgacactgaaatccttcattttcctttgttccaccaaagctcatttaaagtggtggattaaatgctatgctcttttactatctatagaaagcaccaggcttaatgtgtctttcctttcaaaacatccacagaattatttaagagtctagaaatagtgttggcatttttctcttgacagtcatataggttgtagttaggaggtgtgagggaagggctggaaaatgaaatcaaaggtgtcttatcagcagaagtccgtgccagcagttttccctctgggctcagggctcctagattaccatgtgaaccttcaactgatgtgggatactatcttggtaaatgaaactcatgactagaagatgtcatctttgaaggtctctatgtttacatctacttctgttttctttctccagtttaatgtcaaacgagggaagattaaagtaggaaaaattacttctattttttcttgttaacattttgtggtgatattttgtttccttcatgaaaatcagtcagaaaaaaactggctcttaatcacctctttggacactgggttggaaacaactgaggtttgtctagccttcttactctgtccacaaagtagtcaattattgtagttaaatcattggaagcttgctaaaaagtaaataaatttcaacagcatatcatttttcaacagtccttttgttgaaatgctgatattatcaatgaacaggaacttgtcacattttctcacttggcatttacttatttatttatttagagatggagtgttgctccgttgcccaggctggag

SEQ ID NO: 75748 - DNA, 1020 bp, Homo sapiens
catctcagcactcactgcctatcttactaacactaagttagagaaagtgaactctcatctacctcatctgagatattttcacagacattctaacctttacaaatacaacaaaatttagcagcaaggccatgatcttgaccaatttataccatggttgtcactgtcatcaccaccatcatcaattcatcattctaaattctccgtaaatattagctacgtgccaggtgctgtcctaagttcttgttacatacctgctttaattaagcctccgtgagactttttttattactctcatgttataaaggaggtaactaagggatttaagaatgagaggggcagcagtttgccccaggacgtaactgggttctgaacacagaacattatgatcatgaagcctattcttttaacacttcgactgtactacccaaatccgaatggtgttgtactaggggaacaaagtttgattagaaccatgcatccacatgattctgtttgttctctaaagatcattttttctccccagatctcactgtactcaacaaattcacctggcaggatgcttagtagtatggttgattgatacatgtgtgcctggggctagaggtcacctcccactttactctgcgtggcagcattttgtagttacagattgccagaatgtaagttattgatggaagatgaaacactttccagagagcataacctaaaggcaatctttttttataaaatattttgaaacttttatgctggtctacagtgttcgtggaaacacttcaggatagtctgttctgaaaggagctagtctgaaacattaaagagctaagcattccagaatacaccgaggaaataatctgttttagccacagtaattgaaaaaaagcatgcctttgggaatagtatttgggaaagacattttacacatatacataaaggcagactaatatcaccttttatgaaaatcagcattttatttagacccattattattaaagtattatacaaatattacaatgtaaatat

SEQ ID NO: 75749 - DNA, 1044 bp, Homo sapiens
attctgagagatgtataggacaggaggaccaggaaagggacagcaataaattcaggttgccagggagttccagagaggaatcatggcccgagctaaggagttgtactgtgatcagaggctgagacagaggacaggctggcctagagggagggctaagaagcaatccaagtgaccatgtaaagctgccaattctagattgtcgattctgttccattaacctgtatgtatatgtgcccctgacaagagtccctggccaagatggcaagtgaagcttgactccggctcactctgttcaccaagccttgtgttgagatgcagcactgcagccacctggaggaggaatcttattccaatttttttcttccatatttctttttaattaacatacaatttatataccataaaacatacccttttaaaagttcagtagtttttagcatattcacaaagttatgcagttatgtgatttcaaaacattttcattaccccccaaagaaaccctgtaaccattagcagtcatttctcattccccccacctcccagctcctagtctgctttccatctttataaacttgccttgtcttgacatttcatataagtggaatcatacaacatgcaacctgtatatccagcttctttctcctagcataatgttttcaaggttcattcattcaaaatacttccttcctttttatggctgaaaaatattccattgtatggatatactccatttttttgtccattcattaactgatggatattttagttgttttcaatttgtgactgtcatgaacaatgcttctgtgaatgttcgtatccaagtttttgtgtgggtcttgaagattatgcctttgttttctttgaagaattttctagttttatgtcttatatttggtctttcatctattttgagttaatttttgtgtatggtgtaaggcagaggtccaaatttgttcttgttcatatccagtcgtcccaggactgttgttgaaaatacactgctgttgaaaatacagaaaattctctcccccactgaatggtctt

SEQ ID NO: 75750 - DNA, 1029 bp, Homo sapiens
aaaaaagaaagaaagagggagaggagaggagaggaggaaagaaaaaggaacgaaggaaggaaggaagggagggagggagggaaataaaattaaaaaggaaggtgttcagccctatggttattttttatgggaagctaactttgaacaatgagaaaatttaggaatatttgaagtagtatttgggggtgaggttcagttatgttcttcccgtgataaacatggaattgcctctttagagtagatagacaaatccctcttacataaaatgcttcagatgactgccatttctcttaaaaagctctcccatttttgttatatgctttcaattatctgaactgggaagtaagctttggtgtacttctaattcagggcaattttttgtctgcctggacccccataggcaggcggactggcaccacaaggcagggggcaagattctccttataaggaggtttcttgtaacaacttgtttgtttggtgcattgtgcttcatctattttatccaccattgacgtgctttctaaagtagttgtgcatccgctcactctagaaatccatacaatgtatttcacaagtactaagaactgtcatccataaaatagaatatattttaattatcctttaaagaagacaaggtaaggttgtcccttcaaatacctaactctcatctgtgatttgaaatgagtattcatagctccattttttgagacattttaaatagattattatgcaaagatgcataccttgagcaaacaaaatagtattatgaactttcatatatagataaacaaaatttaacaattattatcattttgtcatatttgttttgtctacttttgggaaaagcattttaaaattaagtcacagccaccaagacatttcacccctacaagcttcagtgtacatctctaaaaataggacattttcttatataactagttaggctcattattacatctaacaaaacaaatacttaacatcatctaatgcctagttcatatgcagattctcccaagaatcctccaaatg

SEQ ID NO: 75751 - DNA, 1058 bp, Homo sapiens
gggttggatggagctactactgacaatgtttgaaagttggggtcagaattttgtatatatgagttggggatttgggctgaggctttgctgaacatgatttttgatagtagcacaatagtgagtatatattggtataacaactcttaaaagagtctaaaggaataaaggaaaaagaatgtgtatctgggtagctttttgttctcatcactctgtgtgtgtgtgtgtgtgtgtgtgtgtgtgtgtgtggtgtgtgcctgtaattgacaaggtaatagaatttttatgaattctctgataaaattctctctggcgtagagaatgaaacacacacatacacatacttacacacagtaattagtcttttactagatttctatgattacaaattggatatttttgttgccattgctcttgttttgattttactttggaatggagtctggtgcttctgtacttaagaaaaaaaggttgcatttagaattcatccccaccttttattctaaggacagctaaaagtaaaggtggagaccatagttcacatgtcctgagtcacctgcctgtgcctaggatagaactctgcttctgtcccgggatgaataccactgggtaatcagtttctagaaaaaagtgttagttttgtctggaacaaagtaaaattctacatattgaattcaaaatgtgtacttgatgttaattagtaaaagcagctatgtgaatgccaggtcactgtttctctgtagaatatgatgtatgttcttcagattttgctagtttcagtaatttgttcataaggttgttatggtttgaccttggggcccgagtatattaattgctcaaaacaatatttttagagcctttaaaaaatatcaggctaagtttgtcacatgatttcagggaagttttcattgttgtattaccttgctattggcacatgaagtaatatagatcatttcaactcagcatgacacaatgaaaaacaagtttttttgttcattctgagggccgcaaacacaaaaaattgctttttaataattcccttcactaagaaaaatatttac

SEQ ID NO: 75752 - DNA, 1063 bp, Homo sapiens
tattatcttttgtaaagtgagaaaccattgcggttcaattcaacttagtagacttatgttaaatgcctcctttgtgtaaggatctgtgctaaacacaggtcagtcatgacttcctaaaacatgtgcacctttctgattcacagtatttaatttagccaaatagttccttttgtgttatttttcattttcttcattcccaagttattgctggaagcttgactagaagggaattataataatctaaccccatgggcacaagggtatgagttagttttctgagatcaacacaggataagtaaatatgagcacagcttgctcagactgtgaaagacaaaatctgtctttttgtctagctgtgaaaaacaaaatctttctctccctttatttctatcatctatctcattctctacatcttcaaagaaataactggctaaatgttacatcaagatctttggattagttagttgtgattttattcaacaattagattatttcagtggtgactaagggagttttgaaaacgatgctggaaaatttagagggcagtgaaaataaaagacatttcaagagacaaacgtatctacataggaatgctctaggctaaagtcattgtaaagaacatggtccaaaaatgaaagacaaccagttttgtttggttaaataatatttgagggcaaagagaacagtgagaagagtgtgagccagagaggcccactgtttgtggaagatgctgtagtgatagggtatgagaaaagggagggaagggcttctcaattcttatttgagctccctaatttaaaatggacagtgattcttaagttggaaaattgaaacatacagaaagagatactgggatcccaggataagtaaacagaaggtaaaatcttgtattactactttgatgagatcagttcttcacatccaactactttacatctcatggaattgaatgagtgtgctgagcagctttaaattcattcccagtatctttggagaataagactagggctagaaaagctgaaattgataagtgattttcaaaaaggggaaaatggtggattct

SEQ ID NO: 75753 - DNA, 1076 bp, Homo sapiens
aaacataaatatgccatacatcaggtaatttttcagaaaattattataaacttgaaatatttcataattattaaatataatttgaaggattatgaaaacattttagtcttaatttaaagagtcccacaaaattgtgtgtgcattaggattataaagtgcttacattgttataatcataaccatatgatcataatcatttctatatgattataatcataaccatatagaaatatgatatgtgatatatatgattacaattataaccatatataaatagatatagggttgatcaaaatttaaagagaacatgcaaaattgaaaatagttgtatttaaatggaaaacatggaatatatttttttcttttaaaacagttcattttgctggatattgattttgcaataaaatatgatatttaaaagaaaatatacttagaaacctacttcattggaaggattaatagcaaaacataaactaacattattcagtctccttttcttttacagaaaattgaaggtcttcaagaatgtagaaatttggaaaaactatatttatattttaataaaatttccaaaatagaaaatttagagaaattaatcaaattgaaggttctttggctgaaccacaatacaattaaaaatattgaggtaagataataatttcaattatctatatgtaaagccagttactactgtagagtttaaaccacaatgttcaagatcatattgtggttaaaggccaaactattcttgactagtacaattattgttgtcaaaaagaactaacatgtatatagcattttataaggtacagagggcattgtgtacattactttctttactctttacaaggctaagaggtagggcattgttattctttctttgaaggtttaaaaataaaaagaggtttagataagttacataacttgcctaagattataaatatactctgtgtgatgtattctttttcctcctactcctccttttttcctctctactccgcttcctgttccctcctccaataattctgagttccagtatagagaacaaaggtggcttcttggaggcactcatttcc

SEQ ID NO: 75754 - DNA, 1029 bp, Homo sapiens
cctatagtcccagctactcaggaggctaaggtgggaggatcactttgagcttgggaggtcaaggctgcagtgagctgtgatcacagtacactccagcttgggtgacagagtgataccctctctcaaaaaataaaataactgagcatattggttttgtttataaaaactagcaacttagtgtcaagtatgtgccagaaaggggtctgagaagtacagttataaatcctacccttgaaggaagtgaggagatgaaatagtaatgtgaggtttttcctcataggttttaaatgacattttcaaacagtgactttttttaatttttattttttagaaactgctgtgttacagaaaagcatgtgactttcagaataatcccgagtgaggatgagtccagatgtgcctctactgaatgattacaagcaggacttctttctgaagcgctttccacagactgttcttggaggccctcgattcaaattaggctattgtgcccctccttacatatatgttaatcaaattattctttttctaatgccatgggtttggggtggagtcggaacacttttataccagttaggcatcctgaaagactattatacagcagcactttcaggtggattaatgctttttactgcatttgtcatccagttcacaagtttatacgccaaaaacaaatcaacaacagtagaaagaatactaaccacggatatcttagcagaggaggatgagcatgaatttaccagttgtactggtgctgagactgtcaaatttctcattcctggcaagaaatatgtagccaatacagtttttcattctattcttgctggattagcgtgtggtcttggaacatggtatctgctcccaaatagaataaccttgctgtatggcagtacaggaggcactgctctactattcttctttggatggatgacactatgtatagcagaatattctttaattgtaaacacagctacagagactgcgactttccaaacacaggatacttatgaaattattcctcttatgaga

SEQ ID NO: 75755 - DNA, 1693 bp, Homo sapiens
taagatagcctggctaaaacctgtgtaaggagatggaactttcctgtggggggaaagaagaaattaaaatttatacatataaatattatatacagattgaatgaatttaagacaaatacaaaatttatttctaattttatgatagcaacaatagtagaagtaatattgattttttaaaaaccaacttgttacagaagaaaagtagaaaatagtttttttaacagacataattgttcacaaaattgtttgataaccccttttacttgccttttcaagtttgacttttctttctccgtctccgtagattgcagctttcttttcttaggttagtgtccaggtagaaatgttcagcatgttatggactgaatatttgtgtctctccagaattcatatattacagtcttaaaccccaatgtgatggtattttgagatgaggcctttgggaggtaattaggtcatgaaggtgggtccttggtatgatgggactagtccccttatgagaagaggtaccagagagcttgatttgtccctctctgtgccatctaaggacacagcaaaaatgtggccacctgcaagtcaaagaagagagctctcatcaaaacctgaccatactggcagcctgatcatggtctttcggccttcagaagtgtgagaaagtaaattgatgttgtttaagccactcagcttatggcatttttttatggcagcccatgctgattaagattttgctaccaagaagtgggatgcctttgtaccaaatacctaaaaatgtggaaatggctttgtaactgttggtaatgggtagaggctgaaagaggtttttttgtttgtttctttgttttgttttgtttgagatggagtcttcactctcttgcccaggctggagtgcagtggcacaatcttggcccactgcaacgtccgcctcctggcttcaagtgatactcctccctgagcctcctgagtagctggaattacagacatgcgccaccatgcccggctaatttttatatttttaatagagacagggtttcgccatgttggccaggctggtcccaaagtcctgacctcaagtgatccacccgcctcggcctcccaaagttctgggattacaggcttgagccatcacacccagccaagggttttgatgtgcatgctagaaatatggacattaagggtgattctgatgaagtctgaagtcccctgaacccagaggaaaggcagtccttgttacaaagcgtcaaagaacttagctgaactgtgtcctagtgttttgtggagccatgaagttggatacctacgtaaggagagttcaaagcagtgttgaaaggagcagttggcttctcctgtttctagtaaaatgtgaaaggagagagatggattgaagaagggattgttaagcaagagaaggaaccagaacttgaagatttggaaaattttcagcctggattatccatattgtaaaacatgagaaagcatattctgaagagaacaccaaaagtgtggggctggactgtccctcagtaaagagcttttggcattatgtgagtagaaacactgccagtttgaattgaagtggttggagacaggaagtaatgaaggccgacagttgaacttcttggatttgacaggatgtaatgatagaactgttcagctacaaaagtgcagtattcttcaagaaaaggggaaaattatg

SEQ ID NO: 75756 - DNA, 1053 bp, Homo sapiens
gatttgataattacaaagagttttttgtttttgtttatctgtaactaaaaagacaaagccagtccccacatctatttttaaagaagaaaatgactagtttatccagaaaaatcacctccagtttcacttttgattaagaaaataatagaattgagatcatctctagacaataggtgtgatactgctgccaaatgatgtatgaaatgcatggactcttcaaatttggacagttgtcagataaattgtttcttaattttatttcagaagatatgaaagggagcagaagaggcgaaccccgcagtgtagtaatattttccttccccattctttacctagtacagttgtataataatacttttaaatgacttcttctgtgcattttaatttttatcaaagacagacattaaatctacaatgcttagctcagacactcaggaattgtttgaatgaatgatacacatttatatcatcttagccactgtagaaaaaatcttttttcttggcatgtggatcttagtgagtgtgcaaaatttgaaacatttttatagctgttaggttccaaactaagttttcatcttaaaaactgagatttttttttaccttagaaaatttctattacattatcataagtattagaatttaaattatcagaagtattataatttaagtgtttttccatattaaagaattaaccacaataatgatccatttggagctaagtcctatatacaggagaataatcacaatgtttgattacttcaattatgttatccttgtatacgaatactttactttgccattgcttattgttaaaggaccaaaagagatttaggggtagaatctagttttgataaaagattttatgagcatacattatttttacacaaattatcctatccttgatagaggagtgttgtcttgggggaaaaaaaagtgtaccaatctacatgttttccttgaccttcctgcggcttactatttatgtgtggtttgattttcttgattttctgttacttgaatggtttctactcagaatgaaatgaattttatttt

SEQ ID NO: 75757 - DNA, 1072 bp, Homo sapiens
ctttccaaagttacttgaaattttaaattataaaattttaaaactctgaagaatcattggtagaatttcagccaatgtagtagtttagacatttaggggagaaatgtttttgctctggcctcagttgttcagttttacaaattcctgtattcaattttcttactactcagtgatggcttttaattacttcctcctcctttgcacatttgaattaacatattctctaaatgctaagcttgtacacaattgtataggggtagttgctgatgtagaaggacacttgtcacaatttgtatgtattgatcatttgtaagttgggactaagacttttctgtggtgtgtgtgtgtggtttttttttggaagggagtgtgttgttattctgtgttgctttgctttttcttaaaagatcctcttctatatatttcgtgtgatttaaatgttctttttttttatataggtttgtggtaaatatgccagctctagaacacatgaatcagattttacacatcttgtttgtatttttaccctttctgtgggcacttgggactctgcccccacccgatgcacttctcttatgggcaatggagcaggttttagagttcggccttggaggctcatctatgtcaacccacttacggtatttatttttaaatattgatgttatatgtaatattcttaaagaacatttttcttttcaagtaaatatttttttcttttttttttctgtacaggttattagtaatgttcatcatgtctgctggaacagctatagcatcatatttcattccaagcactgttggtgtggttcttttcatgactggatttggtttcttgctgagtctgaacttaagtgatatgggtcacaaaattggaaccaaatctaaggatttacccagtggtccggaaaaacatttttcatggaaggaatgccttttctacatcattatattagtcttggctcttttagaaactagcttgcttcatcactttgctggcttctcacagatttctaaaagcaattcccaggctattgtgggctatggtttgatgatattacttataatactgtgg

SEQ ID NO: 75758 - DNA, 1354 bp, Homo sapiens
ccctgactagtattagtaatatttcctgagaacttgttagaagtggaaattcttgggccctaccctgaacctactaagttagaaactctaggggtgggatcagcaacctgtatttcaaacagcgctccgagtgatgctgactcacctacagattgagaacctctgctctagtctaacccataccagaagacaaaaaatattgaggacattttgattacttaattttattctatttaaaaatgatatggtttaataatacctaataatgttgattgatcctttgtgctctgtgacatatgtggtttaaaaatatactttttggtgttactctttttttctgtctgtctttttttgacacaagctgggttaggccatgccatctattaacaattatattaatactttaaaatttacaaaacatgcaaccttcacaaccatatacactaggattattttcctttgaaacaggaaaaaggaatctcagagagggtaggtgacctgctcaagttcttgccagcacctggtggagctgtgactgaaaaacaagttctgaaggcactgacacctttgtaaaaatatataaataagcaatatttaaataagcagtagcaattataatagtaaatagtgacctgatacctccttttcaagtgattccttctaaggaggtaatcaaaaggtgtttaaaatttatgtaaggatatattgatgatattcactcagcatatatttgttgcatacccactgtgtaccagatactggtttaggcactactgacatagcagtaaccaaagtaatcaaagaagtaaatctgcattctgatgttataaatctggaacaggagactgataaattctggcacatccatacactgaataatgctattagtctcataaagtgggatggaaagcatataatactactgtatatactgtataattctaattttgctttttttctcctccaggattataatttaaaagtttttattgtgtggctcactcttaactatcattatagtcttttaaaattatattcatacctactaaatttgctcaatttctagtagaatttccataatattttaaaaaataatagtagcattatttttaatctctatccagaatcaaatgtgttaagtgccattaactttaagtcaggatgttgctcttgagttaaagaaattgtttttgtcattttccatatttttgtgatgagaatctatgggcatttacatgactagttgctgtatattatgtaataaatgattataaactcaagtactttttatttcttctttaggggttagaattgcaggaaacatcctgtcatactgcagaagctcgcagagttg

SEQ ID NO: 75759 - DNA, 1102 bp, Homo sapiens
cttactttatatacggtatttttaaaataactcaaaaatacatcaaagacctaaacataagagccataaaaaacttagaaggaaacataagggtaaatcttcatgaccttaaacttggcaatagattcttagatatgacaccaaaagcatgagaaacaaaagaaaaatagataaatatgacttcatcaaaagtaaaaacttctgttcctcaaaggacaccatcaaaaaagtaaaaagacaactcacagaatgggaaaaatatttgcccatatctgataagggactgttactagaatatataaaaaaaaaacttacaactctataataaaaagataaatagattttaatgtggacaaaggatctatatagacatttctttaaagaggatgtacaagttgccaataagtacatgagaagtgctccgtataattagtcatcagggaagtgcaaatcaaaactacaataaaataacacttcacacacacaggatggctaaaatcaaaaggtctgaaaataagtgttaacaagatgtggagaaattggaaccctcttctgctcttgggaatgtaaaatggtacagccactttggaaaacattctggcagtttctcaaatagttaagcatagagttgacatgtgacctagcagttctatccctaagtatgtatacctaagagaaataaaaacataaatccacatgaaaccttgtacatgaatgtttatagcaacattattcttaattgctgtaaggtggaaacaaaccaactgtacatcaattgctgaaaacaaattttattatatccatatgatggaatattattctgccataaaaaggaatacggtactgatacatgctacaacatagatgaaccttgaaaatatgctaagtgaaagaaatcggtcacaaaagaccacatattatgtgattcatttcaagtgaaatttacagaacaggccagtctataaagatagaaagtatgttagtggttgcttagggaatggtcagtgaggagataggatggtgataactaaagagtacaaggatgcttcttgaggttatgatgttttaaaacttaactgtggtgatggttgcacgtatctgt

SEQ ID NO: 75760 - DNA, 1032 bp, Homo sapiens
ctcctcctcctaccctttttactttaaagggaatttacactgggagagtgcttagccttcaagaattattgatccaagtgggaaagttaaatcctgaagctgttagaggtcagtgggccaatctttcatgggaattactttatgccacaaacgatgatgaagaacgttatagtatacaagctcatccactacttttaagaaatcttacggtacaagcagcagaacctcccctgggatatccgatttattcttcaaaacctctccacatacatttgtattagagctcattttgactgtaatgtcatcaaatgcaatgtttttattttttcatcctaaaaaagtaactgtgattcttgtaacttgaggacttctccacacccccattcagatgcctgagaacagctaagctccgtaaagttggttctcttagccatcttaatggttctaaaaaacagcaaaaacatctttatgtctaagataaaagaactatttggccaatatttgtgccctctggactttagtaggctttggtaaatgtgagaaaacttttgtagaattatcatataatgaattttgtaatgctttcttaaatgtgttataggtgaattgccatacaaagttaacagctatgtaatttttacatacttaagagataaacatatcagtgttctaagtagtgataatggatcctgttgaaggttaacataatgtgtatatatttgtttgaaatataatttatagtattttcaaatgtgctgatttattttgacatctaatatctgaatgtttttgtatcaagtagtttgttttcatagacttcaattcataaactttaaaaaacttttaataaaatattttccttccttttcaaatatccttctaatatatgtgaaaggagcggggttcatcccattcatcatgtgaatattcacaggaagagcaatgttagggtaatctgcatatgactactaaagcatatatctgactcattatgtatttctttcaactgaatttactgcttctgaaaaatga

SEQ ID NO: 75761 - DNA, 1996 bp, Homo sapiens
tgagcttcttactgattttaagcacaagtagttgttttgtgtgtagaagagcaactcatctttgtgagcctatcacaaaacaaaggtacctctgtacttctaaagaaattgctctaaaatatttgctcttttctagtttgtagtataatcttgatttctatcagaaatcaaattgtaaagttagactgcatattcaagttgccattctacttcctgtgaggccagccagctttttgtctgatataaccactagtcctcttcctgaccaccgagaggaactttcacagggccacccagaaatgagtttgttgccaagtcctgttgcagggtgggtgttagtgggagtagcaaggagcttgactgaactatggcatgacttccacacaaatttttgtctttatttagagaatggcaatttaaaagaaaaagatatacttgttttgccccttgacctgaccgacactggttcccatgaagcggctaccaaagctgttctccaggagtttggtagagtaagtagcatcttatattgatatagtcttgctttgaagtaactgcagaagagattcccatccgtggtgctgtcatacaaagggctttaggcaagtggggtccatgcagtgagatcgggcccatgagttgggccccttaatctctgagcctttgtcattatggaattagtacttttcatgtcttaacaagtacaaattcctccatgtagaacaaaagaagctaaaaattcacggctgcttttatttatttatttatgtattttgagacaaagtcttgctctgtcgcccaggctggagtgcagtggtgtgatatcggttcactgcaatctccgcctcccaggtttaagggattctcctgcctcagcctcctgagtagctgggattacaggcatgcaccatcacgcccagctaatttttatattttttagtagagatggggtttcaccatgttggtcaggctggtcttgaactcctgacctcatggtccaccctcctcagcctcccaaagtgcagggattacaggctactgtgcccagctggctgcttttatttattttaatgacaattattaactttcacaaaaagtcacctaaaacgggaatttaattccacaggtaaattcagggctttattttatctttttaattgctgacttctggaaatataccattgttccattgattctttaagttaacaaaataaccaaccatccataggaattccatcaatctatccacaagacatcccccaaacaccccttttctgattttatttaactagatcgacattctggtcaacaatggtggaatgtcccagcgttctctgtgcatggataccagcttggatgtctacagaaagctaatagagcttaactacttagggacggtgtccttgacaaaatgtgttctgcctcacatgatcgagaggaagcaaggaaagattgttactgtgaatagcatcctgggtatcatatctgtacctctttccattggatactgtgctagcaagcatgctctccgggtaaggctgctcaaactcaactctgatagaactgacttaaatgtgtatatgggggatatggccatcactgtgtgaggtccttggaactggaagtgatgtggggagacagagagacccaaggagacttttggtagaggacacccccagtagatgctaaaaaagacttgatccacacatgcctctaacttgttgaacaaataaatatgtatcaagcactgcattgtgccatgtactacaacagaccctggggatataaagataataagatgtggtctctgccctcaaaaagtgtatcatctatttaacatgttactcttcaccttatccttattcctactaaatcttcatggaaaattgggggtccacttctcctttcttctacatacacttcaggatgtactttttcctccccatttctgtgacttcttttccttgccccttgtagttggtgtttattttgcctg

SEQ ID NO: 75762 - DNA, 1045 bp, Homo sapiens
actttttcacagcatgatggttattttcttgtatatcttactaagcctataataaaagacagggctaaacccacaaatcagagcaaatttgataaaacattcatcttaagtttcataaatatgtgctattctaaattaagtttccaatacatttgcacattctcatagactaacataatacacaaacttatggaagtttcctgttatgctatgaatgttgcctacatctgacattagcttcataaatattcaatgaaaccacaaacaaaggtactatcacttttgaaatctgtccaacatataaagaaaggtcagcagcaattccataaaacagaagggcttcaattctgtattttcttttgctttttgtgtcagttgtttgaaaaacactagaagctgacatgaaattttctgtgtattgtctaagaaacttggttttctgattttagcttgagattttcttccgtaaccgcatctcctctgacagggagatcttgaagtgtatgttggggttccaacacttgattaataagctgtgtttttccctccaattccaaatgattttcagcatcaactgcatccatgtcaatatttgtcgtcttgggtaacaaacttttgggccttggatacaaaatccttgatgaatgtttgaggtgctgggagaggaagggatggggaggatgcctcaggctggacacttggacccaccgacaccagaagtttgatttcttctttgtcaaaccacaaggcaggattactgcccactgctactggttgatagcatttaaaagcttatcatatcagtataaaaaagatccctggaatgattagactttcccaaaaaaggagctgaagccttcagagataattagcttcctcatcctgtgagggaattagagatgggtcaagggcttgagaagagaattctcaaactggagtgggggttgaactatcactttcctttcaactcttaagaatctactttcaggggctcttaaagggaggccattatgtataccagattctgtggaatcgggaaacaaac

SEQ ID NO: 75763 - DNA, 1066 bp, Homo sapiens
cccctgggagggaggcggggagacttcctttgaaccgggcttagcctcgaaaaacctaattctgtagaaattgcttaaggttttacagggggcagggctgagagactccttcagaactcaagtcagtgagtgatgcctctagttcattcattattaaggcatcgaacaaatccattgaagtaaattccgatttcttatccttttaactacgtaaatcgggtaaaacttcttgatgttagagcttggttgaggtatggttctgttctgcttgtagattttaaataaacttggagccttttcttgaaagacagctggctgtggagagccttctaccaactgcagttttagatacgttttgaaaatttcatcacctgaggtatttttcttctctcctgaaacaccacatggtacaaatccacaaaagtcatgcttcagttgtccaagccatgggatctgtgtgctagccccacctccccgcaagtttcctgctcattggaataatgagctgaatgtgttttaagaagtggttggaagagtatgagagataggtatcattttctcaaaggaaatgattttgacattattgagagaaattagacattttaacaattgttttgtaaaacagtcttttcaaacttgcacgttggggttttaaacacaaccactttacatgtgttgcgctccgaaaagtggagggatttgttgaaacactactctgctgagacttagggttccagagcacttgggaatttagcatagcttggtccccaactctctttgaaacactttacttttatacttttatcttgctacatattgggccttttccaaagattgtatttctgtaactccttattttacaaatgagaaaattgaaaataaggagattctctattcttagatgctgcttttactgacttaatgctttctttaccaataaataatttgaagcacaaagtaacatttcctagtgttatagttttgttcttgttatgtgtaacttatatgtatctgattaaactttcagtcatgtaaggatgattacttttaacctggaagtttacag

SEQ ID NO: 75764 - DNA, 1422 bp, Homo sapiens
taccaggcttttcttttgctgaggcaggtcagagctagagaaagtaagcaattgagagaggcaagtttctgtatacctgtatctaaaatgtaatagactttataatttttgtaaggaactgaggaaaggtacaggcttttaatgtgtatcagtaaactagactcttatacagtttttataatattagagatgttttaagcttccttgagtaaatatgtgataaaggggggatcttgagtttttataattcttaatatgtttatttggaatccattgaccaagtgtatgtagtatccatatttaagatctggattaaaagtgattagtttctgtggctgatacgatttagaattaagatcttttgagactaaactacttctagatacagaagaacgtcatgaaagccgtactttcttggccatttatttgtgttaggctttaattttttgccataaccctctaaaatatgtgatgttatcttcattttataaataaggaaatacagggtcagagaacctaaataacgtgccaggatcagatctgggtagatataaaagtatttttcaagatattactgagtggatttttcccaattagatgaacctccttattaccaggaaccaaaatttcaaaagctaaacattaacacttacgattcatagattcctagagttaagcaagtccatgttagtttatgtaaagtcttccaatgcaagactaatgttttcttctaaaacattcagaaaagatttaagaaattaagttcattttctcattcccaaagtttcagaagttaacaaagctaaacattttatgtcttcaagtaccattgtttaggttaaggaatggaatccatgttaattctcaagtggttgatatccttaatgaaggatctagggaaatgtttctgaacagatgtaatcagtagagccacattgaagggccccgtggtggacatggtgataaaactaacctttgaaagaaaggacagtttgagtccctgttctcctatttcgtagccaggtgttcctgggtaagctacttgatttcttaaacctgtttttttttatgtcaagtggaaatacttttgtcgtaaggttatcttgaagatttaatgaaataattatataaagcatttgagatcttttctaccatgaagaaagtgccaaataaatggtagctgttattattgagtatatgaaatcttgagatacttaggggtatagagacttgcttagtatgagagggttgtctttcagtatagcttttgcagtgtgcctggaagccaaactagagattgagtagagaatttagaagacattgtaaactctgtgagtttagagagcttgcatttgaatagactaaaagttatagaagaaagagaaagttgagtatgagtagctttatttggctctgcaaagc

SEQ ID NO: 75765 - DNA, 2152 bp, Homo sapiens
ggaatttgtgtctttccttctccagctttggttttctcttttagcaaagctcatttctaatatttcttcttccacaaagtcatctctgacccccagagtgtttaatctctcctttctctgtacttaaagcaatgtctgtgtattatttctatcatatgttttttttttttttgttttgttttgtttttgagacagagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctatcatatgttttacctttagatatttgtgtctaaattataattgcattcagttaattctaaagggaaaaataaatttttactttacacaaaggctagcggctagcacagtgctttatggatagtagacattcagatatttggtaagtattaagcaaaatctacctggagtgaaagtgattgttgtaggaggaggtagtagaagtagttacaagctttatcgtagcagacgtttctgactctcttcctgaatgttattttttctgaacctggatatttaagtgtgaagattatacaaatctgaagtgtggcagtgttcttatattgatgtagaagactaggttgactgatcctggacctacaagcttcattttaacttcctacattttggctttgagggttaacaggacatttataatcacatatctcttttcagagtattttacatttgcaaatattatcatgaactttgtgtccttttaaccagagaggaattgtggaatcacaggaattagatgatgtgttaaagaagagagataactatcagctgatttaatttgaacccaacaagtatctaataatatgcatactctgtgttcaaataaacctctaagctagactttcaagcttatcaaaatgctagactattttcagtgtttagaaaataccagccaggtgtggtggcttatgcctgtaatcccagcactttgggaggctgaggcaggtgaatcacaaggtcaggagatggagaccatcctggccaacatggtgaaactttgtctctactaaaatacaaaaaattagccaggcgtggtggcacgggcatggtggccacccgcctgtagtcccagctacccaggaggctgagcaggggaattgcttgaacccgggaggcacaggttgcagtgagccaagattgcatcactgcattctagcctggcaacagagcaagacatcgtctaaaaaaaaagaagaagaaaaaagaaaatacatagtaaaatttattggctttttaaatggataatttcatatagtcagtcagtgccggcttagatccatttgttagagaacaatgctaatgagacctcttgatactttgtgttcctcttatgttttcctagccttgacgttagcaactaacaatgataactaacattattgagctcttatgtgccagggactattacaatagattttcaattattatctcattaaatcttcatagcagccctatgagctagatactgttactacctatatcttaacagatgaggaaatttgaaacagagcagttatttgccaagagtttcagagctattaacagaagcctaatacatgttcttggactttgcagaaataatttgttgatccatgcggtttcattgctactgcggaaagtaagtctcttggccattgtgatgggtcaaaatctttgtacatgaagggtatgactgttgttccattgtatccagagagtgaatcttgtgattgagttgggatttgaggtggcagtgtatactaagtttgaaaagtatattatcatatgttagctccctttagaaattttccccaagaagagctattacattttttaatattaaaaaagcataagatatggccataatacaattagttccacaagccatacacacttttttcttatggcttaaaattttattcatgt

SEQ ID NO: 75766 - DNA, 1803 bp, Homo sapiens
gttgacaagggagaagccaaggtataatggctgttattcatctgtctcatgtattcgtcaagtgtcatgtgttaaatatgaacaaaaaagacataatctctttcctcctggatcttaaaatctaaagtgagagataattcaccagataaatgctgcgataagggaaatagaggattctatgagcttatgactaaggatagatctgtttcctcagatgtggaactaagaagtggcagtagttgagaagttcattttgggccatgcgatttgaggtgtggctattcaagtataggaggtaggtggttacacattttttaagctattaaatagaactttcacttgaaaaggtttttttctctctttcctcagcatctatctccctacatacacaaaaaaattgcatgtcacaattcatgaactcagtgagtgactctattttgaaaaatgttagattatatcaactgaagtctgttagaggcaaatgcttttggtcatttttttcagcagggacatttcatatgtgtaaaatatttagaatccccatgtatttatatataaatgaatcttttaccatcttaaatgtttaataagttatatttttcctttctttcaacttaagtatacaaggttatcagcaaacatttgtagatgctctatgtgaggtgttttgtttattagttttaaggaagagaaaaaaggatggattggatcaggaagtcagttattgttttctgggttagtttgagtccaaatcctcaaatatgcggcgatttataagtagcaaactaggaatttaatccacttcagttttggataacttggataagacactttctgtctatagatctgtctatagataacttggataagacaagttatccaaaactgataaatctgaattagttaacagatgaggcaaattgagattgtaaatgctaaaagattattagaaaactttataaactaaatagttctatgccatgtctttttagtattttgcttgtactataattgtagtgaaaataggtcagtatctaatttttatagtcactagagctctccaactaaatttagcttagatgtttttctagcaattatatacttacaaagtttacttttaaaaattgtgtaatacatgcctttatagaaatttaagaaaacgacttatggattatgtacttcagatcacagcacaactagaagatgttgatacattacataaaaaatcaggaaacctatgaagaacatcaaaagtggcaaggtgtgttcacttgcactttgtgagattgaaactgctgccattatctgtgcaaactatggtttgagtacttttaatttagcaaagactaattattttttaaaaattttggggtaaaaaaaatggtctttagcgtagaagagctttacccgacttactttagttggttcaattggttgattttggtttgctttttgaaattttgtattgtcttaatttggggcacattgaactcaataacagttcagttgcattataattcatttgggtaaagtttattgttggaggagggtaagtaaatatttaactgaaaaagtgaagtaaatatttatttaaggctataagttgaaatatttgtcagctgagaaattttcaggtaacttttttaacctttgaaaaaaatttactatagcatgagtattttttatactgctatgtataatccatagtcacgttttttaacctttttatataaaatactgatacagaaaaccatacaatcatagtaatcttttaaaattgctttataattcacatagcgtaac

SEQ ID NO: 75767 - DNA, 1025 bp, Homo sapiens
ggagtgttatagttgaatgcttctgtgagcagtcaattagaggagggctaaaaatgtcccttagattaagtgacttggaggaacttgatttagtaaaatggccagacagccttttggagcatcaacattttttttaagaagtttaactgtaaagagaagagaggcacatgggtagctcgaggggaataagtcacatgaaaagttatttttaatgggtaacatgggtgacacttgtggctttaaaagtcacactccaactgagaaatgttgataaaaaggagaaaaaggaaaatagtgtaacattcctgaaaaaactgtcatttaagactcctttgaaacatgggcaccaaagctagtctagtagaggatttattatcagtgagaggacagagtcctattacagcagaaaagtaggaggggagggttatgaaagaattcattgaaatggttcactcatttattgatcttttttttctgtagtatccaatctgccattcattgtctctattgcaattttcagttcagtaaattgcttctcatttccatgaaactattttcagagtacctcttttttaattgacagtctgcaattgttttattcattcaatgtcatttcatatcttggttagtttctaattttgagctaatgaatactgagtctccctcttttcaacttctgaattaaaaaaaaagtcatcttatttttctctgttcatttttacactttatttagcctaagtatctgaaattggctttgctagaaattacaattagttcactgttgttttctttcagtcccagacaaaaaagaaaaattttagatttctttcttttctcttcttccttttttttttttttaaggtcatttatctttggcagttttagagatttagaaaagaaaatatatagacttgtaggcagaagaagatatggcactgagggaagttttagttttgttctgtgacagtcttccttatcttgtatgttgtctttaaaaagcctacacatttagattttcattacct

SEQ ID NO: 75768 - DNA, 1092 bp, Homo sapiens
taatattttattatttttatttttttagagacagagtcttactctattgcccaggctggagtgcagtggcaccattataggtcactgcagcttcaaattcgtgggcccaagcagtcctccttcctcagcctcctgagtagctaggactacaggcatgcaccactatgccccgctaatcatttttacagagtcacgctattttgcccaggctggtcttgaactgccctcaagtggtcctcccacctcagtctcccaaagcactgggattacaggcatgtgccaccatgtgtggctctaatcatttttaaagcaacaatcagtgggaaatttcagctccaaatgggagaaaaatttccaaagattagccttttttttttttttttttttacagatttgctacagttttgttaatgtgcttatttctcattaccatagataactttgagatggctgccttggattacaaactagaatttattactatttcacatagcttgggaaattaagtgtagtttgtgtagcctaaattatcctttatagagatgtagctgcaagggttagcatttcttctttgaaccccaggtatgcagtatattgcttaatactctattgttccataaatatgcattccagaagtcagctgaccatttgtccttatctttgaggacaaagcccgtacatatgtaagcattagtgagcaatgtagaatataaagatttggtagcagtagagagtttacgctctacatcccactgcaagtaatttgaatattgccatattatccactgtgacctgtgctgtttgttaacgttccttttccccaccttccccgaggagcttgtagtctctcactatatatttttttctctttggatttcccttcagcctttagatttcttatctctaatgcaagtctactctagatttttctcccaaatgtttaaaaccaaacctattatctcagtggtcatcaaaggtcctctagttaccagtatccacccttcttggaatgcctgtttagcaatgttcttttgttatatgagtaagaataactctggtatttgctaagagaatataattttctccacattg

SEQ ID NO: 75769 - DNA, 1018 bp, Homo sapiens
gatgactgtgtaaacatagtatttgcaagtaagtactttttggtattatatttatataatcagctcttgtatccatgtagcttatagttggctgcttcaccaggactctacaaattgctcagaacccaaggaggtaagatttttatattgcctgttttcagtatgtaaaagtccagccacaaaactattaatttacccttgactatatttttacagttgctgtggagctgaacctaaaattttgttagatggttacttggtttgttacatttttatatactaatttatatactataataatatactgtatatattttttaaagtctggggtttgtttttagaaagtatattctatcttcaaagaattatttggtagtttcatgtgtgtatctggaaaataactactgtacttctttataaaagtgagagtgaggtccctgctagttgaggctggaatctagacgtggctgtttatgtaggagttagtaattaaacagtgcctgtttgctgactgcctcatttttgccaggctctgtatgggtgccttgcaaggcattgcctcatttaaaccttgcagcagcattcagaggaaagtattaatatgcccactgtacagatgaggaagttgaggaatgctttattagtaggtgtgaagtgtcttaagcataatacctccctcctcaaccttgctccctcatcctagttaagggaattgagacacagagataaggcaatttgctattgaccttcagcagatgacttaacctcaccgtggcttagtttcttcatgagtaaaacagggtacctatcttttaggattggtgtgaagattaaagaagttaatacatatacaaaactttagaacagtgcttggctagtagtaatctctccataaatgttagatgttattattaagcctgtgactacctgttatctcatgtagttgttcagagataaaaatgtaggctataggaaagaataaggaggaaagccaggctcctaatctgtctaagataga

SEQ ID NO: 75770 - DNA, 1452 bp, Homo sapiens
taagaattatgtgcacctcagcttagtaaatacaaatatacacttgggacaaaaacttcaagaaacagtatttacttacttttatcacctgggatgcactctattttgttctgttttgttttcttgagacgttgtttcgctcttgctgcccgggctagagtgcaatggcatgatcttggctcactgcaacctccacctcccaggttcaaacaattctcctgcctcagcctcctgagtagttgggattacaggcgccagccaccacacccggctaattttttgtattaatagagacagggtttcaccatgttggccagtctggtctcgaactcctgacctcaattaatccacccacctcagcctcccaaagtgctgagattacaggcgtgagccactgcgctcggcctattttatctttttcaaatgcagtttacacacaacccagctgattgggttgtgtgtaacccatactgattaaactgatttatcacccgtgttcattatttttaaaacgttgttttgagatctataattagaagtggaattgctgagtagttgcttaagtgtatcttcaacttcttcaactagctgttgccagttgcaattcagagtggttgaaccaatttaaactcctatcggcactctaggggagttcctgtttctccacattctgaccaactcttgatattgccagatggatgagaaatggcatttgttttaaatgtgccttcccctatttactaatgaagtgtttaaagtgtcttttaaaatatatcacatagaagtttaatttaatggtaatcagagctggcggcaaggaggaaatattattgtgattgactgcctcctctggcagaaaaaatggtgtaaaaattatataataatatctatattatattgagtatttataatttgctagacactatactttgtgcactgtatacattattttatttaatcgtcataagaatcttgtaaggttagtgccttcttatatacttttttttttgagacggagtctcgctctatcgcccaggctggagtgcagtgatgtgatctcagcttggctcagtgcaacctctgcctccaggttcaagccattcttctgcctcagcctcccaagtagccgggattacgggcatgcgccaccatgcctggctaatttttgtatttttagtagagacggggtttcaccatattggccaggctggtctagaactcctgacctcatgatccacccacctcggcctcctaaagtgctgggattacaggcgtgagccaccacacctggctgccttcttatatgcttatacaggaacagatggagaaagagattcggaaaggttcagtagtcacactattactaagtagtagagccagaatttaaacccacattggtctaatttcataacttattttctttagtacttcatgctattggtgaattcgtag

SEQ ID NO: 75771 - DNA, 1993 bp, Homo sapiens
cagcaacacaatgaatgtctgcttatcgcgagttgtgaattcccgcatatctctttcacttattaaaaagattgtttggtacatattttgtttataagacagttattgactttcctgtttctcttcctttgcagacctagaggatcaagacataatgggagcatttttagacaagccaaagatggaaaagcataatgcccaggggcagggtaatgggttgcgatatgggctaagcagcatgcaaggctggcgtgttgaaatggaggatgcacatacggctgtgatcggtttgccaagtggacttgaatcgtggtcattctttgctgtgtatgatgggcatgctggttctcaggttgccaaatactgctgtgagcatttgttagatcacatcaccaataaccaggattttaaagggtctgcaggagcaccttctgtggaaaatgtaaagaatggaatcagaacaggttttctggagattgatgaacacatgagagttatgtcagagaagaaacatggtgcagatagaagtgggtcaacagctgtaggtgtcttaatttctccccaacatacttatttcattaactgtggagactcaagaggtttactttgtaggaacaggaaagttcatttcttcacacaagatcacaaaccaagtaatccgctggagaaagaacgaattcagaatgcaggtggctctgtaatgattcagcgtgtgaatggctctctggctgtatcgagggcccttggggattttgattacaaatgtgtccatggaaaaggtcctactgagcagcttgtctcaccagagcctgaagtccatgatattgaaagatctgaagaagatgatcagttcattatccttgcatgtgatggtatctgggatgttatgggaaatgaagagctctgtgattttgtaagatccagacttgaagtcactgatgaccttgagaaagtttgcaatgaagtagtcgacacctgtttgtataaggtagctagactttttttaaaaacataaaatgattttatgccatattaatcactactctagtatttaatcatcttagaatctgtaattctgaaaccagtttttggcacaactgtaggatactgttcaccaattatgaaaatatatcataggaccactatgtagaaataaattacccaattaccatctctgcaagagttataagctgaatgtttagtcttactacttgagctttgtaataatgtggaagattatcaaaggtaaaaagattttatcagagtgcatgttttgaaagaaagagggtggggagggttaggcctcagtgtctataaatgaaaagcattttagagttttaatatttgaccatgtgatatctcagtacatttatgatatcctaatcctttgaaactaaggtttaatggtctgtagcacttgaaagaggaatgtagtgatcattagacgtgatgtaatagaaatagccttgtacatggagtcagaagaacttgctctgagactgtgtatggttttaggtaagctatttaaactctaatcagtttttttcatcataaaaaggataagacattattatcttgtctcatggcgttgtcaggaggatcaaatgggataatatacacaggtgagctagctcagcccctttattttacagatgaggaagctgaagccagagaaggttctacaaacttaagagtcagacagacctgagaccaaggcttacctctattagttttgtactctacattcctgaacgaattgttcaacctctctcagctttaaaatggagataatagtatcttataagactgttgccgggcgcggtggctcacgcctgtaatcccagcactttgggaggccgaggtgggcggatcacgaggtcaggagatcgagaccatcctggctaacacagtgaaaccccgtctctactaaaaaacacaaaaaattagccgggtgtggtggcgggcgcctgtagtcccagctacgcgggaggct

SEQ ID NO: 75772 - DNA, 1555 bp, Homo sapiens
cccacaatttataatttattttaaaggtaattttatcaggtacatataactacaggtcaaatcctattgtaaacaatgccactaaaattttctgtcatgttgtatggaaggagtgtgtgtacacatgtatatttgtattaggtatcacttcaaattaagtcaccagtaaatgtttagaaatagtattgttttatagaattataaaaaattattattacagtgagattaacctgtaatgtttctctcctgtcttttggagtattggttatactgtattctctctatactgttcgggggagggggagtcattgcacacacacacgcacgcatgcgtgcacatatgtatttttttctccctgaaagtaacattttcactagaacaagtataactgtaattggcacagctgtaaaggttctcaaggctttgaagagcaaaaagaaaactaaaatattctcaaatttttttcttcccagggaagtcgagacaacatgagtgtgattttgatctgttttccaaatgcacccaaagtatcgccagaagcagtgaagaaggaggcagagttggacaagtacctggaatgcagagtagaaggtggatcatttaacaaaaaataagtagctttattaaagaaaaatcttcaacacaatcaaactttaacattttagcttttagatttttatgtgtctttgacagctagtgtctagtgtatgaaagtggaaaaggacatttctgtagtagctgttaagatgtatgcagttgtcctatcacagttatattagaaataacaactagtgtggaaagtaacccacattctgttcaggatacttttgttttaaaaggctaaaatgtttgtgtgctttaaaattcttaatgaattcactggcatgagtaattttatgccgggaaaatctgatttgtggtctatttaattacaaagagattgtgatggtgataatttgaataccatctttctatgaaaagctgtgtatattaattttaatctctagggccttttttcaataacttgaaaatcacagcctcatcattagcaactttatatacacagctttaaaaaatttgctttaaactgtttcagagcttcttccctaagccataaactgtctcacctaaacaagatagacctcaataaaagacataatatttctccacctggcagaaaagtaactgccaagtaagattaagaaataagttgagcatttctggagtatatttctcataattctgcagagacttccagtttattgcatatatgcagtaaagtgtatatattatgcagtttctctaagtggaaaaacttgacatgactttaatagtgttaaaacatgaaaatgctggtgagctgaggtagaaaaaaaacaagaaaaaaattttaaaaatagcgttaaaatgcattttaggctcctaatgtcgttaatttgcacgttaaagacctctaatcgcatgcaagcattgacctaccacacctacatcccactgtgcctgcattattgaaattactactcactttaattttttttcccctttttactgttt

SEQ ID NO: 75773 - DNA, 2208 bp, Homo sapiens
ataagtattttaatatttttactatgaaatgggatccaattttagaaatgaattgctacttttctctttagtgtgtacactttaagttttagatggaattatgaaatattcactttacgttattttgttacaataataagttttatatttcttattatcaagcaagagttgccacctggacagagtttacattgatactcaatatttttgatatgttaaagtgttattatacttgtaccattcaattggagattgtcataaattaaatatggtattttttactcagatttgatgagactgcaactagagaataaatattacattaaaattgctgctattttaaaacatagaatgtaactgtttgtattgtaaaagttgtgtgtcctcagtgaaaaatactgccttcagcttccaaagcaggcacctgaatgcctttttcttttctctctctcttctttctttaaatacatgccttcactagattgctgtgacctactaaacctcattttatttgcttggaacatttttggcttctctgtccacaccatagaaaaggacaaaggccttccagctctccttttctcttatttgttcccttctaaatacttgactctctgggggtgtgaaaagattcagctcataatttatactactattaattttgtggtccttctaagccaatttaaaattatacttttgtgtatatattttcaaaatctttgctactgactaccttagctttaaagttgctaatttggagatgactgatagaatccctgaaacttggtggaggggagtggaaaggagcagaatgtgtttgtgtatatgtatgtgaaacatggatcttctatatataaatattctttagaaaaagcgttcagtctttttacaattctaagtaaaacgtataggtcaacagaaattaaaggaatatttcttaaaattcatttatttttcttttttgaaagcagacagaagcaaggctagtatagtatgaatggtcaggtagtttaaatgcgttgtcccacgtggaacaggagatattaactgtttttaaagctttacattatttttttacaagaatttgttttcctgtaattttcttcacagttaaaatatcctaatttatattttaacaaaagagatgtaagatacatcaaatatagatgattcaaggtaatgttttttagacctgaaactattgattcaatttatcatcagtgtttatttctattgtatctagttatctatccaaataattgtattggcttagcggagactgtatgttaagtgtattagttttagattgtgaaattgtgcagtttaggtaaacatcaaatccctttatttttgtacagcagatttccagcattagaaccatgtagaacaaatatactagatgttaaagattacacaataaaggaacttggcaaaccaaatctgagatccttgctttttgttcagatttaagactgtttttttttttaaggcaaaaaataatagatggtaaaaatttggcctttattctaaaaggacagtttgaaccatttaaagaaatattatgggtagccatgtctttaaaaattttgaggcctgatcaaaggacgaatctttatacacattgttattttcaaaggtatttacaaattgagaagcagaatgatgatttcttgccccactaatgacaaataaaataccatttcttaccataaacattgaaaaacaaactgaacaaaacttgaccatataacttacaaatacttttgacttgaatttgcatgtggagtatgtgtgctaaaactgcaagtgaagactttttatacttagaggaatagttgtagagttctttgtaaggttctttgttcataattttttatattttgtgatgtgaataatagtatgcatctgcatgacaacactgcagatcatattgctgtgcccttttaataactggatattttaaaattattttaaatgcagttgtatggtttatcaaatggttctctttttaaacattttataaggaaatttagaccttttctattcaaggctttgttgaagtaatcagtgaaggaaatggtattatatatctatacagtatattgtttaaaggtactttagagaagaattaaactgagacagtgatgttcaagtacataatctgtgcatgctatttaagtatcattttgcaaatataaatatatacat

SEQ ID NO: 75774 - DNA, 1064 bp, Homo sapiens
tcataaatcttcaaaggtcaacctgattttttttttttttaaatgataccagattagaaaaatctcagatgtggtaaatgccatctttaaaaagctaggttatctttgtttcggttttcttttcaattaaatttggataacacttacaaaaaaagtacttctgattcccagaaatcataaagaagcagggggaaggcgtccccgacttagtccatgtgatgcgcacattagcgagtgagaacatccccagcctcccaccagggggtgaattggcaagcaagtaagttacattctgtacactcttatgctttatgtcagtgtatgaaaatgttaggtattcattgataaaatgtttgtttgcctaatttctgaactgatgcagttatctgtgttttaacctgtgatttcaatttttttttagtattagaatatctagagtttgtttagacataggtatcagtatcattgtaactaattgcagtgagggttgtctttattggaagcttggttggcattgatttcctcatagagcataaacgagataatatactgaaagaactttttaaactaaattacatagcactacataaaaatttacaaaattctaagtgtcgttgttagtagtagtataatttgatttggtcaatccctgagtaacttaacaccctgaaaattccccttcctcatatggaccatgtttctatgcctgattttcccagtatttttggttgttgattgctggttagttggttttaggtgtcagggaagaagatagaatatatttcttgtcttttccctttccactttagttcatagaattggactactttgtgttaaatattaagcttacacctttacataataaagtggaaaattcaagcaattccaagggttaaaacatttttacctcaaatatccatataattgacttacaaacataaaacttgcaaatacctttagcttgaatttggatatagagtaaatgtgctaaaactacaagtgaagacttcttgtacttacagtgaagatatattattgactaattttctcgattctctactgtg

SEQ ID NO: 75775 - DNA, 1831 bp, Homo sapiens
tccagttaagtgttctgttgcaattctgttgtatgatgtttatagaaaagtgataacttaaagatcatgtgggcacagctctgaaatattttatgtattgcattatgaagcttcctcacatattgagttcttaatcttttctgatgcattaaaggtttataaaagtggtattctaaaactgtattggatttcattaaaaaattctttttagtagatttattgattgagtaatacatttggacagcctcatcataaaaccgcatttcaaatattttccaaaacaaaacaaaggattaacaattctttgaacagattaaacattgctatttcatatgtacacatatatacttatatactttaaaaaacatttatattctaaaagtcatctttacagaacattatctttctccattatccagaaagtatggtgtattttggcaccgctaaattttaacgttgttccttattttgcttccttttacaaaggactctacatcaacagatgatatgtggtaaaactgctcatctagccatggagtttaccttcacctccaaaggagagtacagctcaactttgttgaaacttttaacatccatcctcaactttaaggaaggggatatgacatgggtgagaatgattacatcagagaacttcagcagtacaacagctagcccagaactgatttttttttttttttttgtaaatttgagacttatgtaagcgtgatttcaaaccataattcgtgttgtaaatcagactccagcaatttttgttgtatgattttgtttttttgtaaagtgtaattgtccttgtacaaaatgctcatatttaattatgaactgctttaaatcactatcaaagttacaagaaatgtttggcttattgtgtgatgcaacagatatatagccctttcaagtcatgttgtgtttggacttggggttggaacagggagagcagcagccatgtcagctacacgctcaaatgtgcagatgattatggaaaataacctcaaaatcttacaaagctgaacatccaaggagttattgaaaactatcttaaatgttcttggtaggggagttggcattgttgataaagccagtcccttcatttaactgtctttcaggatgttccttcgttgtttccatgagtattgcaggtaataatacagtgtattcataagaatctcaatcttggggctaaatgccttgtttctttgcacctcttttcaagtccttacatttaattactaattgataagcagcagcttcctacatatagtaggaaactgccacatttttgctatcatgattggctgggcctgctgctgttcctagtaagatattctgaattccattttatcaataaagcttgatttaacaaacaagaaacttaatcatgtatgtgtaattcctcttttaccctggccttttaaaacactgtgccgttgtaatgagacgtttctcatagggaaagatgttagtctcttttaattggacaacactgtcactcaaggcatagatgaaactttccttccattagaaagactaaaagatttaattcttggttgtaccttaatctattttttaaataggtttctttcaggctgcttatttttcattaagatgtgtatcagcttggatttgcctactgtttaattaaaatatttattgtcaaagtttgacaatctaacactctatggtaggggtgtgtgtgtgtgtgtttgtgagtgtgtgtttgcctgtgatttttaattggcccatgtctttagaatccaagtggttaagatgtatttgtgatttgaaatatagcatgttgataatatttagctgt

SEQ ID NO: 75776 - DNA, 2089 bp, Homo sapiens
ttaatgtctaaatctgtggtagagtgcgaagtatgataatgttctaagttatggctttgcaagcatctaaatgtgcatttaatgaataccagtgcttctagtatagactaattaccagacatactggtactgaaagctaaatccctattataacaaaccagttccttaatattttaagtagactgacaactttagttccagaaattgcaaaactttgaactggactgtgtaatcttttgagatgcaaaacttaagtcacaagtagagtatgtgatggaaagctgtatttcaaaccataacagcatatttagagccttttttttttgagtctttaaacaagagaaaattaaaatattcctgtcaaaattattagtattgaaattaggcttggacacgagagagaaccgtatttgagtgatgtgagaagactaaatcttttccacatgagtcagcactgccatactaataatttttttactataaaaatacaggaaggaagtatacattataacagcagactgtgtgtgttcctgattcctggaggtaatagtggggggaaaccaaccatactttttaaaggcacttttgcacctctattgtgcacttcattcttgtaccacttaaattcttcacccccatcccctttttttgtgctaattagcatctcagggcaatgcctcaaaaatgtttgatgtgttctgttctttggagggaaaaagttcttatgtgatgataatatagtactcaaaatatacttttatcatttaaatgtcttatttgctgctatgaataggaaataacattttgtatagcaggctctgttttaccctaacattaaaaaatttcactgatctttctttcattaacagggtagaatctcctaatttccactttcttgggaatatacttttatagacaatagaagcagttctcaatattagcatatactttaaaaaatcaaagtgataacttaattcagctttggaagtatctcaaacatatttttactttatagtgcattaacttgcttctagagtacttaatgcaactgctctagccacttaattttttatactaatctcaacattaagaaatttggattaagtaataaattagttatgtaattcaagtaatctgaattacagcagtacttttagtgatcattcataggactatatattaacccagctaataactcagtttttttacaaaatgtttcgagtattattggtaaaacactgttctaggctaagcacattgggactgtaaagaaatgagtagatccttggcttcaagtttacatctggacaatttataatctagtgtatgttagtattataactggatcactcatcaaaaaatatatatatatatctattgcccacctgctatctaccaggtacttagctgatcaaggcaggcccctgccctaaagaccttgtttatacttcctttactcacctgaaaactgttctccagtttattttcttctctctaaagttaaagagtaattcagaagaaaattttgcttagcataagaataaaattggactgaagaggcttaagcccattcagtatccttgattgcatttatccaacggcctttattcttcctgctgacagcagtaactcagaggaataggtagtagatttctgaaaattatccagccatggaaatgtaggtggggtttgagtttaaggcatttaaaaatgtaaatatctctagctaaatttatcttaagtagaactctgtgtttttgtaacacactgccagtgttaatatcaaattttagccaaattattactatgtgttttaatattttaaaataatttcactgcccatctttactggacaaactcatttggagttcaacttgtgatttctgaaagaactgatgaaattgggtactgctttttttctccatttttcgttttgttttaattttgaatttcatggtatatacttttagttcaaactcagctgtttgtacagtattgtattaggatttggtattagaaaagatgtgtaaatatcttagtatataattgtttctcatttgaggtttttcttctaagggaccttaaagag

SEQ ID NO: 75777 - DNA, 1038 bp, Homo sapiens
ttaaagtttgagaagaattgatgtagttttttaaaaaccacaaatacctttgctcagacatctatatatgtttagtaagcagccgagttgattcttataagttgagttgtcaagtttggaggtcactggtctttgaggctcaaggttcagatgacttttatgctgatgacatgaaccaaatttattaaatcagtggaactctctctgaaagtttggtacaggtgagtttatctgtttagtcatccatgaattacaagaaagcttattaattatttagttaaataatgacacatttagtcctccaattaggaaagctcaacactaggaaggaggattttctccttatgtaactggctcattcactcccagactgagtgtaggcatgaggaaatcttttgcttggccatcaaagccgcccccacccccttcgaatgttctgactttctttataacagtacctttcattcagaagaatacaaacatcccttgtgctgctgttcagtgatgttgagggctgtactggaggactgtgtctagttctggacctcacaataaaagagggatgtggggaccttggcaaaggttcagaagatatttgtaaaggttattttttaaattcagaatgaatcttcacattgtgtggcattatctataaaatggacatgaaatgaactttgactgtagcttgagatttttactttaagagaaaagcaattgtagaaataagtggaggaagaagaaagaatgtctcttgagcacaagttctcaccttgtgcattagttacaatgacctggagaaattttttaaaaccccaatgccagttaagttgggggagtctttgtggttgggacctgagcatcaatagtttttcaagtactccaggtgattccaatgcacagctcctgagcagtgctgctgcaactttaatgtcattggcaccacctgggaagtttgttaaaatgcagattgtggccggtgcagtggctcacacctgtaatccaagcattctgggaggccaagatgggcagatcacttga

SEQ ID NO: 75778 - DNA, 1223 bp, Homo sapiens
ataatattacagcttatttaacatccatatatcaactatagtattatataacagctatggatatatctatattacatacaacatatatcaatatcatataattatgttctatattatatatattacatatattaaatttaacaatatagctcaatataaaatagtgatacaagatatagcaaatgatacttttttcatgaaaaaaattcaagtagatatttcatcttggaaaacaataatcaagcatttctcaagctactagattaacatttactgaagttaatatcactttttaaacaggtatataataatctgaaaaatacattatttgacttccaaatccttggtaatagtgatccactatgttctaaaatgtcttaccctataacagtttgcacagttgaatcataatttaaaaaaaaaaacattttggaggtacctagtgtctgagcggcacagacgagatctcgatcgaaggcgagatggcggacgtgctagatcttcacgaggctgggggcgaagatttcgccatggatgaggatggggacgagagcattcacaaactgaaagaaaaagcgaagaaacagaagggtcgcggctttggctccgaagaggggtcccgagcgcggatgcgtgaggattatgacagcgtggagcaggatggcgatgaacccggaccacaacgctctgttgaaggctggattctctttgtagctggagtccatgaggaagccacctaagaagacatacacgacaaattcgcagaatatggggaaattaaaaacattcacctcaacctcaacaggcgaacaggatatctgaaggggtatactctagttgaatatgaaacatacaaggaagcccaggctgctatggagggactcaatggccaggatttgatgggacggcccatcagcattgactggtgttttgttcggggtccaccaaaaggcaagaggagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccctatatgcgtagtatttgagttgcgaataaatgttccatttttgttttctacatttaatgttactttcctgtcctaaaattgaaagttctaaagcatagcaaggctgt

SEQ ID NO: 75779 - DNA, 1062 bp, Homo sapiens
atttattgtatgcagtatgctataattcagtaggttataaaaattttatataatatgaagagcatgatattgtaatgtttatcttccttaggaaacttacttgagaagccagaaggagaagatggctttacattttcttttccatcagacacttcaactcatacatttggagctggaaaagatgattttagttttccattttcatttggacagggtcaaaattcaataccttcttcttctttaaaaggtttttcatcttcctcacaaaatacaacacagtttacttttttttgagctagtcattaattccttaaattattttactgttctgtgttcatgagggcataaatttacattattgcttaaaacatgaagactgctttcttttattgattaaagcagtaatgtttacattatttgattatatttattgaaatattgaaatactgaatattttgggttttgtgtgtgctattaactaatcattatttattttggttttgattttgcgagccgtggtcaggtagaacttttattaatcttaatagaatttgatgcttttttcattactctttatttaaatattaagcctgcttctccttggaacctaaggtttttttctggaagtattgttggtactttgataagaacaagaactgcagtagtaactccagagttagtgctgaagcgtactttagctactaaaaatttctattaaaattattgggtttcacttctgcttcactatgtagtatacagagtggtactgtaataataatttcaaataatttatgttaataacaaaatctgtgttattttcttctaatataacacatggtacaattctaattttatgagttatgctaatgctttcaatggctaaaaattaaatgtaaagggcaagagtaatttctgaaaattggattgttgtatcagtggtgatcctgttaatattcttttttgcttaaatattttttgaagaacatttacaattttgtctccttcaataacaaaaatttcttctttatgttttgtgttcagtatttgtcaattaattatata

SEQ ID NO: 75780 - DNA, 1013 bp, Homo sapiens
tttttataaatggtatttaatgctatgagatcagaatgaatctaccaattgtatttattaaatgtctgccatctaaaaatttaaatctatttacatcctctttttttttgagacagagtttcgctcttgttgcccaggctggagtgcaatagcactatctcggctcacggcaacctccgcctcctgggttcaagcaattctcctgcctcagcctcccgagtagctgggattacaggcgcccagcaccatgcccagctaattttttgtatttttagtagagacggggtctcactatgttggccaggctggtctcaaattcctgacctcaggtgatccacccgcctcggcctcccaaagtgctgggatcacaggcgtgagccaccgtacccagcccacatcctcttttttgacattctcattcatttgacactcattcacttcagtgttttcaaatataatacatacagataatgaacaaatttatatcttgctgcactgacttctaaactctaggaccttatttctgattgtacagtttaaatctctttagacatcttttgacattaaaaactcagtgtagctgaaatgaaacttgctctccttctgacgtccctgatggtatctccattattctggcttttaaggtttggagcatggtaacaattttaacttctctctgtgactgtgactacattcaactagtcattaagttttatcagttctctctcttaaatatttatttttattttctattttcattgaaaccattatatttcagtcttactgttcacctggactgttacaatatcatcctaattggtgttttccatttttcagcttacctatagatcacagcttaattaatcttcagtgcccataatgttggccatgtcactgccctaatcagttaccttcagtgactcccccactgactatcaaattatgcttctacttttctaatttagctccaactacctgtttcattttttattggtatatagttgtacatattt

SEQ ID NO: 75781 - DNA, 1034 bp, Homo sapiens
actgtggctgagctggtacctagtgtgcaagataaaatgccctttactttttcctctgcttttcttaaacagatggggtcttttaccatagccaccatagctgggaatgtgctgggtcacaactgaagccagcacctctcagagcccaaggcccacagcatactacctgagtatcactcctggttattcagggcccaagggctctttagtcagtgggtgattaattctgccaggactgggtccttcccttcaaggcagtggattcccttttaggaaggattttaaactgcattaggaaaatccagcctatcaaaaattatgggatgttgcaaaagccagagcaaaaaatagctttaaataatttagctaataattacataataaaaagaagaaaggcctaaaatcagtgacctaagatttcattttgagaatctagagaaagaagaactaagcaaacctgaagtaaaatgaagaaacaaaataagagaaatcagtgaaatggaaaaacaaacaatagaggaaattaacaaagtcaaagttgattatttgaaaataattgacaaaattgacaaaatccttatattaggaatgaaagagaggatgtaattataaatcctaaatattatgaaacagattggtgagggaaacttactttctaaatattcaaacatcctataaggttagagtaataaagggcatgataacggttttaaggactgattgatcaatggtatgggctagaaaatcttgaaaccaaagattttataatgtgataatgatagactacaaattaataggagtaaattacgcattcatcttacactgtacgtcaatagaagttacagatgcattaaattatataagaaaatgttaacaatatatttctgaagaaatataggtgaatatttaccaaatcttaggaggaaggattctctaagcatgaaaacggtggaagaagaagcaaaagaaaataattgggtttgattacatacaaaatctaaacttctttttttaaattatgctttaagttctag

SEQ ID NO: 75782 - DNA, 1092 bp, Homo sapiens
tttctatatttagaaattaaagctgaaaattgagacatgctttattcaaaaagtagaaacattacagtgtagtggttaaaactagactctgaagccagactacttaggtgtgtaccagatgtgggattttgggtaagtggcttggtttccttatctgtaaaatgaaataataactattatcatagggtttgtgagtattagagtttatacacataaagcacttagaaaagtaccaaccacttaataatcctacataagttttaatgtgatatgagtaatattgttattgctcatttaagttaattacatttagccaattttatgtggattagaatattttatttgcatatatctgacattaaattgttgaaattacaaatttattgatggatgatatagtactatacatgttatagtattttacatcttcaacttttgtctcattttttatttaaatgcttattttaaaaacaagtaattcctaggagtatgctaggcatgaaagtagactatagttacttaattctcatttacaataataacatgaatgcaaaatgcatgtatataaatgtaataggaaacatgtacactttgaataaggaaaactacaaaactactgaaaaaagttaatgaatacataaacacatgcaatacttgcataggaaaaaatattgtaaagataaatttcttcccaatataatttataaatatagtccaattcaaatctaattataatcctggcaagtttgtatttaattttttgttttgtttttatggtggtgggattggggaaggagattggcaaaataattaataactgtcctgggggaaagtggtcaagaactatcaggaaaatattgaaaaataagattgatgataaattaaaacgaaattctaaaaaattcaaccccacaaggtagaaaagaaacaataaaaaaatacacacagtaaaaaaatcataaaacaaataaactttacaccaaataatgtgctttttaataattatattttgtgaatgggctaacactcattaaaagacaaagattgtaagaatggaaaaaaaaaaagcaagacccaaatataagctatcta

SEQ ID NO: 75783 - DNA, 2407 bp, Homo sapiens
attgcttaaaagtacatcatttttcactttcaaggagatagcctatgtaattgttcacccaaagagcatattgtggaaattttaaaagaaaaatcattcctagtcttttttttcatcaattccaatatgttctggctgtcatttactttttcaggtagaagtggaagatggaactggaaagaaaagaaaaaattggataaatatttatttttctatattttgatatatgttttagtattactttcaccagttattcttatttcagttattttgtctgtgcaatgttaacatcatggattaataaggtattttccacctcatgcatttttatgtatgtcattaatgcagcagcatttgttttatagttttctgttactttgaatttgcaggctatatatactgaacattttgggaagtcagtagaaaatgatagtgatgaagtagaagagagagctgagaattttccacgaacgtctgaaattcctatatttttaggaactcccaaagctgtgaaagcacctgagtcattggagaaaataaaattccctaaaacccccccgttcgaaatgtaggattttaattaataactattgttaaattatttgtatgttgaattacataaataactgataggaatagtaaaatgcttagtacctttaacaagtttttattatgtagtatttcagacatgcaaagaagagaaagactaatataacacacctccatttacccatcaccctgttttaacaattattaatacctgttttaacaattattaatactctgctgttcctgtttcatagaccctcttccccatttttcctgcaacatttagctgaagatggcataaatcccacgtacttataaagcaatagtgtgtagatttgagatttttccaaaggataaagaaaatttaaaatgtcaagctaagcctagcatagtggcatgtgcctgtagtcccagctatttgggaggctaagggaggaggatcccttgagcccaggaatttgaatccagcctgagcaacatagtgagactctattaaaaaaaaaaaaaaagtcaagctaaaaagctgttgtcacatatggtagattgtagacttatcatcaattaatattccatcagtcatttcttcatatgttgtagtgtctgaagcaagacttgccatttttattaagcaagctctttaggcataaatatctctaacatgattattaaattttggaaaccacgtatttgtagtttgcagccaagaaaatagtgctgcacttaacctttatgtttagtccattatcttccttaacaaccctgaggtttctctaaaacatatgtcaagcagaattcactgcatcagggttgttttgcatcagacctgtactctacttccgtattttaaattgctaataagagttatggatttgaatgtcatgctgttgactcaagcacagcacattcgaaatggaactcatcatcaaacctgagaactgtaaaataatgtgagctcatacgctaagacctctccccatggatgagaaaactatcatctgtaaagttaagtgactcatttatggtaatagagatagttatggcagtatcatcagatttctattaaatttaacaaacaacaaactgtgcaaggcactgctctagacattttataaatactgctcatttaatattcacaacagccttattaggtgtaggtacattattatccttattttacagaagaggaaacagaatcacaggtgatacaactaatcaacattagaatagaaatttaagcccaggccgttctggctctagaatccatgcttttaaccactggtataaactgtcttgtctaattatttttcccaaatcatattataatttaacttccttatacatcactgtaatggctggcttctcatcaacactaaaatcttgtaactggcattcaaaatcttgaagacagtatagtgtcaaggttaagagcttggactttgaatcgtgattgctgcattcacctgccacctttggcacttattattcttttaagcaaatcatttaacctttctatgcttcaaaattccctactgtaaaatggaaatgatagtaatagtacctatttcatagggttcttgtgaagaataagtaagttatgccttatttaactttatttaacattagtctccacctcatacaatcctttctcgataggattgtcacttcaataactacttcctacatttccctactatgctaattctcacctctatgctgttgcttatgatgcttaccagtattcagtgtttaataatagatttttaacattttgataatttcttatttctcagtaacagaaatagaaatgcagtacctgaagttcaaacagaaaaggaatcccctggactttcttttctta

SEQ ID NO: 75784 - DNA, 1050 bp, Homo sapiens
atatgggtggtataaattttaaaaggtttatcttaaatacagaaatactactacaaatcattactatacttgtcaaaaacattaatttcttaaacttttttgtttctcaatattcaacttaatgttttgtatgtagtggtttcagttaatgtgtgtagttgttgatgttgataatgatggtaatgatggaaaggatgaaatactaatgaaatgagagttctgagttgctaacgacaagcaaaaaatttttattgctttgtgtagccaagtcagatgcttaatttctttctttcagatatttaatgactctgctgtggataaccattcaaaatgttcacatattacgactatcacaagttcacaaaagtttatgcaagtcaggtaactttttaaaataagaaaatgctttaatctctgaaataatttatagatatcaactcagaaaaaatacaaaaattatatttattccattttagattgttaaccccacagaaacaatcaaattccaatcagtggtcggaaaaaggggataaaggtatttgccgtttatatttttcttctaagaagtcggggtaacaaattatatcaggtttttacattagtcaaataaattgtttcgattatttgcatctctggttaactgaccatgcacgcctggctttaaaatacatcttccctaaatatagaacaaatacattttattgtagaatatttggaaaacaaagatataaagaaaacaaaaatatcactactcagacataactgaacatcataaatactggtgcataccatttttttctatgcatttttattctttttccctccaagtttgaatcatatacataattttttattcttttttcccacttgatatactgttgaggttatttctctatgtcagtaaataggttttatttgtaatgactgtataatgttccattgtgtggatatgccataatttacttagtcattctttcatgtggaatattttggttttttttcagttcttttactattataaataatgcctctatattcttttacattaat

SEQ ID NO: 75785 - DNA, 1620 bp, Homo sapiens
tcctactttttttggatgtgttattttcttgattcctccactcccatgtaccacattcagtgcaagtgtgtctttaattttataatgaagttaattgaaaaaataggtaaatagacagaattttactttattgaccgcctttaagaaaaattccatgtattgacagaaacatataaatatttagtcatttttaactcaatatatattctgacactgtttattctatttcttcaatttagataaaatttagtgaaaactattctttcagtaaaaaacttaaaagacccatttatgattataatactgttttaacaatttctgtattcatgttggttgatttatttctgaatatgtctttttaaagtttaaagtaccatgaaatctgaagcatgctatttgtagttacaagttttggcttaaaatgtttttgacatgtgtaggaagtcttttgcaatgattatattttaaaaataagagtggactatattgagaagagcattgaacttaatcaggggaagtgtgtttttgctctgacaccactactaagtaattcagtcattttgggcaagtctattaaattctttggaactcagttttattatctgcaaaacgaggggttttattatatagtatctaaatatgcctcctagctttaaaatatgttaattttaacttatctaatatttaatgtaattcacctttctctttagaatttttggaaaagatgagcatgtacttacattgaataaaactcaaagcagtcaattatttcttccttatgaatctcagaaattagtaagaccaataaagatgcattcttcagaaccaagagttgcaggtataatatctgtttgttattcaaaaacatcattttttttgcaaacacacagaagaaatagaaggaagcaattttatttatcatttggtgtaagtaaaaacaatactggagacctataaactcaagagagtactgctttgaatctttctgagagcaaacaaaatatgtcttctatacgtaacttttttctctttgagaaaggaattattcacacaataaatttcaaaaaaagtgttctggcctggttgcacagctgttagaggaggaggaaaaattacatatttttcatttgaggagttgattatcaatatgtgtgacttaggcaggtaaaagacttatgctaatagtatctataacttagtcactgagatatttgaatcaagtttcattcagtggctctgcagattaaattaactattaggttggtgcaaaagtaatcatggtttttgccattgcgtttaattaaaatttaatggcatttaccattacataatggttttggcattaaaagtaatggcaaaaatcatgattacttttgcaccaacctaatacattatattagattaactacattggctggtttctttgtcttctcaaccactctgtcttctttggtaacccattataaaggtacagttttgtcagttggccttttgtcatttcatcttcatagttattgtaaagctattatatagtaaggaattaagagttttaaaataatttcataattccgtattttaatttaaattaaaaattcatgtagacttgattttctaaattac

SEQ ID NO: 75786 - DNA, 4126 bp, Homo sapiens
agggaagatagaggttccacaaggagtaagtgatcagaagaaccaggttctgcagtgtcaattaggatgagtgctaaaaagagatcattcagttggacaaatttgatcattggtgaccttgggaagaatagcgtcattaaaatagtgggagtaggagttaaaatgaatagaattaagaagtgaatcactcaggtaatgaagaaaaagagtcaagttgagaagtgtggtggagttaaggaaagtctaaagggcagacaatattgagggaagcaagaataagaagacatttgatttgccttttatgtttagtagactttaacagtgtattcacaaagtttttagatctgttgttgttatataaacatcatttcttttaattttaacagagaaatgtatcatgattatatatgtcagtataaagaagttttgaagcagtaccaactaaaatactcagaaacacccttttcacgtgaatattatgagaagaaaagagaacatgaagaaattcaaagcagagtgttggcatgtactgaacaattaaaaatgaatgaaacaatttttatgaaatttcgaggtattaatatttttgttatattgttttaattatgatatctttgtaatgaaaagaatataataatcagcttatgctgtgactttatttttcagtgcctgctccctttccatcacttactaaatggactttaaacatgtatccacaatagtatttgtacttataatttttattagataagcattattttgtattttaattgttactgtgtttcctttgtgagaataacatggatttgttttgtgtttaattaaaatatttaaaaagtaattttaaaggtcatcttggattcattttcatgtatattcatgtgatcagaagcaagcaactttggtgagaataaaatggcatatgtatttgggtttaagtggcgtgtcttaggaaccaaaccaatgaaaatgttatattggtctgtcttaccaaagaaaattccagttaaattgcttattacttgttagaatggaaggtgcaaaggaggtgagttacatttattcattcatcactggaaacctaccttatgccaggcaatactgaagacgatacagagctctcttccaaggagctctgggtttagtagggaagactgacatgtaaataaataattctaatacagtaccactgtaatagatgcctaagtaattcttaattggtctaagtctcacctgtttgtcagagagatcttccctgatgatgaacttgaaactttaatcctctttcaacctccacaatccttcatatgctttcctatcagattataactccactgtttgtactaagtcttctttatccccacatcctaccttgctttctgtctgcttcattctaaaccatccttttaactcttctgctgctagctttttccatgttttggttttagtctcttctgttttttgttgttcatttgctgcccatttgcgctttaacttctcagtgggaaggggccaaagttagtagacgctggtatagcaagggtttagggagttggatgtggaatgggatgacatataaggttgcatgacaaacaggaagaggtgaatggaggtaggaagatttgaagattaggatttaattatctgtacctaacattttaatggaaacttgataataatagacttataaatcatgattcacttgaaattttatattctagcatataaatcatgcatattttaaggcagaataggaaagccctgattaatcttctctggaattcttgttaactgtcactattctatcattttcaaattctcctaaatggattataatttaggacattgtattagctaataaccacgtggaatgtattaatagctgaggattttttacttgaaattgggcacaaatccagttcaagtagaaagtccaagtcgaagatctgcctgtcttttgagttctgtagggtacactgatgagccttacagagcaagaaaagggaaatttggtcgattttgtttttctccagcatactgttgttggcttgaaatgggtatactttaaatattgtctttgaacaaataaataatggaagcataagaagttaaatttgggcctgaattatgttttattagttatgccaagtgacacaatgaactttgatttaaaaagcaaaaaaaaaaaaaaaaaaactaccctgtgaaaatacttaactgaaataatcctaacaaatattttgtatgaaatgtttttttaagctcagtatataacataaacaataaattatctgttagtctgccaaatgtttatattattctcctgttttcagatactgtttttaatattgcttactgtttatatgaaacatacatataaatgatgtcacataatattaatcatttctgatatggcacatatattataaatataaaatttacttatatgacatagttccttaacataaaaagtgttaatttgagatgtgaaacacaagatattcttaaacatgccagcaatcttaccaaaagttcatccgaattgaagaaagaagtagatgaaatggaaatagaaattaattatttaaaccaggtatatattttgttatatatttctaatatgtgtattaatgtataagtataatggtatgttagttgacagttttagaagagctatttttaagagagcctaatgtggagaaaggtttaagataatttagattacctttggagccaaaaggtattttaggtactgaatatattaatttatattttttattaattttattaatatattttatattaatttgtatataatttaatatatatatttaggtactgaatatattttggggaatagtttagctttctttgaggtctgaggagagaacatgaggaaggaataagatgcaacatagtaacaggattttaaaggcattaaaagatctacgccagtgttttttaaaaaggtagtaaataaagaatttaaacttgaaaaatatatgactataatctttagcgagctaggctagaactagtttagcctttaaacttttcttggaaacatttggatgtcatccatgaaattgtggcttttatttacatagctatgataacccatcaaagtcgcttccaaattctgagaaaaatttgactatgatacctgattttctaaatttttgaaaattatgttaaatactgtatacttatctttcattaagtatgaggtaccaaataacagtaatatcattttagtaaacagaagaaagtagatgccatttcctttaaaatatatggtaactgtccttaatgtaaggaatcaatgtctactttgcttataattatctgtttttaaaaagatgggagtttgttaaaatctacatttgccaatggaattgtaaggaaaagttaaacgggtgtgatttattgttaattttgtttttgttttaataactgtaaatagaagatagtaaatgctatcaaaaatatgaatcttatgattatatagaaaaaacataagataaagcatatctttttttactgctttgcaagtaattattttgttttgtgttcccaattgtctttttagcagatatctaggcataatgaaactaaggctctttcagaaactctggaagaaaagaacaaaaatacagaaaacagaaaagaactgaaagaaaggtataggtaacctttaaaattaaattttatgtgaacagatattttgcatctaaaagtttgattctatattccatcccaaaccactaatatttacacagtatctgtaaattttgttgtgcaggctattttctattaatttcttatgaaaaatattattaaatattatgagctaatactaaaatctgcttgttatttagtaaggctgaggataatgtgtaaagagaaatagagtagcagcagcacatctgctgttctagaacctgtcagttgtataattcatccagtgttttccatgatgggccagcaataggagtaaaacagaaacaatggtgggaatagcaaggtatttacttttttatcaccctgtccaccttgaccagttcttcctttgctatagagtgaagatgagtcaaagcatgctactaaatgtgtggcatcatatttc

SEQ ID NO: 75787 - DNA, 1415 bp, Homo sapiens
cctaatataagacattgaaatgtttttatttttaatataattggatgagaacagtatctatttttatattgtaactaaaacgtgcaaaatctagaatgcaatactctatatattcaaagacaagtcttaagaaaaggtagggactaaagttatagatatagacttcattttgaaatcatggaaatacatgagattgcccatggaaatgtatggagcaaaaagaggagaaagctggagtacgccatcatctagagggtaggcagagggtgggatcagtgaaggagacttgtcttgtcatttatacatcctgcttcatttaaaaaagaattttagatgatttgactaaataatcatcttgaaaggatagtgtttaaagaaactagattaaaaatcaaggctgcagggaagtaaggaaaatataggaagttgaagcctttgatgaagttagaaattcatactatgtatcccgcacatttgttagatataggcacgaattaagctttcaaattcctagtagtcaaggcattgtggaaatataatcagtgtgggattcataatattcatttaaaaaaacaggtcaattgcttaggataagtagaggcttttcctgaggtttgagagaaatttctcctctgggtcctctaaaggggaaattgtgcagtgtgcttcagtgacctcccccagccccaaacacagtatatataactgcttcttatagcatctgtcaatgtaagtcatgactataaaacattaattcttaaaaatgattctgtgagaggctaaagcaaaccagttaaaatatgtacttctctaacagtgtttgttatagaggacttctgtgagctaactgaaggtattaaagtgaaaacagttgtctgtttctttcttaaaccagctacatagcttaattgaattgatgcttcaataccaggcatttataaatggaaaataactcatttgttggtttcatggataatggaggaagtagaggcaccaattacttgtttctcctaatctcccatccctgttcaagtcattcatgaaaaacagtattgctggcttagatgagataataatggctcttgtttaactatgacttagctatgctaggctctgccagagtttctatatggagtatgttagaagagtgagcatgaatatacagtatgaatagggtggatgtggcatagtcatctcacctggaactggtgacccaggcttaattttcttataggtatttcttccctggaccatttttcccaagcgattaaatagtaagtgggtcttaattagcaaatatgcgtttagaggaataggagcttgtttggggctcaactgcttttccttgctaaaggggacagtttagtaatattcagaaattaaaactttcttaagattcagacccgctgactagc

SEQ ID NO: 75788 - DNA, 1008 bp, Homo sapiens
taattcatttgctctggtttctcttttttttgtaattcaggatgatgtgacacctgttttctaagtgttaaaggagcaaaaaaacctctctttagcccttattctagttctttgaatgcttactccaaaagaatttttttgaccaaaatcttagaaatgtaatgagaaagaaaggctgatattggagtgttacagagtgtataatagaaatgcaatagcaatacacaatccagccatgtcacatttgctccttccctagtaatggttcaaaaacaagtttaatataaaaattcatgaatattgatattcgagcataatagtccttgaatggaggtagtgggagtgatatgagatggaaatacttttcttgatgtaagcttgttttctccaggaagagaaagattcgtttctctttaaataattatgttcttttttttattatctctatcaatttgtttatcattctgagttgctaattacaaatatatttttttctatagctggaagccaacatgtgatgtttttcgtaaacatgaagattatatgcaggaccaatttactgtttatcaaggaactgttgaaaaagacaagtatagtacttatatgaagtttatcaattctataagtttgtattattaggacatggtgtgtaagaatgtcagttgaaaaatgtagacattttgtactcaaggagtttctttttttttttttgagatggagtctcgctctgtcccccaggctggagtgcagtggcatgatcttggctcactgcaagctctgcctcccgggttcacgccattcttttgcctcagcctcccaagtagctgggactacaggcgcccgccaccgcacccggctaattttgtgtatttttagtagagacggggtttcaccatgttagccaggatggtctcgatctcctgacctcgtgatctgcccgcctcggccttccaaagtgctgggattacaggcatgacccaccatgcccagccaggagtttttgttttt

SEQ ID NO: 75789 - DNA, 1358 bp, Homo sapiens
ctagtaacagaaataagtgagttgaaagtgcgtttaataattgacatagaattgatgaatagaaatttcacatttgtcaaaaacagaaggcttctattagtgtcattaacgaataaatgtttgcaagaattcatagcatcttaagatacgattgaccttagatatcactgaatctagcccttttatgttaaagatgaggtacaagggacatttattttttcatcattcccaaactgaaaatcttcttagcttctggctctaggatcaggcctggccctggttctctgcattttagtatacggtcccacccatctcaagcctcgtttcctctccattctctggctctcttccttttaggtaagctgccatacccattttttttctctatttgtttattttgaacttattatttctacattaagaaaataaacattttctctttgtagaatgctgtgaagatattaaggaaaacaaagtaactatttgtaggatacacgaaactataaatgcaacagatgaggaaattgatcattactgtaaacatagtgaggagattaaagacaactgtagaaagtgagtatttgaaagaatcaattttcattgcattcttttatttagggtttttgagtttacagttgaagatacttccttcaaagtagtattctgtattagctaatgaatcaagtcttaatgtgccttgttatgccactatgtaaagggattataggaggatcagaagagaaatagaactaaacagctataagagctcactaattcagatccacttaatctaactataaacttttgaataagctcagtatataaaattcctattaaatatatttgaaacaatttccatttttgaattttcaagatcttatttttgtgtgagggaatacggcctgaagtttttcaaaataaaaatatttaatacgttaagaattctttcaacatggcttcaggttctggattctactagttaactctagacattttgaaacaaatacataaaaacaacaaagacttattacaaatataaattttctgtacttagttttatatggacattgtagtaagtactgtattttaggatcatatttgttttgaaatattttgttattcaaaattttaataagccttttttgtttttcccccattagttttttcccactggttttaagaaattataaaagtaacatataccaaatacaaatgttcaagcaatatacacatatatggtgcaaatagtttttccctgcttgcagttcccgtcccctaccctgtcatcctctgcataggtaatgactcacatccttttagatcttgaagagtcaacatcattattatgcacaccacac

SEQ ID NO: 75790 - DNA, 1025 bp, Homo sapiens
aatttctttctatatttttagtagaatcatatcttagagatctgctaaagagtacaccagctgcctgaatgccttactgtattcagcatgttggcaaagataatttattaagagtgtaacttgtacataataaataacatcctttattgcagttgtctaacctgtggtttgtcatcttcttgttaagagttcagggtggctagaaaaaaaaacatttaaggttctagataacccatcagaacaggctgagtttactgcattgtggttgccttttaaggttcttggcagaagttcactgccacctttgatgcccactcaaaacacctcagtatttatcctttaaaaaacattttctggtgttatttccagaagcagtaattatgctctcaataaaccccttctagtcttgttcagaaagggtttagaggggcaagtatcatttcgagtttagcacattagttaaacctcaaggggtctaggacttgggctaaaatctggaaaatatctcatggattttcaaattgtccatactttagataggatcagcttgtgatgatttagagactttgtcttggtcaacttcagaaggtagcattatcattcctttttctttcttcctcccctcaacaagaaaaccttgactctgatgatttataaagaacctagacatgtagttttcttttctgaatattgaataaatgtctctggagtgttctcaggttgccagatgtcatcctgatattagaggctgactgtcctttgtttaaagttcccaggtaagagatttctagtaagacctgatccatatggagcacctgaggagagtctgatcggttttatatttttccaaacttttgttcttggacattcccctactcctgtttattactgaacctaatttccctttgtgttctttattttctcgtccataattctgtctaagttttaaggcatagatggcatctgagggaagataaatagaggaagaagatgggtatctatcatatgagagggtgcactttatt

SEQ ID NO: 75791 - DNA, 1097 bp, Homo sapiens
tgggcatgtgtggcagcctgccctgctacatgctagacaagtgtgctttagtacatagccacaagttcttcattctttaaaatgttttgacagatcatctcataataaaaataattcaggaaaactatggggaaatagttacatttcacaaaagatattttaaactctttgtaaaacttagataatagagcctagcagttactttgtatctaattgatacattttatgttaatttaccaccatacattttattaatcaaaattgtatagcatgtgactcttttggctttcagagttctcaaaaatattattttgttgcatgtactgtatgtttagaggcaaccaattatatactcaatatggttttactgtgccttacacaaagagaaactctatacagaatgtatatcatggggtggggtaacagagtctttactgcactgttaggtgatggcacacagagcatgtcccagaacatttctgtgcttaattacccaaccaaagagatctgaagtatgtatgtcgtactgtaatgggggtttatgcctggacaattaagtgttttatttgttttctgaaatgatgtgaacttatttttctaaacactatgctaaataaactttatatttatacataccttgcattgaaaattatttgggaaatattgtgtttttttaaatatgaatgactcatcttactagaaaagaaaaaagaaataatgttggttttatttatctctggaaaagggaagaagaggaagggaaaaaacaaacattccaaaagctggcaaatggttataaggccaattggagtgattttggaaaaataatctttgtcagtcgttgtgcagaattatgcaattaactgtactacatagaggtaaattattagattgcatcctccttaaaaggaagaagtgtaccttccccttcccagcattttttgttttttgttttttgtttttttgtccctagagatgagtgtgatgtttggcacacggcagttactctgtagggtttaatggaattaaattgaagggtccaaagacctcctattttcaaccttattgaaagagttcaatatcacccatccctaggg

SEQ ID NO: 75792 - DNA, 1047 bp, Homo sapiens
gcctcccgagtagctgggactacaggcacctgccaccatgcccggctaaatttttgtatttttagtagagacggggtttcaccgtgttagccaggatggtcttgatctcctgacctcgtgatctgcccgcctcggcctcccaaagtgctgggattataggcatgagccactgtgcctggccacatcttgcttttttttttatgatcagaacaaagggcccactctagttctctacatgtcaatcaatcaagcatgttgaataagggacatagaggatttaacttttgttatcataaatggaacttgcaggcatatatcaagaaccctatgaagaattcctctcccatcattttgataaagaactacatcatttttgatagaattggtgaatgttcctaaactgctgaagctacatgttttttgttttgttttacaaagtcaggtgtttgagagttcttttccactctactactactcatagagcttgttttttctttgggtgtgtgctgatcctgttactgagattaattacatggctctgcagtgtagtttacataaaaatgatgttttccacttgattgctgcagatatcaagagtttgttattttcaaatacccatccaacaagagagatggggaggtttttagttatatatgctatatatatatatataactggaaatgttttatatgttttccgaaaatacaataagcctctcttttattcagtgttcttcctcttttctcccttatgaaaaagaaaagatagcacaaaacttaagacttacctaggaaacccattcatattcccaccatgatgtaattataaccctacaattacttcaggtagctacacaatataccaggtaagaatcaatgcacagtataaagaacttattgttcttttctattctttcagttgaataagggccagttggtatgcagcccatgtatatgtgaatggagtaagataaaccccatgatctccttgcacagaattgcaaatgtcttttgccataccaagggccagactcagaacccttggagt

SEQ ID NO: 75793 - DNA, 2598 bp, Homo sapiens
acacctgcgactcaggaacgcaagtagtttttttggctgtgttgttgttggggttaaacataaaagatgtctccatacaaaatatatctatatatatatttacttggagaggtaaaaacagatgttctaagatgtactaagttacactttcaaggagtagagcctgggaatctgtagttttaggtgcccaaggtaattctgaaccagaattgggctaaatgattgtatggaagtgttgcttctttatagatactgtacctgagaaaaaaacgtgtgtgtaactttttttctttccctctcacttccatcagtgataatcagtactttattttttttaggtaatatctcagtaagctcaagcacttcagatggaagcacatttacaagtgagtctaccacagtccagcaaggaaaggttttcttgagctctcttgctcccagtgcagtggtatacacggttcctaatacaggccagactataggatctgtgaaacaggaaggcttggaaaggagcctggtattttctcagttgatgcctgtcaatcagaatgcacaagtaaatgcaaacctgtcttctgaaaacatctcggggagtggcctgcatccactggcctcctcattagttaatgtatctccaactcacaatttttctctcagtccctctacactactaaatcccactgagctaaaccgcgacattgccgatagccaaccaatgtctgcaccggtggcaagcaaatctactgtgacatctgtcagcaacactaactatgcaactcttcagaactgctcccttattactggtcaagacctattgtcagtccctatgactcaggctgcccttggggaaatagttcctacagctgaagatcaggtaggtcacccctccccagcagtacatcaggattttgtccaagaacatcgtttggttctgcaatcggtagctaacatgaaagagaatttcttatcaaattctgagagcaaagcaacaagtagcttaatgatgctggactctaaatccaagtatgtcttagatggcatggttgatactgtctgtgaagacctggaaacagacaaaaaagagcttgccaagctccagactgtccagctggatgaagatatgcaagacttatgaactttatttcctcctcacctctttttggcatcagcggcaaatcttttcatgaagccccaaggacacaaaacattttcccatttaaaggaaaacactctagttttgcaagtatatgcatacaagagactttagattgatctgcatgaagatcacagttaagtatacaggagtagaactgcattattgcagcctttttgttcacttataaatttctcttttaaatagatggagacaaaggacaaggtgaaatgtatcaagtcaaagtgaatcatttagttgactctataattctaaggtcaaaatggaacttgatagttttttaaattaaaaaatgtatacacctaacatagaaaattaaagatagctgcagaccattagaaataatacaattgtttttgtttacttttactccatgggcattgaaaaggttaagaaacataaatggtacatatttttaaagttaagtagcatgcatatatatatgcacacacacctctttttcagcattttttgagaaagtcttgggtctcaaacacatttgtctcaacacatttccaaatgtgatttctaatagctcagtgtggctgagaaagtgcggaactccactaaaaactctgaaacttcagtataaatgtaaatatatcagttctataagcaggatttgagtaattacagtgaattttatttttaatgtatatgtttctcttcaggcgctatgaactgaaaaatatgttttcttactgtttaatttatttttattgtttgaacaggaagtgaacatagtcgtttccaacaaagttttactttttgtaggattttaaaaataatgatttttaccaggaatctattaaggtcaatattaataacactgaaacaggaaatctaactcccaatattggaattttggtactttttttcacatccttgttctttatttagcaactctgattcatttaaatatgttttttatagaattctatgtgcctttttacctcgtggcctttttattggtagtaaggtacagaagtgtcaacagaagcactgatggttcttttctactatctaacagggttaatttcaccacaaaattgctttaaatctgaagaacttaagtttcactaaataatatatatgacatttatcacacaaatggataaacaactaattattgttgatacttttcattacaaggaaaataagttataaataccatgtcaaattgattatacaggctatgaaaaccattttaaaggaaagaaaatatgtaaattctattgagcaaaattctgtcctgttgaaacttagttctaaaggttttgaatcagttgttacactctgacacatgactgttgtttgcactatattatcatgtcttctttaaaagtaaatatttttggtttctgtaagaagcttgtttaataatgttgtaagccgtggctatagttttatcaagactctgaaca

SEQ ID NO: 75794 - DNA, 1047 bp, Homo sapiens
tataaagcacaggctattaaatggtccaaaagaaagtaagtacaccgctcataaatctttgaaatcatgggaatgtttccagacagaacaagatggaatttatcttcctaattgtgacacagtaccttgaaaaatgcaactgggtgcgtggagataaggctttgtataatttgccattttaaaagttcccctgtcaaattcaaggtattaagttgctttatggaaggctaagaccaagccctagatgcaagaccgggggaactgactgccggaacgtttgtgttgcagcgcctcgccccttgccggtgctctttcgcgaagggaccgtctctgccaagcgcctgttggtaggaacctgcttggtcgcgtctgagggggcttgtaggtggctctggctgaaacaggcgcctgcgagagtctgtaggagggaaaccgccatggacgatcagggttgccctcggtgtaagaccaccaaatatcggaacccctccttgaagctgatggtgaatgtgtgcggacacactctgtgagttgggcggcagtggattccctgggggagagacgcgctgggtgggaggagaggaccgggagatgctaggcctcgtcttgggagcaaagggcgttgttagtttcaacactggggaggaaaatgggaaaagaaggcgttgtgactttaaatagactgtagccgctagccccgagcggctctggcctgctttgaactgcgggttctcagtgtggcatccagcagtttgtcaggttcccccttccatagccaatgagtatcccgactgtatttccaggctttgtgttgtttactgggctctggacatcgctgattaaaagcgtgggggattggagtgtttatttcatatgaaatgtttttattgaaaaagtgcgaaagtgctatgaaaacttaaaatttgcttgagtatatactgctgctatttattgtatgagttaattaaaaaaccctgtgtgtatgcccacttgtcctgatggagttcggttagactcccatcactaaaatgaagaaaacccggactg

SEQ ID NO: 75795 - DNA, 2022 bp, Homo sapiens
ccaaagtgctgggattacaggcgtgagccactgcgcccagcctttttttttttttttttttttttgaaacaaggaggaaaaggaaagtttatagttatagaaatattctttgtagttaagatgtgaaagtgggctttattgttaaataagctattttttaaaaaaattactatttgctaaagaaacataaatctgaaatcttgcagcctgattttagctgttctgctgatttaggaaaaggtcctttggggaagcaaatcattttggttggttgggtacaggttttgcaaagttagcatcaggggaacaaaaatgtctgggtgataccaaatatacaaatgttgtacgtggttccaaatatggaaatggttttgtctaaagcagccactgaagagaaattatctaaatattagcccctttaggaaagtggaatgtgttgtctgatttggctctcaggcttagtatgaaagtttgtgcaaaagtacagcttacaaaatgctatttgttttattaaaaggattgataggaagttgacatacttagttaatttaaatttggaaggagctcagcaaacatctttctagttgtattttatgtctccctccaccttcttttttttttttaatcaaatggggaaactgaagcctaagaaaggatatatggttgcatagcccacctggacagctccagtctctttttttgtgtgtaaatcccattcagaaattaaatttcaaaattaattttcaattacattttgattacctgttgactaaatacatttttttttactgtaatgcaactgggttgtaactcaaactcatgcataagatgaaaaaactacaatattaaaaatcattttgatctacttagaacaattttctctttatattttattttctagggtgctagcttacgataaaaagcatctttgaatattcaataatgatatttttcctgatattgtatttgccacatctttattttttattgatgatatataagcaatgacatagtatttggtttttgaggtataatcagatgtcaactaggaagcctaaatgaattgtattgttgatgcagtgaaatgatttgtaggataacttattttatagtatttttatttttcatatttatttttaaagaaatatagattatttacatgtacaaacaaatatatatattctctacaaaaagataagaaaatttaaaatttaacagactttatcagaaatgtttggagtgttaggttttcttttcatttactaagttggaatatgtaaaaaaaaaaagaattttgagatgaggacaagtgattgtatacctcactcagtttttttagaacacaaatatgatagtggttatatcattgaaaatcaatgaagcctccatcaatatggtgcagtgcctctgcaccactgatttatatatatttaatgaacttgctgttctaatttcaggtaactgaagcaaactgcatctagcactaactggtttacttataaacaattcagctcattaaaatataaatatcttgaaatttaccaatattagatataatttctttataaatagttctactgtgtttacttcctggtgttaactgacatgtttctaaaaaaatcatcatattttggtactgtttcagataatgttaccaaaatatgttgttttatttgatcttatttcttgctactgatctagaatggatttggaatagaagatatgggacaaaaaagctttcaaaagtgatgggatttatgaagtatgacatgccagatgctgtatttttgagatctattggagcataagtgaggaccagttaaggatctatttctatattctttgggattaggaatatagtttttaatatttgcattttttaaaaaatgtattttaaaatagatttattttaagcatgtctattatgttttattgaaaaaatgccacaagataatattaaaaaatgttttgacaaaagaaaaaaattatacataatactttcacagaggagttcttttaatt

SEQ ID NO: 75796 - DNA, 1432 bp, Homo sapiens
tgagtcacagagattccctttctgtccttaactagaacatatgtagaataggaaataggagaaaactgttcatgcatttccgtgcttttaggtttttttctgctcttggcagtgtattgattctgatgctttacttattttgtaatttttattttatgacttcctgtgtacaaggagttgatgatgcaaagttgaatcagaggtaatttttgccctgaggtctcattgctaagtatggaagatagacaaacaaaatgttacaatacactacaataattgttatgatgagtgttgttggaaccatctaaggagcataatttagatggtagagggcagtgggaccaacaaatataccagatattcaaataagaaatctgaggtcatactatatgtactaggcttatttctaagccctacgaagttgtgcccataactgtctccttaataacttccaaattacagattttatcctattccccttgtagtctatgtcttccttatctctacttggacttttttttttttttctttttgaggtagggttttgctttgttgcccaggtgagagtgcagtggcaagatcatggcttcttgcagccttgacttcagggctcaagcaatcctctcatgtcagcctcctcagtagcaggaactacaagtgtgtgccactacacctggctaatttatctttttgtagagacagagtcttactgtgttgcccaggttggtctcgaactcctgggctcaagtgatcctcccacctcagcctcccaaagtgctgggattacaggtgtgagccacgttgcctggtccacttggactatttcaactgtctcctggccgaggactgcttcaagcttaattaacatggatactgcttactaccgcccactcctcccaaccctccaaaaaaaaacccccaaattcagaaaacaaaacaaaaaatagtcttccccttttaaccatgatacttcctgcttaaacttctttggtggtttcttgtgtcttccaccaatgcttctcacattttaaaaagtaacattaacaatggaggaaaacaaatttgtacccctagtttgtctggaggtgcaactagaagtgtcgctttgaaagcccctttgaagttttggttgaccttaaaaatgcatgtaagattttaattttttaatattttctgttagtattaaaacaaaaagtatatgccttcctaattttttatctcatacccctaacctttgcataaaattgatgttttaggaagacgcaccacgttttcctctggctttatgtaatccctgacacacagaccccacatcatcctgtagttcagtattttcaaactgtgttgcctgagagatttcaaactgaaactctgagagattgtttgaggcagctgctcattgtcatcccttaaactagagcagtctccattt

SEQ ID NO: 75797 - DNA, 1023 bp, Homo sapiens
ctttcttctctctctcctcagcttccagcacctttcctagagattgaaacttgaaacctgagggtgaaattaattttgtttggccctggagtgttggcttgcacagcatttaaattaaaacaaaacaaaaaatgaattagttgccaacatgtaaaaatgaggagacatcatgtaaaaatttggatctctcagttttgttgaaaaactgctagatctggtaacattttggctccatattctcaacagcatggagttgatgagtagccatcattaacatgagatgcattctttagttggccagtttgatgaatgttggaaattgttgatgctttgaatagaaggtataccaataaccttctcaaaaggagacttttcctgttgttgtttaaaaagtaactttctacatgccatactatttattgcaggtatactgtacttaatctttgctttgtaagtgttagttaggcctaagttaaagaaattagacttataagtaaaactgctttatgcataatatttctctagtggatgatttgttaataaaatcatatctagccttaggtcaaatatttataatcattctattatttaaaagaaatttttttaaattataagaacagtttttacttatttaaagttctgttctgcccagagagcatagtataatatggaagtaggtcttctgattagaatttatttaagtagtagaaaattcaagccagcttgggtagggagaatatgaagtgagagaaactgaaatgtgaaagattaaagttgcaaacagttttggtacaattaaatatatctattccaagtggacaatataaacttatgcattaatgaaatgatatggtcatattatttgaaatttgcagaaatggaatcatactatacctttacctttttttttcagttagtggtagattttgagtatcagcatatgctttacctcctttttagcaggtaatatttctttatatggatattgcttctgttgatggaaatttagaaatatgaaatttt

SEQ ID NO: 75798 - DNA, 1335 bp, Homo sapiens
atataaaatcttgacttataaaattaaatgtataacttaaaaatgattaattcttttaaaatgaaaattttaactttctaatttctcttttaagtgatttttaagaagatgatttagataatgtaaaaggattgcatctgttaaataacaaactccactgggtgcagtggcttacacctgtaatctcagcactttggaggcctaggcgggtagatcacaaggtcaggagtttgagaccggcttggccaaggtggtgaaaccctgtctctactaaaaatacaaaaattagccaggcttggtggtgggcgcccataatcccagctacttgggaggcgtagacagagaattgcttgaacccgggaggcggaggttataatgagttgagataaagccactgcactccagcctgggtgacagagcgagactctgtcaaaaaaaaaaaaagaaaaaaaagaaatacaaattactcccccttactccttttttgggtattcgtcttgttttaaaaatctttttgtggcctggcgtggtggctcaggcctgtaatcccagcactttgggaggccaaggccggtggatcatgacgtcaggagatcgagaccatcctggccaacatggtgaaactccatttctattaaaaatacaaaaattagctgggtgtggtggcgcatgcctgtaatcccagctactcgggaggctgaggcacgagaattgcttgaacccgggaggcagaggttgcagtgagctgatcgcgccactgcactccagcctggcgacagagcaagactccgtctcaaaaaaaacaaaaatctttttgagaaacttttagatatgggacaattaatgaatatctaatactattcattgtatgactagatttcattttggggaggcttattaatataatttaattattttgaacaacaagatgaattgggtaggtgtttgttagaacttcaaatacattatagttgaaaacttgaaacagtaatacaaatgcaagaataaatattcttttagaaataggaaatggtttcagataatatggagaaaatataaggaaacaattcaataataaaaactattgtttgtaagtaaatcaagtttgagagtttctgctttaataagttgttaaggtttggattcagagatctgtttctcttatagtaaacatttttaatataggaacagctcagggaaatggtttccatatgcttcttgaggtgttaacaatacacttttggattggaaatgcaatataaacctaaactacattctggaaggcaaagtggaggagcatttcaatggtaatatgtacaagaaacccttgtgctt

SEQ ID NO: 75799 - DNA, 1020 bp, Homo sapiens
tgagccaccatgactggccttattttttgtatttttagtacagtcagtgtttcgccacattggccaggatggtttcgaactcctgacctcaggtgatccacctgcttcgacctcccaaagtgctgggtttataggcgtgagccaccgcgcctggcccagtttagttttttgaattatggctaacttcattcctgcttgaggttgagtgtataatattattgtattactcatttattaagagctccggaatgtgtctgctcataaataggtggttgtcttcaatagtatttgcaattttgaagagttacatgtttaataactttctccctggttgacttttaaaggtcttggttgacttcttaaaagttttgttttggttttaaatgatatgttctacagaaacacaaggacaaattacaaaggttttaggagttatatctctgaacaggatttttctaacctttctttcaggtaatatcaaaatctttcaaatggaggtggagaagagggagatgagaataacctgggagggttttaaaaattactactacttatacagaaatgtttactgtgtcctaggcataatgctgaatgctctttattcgttatctcatttaatctttataataactctaattggtaggtattgtaaatatccactttttatggatgagggaattgaggcttagagattctaagtaacttgcctaaggaaacaaactagtaaatggctcagcctagattcagctaggcctcattgatgacaaacctttgcttctgaatcaccatgccataatacactttgtataaaccctttttgtttttctcctttatatcagaatgtggatgatggcaacgctatgtgcattttcaaaaagttaccctactcctaagattataatgttgagtttacatttttaagttatttttttgcatacaaaaagtgtatatataatatgtatagtttaatgaataatgaaaacaaatcaaatgcttgtgcactaaccccctgggttgaga

SEQ ID NO: 75800 - DNA, 1050 bp, Homo sapiens
cgcctgtaatcccagctactcaggaggctgaggcaggggaatcgcttgaacccgggaggtggagattgcagtgagccgagatcgcaccactgcactccagcctggcaacaaagtgagactccgtctcaaagaaaaaaaaagaaaaaaagaaaaaaaaaagaagctgtttcctgctagagtgaacttactctaagaagcaagtggatggtctttacttttgaaactcttggcggggaagtgctgttggagccgctgtggttgctgtccgtgtagtgaaagcgcgtgcctttgtttgtgtccctggccatgtgtccctggccatggcgctgcagctctcccgggagcagggaatcaccctgcgtgggagtgccgaaatcgtggacgagttcttctcattcggcatcaacagcattttatatcagcgtggcatttatccatctgaaatctttactcgagtgcagaaatacggactcaccttgcttgtaactactgatcttgagctcataaaatacctaaataatgtggtggaacaactaaaagattggttatacaagtgttcagttcagaaactggttgtagttatctcaaatattgaaagtggtgaggtcctggaaagatgacagtttgatattgagtgtgataagactgcaaaagatgacagtgcacccagagaaaagtctcagaaagctattcaggatgaaatccgttcagtcatcagacagatcacagctacagtgacatttctgccactgttggaagtttcttgttcatttgatctgctgatttacacagacaaagatttggttgtacctgaaaaatgggaagagtcgggaccacagtttattaccaattctgaggaagtctgcctttgttcatttactactacaatccacaaagtaaatagcatggtggcctacaaaattcctgtcaatgactgaagatgacatgaggaaataatgtaattgtaattttgaaatgtggttttcctgaaatcaagtcatctatagttgatatgttttatttcattggttaatttatacatggagaaaa

SEQ ID NO: 75801 - DNA, 2147 bp, Homo sapiens
gatggaaaaacttgtgctataaagctaagtgctttcctaaatcagatgttttggtcaagtagcttgactcagtataggtagggagatatttaattataaaatacagcaaaggaagtctaaatattcagaatctttgttaaagtcctgaaagtaactaataatctataaacaatgaaatattgctgtgtagctccttttgaccttcatttcatgcataattttccctatcgaatcagtttccaattatttgactttaatttatgtaacttgaacctgtgaagggatggatatttgtactgcttgatgttctgtgatacagaactcttaaaaatttttttttgtgttttataaaatcaagttttaagtgaggaaataagtttgttaaaaacaaaaaaagaagcaagtggatttgtgtggtgtaatttgcctgctcatataatccactcatttttctatagcatcatttattgatttgtagaacctctttatatagtatgaatattatcttttatgtatgatgaaaaaattgttttctagtttgtggcaagtcttttaatagtattgtgtttcccctcccacttatgaaaagttttaaatttaaaattgttgtttttagagatgatggggtcttgctgatctcaaactcctgacctcaagtgcttcttcagccttggcccccacaaagtgctgggactacagatgtgagccaccacacctggccttaaattttgataaaatgaaatttatcaatctcctttacatggtttaaatttttttagttacttttaggaaatttctgccctgatctcgtaattatattctcctataatttgataaaagtttaaagttttctctttgatctttagtcatttgttcataggggatttctttttgtgtatagggtgaaagatagggatctagtttttttctctccttatctagaagcatctctccttatctagaaagcatttatttagtgtctcaagtatttatttagtagtcatttatttccacattgatttgtaatactacctctttcctatgccgtatttccatgtatgcatggattttgtttgtgtgtgtgtgtgtgtgtgattttttttttttttttaacagaagtatacttgttccttacagtgtgctgttatgttggtggtacatgaatccatagacatcttcctggaatgtcaattttacctaaagaatatgaaaaagattgagtaattgaataactggtaactatttgaggacatttttcaatgaaataaggctgtttgaattatggagtcaaatagaactttcatgaagttttagctttttaagctaaaacgtgatacaatttgaagacatgttgagcttatgggggaccatttgaggccatttccccaattttccaggaagttcattctttatcatttaagaatactgtggtagaaaagggtgagaaggactaccttacatggactgtttttattttttgtcaaaacgttgtgtttattgttccatgtatacactgtgtgtattgatacctttattttttttgtgatctctgcctggaatgtcatccttctttcatatttcaaggccagcacatttttcatggcccagctcaattcaacctatttcttgaatcctttaacagttgtaatccttgttactggctcctttgaaatctggtccttactgggtattccttgtattaagtaatatttctaatggctaatgtttattgagagtgtactatgtgtctggtatatttctaagcattttacctgtattaactaatgtaaatctcatcagctctgaaagctaggtttttacccctatgtaggtattctttttatttctcacaaggaaggaaacagaggcacagagaggtttaataatttaaataaggaaaagcaggcaaactggcttcagagtctgtgcccttaaccagtatgctctgctccctctcagttgctcaataaataattgctcaggaatgaatttaccacttatattaacacttagcagacataactttgttctgttgttttatgggtgtgttctttcctaactatataatacatccctgaaggcagggataaaatcttatacttctttatagtatggctttatatttcatacttcattagacggattta

SEQ ID NO: 75802 - DNA, 1041 bp, Homo sapiens
cctgggctcaagtgattgtcctgcctcagcctcctgagtagctaggactacaggcatgcaccaccacatctagctaattttttttaaatttttatattttgtagagggagggatctagccatgttgtctaggctggtcttatattcttggcctcaagctatcttcctgctttgccctcccaaagcactgggattataggcgtaagcaactaggcctggcctgttcttttttttaatgattagtttttatatatgtattttgtaaatatgtagaaaaagatgtggccacacaaacactaaactcaacagtagcatattacccgtgggaagtgagatacagaacacaatgaagtagaactttgagttatttttctatataattctatattttataagctttaaagaaaaaatattcttttcacagttaaaattagaaatggaaaatgttacgtaggaaaataaactgcaataaaaaattttaatactatttaaattattatgacaaggcagattataaaaagtggagatgtacaactgattttggaaacaatatattatgtctaatatacaatataacgtttagaaatattaatgttctatattaccttgctgactaaactattgattgagtctaatctccaagaccttgagatatattaatgttatttgtggctctgtaattttgactattttggatagatgcttacttataaatatctttagttagtatagttgtaaagtttgcctgttttcaccttccatggatgggtttaatttcctctaaccacaaagaatagtgaaaatgcaccactctgaaacttcctaagtccagagtggtttatctggggtttagttgatcttgctaatgacactatgatctttggaatttttccctgttattttttagtgacactattaagatagaaatataggccaggagtggtggctcatgcctataatcccagaaccttgggaggtcaaggcaggaggatcgcttgagcccaggagttcgagaccagcctgagcaacatggggagtccca

SEQ ID NO: 75803 - DNA, 1023 bp, Homo sapiens
tcagctagcacctctttcttgtaattgtcatttgctcagttgattactgaactttcaaaagacattcttacaaggaaaggaagaaaaaaacatctgttttagtgcttggggtatatagggctctctaaagagcaggcccctggcagaggcttctcttgcccaggtctatggatgatattgggactggggatggaggtgaccatacagtagccttttacatgctctttgacttctccctatcctgctcttcttcctagtctctcactcaatttgttttaatttataaatttgtttgatctgtaaaactaaactggtatcacttgggatacctatatctgaaaagtaagctccaaatgaaaaagaacattttccagaaagttttttggtaagattttaaatagaagtgactagttttcaagtctcactctccttatcccataggggcaaactattcagatgtgttgtagatttgaacattggcttaaatgttatgttttatttctgtccttacagctgtgaaagttgtgtagatttactgtttgtgagaggagctggaaactgccctgagtgtggtactccactcagaaagagcaacttcagggtacaactctttgaagatcccactgttgacaaggaggttgagatcaggaaaaaagtgctaaagatgtaagtattcctgctcgaatgattcagtcaacaaagaggactttaacaattatgtcagtaattgattattatttgctcataaatgtggacagattagcaagtaaataactataaattcatttaagttcttagagaactgagtaatattatttatctttgttaaagaagagcctcttgattgatggcttcattattcatttgtatttattctttgattaataaacatgtattgagtacctactatgtattgagtacctactatgtgtaaacactactatgtgtaaacatgttatgcatgttaagcagtagttatgaagtgatgagtaaaacagctatgaactctgtcctcatgagact

SEQ ID NO: 75804 - DNA, 1990 bp, Homo sapiens
tacacagtaagcaattcttttccatgtatcatatatgaattaggtcagaacaagcaaaccagttagataatattaaaagcaatgatatgtaatatgtagatttcttttttcttttcttaaagatacaataaaagggaagaagattttcctagtctaagagaatacaatgatttcttggaagaagtggaagaaattggtacgtttttaatttgatgtatgctagcctataagaccatgtgcttttatcttttaaatgcttaggagaacatctcacataaaaacctcttaacaggttttgttgtgatagctaacatttacctaattactttcttttgcacttgagtcatgtttgtcaaattgaaggcatacttaagtaaagaacctatttaatattgtcttttaggaaaaatatgtttaatagagatagtaacacttcatagctggggaggaagactatatgggtacatgcatctgtgtgttgataacatattagagtagtttaaatgaatggaaaacatattctgatttttcaaaaatggggttcctattaaccatatttatagtgactaaagccatatgtttatcattatttgtgcttctgtggatatagtagtcttaaagtactttgaagcagttgactgttgaagtggcattctattaatcagtattattctggaatcagaggttggagtaatctttgtgccttttctttctgatgtgtttagtcaaaaggaagattttatcaagaaaaaatgatttcagttttcttaaataaaatttcagagatgttaaaaactttggaagttgttatatgttgatttaaaaaataatgctgctttttaaacttgcagtaattattactaagtgcgggtttggaaatgacacaaaggttatatactgtgaacattagaatgagactatgaggatcaaacagcaatcatttttattctttcaaacttaataggtaactgtactcaatatttactattaaaaataagattataataaaatggatcattctttagaagatttatatatgataaacttaacaattcagattcctgaggaataataaatattctaattcctttaatttctttactagaaaatccagaaaatctttttgtttcaactgttacctgaaacttttctcatatgtctaagttcatttgttatgccatagcaaaagcatgtggaaaacataatttagggtttctctgggatctttcagtgccataagagccactgcttttccattctgcatgtactcattgcactttgtatgttatcttagcaatcatgagtgactatggattttagctgaaaagatggtagaattgggagtgacaaggcaaagtggaaaagttagaatgtagactgagaagaaaaaccagaaagaaatctacaagaactgggcaagtatgaaggtatgtagaaatctggctctatatagatactaagtataggacaagctgttggatagcaattgggaagaaaagtagcttacatatattctaaaggtaatgtgattagtcaaaagtctggtcaagcaataaagggaaaggaaattataggtgttgcagtacaagttgaatacatggtcacaattacaagcaggcagtcaggataactaaaagaaacatatacagagaaggtgaggaataggtttaggggatgaactacaaggagatcttgattctgggattaagattctgactgagctatgattaaaaaaatatatatatatatatacacacacacactgcatatatatgtgtgtgtgtgtgtgttgctccaagataaagtaatttgaaggtgtggacaacatggggcccataattggtactagaattgataggcaagagcaagtctggatattgggggtatacaacatgtaatgctttctttaccaaaatatagaagctgtggctcagaccatttaatttgaaagtgattctgctattatgtgtattcatgaaggactgtcttc

SEQ ID NO: 75805 - DNA, 1055 bp, Homo sapiens
tgtagttatgtagttatgtaattaaatacatatttaatattatatgtaatttaaatatttaaagtgtgtaaggttggggaaaaaattgtaaaactctagaaggattctgtttctcaggtttttaagtcacttcttaaaaaatggaaattggccaggtgcagtgactcgcgcctgtaatcacagcactttgggaggccaaggcaagaggattgcttgagcccaggagtttgagatcagcctggacaacataatgagatctataccaaaattttaaaaagtagctgggtgtagtggcacacgtttgtagtcccagctacttgggaggctgaggtggatctctgaagtctaggagtccaaggctacagtgaaccatggttgcgccactgcactccaacctaggcaacagagcatgcccatgtctcaaaaaaccagaaaacagaaaaggaaactgaacaatatagatgacagttatggcctatataaggaagaagcaaaactctaaaatctagaatttgctctatgtcattaagttagagaatgactatatacttcctatatatgttttaagttaaagtatttgaagagagagacaggtgtatgtgtgtgtttctctcctttaacaaacttatttaaatgttcaactataaatcctcattgtgtttattaaagagtggttctactctatttaaagatattgatgatttttgggaagtaacctcttggatttatagtttattttctgaacttcagttcaattcagcaagtttttaaattatgttatgtgaactgctttatggatggggatatgtggtatttgccctcaataagctcagactctaaagggggagataattatgttaactaataactataatgtaatgtgataagtcttataaataggcatttataaaatgctatgggaatacagataaagcaattaacctagcactgggaaatagagatgtggtttggtgacattcagagaagagatgacatgtgagtttgatcttaaaagaagaagaagagttaaccagatagaaagggcttggaaaaac

SEQ ID NO: 75806 - DNA, 1011 bp, Homo sapiens
cttggccaggctgatcttgaactcctgaccttgtgatccacccaccttggcctcccaaagtgctgggattacaggcgtgagccaccgcacccagcgaaaacttcctgtaaaaatcttgtttcaatagctttctattttgtgttgtattcatatttttaaagatagttagatgtctgtgatatctgtattatttgtgttaatcagaagtataaaatgttaatttaatggacatttactaagtaccagactgagctgtacacacattatctcataatttttgaaactctaagagacaggcatttttattcctattttgcatctggagaagaggcacagagagcttaagtattgtgcccaagactgcattgctagtaaagaatggagccaaattgtaaatataggattttcttactttctgagtctagaacatggagttctatggaattattagagatgagagaaaaaaagtagtttggggccatattttgaaggatattaaagacatttgaactcgatcttataggtagaagggtgctgttgaagataaacgtttaaatctggagtaagaaaactagaattattagggtgcctcagagggtcagtgtttgaggattcataaattggagattgaagtaattttgttgtataaatttcattatgaatcttttgaatatgaatataaaaatgaaaacattataattttaataatagcatcaaacattttcaatagaaggggcacacatgaagatggactttcttatggcattaacaatagactcttttctgtggttatgacaatctatacataaaattcttgttccttatggctccagagattatctcaaaggtttattcttagtttcataatgaacagattattcttttggtgcaaaacagattattcttttggtgcagagaatacttatcttaaaagggtgagaaagtcctaagggctttaattataaattctggatgtcaaaaagacttcaaaattgtacgtgaataacatta

SEQ ID NO: 75807 - DNA, 1050 bp, Homo sapiens
gctggtctcgaactcctgaccttgtgatccacccgccgtggcctcccaaagtgctgggattacaggtgtgagccgctgcgtagggctcttatttcttatctgggttatttgaatatacttctaactagtcctcctattgtcagtcttgaacccaattgatctttatgtataccttactgcctctagtcatctttctaaactcatccctcaaattcccttaatatgttcccagtggccttagtatagcaaaattccactagtatggtataacagaatagttgttttatttaatagtaacgtgtctacatgaaataaagtaaattctattttcttcaatatggaattgctacattattaaataataagtgactagtgtgttttatgcttccaataaagaaagtattagagtgtggtatatgattgctcttggctcctaaatttattccacgccatatataaatttttgttttagactcgagaacaggaagaactggaagaagctttagaagtggaacgacaggaaaatgaacaaagaagattatttatacaaaaagaagaacaactgcagcagattctaaaaaggaagaataagcaggcttttttagatgagctggtatgtattaatgctaattgtgattgtaaaaaacattcttcaggatttacctttcctagtaggctggatgatggcatttaaagggcttttccacagtgtttgtaatctggttcacctttagttttgttggttatgtattgatatcagtgtatttattgctgaataagaggttgccctccatccacactgaacaatatgtttttatgctcacaattctgtgggttaggaatttaagtggttcttttgggcttttctgcttccctaatgtattctcaggacacctctccatgtggttttgatagcgacaggaggcagccaaatgcctaggcagatagggacgggtacccagagaaaccccatctccatgttgaagacagtttaaaacctgaaagccaagctacaagttaaatccttggaccagattgagaacttgtcct

SEQ ID NO: 75808 - DNA, 1010 bp, Homo sapiens
tcccaaagtgctggggttactggtgtgagccaccgcgcccagccgcatattcttttagtctttaaagtactgttttgctgcctcattgagctgctattgacatgaagctcccctttgattcagtgaggcatgaagcaagatgtgaaactaccattgttgtacattgtgtgtaatctggagttaatattgatttttgtgagttctttctcccacttcctgttttcttcacctgcaagtcattactgcacatactttcctcagtgtttagatcatataacatgatgattaaataattcttagtaatttactgtattcattagtgcaattaattacaacagattggtttagaataccactgcagtttgaatttctggttttcatttttaaacttatttttagattttgttatgtttatttttcagtctttatacaatgttataaatgttaaaatactttaaatttttatgactaatgaattcattaaatttatttttatcctcttgaatccttattaactaagtaaaagaacgtatttctttttctgtatatgttcatgtgtgagattttgtttaaaaaacaatagcatttgtaaatatgtctagaagcttaattcttataattaatctctggacctaatttacacaagtactacttattagaatttttttcctcctgtttttggttctggtctttgtgccaaaagtcactttttaaccttttaaaaagtatttgcattatattatactgtatgtgacgggattttaatgttatggtcttaatgtttatggcttagtatttgcagtaatgttggctaaaaggtccatttatttaatcctaactgtaaattcaattttaaaaaagtttggaaaaagatttttaaacaggtcctggcttattaaatctttttatattcctgtttgaaaattcgcttcagtttatgtcttaaattttgtatgggctaatattgttgtcaaacgcagtaggtgatttttattagaaatattgtttgc

SEQ ID NO: 75809 - DNA, 1231 bp, Homo sapiens
cccacttctctccacctcttatcatcctaggataattgccatcatttctttagtggactatcacagtaacattccacctggtgtctctattcatctgtgtaccccataatctagtctataagcctttgggtggtttcctaaataaatgaatgatggtaaataaacaatattaaacaaatcagctcatcacctccttgcttactatcttcctatgtcttcccagtacacttagaataaaattcagaatattatctactttctcacctctgagaaagtgacatttgtactaagaagtcaatggtaaaatggagttagccatgcaaaaatacaggcagagaaaagagcagtaaagaaggcctaaggtaagaaacagcattttctagaaacagacaaaagatactgttaagagaatactttccctactctgccttgctccttatgctcaattcacactgaccgtttgactattctatctaaagtatctttctcctgcccccatccacattatgttatgctttttaaaattttaatatagagacagggtctcactatgttgcccaggctggcctcaaactcctgagctcaagtgatcctcctgccttggcctccaaaagtgttaggattacaggcatgggctaccacgcctggcccatgttatgctttttaaccctttataacatatatcactatcagaaagtgtcttatgggtacactgtttaatgtttatctttaccactggaatataaattctgtgtacctagaatgatgtttgtctctagtacctatttaatgaatgttcactgtggaccttcattaaatatttttaaatgaatgactgaatcttacatattaggctcacatttaatagaatgaagatcctgaagtactttcaagtttctgtgactttatggtgtttactctgtttggaatatacttaactgcttatgaaaactttacttataatttatgcatcgatcaagtgtgattttcatgaaccctcttttgtgtggaatttaattgcatattctgatgcttcccctaacattttatatgtacttttattatatattgtagctcctgccttgtattgcaattggctattttccatgccggtctcattttagatgagcttccttaaggacacaatgtgttctgtggcataactttatgtgttcttgtggggactaaatattgtactatgtaattattcaaaaaatttttttgaataaat

SEQ ID NO: 75810 - DNA, 1016 bp, Homo sapiens
tcataaacatatcccctatagatgtatttactctatatatgtcacataaaaacacatataaaaataaggcttataataattaaagtattgacttttctggaggactatataatcttaataagatgttttccttttgataaatattgaatgataatctttaagactaggtaaaagataccatagtatatttagtatttgcattgagacatgtattagtctctttaagagttaatgtctataaatatttaactctggactatgtcactgtcaagtaatattttgggctagagttccccactgagtatctaattttgttgccttattcttttagaagtgttactgtgagcaatagccaggcaactgaaagaaagaaggtgagtgggacccaaaaagaaggacaaaaacagatggaaaggaaataaaataataagaaatttcttaaacagtgtttgttttggatagttttcttgttaagcacatggaaatactttgcacatttgagaatcactgacttacatgctattttggagaaacagcaaatcactcatgtaatataaacacaattatagatttctttgctgtaattttttcatttctggggcttacttttccgtaagatacaaaacgttccttcttacagatcattgcttaacaatatatttggaggattgcaaatttaaattgaatggtacaattaatgcaataaatgatagatattcaaaatttctgaatcctgatagtcttgttgagttatagtctgctctaaagatgaatgttactaatgagaatggactttttagtatacgcctaaagtcaatataatgaagtgttttgaactgcctgtggtcctagatttctaatatgtctgttattatactaataagatcttaagactgaagagcattttatagtattcagtgaacttgcatgtaaatatgcactgtggatattattaattcccttcttttttttacagatatgatcactaagcacaggtggacagtggaaatcagagt

SEQ ID NO: 75811 - DNA, 1337 bp, Homo sapiens
ttatacagaagataggcagaatagcagtgagataggtgttgggttttaatgtttgagagcttcaaattctggctctgtgagttatgcttttgggacttgggcaaataaccttattcatgcttggaataaccttacagtgtattgtttgtgagaataagataatataatgaaatgctcaatctttgagcagccttcttagatgttgtcaaatgcaaagatgagttcctccatggataacatggtagattaacttaaaaacaagcaaataaaaagaaaccaagaacagcaacaaagtaaaaagaaagagagtgattaggtgactggctccaaatataagataaacatttcttaaatctggatgtagaatctgccaaaatgttaagttgtcaaaaaacaaagggaaaatgatctgttttaagccataaataggctaatcagaaataatgacatggtctggtaagaaatattaatgacttttaaagtcattaaaggattacttaaaggataattgcattttccagataacagggaacctaaaactaactttattcttttttgggttcatactttatgggaatttctattaagcagattatcatctagtgaatacatgaaaagacaaacattggtctggtcatcaagtagaattactgggagcagtaaacaagaatgtaaagtaagtcaaagccttggatgaactcatccaagttaagaaacaatctggtgagatcttgattaaaattctgctgttaaagaagctgcttaagtacttatgaatttgtacttctttgtactaccatggtgattaatgtcaatgcatttttctcggcaaggatacacaggcatatctggttttcttttgcttttctttattgtgctctgcagatactgcgtttttaaacaaattgaaggtttctggcaatcctgtatggggcaagtttatcagccaccatttttccaacagcatattctcactttgtgtctctgtgtcacactttggtaattctcacaatatttccaacttttaaattattattattaatatttttattttactttaagttccggcatacatttacagaacaattgcaggtttgttacgtaggtacacatgtgccgtggtggtttgctgcacctatcaaccaatcatctaggttttaagctctgcatgcattaggtatatgtcttaatgctctccttccccttgcctgccacccaccaacaggccctggtgtgtgatgttcccctccctgtgtccatgtgttttcactgttccgctcccacttatgagtgagaacatgcggtgattggttttctgatcctgtgttagtttgctg

SEQ ID NO: 75812 - DNA, 2440 bp, Homo sapiens
aaataaatatagaataagattgttctttaagttatttgttggttaacctgtagttaactcattacttcaccaagaatagttttgggtattatggaaatcttgaagcacatgtatttcaaaatgagttagaggccttaggcatttaaaaaataccaccagtgctgacataatatgagaacatagtgtaggatcttgaggcttttttttacatatttaatgaatcttttatagatattatcaatttttatcttgtctcatgtagtgcagattaatattatgaatatagttggttagtaatttccatgctaatttatatctatttgaagatataacacttgaaaaacacttaaaagtaattgcttttttccaaaagattgtatatttccagaaaaaatgttttctgttttagtaataaatgtaaaaacgttcaaactcatgaacatttacatgaattcattggatatagggagactgtattaaggatataaattatttaaaacatcttccttagaactggaacaataaggttatgttgttcaaaatgttaaagtttaaagaaagaaatttctttgttaagggaagacaaagcatatttggcactatgtatgaacatgcctgttttgctcactgtggagctcccaatgcctaaaatcatgtcattaggtttttttcaccattaaaaaaaatcagtttaatattgaattatttttttaaaaaaatttgaaaaggtctacaggcatcttaaaaattgtctgtacacttgctattaatgaaaaaattagaagaatttcgagcaagaaaatattcacctgaatcaacatattttagtgtccttaatgttgagcaattagctgataagctagtttgaacctgactttcaggatagaatacttttgaggttgtatttgtttttttgctttcaacaaggcaagtcttgatgctagatcaattagcaaatcttgaagaattaacttaaatggtgtggtaattcctgttattagagatatttcttagaactcatgaaattcctccctcccacatgatatcagatgtgttgagttgagaaagttgctgggcagcagtcttgtatatcagagtccagttcaaagttgttagaatgagaagtgtttttaaaatgttatgggaatgcccgaattacaattgaactttgaaattaaaaagaaaacacaagacagtataaaaataaagacctatgagagtgttgtagcaagttgggctttttgtaacctaccgtttaaaatacagatctttgaaggcaggtttttactaattattttattactttgctcttgctaaagacagcaaggcaagtaattatcctcagatctgaagattaaaagtcttatgatttttaaataaatattaagcaaggagagtaatttttataactgttagcacatatgctttgtgtgctagctttttcctaatgtaaaataaatctgaatatgccatacgattggtgacaaataaaaaactctttgtgcaattaagagaaaatctgtttatttaagagctctcaaaggttgtaaaagattatacttggctgtatgtgaaggataaatgttgtgaaataatgccccttagttccccttttataataaatctcagctgtgtgttcagcacaagggctcagtgccaaaaagaacaggttcaacttgtccgtgaggatttgcaccacagtaaagtgcacaactgcttttgtagaggtcattgtggaggtcagggcatgtacagttgaatgaaagcaactttagaaacatggtagatcatagagttacttgagattcaaaaatcaatgttaacttaaaacattaaaaagatggaaaatcataagaaccttcaaatatatttttatctttatctacatatgttaatatgttttcatacagattaaaaataatttctttggcatcttgtgctagtatagttttaaggatcttcaggatattttataattgccaagatttggaagcgttgactattttaatatttgttaaattctttagagtgttcacataatgaaggtaggatatgatggtggtagaacaaagtgtgcagggatatgtgcatggtgggagtaaaggcaggggagtgtggatgagttttaataaaaatatgggtgtaatctggaaaatgtctctacaagtcatatttatcttgagtttgtgatcgaaagattcgaaatttaacaacaacaacaacaacaacaaagaaaatgcagtcttatacagtatgattctttttcctaaatatctcaaaaatacttttatacatttgtgataaatagaaataaatgagaaatagaatgtggagaggctgtaagatcccaggactccagccagtgcattgagtttcatataaagaatacctgaaaagatataactaagtagatgcatagcttacctggggttatatttta

SEQ ID NO: 75813 - DNA, 1055 bp, Homo sapiens
tttagttgtaattatatattatttgaggatctttaatgatactaaccttttactagtgatcttttaatggaagatactatttcctaatttttttccaaccttttcaaaattggttacttttcatttttgaagttcttaaggaaaaatttatattgatataataagaattctaaaattagagttgaaatattattaaaggacatttttctgtgtggaacactaattagagtatgtgtttaaggaggagattacaaatgaatttggctaacaaatctttaaggaatttcactgtagtaaacagattttgatgagtttccagggctaatttgctagaaacattttcagagacttggcttgccaagtgaagatgtatttagagccattttatttctaatgttgagcaagaaacttaagcccttagctagatagttatagaaatttgtctttgatgttttcaagcatatcatgtgtatttgagtagaactgaacgttgctgaagagctagaaaaatatggtgctgtgtctgcaggatgaaacctctttttttattttgaagaagccagttttagaagaaaatttttgtgaaaattggtaatctaactattaggcatcacattttaaaagacaaagagtgctcttaaaggctgatttgtgcaagtatgtcaccattagaatgcttaaaagagcctaccatatatgtatcttttttaccgttatattctgcttattcccaaacatacattcagaaaaagaatgtagtctgatgattctaatagagttgggaatctgggtcttagtcttgtgcatttttttctactggctgtttctttagtatatgtagaatcaaattactttacattaaatttgagggaaattttatgtatttttatgatacattgtgagtcagtggcttatttccacttagtggtcatgaaatgatagcaagttagacttactgtttcagtctcctcacttatacactccccccttcctcattgcacatggtgaaaatgaaacatagagaaattaaatgttgcacctcagttcattctagt

SEQ ID NO: 75814 - DNA, 1052 bp, Homo sapiens
ttacagtgtcagaggtgcctattacaacgtgcctgtaaactagctaggatgatgctacatactattgaacttgttgaagagagaaactgtaatccagatgcaaggatcttcgatggttgtttctcactgctacaattgtattttatgacttttaagtcatgacttttaccttttttaaaataataaaatagataatgtgtactgtgcatccaacttagtaatttaggggaaaaaggaaactaagggatgtagcaacaaaaaaatttataaactagaaattggaggaattaataactgcaagaatggtttataaaaagttatgaaatagagaaattgatagaactataccaagaaaaacaagagaactagggttaaaatcagcaaacacagactatataaaatgtaggtatttttataaattagaattctatgcccacgtggatgatagatatgtaaatctcaatgtaatgatatatacctgagtggcactttattttgctcaaatatgatctgtagggtctttgtattttagttatccagtagttctttcttctcagaaaaatagagtggatgttttcatccaatttagttttcagcataaaattttcttattttatttgtatatgtgtgtgtgatgtgaaataaatacacatttggtaagttagtttgatatcatgtaaagacttcagagaatagatatttatgtggcacaactttgcagagaataattttattagctttcttccctaatttgagctttcaaaaaaaacaaaaacaaaaacactgattaccgaaaatgtcaaagttgtttagtaaaaatagaaaaatgtgaggatagactatgcttgtacacaagggaactttaaaaagtttgtggaaaatggaattaaaagataaatataaaaaatataaactttagttctcaatataagctccatcaggaacaagacacttttgtaagcaatgataccaggcatttagttcatccctaaataactgagggtcctaggaatttaactatgtcagcgaaatctttttttattattattact

SEQ ID NO: 75815 - DNA, 1016 bp, Homo sapiens
taattcatctttaaaatgattataaataagtagcaatatgaaaataataataagaggtattaagttccttcatttttctaacagggtcaacatatttcactggcacctattcacaagcttgaagaagctctgtatgaataccagccactgcagatagagacatatggaccacatgttcctgagcttgagatgctaggaagacttgggtatgtgtcctaaagaactttacattgaggagctgatatgtgggacttattgctgttcttaactgacatgttaacattcttagattttcagtttatagaactttactgttttgtgaaaaatgaacagtactcaataccaaattgttttatttagtacattaatttttctgtggacttgttaggtctcttgagattgagcctggaatacattcgttcttttagaagtctgtccttggcagccatattgaaatggcgtttattttcagtcatgagtgtttttttcttttttaaagaaattggggcttaatttagttagtagtaagccaataaaaatatgaattgggctccttgccatgaaaaagggtagatttactcattgtgcactgtctacagtgaaactacatttatgagccatgagccatgaaatatattttgttgaaaggtataatgtaaggctggccctgtggttcaacagtcatattatatatatccattctggaaatgaacctgggatcctggcttttgtgagggatggagagatggttatagtctctctcatgggagcaagtgggtatttgtatacttgaaaagcgcaggcacagatgttgctagatggagcaaatcatttcttggtctgattttaaaatgtgaactattgaatgaaaggctgatccagaaactgttgttgcttaacaaaagaaaatagtggaaagaatatactgtgaaaaaaaagtgggtaaatcgagtccaagaaactaaaaagcaatagaaaaagtcagagaccccaagaacaaaaacaagaaagatgaa

SEQ ID NO: 75816 - DNA, 1044 bp, Homo sapiens
gaatgcttttatgcatctattgatgtagtttttgaacctaatggtgtataatattattaaaaattttttcaatagcaagtacttcctatattcctagatagctacctacctaaaatagcgtttgggaaaggtagaatttcagctgaaaacttcaagttcaggaaatttgttttaaatggattagtttacgttctaccagtgaaaaataattgaggcaatctataatactttaaaaatcttaacacttaagaaatttaaatttaatcagctatatgaaagcataattcacatacaataaaatacctattttattgtatattccaatgagttttgacaaacacatccagtttgtaaccaccagcacagccacgatatagaatatttgtataatctgctttcactgtgattgtgcttttttctggaaatcacttagaatttttacatatgaaagtgttacttatattccaaaatttccatgagagaatgtggcattctgtatactgctttttggtcatagtctttaccttcgtctttaccttataatattgacttattatatatggattgtgtaagaatggtgaaaacgtagttgtttcatttaagttttgttttgtttttgatgctacccatgtaagtttttttttttttttttttttctttttgatggagtttctctctgtcgcctggctggagtgcagtggcacaatcttggcctactgcaacttctgcctcccacgttcaagcaattctcctgcctcagcctcccgagtagcggggactgcaggcacccgccaccacatctgactgatttttgtattttttagtagagatggggtttcaccatattggccaggctggtcttgaactcctgaccttgtgatccacccgccttggcctcccaaagtgctgggattacaggcgtgggccactgtgcccgaccttaagtttatatgttagttttacagaaagtcttggggcatcagaaaatcaaagaatgtggaaaaatacaaaaatcacaaaaaaactgcaatatgcatgtgtata

SEQ ID NO: 75817 - DNA, 1056 bp, Homo sapiens
atcttggctcactgttcagcagttcttttacttttgttattcatttggttgtcggttagcaaatagttatgaagtgcctactgtgtgccagttactgttctgggtgctgagaaaacagtagtgagccaaacagaggagtaaatgtctactatcatgaagcttaaattctcctgtaataaaaccaacaataacagtacattattgaatctgttaagatgctgttagatgtttctatgaaagatctaacatttgagatgaaacttaaaattcaactgtaataaaaccaacaataacagtacattattgaatatgttagatgctgttagatatttctaatattagaaacacctgttagatatagcagataaaccagggttttccagagaaagaatcaataggacatttagagatacataagaggatgttcatgtttggaattggctcacatgattatagaggctgagaagtcccatgatatgctatcagcaaccaggagaaccagggaagttcatagtataactcacgctgaatccaaaggcctgagaattaagggagccagtgatgtgactctcagtttgaggttgaaggcctgagaatggagacttagcgggggtggaggtgaaagtcatggagtatgaaggcccaagaaccttgagttatgatgtccaaggacagagtaaatgtcccagctccagaagaaagagtgaatttacacttccttcgtttttttgctgtgttcaggccctcagctggattggatgacatccatccacattggtgagggtgtatattttgtactaagacttttgattcaaatgccaatcttttctggaaacaccttcacagacgcacccagaaataatgttttaccagccatcaggagatcctttagcccagtcaagttgacacataaaattccatatgataattagtactttgaagacaaataaaggataaaaggatggatagtgattggagtagtgtgctatttttggtgattgaaatcttttgtaagatggtattttagcaaatacctgaattagcaaagaaatgagt

SEQ ID NO: 75818 - DNA, 1882 bp, Homo sapiens
gagtgcagtggcgcgatttcgtctcactgcaacctctgcctcctgggtgcaagcaattctcctgcctcagcctcctgagtagctgggattacaggtgcccacctgtaatcattacaggcccaccactgtgcccagttaatttttttgtatttttagtagagacagggtttcaccatgttggccaggttggtctcgaactcctgacctcaagtgatccacctgcctcagcctcccaaagtgctggaattacaggcattgagccacgacgcctcgccttatattctcttaagaactactttcaagtagagatgactttattttcattaagtttgtagaaattgtatttctatttagagagactaatttttgtttttaaaaggaaaaacaatcaggagattgagttgttaggaaattattagacatgtatagcttggtgactctttcaacctttcaaatgtaaaacatgttggcttttgggttaaagtactctggtaatttatcgttatcatgttctatgattgtaacctaagtctctcttcttcttctgtctccttattaactgagatataattcatgcttttaatttctctaagtccttctaccatgaattttctagctaaattaaacgtaggaaacaatacaataaggaaaacataaacctaagaaatattagatgttacataaactgttggagattgtcattcactcctattttcagaaatagagattatgataatttaaatttgaaggagaattcatacaatataatgtattaagacatgttagcgttttctcttgaggtctctcccagttatcttggagtcacatgtatctgttaaaataaataaattcattgggtattccccattgtaaaagtaatatatgttcattatagaaaaattttgaaaatataagcaaacagaagaaaaattaccatgtttctactgttgagttattgatttttataatatagaaaatcataagccataagtggtctctgttcttaggaaatataaacccatcacccctatgctttttttcttggcactttattaaatgtcacctctcttcctcctgctttggagtggcactgtcttaagttaggaagccactgttactactccccaaacagttcagcagatgaaaactagatagttggttctgttggtacaaaataaaaatatatttaaactttgtttctaataatattaaattattttaacacgatcagaatgcccaaagtagtcattattctgacgtgaaggtaatgttgccatggttttttgtttctctttataactggttttaaatgtaaaaacataaatcctaaagaacaggaatggaaaatggggatggttttcatttgctacaatttcctgtgagacatggctctaaacaagacccatatttacacaactcaatatagttttacatacagtgttgtattcagcacattttaaaattctttaatttcacttttcagtcattggtttaatactttcatagtaaatttgtttaataacactaggtgaagtttgaaataatttttgaataattttacagtagaaacaccagttaaatcacccttttggtaataaatgtcggaaaaaaagtaattatttttgctgccactgcaaaatcaattgtgtaactgttctttttaaactgacttttacattactaaattttaaacactcctgtaacttgtcagaagcaggttttggttaatagatattttcagtgatgtaatgggaacttttggcagtgagtcagaatataatggactatgattaatgttttaataagtagttttctattgctcatgatgtaaaggagaaatggtttcctgcttggatggataggagaatagcaggtgtgcata

SEQ ID NO: 75819 - DNA, 1353 bp, Homo sapiens
aaggctaggaaatacagattgttagtcaaatggaatagtgatcaagtaagatttctccattgccaaggccacaagttcaacgtataaactcagtagttcagaaatttggaaagttaaacccaggagattttgtgtcagtcttggaatctgagaaagtttataaagacaaactggaagaaatattagtataccagacttgaaggtttgattcacagtttgctttcatttttttgtgatttaattttggcaacttatatgcagtaagtatctgttattttgttgtaggtgaagagtcctagggctcagtagatacattctacttgggaatggtactttactaccatagatactttctttcccatatttgtgaataaaattgagcatttgttcaaatgtacactttcctggaataaagtttatggtttttattcctgtctcaaagggatcctgattcccaatagaggacctagagtagtggtctcaaaccatatatcagaatcacctagagggttttctaaaacaaagattgctgggccgcaccttcagagtttgtgattcagtagggctagagtgagaccccagaatttcatttccaacaagttcctaagtaatgctgatgctgatggttaaggactatactttgagaaccactagcttaatcttcgttaatagccttctagaccttttttgttatattgcatatttttgttattatacatatttaacaaaaatgcttctgttacatttgctacctgtcttaacctactatatcttatctttacattttatactttacattaatactttaaatgatacatgtttatccattgcatcatttacagtatttcataacataatttatttaaccagtcttcaattagacatttaggtcagttttcatttgttgtttttataaatagaatcttgctaaatttttatgtgatcttctaattatttcattagcaaaaaatccctggattaacggatggacatggcatggcacggtggctcacgcctgtaatcccagtactttgagaggctgaggcaggcggattacttgaggccaggagtttgagaccagcttgggcaatatggtggaaccttgtttccacaaaaaataaaaaaaattagccaggtgtggtggtgtgcatctgtaatcccagctactctgcaggctgagaacccaggactgcactccaacctggatgacagagcgagactgtcttaaaacaaaacaaaacaagataaaaacagtagatatatttataaggcccatttgaggtgtaagtgacttaacatccctggcacttgaacactaatgaatattatgactgccactttaaaggaggcaga

SEQ ID NO: 75820 - DNA, 1205 bp, Homo sapiens
agctgcagcagggatctgaatgattaaggcagctgctcaggcttgctttctcactactcacttttgttgcctgtgtcagggaaaggccagggagagaaataattggggacagggactgcatttattctgctgccagagagtatgtgcagctgccgcttccttctgattcaccactaccacttgccacagcagctgggctggaccaaaataggtagactgtaaaagattctgtgataacaaagcccattgcagcactgggtgtaacttgaaatgttttttattcatatttctctaacttttttcttatttcaaaaatatgtctgtagatacatatcgtagacctgaattgtatatttaatatgtaagacccttaatatttttgatttagtcagtgtgggagaatagtactacttactttaatgcatatatatatatgtgtgtatatatatggtgtgtgtgtatatatctataacctttgacactctgaaaagagctgcttaattgtcaaggtagaagattttaaaaacatcctcaaagtttttttttaaaaaaacaatggtgaattaattatatactcccttagatactgagcctactttttaaattttttaattcagtcattttgagaattaagtgtgttatttgtccattgaattaagtttgtgtgtaaatatttgccatttctagaatattcatacttcttactcttactaattttttctgataaaaacttcatattataaggatgttagttttaatcaattttatattatcaagttttctagtatatgtctttaatttttgcttgtacaaacctatatattaggttacattagagttctgttatcttttttcttatgtaagtttagtctaaaataagactgacatactagtttttaattcgctcatatttcttaaatttttgtttcatttgtagtataaaatcacttttttagagaataatatttagtttttcttctatccttgtaaaactacagcagccttaaattatgctataggtgttcattgttggttcatcataaaataattaacacttgcattccagaactgtaattccacttagtacagcatttcatttcatttttttaaaagaggtttccatttttagaaaatttggaggttttttccctcctttaaagacatggttaaataatgattaatatagttcaagaaactgtcttacg

SEQ ID NO: 75821 - DNA, 1060 bp, Homo sapiens
gtaatgtcatctaagcatataatggcaatactgaaattagacaaacattgtattaatctcttgtggaaataaacatctgacttggaagaatatacttaaaatttatcaaatatcttttggcctattagctactgtttattatctgtttttcatggctctatctatctcatagcccatgttcctgagatgttcctgtgtttaaatgtatgtagtatatagacagaatctatccttagaggtctatcctttgagataatcagcactaccaacaacattgttcatagaatatattatacttaagtagctatatcttctgtgtgttctatagttcacacttaaatcaaggaagtaatcctttcattatgtaattatattaactgtcagtaataactgttctatccaaaatacctggtgtgctctttgatagcaataaattacacagttatagtataactggacttatactccagttataaggcagaaagtcttctccgagcaatctatattcagttattaaatatgagtaataataaagcattgtgttcatttggaaaccatgtgtcttttaatttccaaatatgagttttggtgtttgattggtctaaatgtctggcataactattcactctctttccaagtgtattgatgtaaatctgaattcagttttattattagtttattcaaattgtattctcactagctggctagatggtaaagtgtaagagtaacatatgactgcctgtggaagtttgttacatttttgtttggacttcatgaagccatatgttttttgttttttgttttttttaagatggagtctcgctctgtcgcccaggctggagtgcagtggcgtgatcttggctcgctgcgacctccacctcccgggttcaagcgattctcctgcctcagcctcctgagtagctgggattacaggtgcgtgccaccacgcccggctaatttttgtatttttagtagattcgggttttcaccatgttggtcaggctggtctggaactcctgacctcgtgatctgcccacctcgccctcccaaagtgctggga

SEQ ID NO: 75822 - DNA, 1006 bp, Homo sapiens
caaaatgtgatgaatcaaaacagttagttgcacagtggtttgtattacagctatgaaaaccaattctcatttatgatgtttggcttttcaaggttgacaaacattctactgtggtgcttgaattttaccataagtgaacatctattgaagctaagactatgcttttcttttgaggatctgaggaaaggaaagggtgatacattatcatctggtgtgcggataaaaattagctggaaacttgtatcaggaatggaacatttcatttccaagttacctataaaaatattactcacttattatttgtatgatagttattgaattccctgtgaagccaggttaatttttagacctttctgaggtaacttaacatttacttcatttctcatgcatcagaatcttaacagttgatactttattgtgtcttggaaagtaataagcagataactttatggccatggggtaggtgtggtgaatccctatttcaatcctatgcgacctaaggttctatcaagagtttaacaacgactatttttcttttttttttttaaacagggtctcactctgttgcccaggctggagtgcagtggtgcgatctccgctcactgcaacctctgcctcatggactgaagtgattctcttgcctcccaagtagctggattacaggcacctgccactgtgcctggctactttttctatttttagtagagacggggtttcaccatgttggccaggctggtctgaaactcctgtcctcaggtgatccacctgcctcggcttcccagagtgctgggctcacaggtgtgcgccaccacacccagacaacaatgactaattaataatagtagtctctaaagtgggatgtgtcccatgaggatatgtaagatacagtatatggagaaaatattaaaacattcattcattaatttatttagagatggagtctcgctgtgtcacccaggctggagtgcagtggcgaaatctcggctcactgcaacctccacctcct

SEQ ID NO: 75823 - DNA, 1022 bp, Homo sapiens
aaagcaagttatagaacagtatgtataaaatagttctcgagatatatttaaaccttctaggttatacccagaaagacttttagttggcagaaatttgcagaaacatttccacctctgtaaccttaataatttggccggaagcatctgatatggttgggagaaggaaaaaaaatatacatacaaattgggaattaaggtcctggaaagcagaagatggaagatgtatctatctatgagatttatagaacttatgaactttctggcctttgattcttcatgcataaattaatgagtttaagatgatggctgaggtcatacttcatgactgtaacttaagttttattttctgttttttaaggtgtctactacaatagacccaaaagaaacgttaaaaagtcttttgttcaagaattagcttcactgtatatatttagtttacccatgaaaactcaaatttgggaaagagaatctgggaatgattcattctatacactggctctaatttatagacatcaaatttgcaaagttcaagtagctgtcgaaaaacatagtaaaatacctcaaaattgagtgacacatctaccatggctcccttttacaaacacaaaactaaataaggagggaagcttgtttgctgcatagaagtactgtctgcaacttggctacccagcatgaagatatgggtggtgtgttgtttcaaaattgtaggtcttgccttgtctatctggtgacataagagtataattaagccagttaattggcctgtctgaaaaattcctcatgtgatatggtaactactttatggccatggccctataggattgagatggagagccatttggctttaaagagatgactttttctcacgaataagtctaatgcagtatattaactggccttaggaatagcataaacaccaggagtctaattaaaatgcctttaaatgcactgttgtttggctcttacagtagtaaacttaaatgtgtatgtgtttgcctgtgtgtatacacaacctatccaat

SEQ ID NO: 75824 - DNA, 1021 bp, Homo sapiens
cctgggttcaagcaattctcatgtctcagccctctggcatcttaagagacttcctatgagttcctgcctccaaacttttttttttttttttgaggcagtcttgctctgtcgcccaggctggaatgcagtggtggatctttgctcgctgcaacctctgcctcccgggttcaagtgattctcctgcctcagcctcccaagtagctgggattacaggcacccaccaccacatccggctgatttttgtattttttagtagagacggggttttacagcgttggccaggctggtatagaactcctgacttcaggtgatctgcccacctcggcctcccaaacggttgggattacaggcgtgagccaccgcacctggccagataacattttttagcatactgtcttcatggtgctgttttaagagatttgcatgtattattctcacaatagcaatgtgaggtagaaattgttacatccactttagagataggaaactgaggcactgagtgattaactagcttgcttaaggttgcacagctagctagttagaagagctaatattcgatttaggcaagctaactccagagtccactttcataacactgtgctgccatttccccactattataggaacctggaagcttattttctggagaaggtaaactaaaaggactcagcaatcatagatattaggtgtagttaaggccaagatcaccttactgaaaacagggagattaagtgaaagtctactaactgaaggagagtcccagttagtaggagttctgagactgctggcagcaagtcttctactttcacttaagggattggaggaatattttcaacagaatttctcctgcccaagagaaaagacctacaggtaaaaatagttgagggcccttcaagaaagagctgagtacctcctgtttaatcatcatatagttaagcataccactcaataagcctcttctgtgtacacagagcttgtatttagtcttttaatgcatcacacttacgtcaagaaatagcca

SEQ ID NO: 75825 - DNA, 1047 bp, Homo sapiens
atggttgtgagctgtccaaactatattttgatgtgtttttcttcttttgatcagggatcatagttcagtaaacccacagttaaactaagtgggctgatcgtatgggtctatctaaagtgaatttgtgtacttgtctcatccttcttattaatgagtggttctaaactggacttggtttttctcccatggggcatttggcaatgtctggaggcatttctgattgtcacagccggggattggggagggcagggtgaggcaaggggctattggcaggtagtgggtaaaggccaggaatgatgctaaacattctgcaatacacaggacagcccccaacaacaaataatgatctgggcccaaaagtagtggcaaggttgagaaaccctggcaacattatgtgtgtgctccccttgtgtagtgattcctttgtagtgtttgccttgacattagattaagtgttcccttaagcagaagctgaattttttgttattgagttgcagtgaaggatgggtgtgaatctctgcagggttaaacatttttacattaacctttcctttttatttttatcaaaagtaatatatggttacatgtatgtgtgcatgtgtgcacacacttatgcagaacttagaacagttccccacccattcttccctagttttatcgcatttcccagagttagcaacatgtaaagagttttgtttttaatttttttggtgattgcctctctaagtctaaataatagcttttggttatctattgatttaagagattatctattgactcttcactgcagaaggttagcaaaagctcagctacactaatccctccccttcttccttctaatattcattagtttatattcgattgtcctttcattgattattttgtaattctaaattaaatacatataaacatttaattttgttccatcaactttagtcagtatctttttatcttctgcctttattatactagcgcttctgttctttcaccttccttattcctatttcctatagtctgtctgctgtacctttacattgtcagattgac

SEQ ID NO: 75826 - DNA, 1033 bp, Homo sapiens
actgtcatttcatgttcatatttcctgcgttgcttgtatagcagcaaagtttaaagagtagggactgctgagagtcttcttttcctaaacctcttagagtagttgtgttgtcattttaatacatgcaccaaaaaagttcatagtaggcaggaacactagacaaagcatactctgaatgaggagttgttgtttggttgcttgtttaaattttctccacacttccacagttgggttgaaacttaaccatttccttctatccagatgttatatagttataatatgggataatattatgataaagaaattttttgaaatgttttgaacttgttaaagatttatttcaatgtctataaattggtatttattcaccagacaaatatttattgatcaaatactttgtaccatgtactgtgctaggcattaaaaatataagtaggtaggcaggtgggtagatagatagatattctagctttcaagatattaaatgcttaaattcagccaaagaatgaaagaataatcatcaataagttaatattactgttttttgcaatatattaattgaaaataaaaccaaatttcatgtatacctactactgacagtaggtatcatttgtactgaagatagtatacacaagttcaaaatagtcttttcacaaataacttcgacattttggaactaagttttacataggctgaaatgcagaattttttctggagagcgttcaagtggcaatcaccacatctccaaagacactttgccagattttcatatcattagccctcctctgcaaacctcaaggctcctaggtcctaataacttagattgttttcagtgtaggcaaatgctgtgccactgatagaattcctaacaaagatgggcatgaaagattatctgttcccaattcatgtagaactgaatgattctagacagctagtcagctccaggcatacgttggggttccgatccattaagacttgagtgattgaaaggcccacatggaagcacagtgttttactgtttcctctaagcata

SEQ ID NO: 75827 - DNA, 1044 bp, Homo sapiens
ctggttggtcagttgccagaattctagaaaggattcttgcatttggaggtggataaatcatgagttttcccaactcttaattttgttggtttgcttgcttgcttattttagaacttttttttaaaaaggtgatttagagtggtcacagcagtttttaatgtcccttaaatttagaaaagctagtaatgcttatttagtttttagaatgatatcctcatgattttcttcacattggttaaaagtgtattaagtgcccagtcagtaataaccaaatacatattttcagagttttttctgtcttttttcgtagccagatgtacataaaccatttctttattataatagaattggaagcttgctcttgtgagcagaacactagattggaagtcagataccttgaattctgtctactccagtctctgccattgggtagccatgtgtcttgtggaaatccctcactctcactgtcttggcttcagttccctctttgttaaattgttggacggtagagtgggaagcagggagtttaaggtcccttcttaccccaaaatttgaattcaaatttggcacattgggaggcatattaattattttaacgtattaacgtattttattacaggaaagttcaatgcgagggttatacttggttcaaaagatgatttggccctttcttaggtatctttaacaaatcaataactattgccctaaaagcattcatggatgctattttttgtcactaagcaaaagggaacttcagttcttaggactaccctttagaacctcctcttaggttaaagtctaggaaccctagccttaaaaagtagtttcttgattgatatatacagaatctgtggaacttctagtccatgtatgcttgcaaacaacatacttatttgggaggatatttaatatactgtgtcattatattaaataagtatatatatatatatacagttttattataataaataagttaatcgtacaatgaccaatgttacttcattaaaatggattttgattattttctttattaattggaaatat

SEQ ID NO: 75828 - DNA, 1035 bp, Homo sapiens
ttaatcaatttttccccagatttttgccattgaaacttgactttcatttttgttcttagcttttgtaagttttgtaaggagaaagtgaaatgtttcctgatatataaataagtaataaaattaatgtgcacacaaagtatactctttattcttttttttttttttttttgaggtggaattttgctctttcacccaggctgaagtgcagtggtgcagtctcggctcactgcaacctccgccttccagtttcaagcgattctcctgcctcagcctcccaggttagctggtattgcaggcaactgccaccacgcctggctaatttttgtattttcagtagagacaggatttcaccatgttggccaggctggtctcgaactcctgacctcgtcaaccgcccgccttggcctcccaaacactctttgttcttcatgggcgtttcctttttggccccaacacatacacacaaacataatctctgggaggaaagagaatcttactctgttaaattgaagttctgactacaaatcttctgagtttctatatatttaagcttaaactcaagtatttacatatgaatgagttctgtattctgtaaccatattaaaacttttcctagtatttttatagaatttgtttttatagctacatcagaattaggatcgttattaaagtgctataaaaggtagttatttatcggactctgttagattaaatgtgagaaataatgctagcttcaggttatgattacataatatagatgaaccctgttaataaaatggaataaaagttggaagttttgtctttttaatatatttaatggtttatattgaactttctctaatctttttagagactaattttaaatgtaattcattatgtattcttttttatcctataattatatgtgttcataatgcaggggtgggtagtagagagaggaaaagaaagggacagagggaatgagacttctctgttgtggggaggcatctttctctagtaagaaggaacagataatccagttactagccataccta

SEQ ID NO: 75829 - DNA, 2978 bp, Homo sapiens
tcttttaattattaaaacagagcttcctgctgctattgcagaatttttgactggagactatagtaggtaagaaaaagtattttacattgtgtccgttcatgtattaatttgataaatatgtattaagctgtaaatggcaatacttgtagtggcaggtaaaataaatgtagtccttgccctcaagacagttacaaattaggcagaagtgaagcagtaatagaatagaaactactcagccaatgtttgattacccatatgaaagcgctgttctgtgaaccatatgaagcaccagatataatccttgcattccttgggggtgtgagataggctaagacaggtctgagattgagatgctcttaaggaggaataaagggtaaatttctggggatatgcaagacacaggttggggatgggagaaggttgaatatactgacagtacgggtcttaaacaaaggaggggagtgaatgatattgctgtcatttctcagcaaatcatagtgataaaaaatgtggcagttacaactatacctgtttgaaattcctattatataccatggcaaaaaaataaattatttgcaaggacttaattgtttcatttcctgtttttgaacaatattataaacaatactaaactacattgtatctcttttatctttctttaaaaaatgcatcttacatttttgactcacctctttatagggaaaaaacaaaattaattgtacttttcactgtgtagaacaagaacattctagaaaaaggaacttgaaaagacagaataaatcattttaattgccatcaagttatttcacatagttaagtttcaaaccacagtacaaaacctgtcagacttttagatttgaatactgggttgttctgcttcaataattgaacttgttctggaatgcaaggaaaggtttcaaaaattagtttttagcttttacatttcagcttccattaaagaattctacttagacaactgcaaatacatatttgtaagaaaagtgtggtgtactttagatctgaatagaaaccatcaagaaaatgtagttaaaaaaagacaagtagaagtcctaaatgatttctcttcatcagaagatattgttcctttgtatgatactttacagttaatgaggtttccacatgcattatcacatctgatactcaaaactaccttattttatctacagctttatctagttacattttgattttatgcttaggttgataaacaattcctataagaaatagctatgtgaaattcatttttgtatctgctgtaaaaaacattgagggcaccttctattactcaaattctatgtgagaaatttatattttagggttaagaactcaaggcaatatgaggtagaataaagagggctagactaagagtaaggagatatgtgttctatccatttaatattcaataatctcaggaacttaatttaacttcttttgactatataaagtacttggagccttaggtttttttatgtgatataatgggggtaccaatattgccttctcaataaagttgctgggatgatcaagtaagatatatatacacatgctaatagcatgtgtataaacaagcatgtgtgtacacaaacttacagcacagtgtggagaattaaggaattctaataattactatattaaacgtggtgtttccctttttgccctgactgccaggaagctcagagtcaaatgtgacacatttgaattaatataactgtgttaattccaacagttgtcacaagtgttttcttttttcttgatcctgaatttggtggctcctatttatattcttttattgtcatatgtcggtggaaagaggagggattagaaatatatgtaatattttagaaataattaaagtagtatgtggcagaactggtattgaaatttaggtcttctttctctaaaagtgatatttttaccgtagcttcattttaaataattggcaaatgatttacattgttgcattgatttttttgttttttaaataaaaattaaaatgaacttccatctcattcatattaatagaaaattgattaaaatgttatttttacatgttagaaatacatttttaaaatcatatacttcaaaatactgtggtcagtttgcatcatctctgttatgttttaaaattgtacatctttttaacaaccttatcttgttttaaatgtaatatatattcatttatttttggctaattatattaacttacttgaatgcagataaatcattagtcttgaaagcttgatgctagaaaataagtaagaaacaaaatatgataattgactttactatccataaaggacagtttttttctagatagacttacagtaggcagtatttcttctatgagagaaacatgatattgataagcttttattttagggtttgatatacaataaattttaattaagatctttcaggtatgctaattttctgggttatctgcgagcttggtgtacctttgaaatataaatctttataaagatatcagaatgaaactgtgttcataatattctaatagaagtcagaagctataatacttatactgaactttcatgatatatctatatatttcatagaataacttacatttttaaaatctgtggctgttaaagttggaagctctctgttaacatttaatgatcttgtcggggaatatgattgacacaattaagttgtcttgcattttagttacataattgatatgggatgtgagtaagatcctaattcagaacatatgatactcttgttccattcctttcgagaatgaaattaaagcgacttataaataaatctggttttcattaaaatatggaaaaaaacatctgcatgccaaagcatttgcaatacagctaaggatttatactctatatttcatacttggaacatttttatcatacaggattaaatccacagatcaaacaagttctctaggaagtataaaggtttttactctaatt

SEQ ID NO: 75830 - DNA, 1034 bp, Homo sapiens
tgagcttttcataagcttggttcaactctttcttgtttttgaaaatgcatgaaagaaacagccatatgtaagagcagaacagcacatcagtagttaagccatattaaagatccagatttcaaagctgtcaaaacaacctagggtgcatttaacttaggctaagctatcttctgagacacagggataaaataactttaaattatttaaacaaagtggaagtgactctgattttagtatatataagcatttattctctattgaatgctcttaaaactaaaaacatttaacagtgtttacatttaatcatttgttgaatttaacaacattaaaatcattcctcttcttctctccccagttgtctgacttatatcttacagataagtgaattgaacatacactttgtaggctccatattgaaaaagaaaaaaactaaatatttccatcatcatttgattgttgagaagtgtggttagaagtggcctacatatgcaaatgaatgtatggatattaaagagaatcagtatagataacatattgaatttttctctcacagataattggcaatgcaatcattgcatagataggagtaatttagttttcatagccaatagcttaaagcaggttaaatgtattgatatgatatgtctactgtagttttgtttctgtcatgacagatactctttaattcaatgcagatttctaatgtagcagccatatggaaataatacccatattctacatttattgtaatgccttataaaccatctgctcagatttttacctgtgagcacagtttaatctacagtggggcaatgaagaatactctgtatgcttttttaaatactctttttaattggcatgtttattttattatttatttatttatttattttgagacagagttttgctctgtcacccagggtggagtgcagtggcacgatctcagttcactgtgacttacatctcctgggttcaagcaattctcctgactcagcctcccaagtagctgggatttcaggtgcatgctaattttt

SEQ ID NO: 75831 - DNA, 1037 bp, Homo sapiens
tggagaacagtgtgtgcaatatataaataagtattgatatatttgcttcagaataagagtctcaagagttgagaggagagaaggctcactgagagctagagtaaagaaggattttagaggaaatacaacttgagttgagccacaaaagaagcaaagggcttagagcagagagaaggaagggaggccttttgtgcaagtgaacaaatatttttaatacttagtctcctttttccctttgtcattccaaccccaagacttaccttcttaccaacctaagcaaggacttcctgttaatctttcctctctgttgttgggtctcgtttcactcccgttctgtacttctgctttgtgggacatcatctctatccaccccataccaccatacaggcttggagttgggatggatctttgcagagaaattagctgtagtaactgaactgtctattaatataaaatcaggctacttcttatttttttcaaattaataaaaattaatgataatattgcactttggagcattgctttgaaatattttgatttgaaagcttaagaaataacaactgataaatgaggcagctcacatacagagtttatctaggtacctggtgcacagcaagtcctcagtaaatgattttttctgccaacactaccactgttagttaggggaaaatataagaaactgaatttgggcctgtgcagtggctcacgcctgtaatcccacactttgggagcctgggacaggcggattacttgagcctaggagtttgagaccagcctgggcaacatggcaaaatctattctctacaaaaaacacaaaaattagctgggtgtgatggccacacacctgtagtcccaggcactcgggaggctgaggtggaaggatggtttgagcctgggaggtggaggttgcagtgagctgagattgtgttactgcactccaggctgggtgacagagtgagaccctgtcttaaaaaaaacaagaaaagaaactgaatttggagcagtttcaccctcacctcatcctcatcgtttttttt

SEQ ID NO: 75832 - DNA, 1007 bp, Homo sapiens
tctacagtaatttttttcttggtgaggtttttaattaagagtgattctttagttcactcattaacttaatcctaaaagtatatgttttccttatatttgttttatcactgtgtaaaattttgattaaattagtcaaaatccaaaactaggtaaataccaagtaggaatagaaattgtgtttacatattggtctcctacaaagaacaaatacttcctttattctttcttgtccttttgtgcactgggattcaccctggagcaaacatttacagagtaattatgtgccctgaaacaacagcaacaatggtaatattgacagagccacagctataggtctgataacaggatggccacaattaagagtaaaaacatgaaacattttcattgattaattctgggaaacagcatccctctggatttcttttaatgttttttttgtttgtttgtttgtttttaccagctggagttccctagctatatgctcctattccagccagctttctccacattaaccaaaaataattcagatctgtaaaagtaaggaggggcagcacttaatgtgtacatcagaaatccctgagctccttctgagtataaagtctgtacttatttcttcctgtggcctttccataaactgctgttaaatgtttctctattcactaatacctactctacaaataaccatattcctgtgtgacagtcactgaaaacatcatgttcctgttttgagttgcacttaaaaaaaaatgccttgatgctgttggaattttgaaagttgacacaggagtacccttagtctttaatgggggagatctctacttaacaccctgcagtctccaaccgcctccctaccacaggtgaccatgttaaatgttgaccccattctaaccgggaaaagtcacagaagcagagactcttctattagcatcttatttaattgaaatgatactgacctatttcaattcagtttcttattaattttataagaaatgatctgagtgctgatt

SEQ ID NO: 75833 - DNA, 1024 bp, Homo sapiens
tatctctctggtcccaaaagggagattaccacatcttttacatggtaaagacctccaggtgccgtaaagatctaggtaggataattgacaagccaggaaactgagcaatatatgaaatggagaatttgtgaattaaactctcattttcctagtccagcctcaggaaacactacagcttcctctctcctaacccccttcagatattttaagactctaggcattatgtcccaagataggtcttcatttctggaatttcttttgtttaagagcctgaagttagttaagtggaaatttttttagagcagaaaggagaaaatagatcaccatcgtctatttggtaaagatggtattttcacttaaatggtaactttttttgctttactctgactcttaagtattctaataataaaaacaaaacaaaaccttatatttgtatattacattggatctcttaagagtttgtaggtctagaataaatgatattcattcccattgaaagagatcctaatcaaagatgctggcaatattaaaatgtgattaatattttcagtattcccttggattgagttcatgaaagcaggttcaagagcattaactattagtgctgcttagagtaataagatacatttaaattgtgcgtacatttagaagacagagaattaaaaaagagcatttctaaaatgttatttttatctcatttaaatattatttatcttatgtaatttttaaaatcttatccagataatgtagaagtagtgattgtagtaaaagcagcatggtatgggcagccaaataaaaaatattctggctagtacaggcaagcccactatcaaataaaatatttgctggatcacaagtgtttttctcttttaaaaaattcttattttataaagagaagactcattaaagatgaaataaatgtaatcaaattgattttttaaagaactgagtttgttgtcaaatgaaataatggtttcagtagagtggcatttaataattttgtctctttaaaatttttttcaga

SEQ ID NO: 75834 - DNA, 1040 bp, Homo sapiens
tattgtgtatctttttacctctaaggctttcggattgaatgacatcctcttttattaatcctttcctctcatcagtggatcctaagtgttagtttaaaacaaaacaaacaagagttagttctgtccaagttaagaatgtttcctagaagtgtaatctttgaggctggcctgtaatcccagcactttgggaggccgaggcaggcgggtcacctgaggtcaggagttcaagaccagcctggccaacatggtgaaaccccgtctctactaaaaatacaaaaaaaatagccggacgtggtggcgggcacctgtaatcccagctacttgtgaggctgaggcaggagaatcgcttgaacccaggaggtggaggttacagtgagccgagatcacactactgtattccagcctgggcgacagagcaagactctgtctcaaaaaaaaaaaaaggaagaagtgtaatctttgtgtactaatttcgaatgaggacttctagtgtatagttattgatggagttgttcttgaatgaggaattctctcgaccagcttaggacatacttgtttctttacatataattcagatcacttattctacctttgtcatttttgtcttttagtccttcaaagaaaagaatgcagaatgttaccaatacagcaattgctttaagttttctcatttattttatatctgcactctttgggtacctcactttttatggtaagtacattttaaaattatagatgacaaaataatagttacatagatggcctcacgccaatctatagactttacctatgccttttattactaagttaatttgctcagatcaccaaattacaatgcagtactgtggtggctcttgaggcctaaacaattggattatctttcttttagaaaggtagttcaggtttaagattaatgacttcttatgaaaattttcttaaacacttaagtaaaacttcaggcttagggacatgattctttctataagaaaaaatgtgcaattttaatgattctgtttttcttaaattttgaattcaatata

SEQ ID NO: 75835 - DNA, 1052 bp, Homo sapiens
gaatcataaccaagaaaaacctttgatcatatctttctaccaggataacaggagctttgtgtcataggaagaaattgctggttgaacctgagatcttataagggctagcctcaacttaaggcttccaattcattttacagatgaacaactaaagcccagagaggtgaagtgacctgtcacagaattaaaggcaggtttcctgaatactaatccagtgttatttctgctactttgtgataatctttgtaaacttaataccctgtttgacaatgtgtattaaacaggacagcctcctgacttcaatggcatatataacttgcagagatcaccattaggccctttctgagatttgtagagatttgtctgaatccagggaagcatgcaccactctatccctcacatatgttatggctcagttaagaacacagagtgactggctcagaagaagtgttttcatcctgggaaagtagaaagtggacatgtgacatctattttgaatttgtaataaatctagttcttcaagattcaggagctgctttggatccttttatccagagctcctaaagtttaatttctaaatttgtcagattaaagggacttataggtatgtacctagattaatgatacttgctctgattacagctgtgaaaggaagagaaaagggttcctctggtgagccaggccagtgcccaaatgttgcataataaccaggccatttaaaaagtctatgaggttgttaagcaagaagtgttaatagctcattttatgattcagaaaatggaaataaaatagtttgccatatttctccaaagactcacaagtatctcacagatttggaaatagaatccagatttcctggctcttcttagtctcctacttagtccaaatcccacattgtgtaaagtatgtttttgatactttggacaattcatttctctcctgtttccattatcactagtctagttcagattctctttacctctcagtgattgtaacagtagctgttatgcctgtttggggtctctttttcttccaatccgtactcctgcttt

SEQ ID NO: 75836 - DNA, 1054 bp, Homo sapiens
acatcagcacacattcattgactcatgtaatgttctcagtaaccctatagtttagtatatggccatccccattttaaagatgtaggaactgagagactcagtgtaagttgctagttactggtggggtttgaacatgttctatgtcatcacagtttagaatctccatagctcttgtttagaactctctggccacttacatgtgtatatcacactttctatcatagctatgtgtattcatctcatctcttcttaaagttccctgagaacagaggtatgtttccttttgtttttggtttccctcaaagtatcctttctgaaacactctcaaattaaaaggcaccattctattttaagtacaaactgatattttcccacaaaacactgatatccagtgtttctgagcaccctcagtcttctttccccttgtctgggttgaggttagggagacattgtgagaatgcaagaacactggagcaaagcttggtcggcatgtataaatcctattgctgaccaccacacactggcctactaagtaagacatttccctaacacttctctttttttcataaaacatgaatccacagatgaaacgtaacatgcaccaagctctgagattctagaaaacgttgtggtattgaggaaaagatgctgtctctagcaccaaaaagaagtaggtgtatggcactgcccctttgtgttatgtgatcttaggcaaatcatttaacacttttggacctacctgcgtattaatattgttatcatggggactaaattcaacaacacgtgtgaaagcactttataaacaaacagcacaaatgttcaaacccttagattatggaaaagttccaaagagataatttagtatacatattcattgtcataatttgagaggttctgcttattctggtttttattaaaggaaaaagggtgttaggtttcaagaagatatttaattaatgtctctgtgtttcataggctaggggaaaggccaggatttggtaatgggaatctaaaatctgttatcatccattagtgcaaaggaaaacaattttgt

SEQ ID NO: 75837 - DNA, 1042 bp, Homo sapiens
tgctttctctgggcattggtacccatacccaggtgtggtcagttggagtaactcctgccttgctgggcttaactgtggtgtttctgggcctaaggcaattggaacatctgtagtttatttcctaatcccaattttgtggaggtttgtgttctagctttgattcaattactcctaagtagtggcccgtattaagtagaggctgtgtgagacaagacacttaatgtaggccccttggagctgctgggtccttttcatcagaatttggctaatgatgcctctctcttttttacacactaaagcctaatataactagtaatgaacctcattaataatttgtattggcagatgtgaggtgtcacacattaaaactgttttacaccatgagcattgacttcattcggtcagtgagggaggatgcaaccacctttgccaaaataggaaggaagagaagacccagagttttcagggaacggaattaaatagcactttaacaagcttggcggaggcagtggggtgaggagaggaagttaataggcccagggaggagagtatctcactggtttctccaagctgattcttctgggtgccaagagagctgtggaaacccacagaggaatgccccggttcctttccttccttctttctggtaagggtttagatctatttatttgatggtcagccttccagttttatcagcaccggtctctttgtacaacttcccaaatgtacaaactccagacagatgagtacagttggtgttttccggggagggtgttgctccctgtggtctgtcacagccagagagcagggggccagagagaggactgattgcccatatgttccacatgagtcgtcagtggtgcacccagttttaaaatgctctgggggtgtgtggccatgaagtggattttgaatgaatagaaggaaaaagctcgtggatgaaaaccatgagccatttgaaccgtgtgtggtgtctggaaaaacaggtggtctggcaaaactgacaaagtttgcttggggaaacagaagctttgcctccacc

SEQ ID NO: 75838 - DNA, 1099 bp, Homo sapiens
aagaatcacatggatgaagcaaatgatgataaccaaaatataatgtatgggagatcactttataaagatgtaaggctatacaataatttaacgtgtttttgaagtaacattgcaattcctaaggggaccaaaatgaatggttggtcttaatgggctttgtctgaaaattgactggaacaattgcttccaaacagaagatacttggaatttcatatatggaatatagatgagatggttggcatttgaccatttaattttatcagtcaatataaaatgatctatattattcttaattttcacacttttccatatttctaatcctaatatactcatttgttgccttttcccacttaattgtataattgcagttcccatgttgcttataatagctgcataatatttcagtcactggtttacataatttaccatcttcttattgctgtttctatttgtgtgtgtgtgtgtgtgtgtgtgtgtgtgtgtgttacaaataacacttccgtacctatagctgtttctttttcttttcctttttttccccctatatttaggggttgttttcttagggaatatttttttctgaatgcgtgaggaacttaaagtttattctataagcatttattcagcatctactgtgtacagggccctggagatacagagatgaattttagaacctgtgcacaagctgtctccatttcctggactctcttcctccctctcccttcacctgacgaattctccatttaaatcccactttgccaatgaggcctttatgtattccccagagtattttaggcttttctgtactttttcttctcatttagtcacagttatattgtgtacatctcagaataactaagattacttcatttttgccttcctcattagactattaaacagtaaactctgagaacaggttttatgtctgatttattttccttggtaccctcagtacctgggacattatgtctggcatataccaggcacagaaattcaaatgagtacttgcataaatgaattagatgaacaaatatttgaatatgattcttgccttgagaaatttagattagaactgaaaaatggattcaatggataattt

SEQ ID NO: 75839 - DNA, 1039 bp, Homo sapiens
gccagtgattcccatgtctctgccttgcactgcctggtgaccagattctgctggttgtcatgtgagtatctgaaagcctccttaaattttccaggagctgaatgcatgaccatttctcctaaacctccccttcttttctgaatttagagaccatattatatatggtggttaagattggggctctggaatcagatttggatttgaattggggctctgatacttcctggatgtttgagcttgaacaagtcacttaattccctgaccctcagtgtctttctttttaaaatggggataaaaatactatccatctcagaaattcttatgaggtagattgtaatgcatttgtacagtgcctggctcagaataagactggaataaatgttagctgctgctgttctctttcagtttccctcatccacggagacatccaagccagaaacctgggagtcatctctaatgccattttcctttagctccttaatgcctgttttctttagcttccatacatagccagttacccagtgtggctgatttctaatcactgtttacttcttccttctggacatttctgagttttcctttctcttgattcccattaccactacctgtgtgaggcctttatccttactttccaagatgaagccacagcctcctgcctcctttatgttcctgtgatcctccctccagtgtgttaccaggctgcctctctgtgtctaacagggtttccaccctggttgaagccctcttgtgatgctccattatatgcaaatcaaaggccaatctccttagcatggtattcctgggtgtcctcctggcccttggtggcattctagcctcccttttaccacttcctgattccggcttcatccttgagcaacacagtcttgctgtgttccctgtgcaggccctgctctttaggctctttcccacctttgttagcgacactgcttggaatgctcccttccctgcttttgacttagtaactcctcatcctgaggactcagctcagctatcacctcctccaggaagccttctctga

SEQ ID NO: 75840 - DNA, 1008 bp, Homo sapiens
ggttcttctagtctgtgacagtttctcagactttccttggttttggtgagcttgacagcttgacaagtcctcgtcaggtattttatagaatgtccttcaaattgggtttgtctaatgtttttcctgtggttcaagggttttgggaggaagaccacacaggcaggcatagtaccacatttcattccatcatgtcatatcaattgcataattagcttttacatgcatacatgctatcaaaacgacctatcactgttgatgtgaaccttgattgcatggctaaaattatgtttgtcagatttctcacataaagttcctcttccccttctttccatactgtactcttgggaaggaagtcactgtacatagctcacactttagttgtggagaattatgctctacctccctgagggaggtagtatttagagaaattattgggaattcctctgcttgggagatttgtctattctcccccatttatttattctatcatttatttgtatcagtatggactcatgcatattttatattttaggttataatctaatatcacatgattgtgctcctcaaattgtttcagatttggtttttgggagctgtttcaataggctcctgtgtccctttgtgacatgccacccatcctggtgggtttttgttgttgcatgtgtgctttttaaaatcacatccttattctttctggcactaaaagatgcccctggctcactttgtatattctttgccccatccctagaatcagttatttctccagggaccctggttccttttgttggagaatggttttagaaaccaagttctgggcactgcgtgtccttgttgctactgaggtgtcattgcttttaggtctgttcagctgacggaacagagaaataggtgtatactcacccttgtatatacacatatctgtaaatatttctatatgtatccatctgtatctatattaagttgaacatgagttcatgctaatgttttcaactccgatacagtgttaca

SEQ ID NO: 75841 - DNA, 1036 bp, Homo sapiens
agcagcctctggagggcctggaacctgggtgggaaatttgaactttgttgatcggcagtgaattaccatggaatgttttcgattatgggggcaggactagagtgttagaagagtcctctggtggtgggtgcaggatggaataaagtcaggaaggaagaaataggcccaggacttgataagggatagtttgagcctgagcaaaggtctgtgttaggatggtggcgaaggcaataggaaggatgggcgcaccagctgctgtcaagggggccagacgagtccagtcttgttggcacggtgcagccctggttgactctgctgtaactggctggactgtgagcttctgataaatgtataattgctggatttaatttcctagtgtgcacctgtgtcgtccataaacgctgccatcatctaattgttacagcctgtacttgccaaaacaatattaacaaagtggattcaaaggtaagaggatagcagtttgctgattaaatgtgcgtgtgtattgtgtatgctgtgtaccgccgtctctctccctccctccctcctttcctccccctcttttccttctccccgtccccaaacctctgctttcctccccctgccacctcccttccacattctttgaagccaagggttgtattagaatagaaatgtctctctccctttttttaaattatggcatttatatttctgtatttatgtggcatcatccctcctttgtgaggaccccattagtggttggctgggtataagctatatggattggttctacttatttggagagacttttggcagagtgaaaggagccctgaacttggcatctgacagcctggatttgaatgctgaatccagcctctgttagccatcttctctatgagctgcggcaaggcctacaatctctcttttcctcagtcttaaaacaggatcaatgtttccctcacacagtttttgtaagttaaacaacatagaattgatgtgatacatatgttaataactgtaaattatgtttcctaagtaaaaagattgctggctt

SEQ ID NO: 75842 - DNA, 1012 bp, Homo sapiens
caaagaagcaagtgaggctgggcgcaggcagcactttgggaggccgaggtggggcaatcacttgagcctaagtgtttgagaccagcctggccaacgtggtgaaaccccgtctactaaaaatacaaaaagtagcttggtgtggtggtgcatgcctgcaattccacctactccagaggctgagacaggaggatcgctggaacccgggaggcagaggttgcagtgagccaagatcgtgccattgcactccaacctgggtgacagagcacgactttttctcaaaaaagaaaagaaaaaaaagcagcaaaggagattttctaatgctgagatagaggtatacaattttagttttgctgtcgttgttgccttctttgaggtttgcaaggtatcggactccacagtacacatagcatttgctcgctgtgcattcgtctgttggaagtccttatttactgttgtaaaactatccccatttactgttggaaaactaactataaagaacagaaagtgttacttgctatgagaagttacagcagaaagatgcttactttttagctgcccagtgttgcaggccctggcttctcaagtaagatgctaatcagtgtgtaatgctgaactgtgacagtctcccctggagaatttaggagtgagagggggtgttggagccactctacctgcaaagcatttcattgtgagggcctttgtaaaaacagcactctcctcatgcagccctgtggaatcagtctctctgaagcccagagcagggcagtaactagccgaggatcccttagattgtaagtggcagagacaaagttcaagtttaggtcaggctgactctgactccatatgttgtcttattccgcatttagttggttgattcagcctcggcttaagcacctcctatctgtcttggctcccctccaacctgacaatatggaaatggcattgcccttgggaacagaaaacctgaactgtgttttagctttgttttccaccatctaaatggcttgagtct

SEQ ID NO: 75843 - DNA, 1058 bp, Homo sapiens
tctgaccctgattctcagatgtattcacttgtattttgtggaggaacagaagcccagttcctaggagactcagcaagggaagggcctgcctctctgcctttggttggagggtctggaacctgccatggcccagaaaccaagaagagtaggctgggaaggaggcagtcatcaagtcagttctcccaaggggaaaaaaagaagactattcattcttttgtcctgggcttcttggccgattggaaggccagacagtgctcatgaataatttactcatggtgttgacttttttccggagtcaagccctacagaaaagtaagggaaacaaaggggcatgcatcccattgaccagacatctttcagcatgtttcatcaactgtattaaagggaaactcagctgtcattgacatttcaaccccaaactcctgaagccagccagcacacatttgattggctgtttttgacaaagtgtggaatactgtatctgaaatatgttgggtgaggaatagtttatagaagggcacagtttaaatttcacttcctcctcaccatgttacccctgggcacacagcactttccaacacatgcttttcgactcatgagtctgactgctttgtgccttatgcagctgttggcatgctgggtgcacggtaattagtgtttaccctgaaagctccaaatgcttcccgtggtatttcgccatcccattttgcagatgtggcccacagaggaagcttttgccccacagaggctcactgccaactctgacatgccgccttttactcccatgattacgtggcacatgaacttttcaactttgagctgctgatttctcctcagattgagagaaaaatgtctacttaatttgactcttttaaaaattcagaatttgggaagagtagcaatctcactcgcaagattaagccctgttaagctagtctctgaacatagttgggggatctgtgtgaatataccgatcaccaacatcatctagctcttgtttctcaagaatcatgagggtccacaggtgcctcgctgactccagataactcagctgggca

SEQ ID NO: 75844 - DNA, 1040 bp, Homo sapiens
tcaacatcactaaccatctgggaaatgcaaatgaaaaccacaatgaaatatcacctcatacgtgttaggatggttatccaaaaacctgaggacaagtgttggcaagggtgtggagaaaagggaaccctatgcactgttggtggaaatgtaaattggtgcagccactaagcaaaacaatatgtaggttcctcaaaaaaattacaaatagaactatcatatgacccagcaatcccattcctggatctataaccaaaggaattggaatctggatctcagagatgtctgcactctcatgatcattgcagcgttattcacgatagtcaaaatatggaaacaatctaaatgtccttctgcagacaaatagataaagaaaatttgctatggaatattattcagccttaaaaaagaaggaaatcctatcattccggacagtgtggatgggcctggaggagattatgccaaatgaaataaggcagacccagaaagacagatactgcatgatctcactcatatatggaatctaaaatagtcaaaatcatagaagcagggagtagaatggtggttgccaagggtggttgggggacagagaaatgggaagatgttgatcaaagggtacaaaatttcagttatgcaggataaacaagctctggaaatcctactgtacaacataagacctatgattaacaatgctgtactgtatacttaaaattttgctaagagagtacatcttaagtgctcttatcaccaagaaaaaaacacaaaggaggcaggaggaaacctttgaagattatgtacaggtttattgcactgacagtagtgatgattttacaggtatacacctctccaaacacatcaagttgcatacattaagtatctacagctttttgtatgtcagttattccttaataaagcagttatttttaaaaatcctcttccctttggtcccccagcctttaacatggcaattgacatggcaattgacatgataaaagctactgtatttccttgatttaaaaaaaccacagctcacaaaatgccca

SEQ ID NO: 75845 - DNA, 1011 bp, Homo sapiens
ctctgtgggcttgggatgttaacaggagccaaaaggagggaaagtgtgaagaataaagtagatctgagaaattctgagccaatcaggcttcttaattcaagagacaaaccaagacgttctgtcaactgtgctgtgctcttctttaagccaatgaaccccaattcctggcagtctacaagaagtctcttaatgctaatgaagaatttaaaggtctttttaaggaaatgaagggctttccaaatagaatgatttactctgaagaaacaaacaatggtatctctgaaactcacaacctaaagcccaatcttgaaaatatgttgtgcaccaagacgactgcttcagcttcttctcttatccttactttctttaatagatatttattaaactgtccagtgaaaaggtgccacaatgcccagtattgtaaacaacaggtttgcattcatgaagctttcattcattctggagtctactaatttacctgaatggtgtttgcattctgtgaaatgcctctccacgttgcatatgtcacacttttgtctgcacataactcttttttcacaagaagggtcactgccacaacagcacagtcagcgggtgaattacaggtgcctgctgcctgcctacctgggtaatctgatcttgtctgtatcgccgtgtgctcatcactgaagaattgcaggccactcatgtcagtgaccagatttgtggcttataaacattagcagtttatttatgttttaagatgcaaagatgtgtgtttgatattcactttaataattagaaatggatcttgtaaacagggcatatatcaaagatgaccttataatatgtacccgaatatacagttcaagaattttgtctgactggaaataaatgcattttgtagcaaaaggaagtgttttgactagaatgatttgtctccttcccactaagacagtagatttccaatcaaaataaaaccttgagcagaatgggtagaactcaactcacagaaaattcctgagaggagag

SEQ ID NO: 75846 - DNA, 1056 bp, Homo sapiens
gagcaggagcattacattactgcaccaagagtaggaaaatatgatgcatgtttgggaccaggcaaccgaaatcccttctcagcagcgcctcccaaagccgggcaccgccttccttcggagaaggcgcagagtccccagactcgggctgagccgcacccccatctcctttctctttcctccgccgctaaacacagacgagcacgtgagcgtcgcagcccgtcccagctgtgcctcagctgaccgcctcctgattggctgagagcggcgtgggctggggtggggacttgccgcctgcgtcgctcgccattggatctcgaggaacccgcctccacctcaggtgaggcgggcttgcgggagcgcgcgccggcctgggcaggcgagcgggcgcgctcccgccccctctcccctccccgcgcgcccgagcgcgcctccgcccttgcccgccccctgacgctgcctcagctcctcagtgcacagtgctgcctcgtctgaggggacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagtaagcccattccctcggcccgccgccttctcccccggcgaccccgcccgcctgcccgccctgggctcctgggccggcctcggcgttaatgggattggggggggcagcctttttgtttctgctgctgctcccctcccctctcttcccccaacctcgccggccgggctcccccgctgtccacgtcgccatcttgtcgtggggggtgggagacgcctcgaaagtgctttcaggggccggggtctgagccctgcttgccctccc

SEQ ID NO: 75847 - DNA, 1299 bp, Homo sapiens
cctctccagttccattgaaaactcggccctggggcggaccctgcacgctggtcctggctttccagtggacttggggccttgagttcccgactgagggactcgcgtggtcggatgcgatcttgtcctgtagttgtccagccgtcgcgggtgtctttgcctttgtgcattagggatttgccgcgatggccttaagatgcgaactttttagtttgcacgtgcaggttttgtttcgttttaatcgccttgaaaaacttgcctagactgagagtcagagtaatgggaatttagggaaatggcaacattttaaagagaacttcagaattggatacttgagttcatatcacctgtcacgagaacgcagatattataaatgaatatatgcctcattcattcttcaaataatgaaaatgtaggggctggttaaatttaggcagttttaatgatactgaaaaaagtatatgatgagtgaatgaaatgcggcactaaaatgttgcaaaaattttcgaactctgtctcattttcctgaaattgaagtatattaaaggaaaaccgtcaacatatatctaaagtaagtaatcactcggttagaacttaatgcaagttttataaatcaccttgaagtttgagtctaaggggtacattagagattaagaattgtgagttggaccagtggtgttaagagcggactcccccatcccccaacacacacacaattttgcccactttggcattttaacttttaaggaaatcacttaaggaattgaagatttagagtaagagttttggttagtagactggctttgctgttaaatccttccactcttctggcagagagattaatttccctaatcagtatcagcagaagataaacttgtttatattcctgctgttttgtagatcccttctcctggtccttcttcaatagaatattaaattcttagtttgtatacagcagagaaggtcacttataaaattcaaaaagtgagcaaacaggtctagattaattccaagagttaccaggaattaattgcagtttattttgcggaggtgattacagtgcttttgatgaaatgataaagctgctatattgtaaacctaaggcagattacctctgtgtagtgccagttttctatccttattatatattgaatcatacttaatacaatgcattaaattatgtaccactttttttatatacagtatcgaactcattgttttgccattcatccgttcagaatatcagaagcagttttgaaacgaattaataaattagctactgttcatcagccccaattctaa

SEQ ID NO: 75848 - DNA, 1050 bp, Homo sapiens
ttagaaagagaatttgaaactaagacaagccaagcttcttgttgctcagtatttttggtaaaaatatggtcagattgtttaaattaactataggctttggaattttaaaaataattatatctcttggtctcttgacacatcaagaattaactgttttgtatatgcgttgagtattaatgttcatgttttctgcagtagaaatttataaacccttatttatttgccagacatgatccctttagagaaatctagtatctaaaacctgaatttttaaaacaaaatttaaaatttttgtttcataaaaacaaaaatgtgattacctcatggcttttttcttatagcttttgattgttttttaaaatcgtagttcaaaaacattaacctaaaatttaccatcttaaccatttctaagtactgttcagtagtgttaagtatattcacattgtgccactaacttccagaactttttcatcttgcaaagctgaaatcttacccattaaacaactcccaatttccccctctcctcagcctctggcaaccaccattttactttctgtttctgcaaatttaactactctagatgcctcatataaatagaattatagggttttaatatttttgtgatgggcttatttcactttgtgtaatgtcctcaaggttcatccatgttgtagcatgtgtcagaatttccttcctttttgagtctgagcaatattccattatatgttccatattttgtttctccattcatccagcaacggacacttgggttgcttccacatcttggttattgtgctgctctgaacatgagtctgcaaatctctctttgaagctttcactttttttggatacatatccagaagagggatgctggatcatatggtaaccctttttaattttcaaggaaccaccatattgttttctatagcagttgcaccagtttacattcccaccaacagtgcacaagggttcctatttctccacatccttctaaacacttgttttctttctttccttccttctcttctctttctttcttagccatctaat

SEQ ID NO: 75849 - DNA, 1307 bp, Homo sapiens
cacggtggctcctgcctgtaatcccaccattttgggaggccggggcaggtgaatcacctgaggtcaggagttcaagacaagcctgaccaacttggagaaaccccgtctctactaaaaatacaaaaaaaaaaaaaaaaaaatagcaggatgtggtggcacatgcctgtaatcccagctactcggaggctgaggcaggagaatcgcttgaacctgggaagcagaggttgcagtgagccaagatcgcgccactgcactccagcctgatgacagtgtgagatgctgtctccaaaaaaaaaaaaaaaaaattaaaaagaatgttttaattctttagttccctgtctgagattcactgattggtaagaagaaagttaaagaatctcctttgactttttttgatatagatatttaaattctattactttatagtaaggttggggtttattttctttgctttataatagaagagcattgattattctctttgctttataatagaataccatttaaataggagttccctgagtgtgtttacaatcatttgatctggctaaactattttaatgttaatgaaattttaaaattttggaggaaaaaatttaaaaactacacaggtgcacaaagaaataaaaatcacctgctttttcactatgtagagaccattgtctactatttctcaattctgtgttacatctgtatgttaataactgtaggattagggactgagtactgtttttaacctgcttttaaaaaatttacatctacattttttcccatctaaatagtgaggaagagtatcagaattttgtaggcttgtggtgatggttaaattagataatattaatgttgggtacttaacataatatatggctcttaatactctccagatttcagatatagtctgttttaccattactgcctttttatcaaacctattctcaaaaaagtgagaaaagtgctgagattacaggcgtgagccaccatgcccggcctcatggttctttcttaataataaattagaagaagtagaattacagggtcaaaaagtatccattttaaagctttcaatgtaattgcctgtttatcttctagaaagtttgacctagttgtattttagagtgtcattttcttgaactttatcatcattaaagttttaaatttggaacactggcaatttgataagtatattaggattcttcttattgcaagtagcaaaatacaactcaatctagtttaagaggggaaaatgtagtcattggctaacacaatctaattttggtttaagagacaaatctagagtctcaaatgat

SEQ ID NO: 75850 - DNA, 1614 bp, Homo sapiens
gagatcatttagatgatgtagaatatgccttttctttttttacaatgccaccaaaatgaaaacacggttttaaaaattctcatagagtgtaacttcaacactgctttaactctattaaacaaagcactgccatgttgtaattcctatttattactctctggagttgtataaattaccaaatccgccttttgtttgatatccttttcaaatatctgagggtagctatcatgtttcttccttctattcttaaaaaatagtcccaaatttcttgaatcttttaatttaaaaattatatattgagcatctgatttgtggaaaggcataggccatattaaaaatggggcttcatattaaaatggggaaaagggtggagattctcaggtggaatctgagatctgccacacactaatagtgttacctaaccctttttaaagacaaagaaacaggatcagaaggtcactttggaaaatttatttggtaatattggataggatggattagtatagttggaaaacagagactcttgctttaggagagctgctcctttgtcatttccagaatcttaatcatggtcaaggtttagagctaaatatttaatagaagaagtctttagggtatgctttctattgtacacccttatttcaatacatgtgttttttcctgttatgtaagtactttattattatttatgcatcttctattaaagttaagcaaataattatttcaaggacacattcttctacatacacacaaagtttagggtcactgaccttcttaggttctagtcttagatctgttaccatctaagagcatataaataagggaaacagaaagaaaaggatttacaagctgagaaggaagcaatgcagagaaagaagagtgatagagtaggtaatttggggaaagtcagtgatacacagctcttaaccatgaacagtgattcttcactcttgaatgtttgtgacattcatgaaggtattaaaagctgacttttaaaaaattgtttcagagaactggaaaaaaattcagttgccacattcttccttaggtcatctttgaactctactcatgcacttacgtgtttaaggcaaagttttactaaacgcacacttgttcttgctggcttattgacttttactgctagcttcttattcttagcaattatacctcacattacatagtattgtgaaactcactatattcagtgttttgcctgacaaacatggtatgttataggatgtgtattcagttatagctaaaaataaattattctcgtttttcaaaatttgctggcctacctgttaagcttttgctttaagacctgctaatgtttctcaaacttctgtggttaaatcacctgagtgtctagttgctctatggattcccagggacccattcgccagagattctgatttggtaattttgggatggaactcagggatctgtaaattttacaagcactcagaaatgaaacatagactttaaacagctaagagtgctcatcaggattatgttgatattattttttaaacagatgtgccaagcctttaatttgaatttccagggttgggatttggccttctatatttgggggaaaaaagttctattgatgat

SEQ ID NO: 75851 - DNA, 1054 bp, Homo sapiens
gtttttgctattttttccattaagtagagatagggtttttaaaaattacatgtgatgttttaagtattctggttttgcaacaattactagatagaaaatgtaacaacagatcctattaataatacttccaataatacatataaaatacttgtctaaaagtaaccctccttaaaaaaacaaagctggccaggcgcggtggctcacgcctgtaatcccagcactttgggaggctgaggcaggcggatcaagaggtcaggagttcaagaccagcctggccaacatagtgaaaccccatctctagtaaaaatacaaaaaattagccgggtgtggtggcaggcgcctgtaaccccagctactcaggaaaatcgcttgaacctgggaggcggaggttgcagtgagcggagatcgcaccactgtacttcagccttgggcaacagtgcgagactctgtctcaaaaaaaaaaaaaaaaaaaggcaataggattaggtatcaacttaatgaaaacttcgtgacagcactttcttgaaaaagactgtggaaaccaaagttagtaaactcctgtttctgcctgggttcggaaaacataaagatgataaagatgtttaagtattcctttttttttttttttttttttttgagacagtgtcttgctctgtctggagtgcagtggcacaatcacagctcactgcagccttgaactcctgggctcaaataatcctcctgcctcagcctcctgagtatctggaactacaggagtgcaccattacactcggctagtaatttgattggttaagaacattaactataactcacacattttcctgaccacatttgcttaggacaaaacagtaaaagacatgagtgtagatgaaagcgataagggaactaatcttaaacactgaacctcttttcagcaaattggctttctagtttctcagctctctctttacacctctaaatctctttcctggcaagatcatttatttgccttggtttatggtgatactcttcattgttatactggtgggtgattgttttaattgatagctgtttt

SEQ ID NO: 75852 - DNA, 2241 bp, Homo sapiens
aaagaaacaagtagaaatcagtttgtagctattaccgttctacctgctaacaactcctgttttcaagttattatgtacaactttaggtagtttctctagccttaatcgtggtttctctgtattgagactacttttgaattctatgaagtacagccttagatgtacaggctactttaaatttttgcctaaaataaaaacattctctccaattacatatgctggggaggaaacacctgcttccgacaggtttaaagcttggttttggactttttgtgagagttccttatgtgtgcagtaatccaaaatttgtatagttgccctttataaaagtacattaatctagtagacaaatctccatgtaacttaattacatggcatcttctaatccttctgtgataagcagaaatgtaaagttttattcaagttaaggcaaactaacttgtatacactttccatctcgtgtttttcttgttgttgttaagtaggataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgagttattttacaagggtataaataggcctgaaaattagaagttagaagtaaatagaaattatttttagaaggtggtcgcaatgttttgattttgtatacctctttatattgtgatatgtacacgtttaaaaatttttctgtaattctcactatttttatcaagcttcatttttttctcatcagttattctttgaaataatcattctttatgcacataatttgttttgctttattctcttaaacatactctcaattcttttctaatataacatcctttttattacctgcttttaaagctttagtcaggaataagatactggcttttcccctcccccctttttctcctgttccatctacctttcttcctttaaaaaacatgactcaggccgggcgcggtggctcacgcctgtaatcccagaactttgggatgctgaggcgggtggatcatgaggtcaggagttcaagaccagcctggccaagatggtgaaaccccatatataccaaaaatataaaaaattagatgggcacgctggtaggtgcctgtaatctcagctactagggaggctgaggcaggagaattgcttaaactcagagggcggagcttgcagtaagccgagatcaagccactgcactccagcctgggcggcagagtgagactccatctcaaaaataataaaataaataaataaataaaaaacattactcttctttcttcttctatggtttgctttgctgcattactttaatcatgaaaagcagctggcacatctaattatagtttttctagcttctggcctgcacttttctgtgttgaaatggctgtatatattaaataaagtgtctgcgagaaaactttgtaaaaacatctaaatattatatcatttaagtacaactttttaactaattattttcctcttcttgtgccctttttaggtgatttggatattgaagatgacatgaaagcacagatgaattgcttttatttgaaagccttggatggttttgttatggttctcacagatgatggtgacatgatttacatttctgataatgtgaacaaatacatgggattaactcaggtaaaatgcacacatattaagagctcttctatatgtttttatgattttatgatctagccctaatttttaaaaatgtgtttacagtttgaactaactggacacagtgtgtttgattttactcatccatgtgaccatgaggaaatgagagaaatgcttacacacagaaatggtaagaaaagtctgttgtttgatttaatgtgacaggtggttttacataataagatactattgctaattattaaactttgctattgtacttacccaaggcaaaatgttatttcatgtttaataaaatgtctattctttgttaaaactattattttagtttttaggaatttcattttgaaagcccacctaattgcataaataattgtgtgggtgtgagaaataaaatggaaaagtaaaatcatgaccaagagagttacaaataactttttttttttttttttaagatggggtctcgctcttttgcccatgctggag

SEQ ID NO: 75853 - DNA, 1815 bp, Homo sapiens
tttgttattaaaaagaaagttgttattttaaaggttctataaagacatagagtgcttattagaaattgagctaacacattcaggaaaggataggaagagtttgctgaagttctttctttagggattcttgtgtaccgatagcacagttaaagagcaaactcataccatttttatatttctgtgtatttgactaagcttactggcttcaatgattaactgttatcccaaatatggattatctttcagccaactcagggaatcacagctactgagtagtgtgtgtcagatctcttgggtgtgctggagtgagtaaaaggggaatgaattactgtgttcatgctgagacttaattgaacgggtattcagttgatctaggtgatgggcactttgttacttttattgtaacaaatttgtatatttagttgctttaaaactttatttcatgctttcattaggccttgtgaaaaagggtaaagaacaaaacacacagcgaagcttttttctcagaatgaagtgtaccctaactagccgaggaagaactatgaacataaagtctgcaacatggaaggtaagtgaaaattatttgtgattgattatacactttatttatacatagacattgtagtattaagataactttagaattgtgagggaaggtttacagttccatggtgtttggttatgtaacatttatatcttcaactcatttgcatgtgatctccaaaatgcagaaccgtgtagtaatttgccaatttgaggcacaaacttaaattacgtgaattgtggcactggtgttccaggcttaatcagttggctttgccagccacacaatatttgaatcctgatagggcttaattttctattaatcatggttttatatctttgttcaatgttgaaacatagtcatcagtgcaagaaataactatcaaacagccatgatgatgagatgaatgaaaaagcagcctagactttatacgaggggaattttttaaagagtaatgtataggccctgggcaggaagtaggtcataggtggtatcataggaaaaatgttcattgattttcaaaaacgtgattaatccactagtgacagtaaattttatcaaagcttactggccatgtcagactcaactacttatctctgctttttttttccctagcattgtaaatattttttttaactgctttgttcttcatacacaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaaggtaaattagatctaaaatgtgaatttgaaatttttaattagtctacagcattactgaatattcaccatagcaaagattcagcgctggccatgcatggtggctcacacctgtaatcccagcactttggaaggctgaggcaagcggggggtggatcatctgaggtcaggagattgagaccagcctggccaatgtggtgaaaccccatctctactaaaaaatacaaaaattagtgggacgtggtggcaggcactactcaggaggctgaggcaggagaatcgcttgaacctgggaggtggatgttgtggtgagctgagctcacaccaccacactgcaagcctggatgacagagcaagactcccatttcaaaaaaaaaaaaaaaaattactcaatgttaaactatactttccact

SEQ ID NO: 75854 - DNA, 1066 bp, Homo sapiens
gaaaccccatccctactaaaaatacaaaattagctgggcatggtggcacatgcctgtaatcccagctacttgggaggctgaggcaggggaatcgcttgaacctaggaggtggaggttgcggtgagccaagatcacacctcattgtgctctccagcctgagcaacacgagggaaactcttgtctcaaaaaaaaagaccaggtaacaagtttgggtgaacaggattaaagagttaaataacaggaggaatctagaggacttaaagaaatgtgtggtgttggatttaataactgtagttgccaaaggtgaggtgtaaatttattctaagcaaaggaggatgctcatttttgaaaattcacttgtccataagattaatgcctatcagttaacttgggaggagaaaaatttttctttatcagtgtctcccttttttttcttaaatcttgtattttttactaacagaattaccgaattgatgggatatgagccagaagaacttttaggccgctcaatttatgaatattatcatgctttggactctgatcatctgaccaaaactcatcatgatagtaagtacaatggaagaactcagagatattctaattacttaactgttgcaacctctgtacagtttggctacccatctaattctctggttaaaagttctagactaaatgtgttaacaggcctattcagtagagatcttgaccattttgtgttttgtatgtgttgcaacaaatatcagtaaaaatagaatcatttaatcatagaaaaaacttcctggcattttaaatacaaagacttttgaaaatccaaatattatagagtattgaatagcataattttcagaattcacataaatactcagaacagtggttggtatgtaaaaggcactcagaaagtatttgtacaatcaatgaatgtgaaggtggtgaacatcacctttggtaataagtaccattttaaaaaatgcttataagtgcatagttaggtatttatatttatgggttcatgaaatattttgatataggcatgcagtgcataaggataaatggagtacctatcacc

SEQ ID NO: 75855 - DNA, 1153 bp, Homo sapiens
aatgtggtatcaatttatatttaaatatgctacatatagctttttaaagcatctttggttctctggaaaccatagtcagaatttaaggaagttattgtggcaccattttcttgaaaaaggctattgattattctctaatctgacaccaacctaagtcattaaaggaattttagttactgaagattgtatattcatgaactcttcacttagctcactggcagcaaaggagttttatttagggggtttgaaaaaggaaatgggtacattttcagctattctgggacgcactgtcagaatgtaagcagttacaactgattccactaaataaacatttgttttccaaaacaatgatgaacattcagcatctgttcatttaattgaaaattcaaagttaaaatattttctctgcatgattctttttcttttcccccctagtgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgaggtaagtaagtttgagaaataaacatttttggggaacaaatagtaattctttttggatactctgttcatttataggaagataagataataaatattaactaaattttaattcttttacatcgctaccaaattattattttctatactctgacctaggtttccagtccagctattccacagtgatgctgctaaacactgtcagtagttgtctatccccataccttcactcctatttttaaaaagaccatgaaaaaaataccagatccattgattggtttggtctaattatacagatatcggcatatactatctcaagacagctgtgttctttttgtaggaagaatcctggcctagatttgtatcatagctctaccactcattagctccctgaccttggggaagtctcttcatttttctgaatttcatctatgtagataatccttcagaaggttataatgaaaattaaatgaaattctatgagattagggaggggggagggatagcattaggagatatacttaatgtgaatgatgagttaatggatgtagcacaccaacatggcacatgtata

SEQ ID NO: 75856 - DNA, 1197 bp, Homo sapiens
ttagccttccctttaaaatctagggtcactcctcttaggaagactttgggcagtttttatttttgctacttctgacaccatcctttaatgttttaatattagtgccacagagttcttttgtgactttaccattatgtaagaatcttccacttggaatgtctttctcttcctcacaccccagtctgcctagcaaatgccacttgatcccaagtatcagcttgttagcttctcagtgaagcaagccttctctattttagcagttatcacagtgtattttaattgtttacatatctactttcacaatgggttataaatttcttaaggtcaagggttggctattttaatctttgcattatcagttcatttcagatagtgaacatttaatacgttaattaaaggaataatttacatttaagccaaacgtgaagataaactattgctcatcatccctcttcagccgtatcctgtaggtggtatcaccttatattcttaccaccaaagaaaatatggcccctctcttagaaagatcttaatcatttatctgtgtatctttaggactatccttagatcatgcctcacatattgatgccaaagagttcttttgtgccaatttcataatgtgtgtcagcacaacaattctgaagatttgttggtgtctttcatgtacttgactacaaattgccttgccattactactcttctcaaaggatatctgaaattctttttttcttttttttttttgagatggagtctcactgtcacccaggctggagtgcagtggcgtgatcttggctcactccatttcccgagctcaagtgattctcatgcctcagcctcccaagtagctgggactacaggtgtgcaccaccacaccgggctaattttttgtatttttagtagagacagggttttgccatgttggccaggctcttgaactcccaggctcaagcgatccacccgcctcagcctcccaaagtcctgggattacaggcatgagccaccacgcccagcctggatatctgaaattcttaactgaaattagtcaaattatcttgtactggggattttttttttaatttcaacttttatttttgattcaggggatacatgcataggtttgttacatgggtatatcatgtgatgctgaggtttggggtacaattgatcctgtcacccaggtagtgagcataataccca

SEQ ID NO: 75857 - DNA, 1069 bp, Homo sapiens
gaggtgggagaatcatttgagcctgggaggttgaggctgtgattgcaccactgcactccagcctgggtgatagtgagactctttctcaaaacaaaacaaaacacaataaaacaaactaaaaggggtaacaggtataggctgtagctaccttgagcacacttagtactattctctttaaatgtccaaattcaagatgtttttgtcctactgatataaataatagagaaacaatgtacgtttcaccttttggtttatattaagctagtttcttcccatgttcctgactatctttgagcctaaaacatgtgctcaggtctaggttaggcagtagctcttgcaataattttaaagtgctaaaattcaaacacacacacaaatgtaatttgtggttcaaataagtgtttgaatcaaacttataaatacattcttgaatgttaaaatctgaaagttgtccctttctgattatatcatgacacctacctcaggtgaactttgtctagtgcttccatcggaaggactaggtgtctgatcctgaatctggggcatggtaaaagaaagttccagtgactctggatttggttctaattttaatgcaacttcttgattgagtgcagggtcagcactacttcgaagtggctttggcgtttcagcggtgggtaatggagacattgccaaatttatattctgtaatttttcgttgggtgaggggagcattacatcattatataatggtacttcctcaagttgctggtcatcagtttctgtgtctgtggggaaaaaatatgagtcaatctaaagtatagaaggatttttttttttttttacccaagacagagtcttgctctgttgcccaggctggagtgcaatggcgcaatcttggctcactgcaacctctgcctcccaggttcaagcaattcccctgcctcagcctcccaagtagctgggattacaggcgcacaccaccacgcccagctaacttttgtatttttggtagagacggggtttcaccatggtggccaggctggtctcgaactcctaacctcaagtgatccacccgcctcggcctccc

SEQ ID NO: 75858 - DNA, 2124 bp, Homo sapiens
caactagcaaagtatatggaagcttcttcaggaaatagtaaacatatttctttttacagcctaatagtcccagtgaatattgtttttatgtggatagtgatatggtcaatgaattcaagttggaattggtagaaaaactttttgctgaagacacagaagcaaagaacccattttctactcaggtatatgaacttatttgttttatattaaatttcattaatttttagtctgaagtgactttgagtttcacttgttttttatttataaggtgtggccattgtaaaaactcatgtatttgctgttttaaaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaaggtatttatatgtaacattcaagttatagttcttttattatttttgagataaatgtatgtgatagtacatgatttttaaacttatagcaaactttctgatatatatgccctaacgcaaattcttgagaactcaaaaaactttctaaattaacctcatatattttttctttttctttcttttttttttttttgagacagagtctcgctttgtcgcccaggctggagtgcaatggcatggcaccatctcagctcacggcaacctctgcctcctgggtgcaagagattctcctgcctcagcctcccgagtagctgggattacaggcatgcaccaccacgcccggctgatttttttggtatttttcatagagacagggtttctccacgttggtcaggctggtctcaaactcccgacttcaggtgatccgcctgcctcagcctccgaaagagctgggattacaggtgtgagccaccatgcccgctcctattttttctaaaataattataaattctaaaattacctatctaaatggaggagggtcttctgacacctttaaaataaaatccagctcagtactgtaaatgtgtttacagaacttgtttaaagttcttacagttgtttaaatcagactagttaactaccctcactacttagatgcttccatttcttagagctcttttttaagcttatctgaagaaaagcccttccaatttaagggttatttccaattgcacattccaaattgagccttccatcttcagcattcaatatagatatttacaggcccctcttttaaaattttattatagttaacttgtattaaagttgcttttatttttcattacgtatttgtagaacattagctatatatatattgcaggctacataggttttcaaactgtacaacaggaatctaagcatgaattgttacttctatggagctagttcaaacaaacatatggacatgacccaatttttaagttatactttctgtatataatttgtaaggggatttcacatattttaagtttgaggctatagctagaagaaattaagttttatctaataagtgtgtggaaaagggaaatgattccttctctactatgtctagactaagccagatatcaatagcaataggaaagaaccactgtcgtagccagaacacatagcttttttccctgcctaacattcccaccttgacctagagtgctgggagaggtcttttccctaagcttggaaaagacattggggctttagatgaactcagaagtactttacattactttatttactgtgtcacttactcacttttgactctgagctccacgagggcaatcacagtgtcttgggcattttagtgatactaatacttagctcatgacct

SEQ ID NO: 75859 - DNA, 1028 bp, Homo sapiens
tacaaaaattagccaggcgtgttggtgcacaactataatcccagccactctggaggctgaggcaggagaatagcttgaacccgggaggtggaggttgcgatgagctgagatcaggccactgcactccagcctgggtaagagagtgagagtccatctcatatttaaaaaagaactgctatgttttggggtaagtcaatggtggtataatacattctgatattttcaaactaaattaactggaaagtatttatagacagaatggtcataatggatgacaaataacttaagaaagaattcaaaataatttagggtagtatttaagaaactgcctataatgttattaaatttacaccaatttcaaggtttttggttgtttaaaaaaaaaattcaacaaactaaacttgaaataactttactgtttatagggaacattattacagcagccagacgatcatgcagctactacatcactttcttggaaacgtgtaaaaggatgcaaatctagtgaacagaatggaatggagcaaaagacaattattttaataccctctggttagtttattctttttgaccttgaacatcacaaagacaaaatacatgaaacatttttatttaggagctttaatctaagtgagaatgactttggttccttagcaagattaaaaagtaaagttgtggctgggcgcggtggctcacacctgtaatcccagcactttgggaggccgaggcagccagatcatctgaggtcaggagttggagaccagcctggccaccatggtgaaaccccgtctctactaaaaatacaaaaattagctgggcgtggtggcgggcgcctgtaatcccagctacttgggaggctgaggcatgagaattgcttgaacccggaaggcagaggttgcagtgagccaagatggcaccactgcactccagcctgggcgacaagggtgagactctgcctcaaaaaaaaaaaaaaaaaaaagtacagttgtatttcatgtgatggtcttaatacagagattaacatttca

SEQ ID NO: 75860 - DNA, 1955 bp, Homo sapiens
ctcaagcaatcatcctacctcagcctcctgagtagctcgcactacagacatgcctcaccacacccggttgctttttgtagagatggggtctcactatgttgcctaggctggtttcaaactcctggcctcaagtgatcctcctgcctcagcctgtgctaggattacaggcatcagctttgatgcccaccatatttatgcctttttccaaattgttatttctttgtgcctttattgtatcctgtaaacatttctgacacagcaacagtatcactggattatacttactttttaacatagttgtggttttgccaggtaaactaaaaacccttccagaattttgctttattttctatgatacctaacacattgtgggtgtttaataaatattcattgactagatgaatgtatacttaggtatctcttttgtttttcagatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcattacctaaagcagtctatttatattttctacatctaattttagaagcctggctacaatactgcacaaacttggttagttcaattttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccaggcccctttgatcagcttttatgttcaaatattaataatatttgcttcaacacctccaactcataaaattgtttaccaacaatttaagcacttatgaaaattacatggtactggttatttctacatttatcttagtgccatcaccttaatgtatgttgagtccctaaatgtcatgttaaataataacaaccataatat

SEQ ID NO: 75861 - DNA, 1032 bp, Homo sapiens
taaatgttgaagcactttgggtcacagtgtttgtgcttaagtatacctgtgccccccccccccccaaattttgcactgaatcttagtattaacttttgttccaaaattttcatataattgtaatcactgtcctccattgtaagataaaaagagctacctaagagatctgtggctcagttccttttgttcagtatatatacctcagggtaaaggacctaaggctctggcacttcctacataatttgttcataaaaataattttctgtacctgtaggtgcagggattcatagtgatttttctgttttaaaaaatatctttctacactgtctgatttttaaaaatgagattatcagtataaaagaaatacagctattttgtaaaagaaaaatacaggagaaaaaggataaagctactttgttttaaaacgcagtatcattaaaacaaaaacaaaccaaatttgttctaagtttgactttagagtcaggaaacttaagcttacatttttggtctgccatctattacttttaaagcttgggcaaattattcatttgaagtctaaatttattaatctgttaatgggaacagattagaaatcttcagagaagctctagcctttgtaacattgtgactataatgctgagaactgcttcactcatcccattcatattttaaaaatactaatattttgtgtttgagcattttaataggctcagaaacttaaaaatgatgtttcttttctaacaacatactcttttcaatgggatattatggttgttattatttaacatgacatttagggactcaacatacattaaggtgatggcactaagataaatgtagaaataaccagtaccatgtaattttcataagtgcttaaattgttggtaaacaattttatgagttggaggtgttgaagcaaatattattaatatttgaacataaaagctgatcaaaggggcctggtccacagaagatgtttatttgatgtaacaaaacaatacagttagtgttagatccaaccacaaagagcaa

SEQ ID NO: 75862 - DNA, 1085 bp, Homo sapiens
gtattataagtaatctagagatgattgaaagtatatgggaggaagtgcataggttatatgcaaatactacacaattttatatcaggaatttgagcttctctggattttggtatacgaaggaagtcctggaactaatcctccatggatactgagagacagctatacgtggttgctttttaagaattgttggccgggtgcggtggctcatgcctgtaatcccagcactttgggaggccgaggtgggcggatcatgaggtcaggagatcgaaaccatcctggctaacacggtgaaacgctatctctactaaaaatacaaaaaattagccgggcgtggtggtgggcgccagtagtcccagctactcgggaggctaaggcaggagaatggcgtgaaccccgggaggtagaggttgcagcgagctgaggtcgtgccactgcactccagcctgggtgacaaagcaagactccatctccaaaaaaaaaaaaaaaaaaaggacagaaaaaagaattgttaatacctgtattgcatatacagcattaactgaaaattctttgcttaagcaagtaagggaattcacctactgatgtaacaaaacaaatccttagccaggattggctaaagatatctgtgtcgcagacaaagctatcattaagactggccctccattttcactgccgtcaagtgctgttttcctgacagctccagccttgcatgttcccagctttagcttccaaggcaagaaagaatttttccttcttaatagttagacaattccaaaatagcatttcattagccatgatacataccacataccccgcctgcttgcctccccactcccaacaaattaccctggccatggggatgttaaactcattgtggccagatctgggccacatggccaaacctggagccaagcgtgaagtacttctacttggaatgcgtggtagtgcctaagggaaataaatttattagaagatgcctctacacctttgttgcctaaccatgccagataatagaacaacttcattttaagcccatgtgagtagatgatgatgacagctgcaggaaacttcatgttataaaaata

SEQ ID NO: 75863 - DNA, 1041 bp, Homo sapiens
actgagtacacttatttcaggatgcattcagaatctattaatatgatttaccacatcaataggttaaaggggaaaatgtgaatttattttaatagttaccaaagaagacatttgataatatccaccatccattcttgatttaaaaaaaaaaaatcctctagatcaaggagtcagcaaacagtttctgtaaagggccaggtagtaaatagtttaggttttgtgagccgtgtttctgtcacaactactcagctctaccatcgtaatgtgaaagtagctatagataataccaacacacactagtgtggttgtagtccagtaaaactgtataaaagcaggtggttggtcacatttggtccaggggccatagtttgttaactcctgccctaggtaaaatagaagattatttctttaatctttaaagtgtgtgtgtgcacttgtgtattagattacaaagtgcctcatgttcaatggtaatatgcaagaagtatcacagttttatttaacgttgctcttaaagagctagtcagtgtaattagataagagagtgaagggagatatgacatcagaaagagagactagaaaattatcatgatatgtgaatgattttatgcctaaaaaaattctaaagagaatttgctgaaaaataattaagaacaaaaatttagggaggtaagggtgaccactgtaaaccttacaaagattaaaaggtgaccaaggcaaaattataaataattttatgccagtaagttaggtagcttaaataaaatgaataaatttattaagagacacaagtttccaggccgggcgcggtggcccatgcttgtaatcacagcactttgggaggctgaggcaggtgggtcacctgaggttgggagttcaagaccagcctggccaacatggagaaaccccgtctctactgaaaatacaaaactagctgggcttggtggcacatgcatgtaatcccagctacttgggagactgaggcagaattgcttgaacccgggaggcggaggttgcggtgagccaagatcgcgccaagat

SEQ ID NO: 75864 - DNA, 1103 bp, Homo sapiens
agtgaaaaggctttttaaaaaagtatgatctcgtttctattaataaaaaaatatacatacatacacacatgaacataatatatagcactgaagaaatctagatgtgtatgaagtattaccagtggttaattttcaaggatagtataatgagaaactacccataaatgtctgtaacgtttggattttgtataaccaagtgttactttagtaatcagtagaaatccaaagacctttttacaaataaggtaaacataatttcatagactcagacaagtagaggggctggtgtgaaaaaggcaaagtagctgggaagtatagagtgaggggtccatttaggctggattgtaaaggggatatgttggggagttaaatgttaaaagtgctggaaaaatatgttgaggattgtattgtgaccaggccttaaatgtggaatcaagaagtttacacttcaattggtaggcagagggggagtcagctgaaacttttgagcaagaaagtggcatgcccaaagttttccttgaagaaaatcagtctgggagtagaatggtaggtagctgggaacaaactgaaaataggaacactaagtagagggctgttgcggtagttcagatttaggagtaacgagcgtgtgccacatggttgtaggaattagagaagcaaggctaacagacataagagcaaatacggagactagtggagaggggtgagacaagaatgcttaatgtctgagcacctgggaggatatttgtgtccttgctggagaaatacaatgacacaataaagatttcattggggggagaattcgctccagtccgccttgccagactgatttctgtaataattgcttggtgtattaatgggtgctcagtatattgatggaatttacttaagcttatgttatttaagctttaattatgtgctcaccattcctcgaatataacatgcatgttgacaggacatcagtaataccagtgctatgatggatgaagatgatagcaactactatttattaacacttttttttgagatggagtgttgctctgtcacccaggctggagtgcagtggcacgatctcggctcactgcaacctccacctcctgggt

SEQ ID NO: 75865 - DNA, 1028 bp, Homo sapiens
cttttaatttattgaagcttagttctgttggagatcaattctatcagattttgtttttctgagtctttatttaaccatttttgaaggatatttttcctggatttgaattctaggtagacacctcttttctttcatcacgttaaggattgttgcatgtcttcagccttcattgtttctgatgagaagttttcattcttacccattttttggtatataacacgccctttttctctggccacttttaagtttttttttttttttttttttactttattttcagccatttgcatgatgtgcctagtgcagttaatttttccagtatattgtatatgtttttctgtactggtctcacttgcttctctttctaggactccaattacatgtctgttaactgcttaatactgtcccaaatgttattgtggcttcctcccacacccccagtaatttttctctccgtgcttcagattgaatgatttgacttgtcttcaagttcatgaattatttcttcttttgtattcaatctgctgttaatcccattcaataactttaattttagatgtagtatttttcagttctaacatttctccttggttcttcttcatggttttcatatctgcactgaaatgtcccatttcttcaccaattataacattttttgctgtaggtttatactattttatagatactataaatttatactgtaggtgctataagtttagcaaatttagctaccttgaagtgtttgctagtttcaacattgggggcatcagtatgtctgtttcccccaaagagtatatctgtttttattgaccgatttatttttttattgactgtggtttacattttcatgtttctttccctgtctactaatattttattgtatgataatacatgttagggactctgaattctatcaccttcctctaaagagtgttgagttttgttctataaggcagttaagttatgacagagcatcttatacttaaaggggcttgattgtaggctttgtcagggtggatctattcagc

SEQ ID NO: 75866 - DNA, 1028 bp, Homo sapiens
gatgaaccagccagtcacaagatatagtttgtcttgttaccacttaaaaaaatcccttatatttacaaatataattcattcacaaaactacccttgatagaattaggactaaattgctttataatgtttctggatctccataattgagactgaatttcctcagaaaagaaaatgaagaatatagagtgactcctcagggttgtcaagtcagaatcaccttgttctttggtggatttaaatatgttttctgatataaagttttaacaaaatgaggagactatctctagcaatttgtacaggctagatgactacaggaaatgaaaccaggcaggtgtagcctactaggaaggcctcgtttggcctgaaacttgtggtgccaagaggagataagtcctggcctggtcaatagctccatccatttagtttttaatttttactttttttgttctgtatctgagagtttatttatatctgtctagatacgttttatattttcttgttctttgattagcttttcagtttcatattttatttcttcaaatatttcaagcataattaatttacatcctgtatattaatttcagtatctgcaattcaaccagtcagtctattatttgttgttttgctgattctcactcttggtgatttgtatccttgttgtatttggtggtgatctttatttggagctcaaattttcttatactgaatcctgtggatttaatttgggatgctctcctttagagaggatttatgtttgattctgctatgagccaagaatactattgttctgatacctctaaagtcctttgagtccttggaatcttaggttacactccaagtttgatcttttgatttcaggaattattagatgaactctgcttcattggtttctactccacttgcttaatatcctactgcctcttgctctggtttcagctaattgttttgtttttctccttggagattctgctactttctggtgagcacaggaatgcattaacctttttctttagtagtatattcaggag

SEQ ID NO: 75867 - DNA, 1030 bp, Homo sapiens
cttgcctgtacgtgttcagacagcatagggacaacttggagtgggagacaggcaaccataagccagtggttttctgggtttaggtcactgaatttctccagtcattgttggaaatttaaccatcaaacctaggccctgccttccaccttccagaccagaattctacctgagtggccctgtcttacttctgttcattctccatatgacttgcaaggattaaatcagaacgtaatcctatttattatctaatggctatttttaagatcctataatttttattaccatattctatgtcatatttgaatgttctgaagttcttgagttcagaggcttaggaaatatacagagatactattgcaaagagatatagacacctaatgaaactcaaagataagttctataaaaacaattaaaaaatgcctctcctttggtgtcagataaaatgctcagtagcttgcaggccacacgcacagctaaaataatttttccatttccacctacggcaacaaagaaaaagcaatagctatttcaaccagaaatagtctccacggtgacacagacccactcagcatgtggctgcagcccttcaccctgccttgctctcatttcttgtttatagccggagtgttgatatagtcagcaggatgcggtcatcagccaagggtcagagggcctatacagtaacttctgtgcagttgtataaaaggtctttgtcctaccttattctggaaattaacttaagcaatgtgaatggtgacatctgaattacaattatggcaaataagtcagaagagccctgcaagaatcataaattatctttgctgaagtttttttttttttgtttgtttgttttggtttttttttttgagagggagtcttgctctgtcaccaggctggagtgcagtggcatgatctcagctcactgcaatctctgactccctggttcgaacaattctcctgcctgcctcagcttcccgagtagctgcgattacaggcacgtgccaccacgcccagctaatttttgtatttt

SEQ ID NO: 75868 - DNA, 1026 bp, Homo sapiens
aatatatatgcaagaaatttcgttgcccctgtaatgacatcttgacatattagataatgtgtgttcaaagcaagaataggtcaatgttatgtctcaaagctgtttcagggctgctctgagagatactgtacttttcctggggattggagtgagcattatgtagtagacattaattttagagcacagttctcttttaggtcacattcctttatttttctatattgaattaactacctgactggtgggaaaattaaatctcaatcattactgataccctttcccactccataggataatataagaatcccaggctggtacagtgccataaatttgggatggggcccagtccactccccacagttggctccgtcatgaccactgcacattccgacatgctgctgctgaagacatgatccccagcaactaggctgtcagaggaccctcccagctgttcacccactgacgaccaccctgagagagaatgcaccatgtccatctactgttggctttctggaagagctcccccagctcccacctacccaggcacaggtgggaacgaggtctgtgtttctgacagaacacaatctcttaaattcattcctttcctgttctggagaatattcctgtcctttcccttttggcataggctttctttcacaaagccctgtctggatgggaacttttgtaagtaccttgaaacttcaatttattaccctgaaattcacaaaattattaaaaatggagtgtgactcttgctaaggactcaaaaactccaaacataaagttgtctatgttattggaagggagaagggaaaaatactgatagtagcaatagcagcaggaagaaagtacaaattaatatctcgatgaatcatcatgccccattgtgtttgatgtaggcaacaggcctaaggcttctgcagctaaatcttctctttacttgggccatccctagcaagtgaaagggtgtttattgagggtgtttccccaccggccccccacccccccgccatggtctaagcactg

SEQ ID NO: 75869 - DNA, 1033 bp, Homo sapiens
tccaggaagtactaggtagcctcaattgaatcaactttctcaaggaaatatcatgcctggtttaacttgctttgcagtcgtgaaagttccagagagctgggtaagttggttgttctgaacagtcctcaggctaactttgatattctgagggaaggggctagtttactttgaaaatagtacaagaactgtaataggtgtaagtttgatatttaacctatttgttttctcttaaattgagacttctgttgttgcatgttcaaaccccttatggatctgtatcatacgagttcacctgagtgttatagaaaatggaggggttgaaaggcggagctagacagaggctagaggtgggaaggtggggaagggatgttgactggagctgcagtggaattgatttgctttgtcctcctaagagataggaatggacatcaggggcacttacttaaagaaagtaggtgctagaaatctgtttgctgaggaacaattggcaggaaaaaaggacataactgaaattttgctctcttgttcttgttttcagcttttaacatagtcttgaccttggcatatatgtctttgagctaagtgagcttatgtaaagcttcctttttgtgtgtctgaatacctagtccagagagggtgtgtagaaggattagtgatctctagtcatcagaaatcccatggcaacatgatcaggcatttacctgataattttatacctaggtgagaagcccagtcttctgggattggcagaaacagacagtggcaattacattttgttctcatttacagagcttgcttctttgctattagaggggcttaagtctgtagatatcggctactcttctgttcataagcacaccggaggtgtctggttattttttaaataacctgggttaagaactgagcattacttccttttgaggctagggcataacacacagcttgttctcaggaacacgataatgaggataagtacataaatatggataaaagcacgtcccaaagcaccatctcctgcaggaagaaaggtgat

SEQ ID NO: 75870 - DNA, 1051 bp, Homo sapiens
attgaggaatacccattttaactttcatctgaggcctcttctgttgccccaacctcctaccccgcaacacacacacacacacacacacacacacacacagagtgtttcagacaggaaacttggagggatgagaccacatatctagactataagtttaatttttcaattaattaccgaaggataaagaactttttaagaaatgagatacgcaaacagggtggggattgctacaggctctgctttcacacgttttcctccttatctgcttccctggtgtttattgaatgatactgtacccaaaaccctgtgatagacactgtatgagctgggtggggaggatacaaggaatattagacgtgggccttcaagggcttcacaaagtagaaaacagctgcccagcttgccagatacgagatgtttgccaggtaagtagtgtgggagtgccatacagttcaccttcagggttggctgggtgggaggggacttgactaggaaggcattcttggggaggggattggattaaaggtccagaggcctagaaatgaataaataatgctctctccagggcaatgcgctgaggttgttaactctgtggaactacaaggcttcctttgggggcacagtgggataaacctggagttgaccttaagagacaagcaaaaggatttaaggggtatccttaagagacaagcaaaggaatttgggctttatattgtagctaatgagaaaccattaacaccagctaagggggactgacatggttaaaaaacaggtgaagatgaattttgtttgatgctaagaaggatgaatttaggggacagagggagtgtggaaacagactctaaagggattttgtggtaattcctaaaggatataaaaaggacagacatgaggctgggtgcggtggctcacgcctgtaattccagcactttgggaggccaaggcgggcggatcacttaaggtcaggagcccgagaccagcctggccagcatggtgaaacctcgtctctactaaaaatacaaaaattagctgggcatggtggcgggtgcct

SEQ ID NO: 75871 - DNA, 1049 bp, Homo sapiens
gagatagaaagagcatcatgttcttccaatacttggggcagccatgtttcatgctgggaataggcgtcgggcttttccactgcacctgcttgagcgaatagcggtgcccactggtggttttctgttgattgtgaagactcttgatgagtgtatggagatcatttggaactctaaaaatgacatgttacacttcctttcgggagttctattcccagaatagcacagttctttgaaatcctcatttaaatgagcctcatgatttgtggaaggtgagaatgcacacacctgctttgcaaattgataaactatgccctaaattcataacaggtggtttgcttgaagtagagtagtgagtcagcagtggggctatcaatagaatccagtcaatagttctgtcgctcaccctctgacctcgcttttgatgttagtctagttggaaaaaaaaaaaagtagtaggaggagattgatggttttatcagctgaggccattgcctttctctgtgtgtatgtgtgtgtacacattgatatgtttgtgtgtgtttctgtgtttgcctgtgttttctgaatcatttttgccaagtggtatcttcttcctacttcccagatggtagttctgattttttttcttttggaaattgctcacaaatcagaaggcttcacttgccagttgacagattttaacagcagctggtagctgaccaccctccaccacccatccctcccaccttcttccatgaagaggcatcaggagatagcacagataagctgtaagatgtttagctttgttaaggaggttaggacagtaggaaaatttgaccattattgaaaatattcaatacaaagccaaactgaaatgtatctttctgctcagattaaagccatttttgccaatgtctctgactccgtattttgatcaattccttttcagtcgcatggtagttttgtccgcttatatcatcctgccgggaaaaaaattagttttgaaagtgttttaaacagaacttactcagagaatattgaaaatgcaaccattgtgatgttgatgttat

SEQ ID NO: 75872 - DNA, 1064 bp, Homo sapiens
ctttttcattttatggatcaagtttcttcactgtatggatagaattatgtttctgcaggtattattggtatgggttctgtttctgcaatcttgattgttgtgactgcaattactcaatttctctaggtaaaaaggtgttaaaaataatgcatttgaaatggttttcttattgcaaatttagatttggatggagccagccaacggcgttattctgagaatctctcctacggtgaagatgaccacatccctgctcactcacagtccccatgtgaaagaggggatgccaaacaccacggcacatctcaccaagagtccagtgtggtccaaagcctcaggcgccaatccacagagggcagcttggagatggagacagcttttaatagccggggatttgaagattcctatgccactgacagctcctccatgtggagtccagaggcaagttatttgtttttcattctttcattggttccctttccccttcccctctttccactctcctttctcatctctctaaaaaaaaaaaaaaattccagaaaggaagcattacttttatctgcaataaatttttgtccagatgaccaaaatcccatgcatgtcaataaaagagtcataaatttctctcaaaatggaaaaaaaaggatgaacggtaaaaaaaaaaaaaaagaaaaaaagaaaaaaaaataagaatggtggcagaatggatccaggaacagccaggcttttcttttatataaaggctttttatagacttaattttaaataatggaattttcagttctttagagggactggtttatttacttcatggtttcaattaagtggagtctatttttatttagcccaaatctcaagttacgattatttgatatgaaaattatttgaaaattgaactaaaatgaaatggccttccaagtgaaattatacaaggtgtaatgatgcagatcttgcactgtgaatatatacaaaatatattttgtgcctaggagacagcattaatcagtaatgcccctctggccattgacattggttttgtagtaaatctctgataaaagatacttctt

SEQ ID NO: 75873 - DNA, 1034 bp, Homo sapiens
tgctaacatgttggcgtgtgtaggtagtatctaaggaggggtatgcatacacatctgtgcccctgtgtagatgtctctgctgaggaccagaaatggtagctcacatatgtggtttgtggcttgttaaaaagcagcccttcatatggaggcacccaaagccattaactttatacattttgtttaaaaaaagaaaaaactctgcttacccgttagtttactaccaagccgtatcaaatcccacacactaactcttaaaaaatattttgaatctctctcccaaaaacaaaacagaccaaatgatttgcctgcctattgatactctgtctccttggtgattgtgccatgaggcttggaagtgacttctccaggtcacctcccatttacctgcctgctggagctttaatagaagactcggtattgagggtactaaatgttctcagactccaaaaatacccagacatctctgtgtgctccattcaacctcctatctattttgagaaaaaactgtaatttggtgctcctacagtagaacctcaaatccaactcggaggcagttcccgtaactgcctgctttgcaggcttagcttgccttttaagaaatgatttatttgcctcttagctgtattgagaactctgtcttcccctgtgtatctggcatcaggaacatattgtaggcctgtttactttaggccacacagatgacatcaacactatcttactaaaacagaaaggctttcaatttgacagaaaatctttaaacctacctgggttttgacaatttgacacaagtattctcatcttaaggaaaagcccaggatattggagctcaaggaatcatttattttgtctcagcaggaaactggtcgtgcagtgtgactacctgttaggctgatggattttcgagctctgctcttctctgctggcgaaggcctttggctttttcctgcagacccagggcttggcaggaaagacaatgggagtgtggctggtgattttgagcacacagggagacaggtgtcccacttttcatctct

SEQ ID NO: 75874 - DNA, 1121 bp, Homo sapiens
ggattttgccatgatgaccaggctggttttgaactcttggcctcaagtgatcagcctgcctcggcctcccaaagtgctgggattacaggcgtgacccactgtgacattttggacttttgacctccaaaattataagataataataagttgtggtaatttgttacagaagcagtagaaaatgaatagagactttatcttataaaatacttactaaataaatgttattaagtcaatgatgtttgggagagaggacctcctttcccttgacgtaatatttccatgtgacggaaatcacttagggtcaacacacttggcttgaatgcccccagtggagtgagagaatcatctgattggtaaatctgggagcagtaactgggtatgcattgctcagcaccttcccctttctctttgggtttgtctgcagagagcttgttgaagcttaggcttgtgttcctctctcaggaaaaacactatttctagaattgagactgtgaaaaattcttttctatgggtttttgtaaagagaagacttacaataatgtagtgaacaaggttctaaatgtgatcttgagtaactatggctatatacttcagaagccatttcttacaatgtccttcagtttaaggaagtggtacaataaaacatacttcttttctttacacttaataattatgtattgagaatctactatggaccaggggcaaagctgggtgctagggcatccatgggtgaagaaaacagaattatccttgccttcagggagcttatagtttggaaggggagccagatactgtacaaataaccccttgctaggaaaatataaaacaggactcaaggggaatgtaaaacaggaggctcagttgatttttttaactttttaattttttaaattaattaattaattatttatttttgagacggagtttcacttgttgcccaggctggagtgcaatggtgaaatcttggctcactgcagccactccctctcaggttcaagcgattcttctgcctgagcctcctaagtagctgggattacaggcacctgccatcacgcccagctaattttttgtatttttggtagagatggggtttctccatattggcgaggctgatctggaac

SEQ ID NO: 75875 - DNA, 1401 bp, Homo sapiens
cctttctcccccataaagtttttcaggatgatcaggtcacagtgtgtacgtaagagtcagctaattatggatattgtcatctcggtaactttgtaaaaaaacaaacaaaactggcattgttaattccaaaaagaaaaaaaaaagcagtaaaaaaaaaaagtcatatgcaacaccagacgcaacatggtttaatggaattaatagtttttttttttttttttttaaagaacattgatggggattcactgtaaagttggcagaggctgccaaagacgaaacaactgactttaaaaatgctggaacaatgtgataaaaaataaatttgtaacaaatcttctcctttttagcccttgtcattttagccctttagtttcaactctgcattatatttagtttatatagtgtaaacttttgtttgccattaattcatctttttaggtagaagacattaaaatcacaggtttatgaagaatctctgctcattggaatgaaatgcagtcatttgaaatgagaaaggccaggatccttttttgtaccttaccctgtcttcaagagtaaaggtgaacacttacagctctcctccttgatgtcaattttgtatgttgatcattccaaactgagaagaataaagccacattttagacatatttatagaatcaattaaagctatatgtctaaaattcgtagggcaacttctgagaagaaacaccgtctttttcttttttaatggaaagtgacaatgtgacattagtcatgttgtgtgcggtgacgcagagtaactgaggtaatctgactgttgcactatgtgacatatttcaggacgtacttgctgcatttgcagcagccctctctctctgtcccttcccacaattctgctgttgctgcaacttgagttaattgtgacaaatgcatctttgtgttatattttgtttgcttcataatttccagaactatatataaatatattttttaaatagcaaatattgtagttagtgagtgatgatcactccaaccttatccttaccatattggtttcagggataggattaagagtgtctttggaagagaaaaatacacacaaccctgtggtttagaatgacgctgaggccttaggctgtgggcctagaacaactatgtgagtgaattcacccatctcatactttgaatcaagcatgcattcctgtttctcattgtgaagtatccccagttgttttccttcagtgttgagtttttgtccttttaaattttattatattttgctctccctaacatttgactgttttttataaaagaaaagaaaaaaaaagaaataaataataccctcgatgccactggatactcacaagcagggttatgctccttcatcttgggcttgtttgcctaaatgaaagggtttaattt

SEQ ID NO: 75876 - DNA, 1987 bp, Homo sapiens
tatgaatgttaatctggatcagcatttttttttttttatttttttttggagacggagtcttgctctgtcccccagactggagtgcagtggtgtgatctcggctcgctgcaatctccgtccaccacaatctccgccccccgggttcaagcgattctcctgactcagcctcccaagtagctgggactctaggcatacgccaccatgcccggctaatttttgtatttttagtagagacggggtctcactgatgatccacccgcctcggcctcccaaagtgctaggattacaggcgtgagccactgcgcccagcctgggtctgctttttattggttcgctgcaacatggaaaaaaaccagagacagtgtagtgaattatttttagtaaatgtgaatttatataacttacaatatagtcttatattcctgcatcatgtacttcctacttggttgatgttaaaaatcctttttttgtaaaaatgtaattttaaaatgtccttggcaaaatataaagtttgtcgattctaatttggacatctaatttttgggggaagttttaccaaatagtgaaatctcaaagtctgaaaatcactaaatttaaaatcagtgaaattgatattgaacccaatttgaaggcttgatgcattaaaatttaatacttaataatatcaaccaagttcttttcagatcattaaaagtgaaatcacaagttttcagtttcttctaaactactgaagaatttaaatatgcatgaggtgggaaaaataggaataaaggagcagatatattttcttgacctactatattctctgtatcagtgtcatctccagcatcctttttgagaaactatttggagataaagaaaaattaagattcttactaagctgcaagtgaaaatcactaatatgcccttgattttacaataactgatgcatataagtcattcccatttttgtttcttagtaattttaaagttaattttctcaattaagctaagtataaaggagtgttaaggtgaaattgtaaaatattcattgttgcataatctcattaaacctcagctgtttacattgtattctgtttcttcctcagtgagaaaaagaaagaaaaggagcgtgaagaattgtggaaaaaattggaggatctggagttaaagagaggtcttagacgtgatggaataattccaacttaacaaaaacaatgacaacaacattactaacctgtggagtcacacgtttatgtagtagaagatggagcaacagttttctgtattgtgcaactttacagtagatttcacctttgtttcattattacagcagcactgtatatacctgtctctaagtaaaggaaaaaacaaaataaggacttcaatccaaagtttggacagtagatggacttctcagaactttgcaaacataatcattgttctcaccctcttttaaaaaaaaaaatcggtcttcaaagatctgttgatgaaattgctatgttaaaattccattatcgggagttccttatttatcactagcagagagtatgatacaattttcaaatgtgaacaatcttaaatttagcttgtctttctgctaagctgttaaatgtatttatagtaaaggaagaaaaaaagactgtcatttccttataagtttgtgtaacatcctcctctggataacttgactgtaatttaacatctttttcttttgcacatcttcctgagttgaatgtccacgtggaatggggtcatgaattataaaagtccctgataaaagttttgtttactggggtgaacatctttccagtaaccaggtagtcctggtactcctttagttttaaaattaggagttaagagagaagaggtgataaacatagtagggaagggaatatcggattcatgcatcagtttatggtgaatccaaatcaatgtcttgaatcctttgaaaacaggcactgggacatcacaggcttcagtacctgaccagtattagttgcatata

SEQ ID NO: 75877 - DNA, 1046 bp, Homo sapiens
acattgaaatgttttttagttgagtaaaattccaagcccttgcttaccatccccttatctctccaaataaaaaggtcatattcatcgaaagtcagcaggatctatacaattgatttatatatacccaaattgtgttttttgctaacattgatttagacctcataattattcccagactgtactgagaaacaaaaagtgataatttgtcaaacagcttgattatgtttagaatctggaatgcaccaggagtggtggtgcacacctgtagtcccagccactcaggaggctgaggcaagaggattgcttgagcccaggtgattgaggctacagtgagctatgattgtgccactgcactttagcctgagcaacagaatgagaccctgactctaagaaaagaacaaaagcaaaaacaaaaaagccagaagaagattggaggattatctaatcttgcccttattgtcctataagtgcaattttttcagggtcaaaattaacaaataggtaattttatgaaaactagtctgcttactgaaatttatattgtgcagatttgtatttgagatagctgaaactaattatggtaaacaaggcctaagttatgaaaatattacctattagatcatgatattaattaccatatggctttactaagccataaacatttattgtaaagagttccactggtttgtgctcccatatggtcttaaacatttctggttaataccagactattatggcattataattcaacatttcctcaagtctctagtggaataagaatataaaattacttaggtttttcttgagttttttgggagttggaggggatgaagattaatctctattgctctagatattaatataacttttaaaaaacattggttataatgttttaaaaaaaatgaggcattggaattacatacaaatttcactcaacccatgtggatttccctgcgtagaaattgtactgtggctgaagttttaatccttgctaagtggggtagtgcatggattacatccccatgcctgagatggtggagccccca

SEQ ID NO: 75878 - DNA, 1096 bp, Homo sapiens
cacatgcctgtaatcccagctactcaggaggctgaggcaggagaatcacttgaacccgggaaggggaggttgccatgagcagagattgcatcattgtactccagcctgggcaacaagaggaatcccagctctttgggaggccgaggcgggcggatcacgaggttaggagatcgagaccatcctggctaacatggtgaaaccccgtctctactaaaactacaaaaaattagcagggcgtggtggcgggtgcctgtagtcccagctactcgggagggtgaggcaggagaatggcgtgaacccaggaggcagagcttgcagtgagccgagattacaccactgcactccagcctgggcgacagagcgagactccgtctcgaaaaaaaaaaaaaagaaaatgggtttttaaaagcaagaataataatttgtcaaatgagcaatagaagggtgtactgacagatggaaacattggtttctccataggtgtgggaataggacaagggaatgaagaaatttagttggtactgtcagagaataactgaatggacaattttacttcaggatggcaagaagttaatggtttcagttcagatcaaattttgaagtattacaaatctgaaaatggtgggtggaataagtacttaacactgttagatacatatgccaacattagtgctatgtaaaattgaaattagaagagaatttgacaatatcccctgcatgacagtgtggttaagcgttaaaatttccacctacagggagagagaaaagtgggaaagattgggggtgacaataactgtgtcagcaatatttaggatttttaaagatagagttgtcagtatgaaagccgtgtgataactgagcataatgctcagttggaggaaaagcccaacaggataaattgcattgagtgccatatttgatcaaaaacatgaaacactttagtaacaagatgatgaatgttttaatgatgtcaacacttaattaaccaatttatgcctagtgttccattattggaacgctaagcttgtgggagttatttctatcccactgctcaaggtcatcgtcaaggtctgatttttcacaagaaagttttaca

SEQ ID NO: 75879 - DNA, 1037 bp, Homo sapiens
ctccaatagcagggggaatgaggcaccatttatctagctcttgggcccaggacttactagaacccaacaaatttattacaatttaaagatcagtgaaaagaacatgaaggttaatagtctggtattaaccagaaatgtttgagaccatatgggagaacaaaccagtggaactctttgcaataaatgcttatggcttagtaaaaatcttgtccaatgcattctactttccaaaagatgtacttggggagattatagaagtctagagagctcttagtagttgcgcctgtggtttggctttgatcatccataagcagatgtcagctttgtatatcataaagctatggaccttagaggacccagagatgtgtgcgagtgttcatacccagggtcttgctgaacctctctggttcccttggtgctttgctttgtctcatttttagtctgtcaacttgcattttattgataaaaagagcaatgaggggaaaggtttgatggcagagggaccattgcaatgatttttttgttttaagttaccagggatgtggtttatgaaaaccaacttaattatggaatgtggtgagtatttagctgagaatctcagaagaggctgggattttttacccagaatattgggattattatcaattatgggatatgttattccatactcacagtttaaacaacttttttttttttgttttttgagatggagtcttgctctgttgcccaggctggagtgcagtggcgcgatctcagctcactgcaagctccgcctcccaggttcatgccattctcctgcctcagcctcctaagtagctgggactacaagcacccgccaccacgcctggctaattttttgtatttttactagagacagggtttcactgtgctagtcaggatggtctcgatctcctgacctcatgatccacctgcctcggcctcccaaagtgctgggattacaggcgtaagccaccgcgcccagccctaaacaacttttaattcagtatattagcgattgttgcaaattataaatttat

SEQ ID NO: 75880 - DNA, 1671 bp, Homo sapiens
aaggcagggctgtcagaactcttgttttactagttatgaaactgtagagaggttaaatagcctgccccagtacactaagtaagtacagatgattaggccagaactcgcctccttgactcctaaaccctgtctttttattcactgtgctcttcagcctcgctaagcccaggccaggccccaatcaggtgtccagttgtctagctttgttgatgttcccttccgagtggcccccttcataatatgaaggttttgctgtcactgtacatagacgctagagcagcctgcccaaatactcattttaaagcatggtataggtggatcttgctgtgtcatcttagaatagacaacagacctttagtttcagccattcacaaatgaccctggggggttcaggcctacaatcatttgtacctttgctgagaattcaccaggcatgtgctactttgtgaggttgttatggggtagtgcatgagtttcttagctggagttgagcctaactgagcaccagatctgcagccattcttctggaaggttagcaaccatgtggaaaatggctcagaaaaaaagatcagctgttagttttatatttggttaaaactttgggagaaattccatatacatattaacaaatggcaagggtctactatattttacttttagcagaaacgccttccttctcaaatcagcttcaattctccaaactctattttaatttcagaaagtcatttaatttcttaaaatctgttagataaaattgaactgtgcattgctacccagatacatctcaaaatatgaaggcattgttatttttcatattttgattgctcactttattttttcaaagtaattattttttcatagctaaatacgtaaactggtttttatttatctgtcattttcccattatatttaaaacaattgactctactgcagatttggctccatattgtgatctaaaaactctgtttcttgcggcacccggtgctgagttcacaagattcactgtgctttgtagagagcaagcgtgtgtgtgtgtgtgtgtgtgtgtgtgtgtgtgtgtgtgtcgagaatgcgtcagtgcatgcttatgggtttgaagtggcacctgcatgtgagtgagtctgctcatttgtgtttcttgaactttttgttgtattaatgagtgcgttctagagcattgagcatgtagcaggggctgtacgtatttggcaaataaccacatttgaacttttgcctcttccatttaggagggccaccttctcattgttttttttaaaaaaaaaagtgttgtggaaagagagctggattactaataatagagaggaaggccctacggggtcagttttgcttctcaggggccggtgcagtgtgtgagtgtccctcgttctatgtaatatatataccaagtagagtattttttccaagtacgtagaatttttccaagtaccctatggtgaattctttgtggaacgaacatcttctaacatgggataatgactggttcatgtatgtttggttttatgtgtaaatttttcttaaaataatccaaactctcattaatcctccttgttcttatggattttttttcatgatgtgcctcacatcttgtattttgcttgtacttacaggtcatgttccttggggaactggaagaaatattggatgtgattg

SEQ ID NO: 75881 - DNA, 1030 bp, Homo sapiens
ttatcccagcactttgggaggccaaggtgggcagatcatttgcagttaagagttctagaccagtctggacaatatggtgaaactccttctctactaaaaatacaaaaaaattagccaggcatggtggtgggtgcctgtaatcccagctacttgggaggcctgaggcataggaatagcttgaatcccggaggcgaaggttgcagtgagctgagattgggccactgcactccagcctgggcaatagagcaagatgactctgtctcaaaaaaaaaaaaaaaaaaaaaaaaaaggaaattctgaatgccactggggtgggtattatgttgttttgtacaaacaaactgattaagtttaattaatatcacaagaacagtttgtctcagttcaacttgtggtaacattgctaatttgtgtctcttttttctccctagtattatcaatggctttgctttacctcttaaggcagaacacaaacagtttctggtgaaagtattgatccctttacacactgtcaggagcttatcactcttccatgcacaggtaggaggattttgtacaactacttttagaagcaaaataaaaagtttgcaaactcgtttttttgatattgatataaccttcattttgtttttttggtttttgttttttgagacggagtcttgctctgccgcccaggctggagtgcagtgggacagtcttggctcactgcagcctccacctcccgggttcaagcaattcttctgcctcagcctcccgagtagctgtgactacaagcgcacgccaccatgcccagctaatttttgtatttttagtagagacggggttttaccatgttggccaagatggtctgggtcttctgacctcatgatccgcccaccttggcctcccaaagtgctgggattacagaggtgtgagccacggcgccgggcctatcgccttcattcccaaaggaaagagacttacttaagtttaaaatactccccgagggaaataaaaatgtatgcattttttttctatgcacagtagaatc

SEQ ID NO: 75882 - DNA, 1110 bp, Homo sapiens
ttaaccttggaatgggaatgggtggatgggtggattgggtaggtggattagaggtcttatgtcatttggaacatgttatagataaagagatactgagtctatatggggccttttttttttggctggttggggccacatgcctttctttcctagatagaatgttttcctgtggaaatgtattaacttgcccattacctcccctgatgggctccaaaattgttcaacaatgtgtatgtccagcaatgaggaccatcgctggcacatagaaagaactcagtacgtatgtatttattgtattgctgaatgggcagagagctgtagttaacaacatcttctgtttggataggctgctaggaaaagcatgtactattgaacctgtgaggagcactcatatcccacttctaactcctcatttcttcatcggtcagcctggatgtctcttcctttagaagcctttgctgatcactccacttcttccaaatacagtagatgtgtctgctgtgtatttatacaacatcctgaactacttaacatgctgtttatttacttgtttgtattccccattagaataggctctgagaaagcaaagactgtatctgtcttgcttatcattgtatccctgacagctcgcccactggctggcttttaataagcacaccataaatatttacttgaaatactcatttttaaaatgaacagatgaatgaatgatagatggatggtggatggcattatgtagctaaaaattgtgtcctgtctctacctatttttgaagaccatcctttagtttgcgtttcctgccatgtttgaggggcctttttttggtccataactcttgtcttttattcaaattaaaacaccgaacaaaagcacattcgattattgaccatgaggtttttattctgctgtcagtgtcaacctcatgtctaaatcacctgaggtcaaacttacatatatctggatagcctttttgatgacgatggtagtctaatttgtgtgttatgtgctcttgaaatgttttgctgtaaagacactagaactgaattttgctttattgcaatgatgatgaatgttaaaaaaaacaactcagtaacattcaaaccaatttcc

SEQ ID NO: 75883 - DNA, 1065 bp, Homo sapiens
ggtgtatgccaccacgccagactaatttttgtattttcagtagagacagggtttcaccatgttagcccatgttggtctcaaatttctgacctcaagtgatcagcccgccttcgtcttccaaagtgctgggattacaggcgtgagccactgtgccctgcctgcctacatactttattgacattttggctaagtgtaaatttggaactttcccagatgttttaaggaattgatccattgttttccagcttccagtgtgggtattaagaaggcctgcaccaggtgaatgccttatcctttataatgacctgtcttctttgtatcttctttgagatcttctctttgtctccacatccagaaagtgatgtgctttggtgtggatctttgttcatttattgtgcagaacacttaatggaccatatctatattgacattgatgactttttttttgttggaaattgaattgaattattcttcagataatttccttctcttcattttctgtttttctgtctccatgtctttctggattgctattatgtattggatcttctggtttttaaaatcttcttctatatattatctctgttttttggttatatgctctggggtagagttgctcattttaatgttctagtgcttctgctaaaatttttatttattatatgttgaacttctaaaagcttttaaaaaatttcctgaatatccacctgaataatagcactgttttatttcaaggatccagcatatttgtttatctttgaagatgttaatagtttccttcttgcaattttttttggtactcctagcattgtgcctgtttcctctgagttccttataattgtttgttgtggtcttttatgttaaaatatctggtgatctttgacttcatagtcataattacatgttagtctaccgaaaagttgcttagaacttgtgtatgttaccgtgtgcacatgtgtgtttatatttgcatggtgacacttggcaactggtgactttgaatggcataactggtcagggaccttgccatttcattaggaaaccctcagctgttagcatatctgt

SEQ ID NO: 75884 - DNA, 1402 bp, Homo sapiens
taatatttttattaggattcttgttttgagaactttcttaagctctgttttctttaatagcttcagtccatgaaatcatatagtgttagcctgtcatgtcttacctagcatgttatgaattatttgaaatccaactcttattctaaaaatcattggtatccattcaactctacgtatatggttcttcacaggctgttgggttctcttaagatgttacatgggtttcctgtgtctctggattctcttcagttccactttgccaactgatttcctccaatcagtgttgaacataaatgtttattagtgccaggaacgtataatttataatgtgtgaaaaccagggatagcccatttaaatctttacagaggacagacaaatggtacatgattaagtagtgttggtatgaccaaaggagtgatggaaactgtggcgatttagagagcttggatcctgctgccaatccgctcccagtaacggttggtctctaggtaagtgagccaagtattgctagatcttttggcttttcaagagaagctggaaagccatattttggtagagccagacaaaacagtctgttgtttttctttttcttttttttttttttttgagatgaagtctagctctgtcacccaggctggattgcagtggctcgatctcggctcacggcaacctccgcctcccgggttcaagtgattcttctgtctcagtctcctgaataggtgggactacaagcatgcaccagtatgcctggctaattttttgtatttttagtagagatgaggtttcaccatgttgggcaggctggtcttgaactcctgacctcgtgatctgcccgcctcggcctcccaaagtgctgggattacaggcgtgagtcactgcgcctggccaacagtctgtcgtttttcattcaagggttttgaatgtttttgtttgaagggttttgttgttttttattctagaatagtatgactggctcacttgaatttcagtgtgatttttattaaatctagatttacataacctgtagcattttttgtgtactcacttaagtgtttggacaagaaagctgttagagatttatcaaagatagtccattcattgcatagtgcacttttgtctgtggtaatgttgatttcagacttaagtaacttggttaactgccttctagagctatgactatgtagacttgcctaggctttatggaacaattttgtctattcttaataaagataattttcatctgtattgggatggttgggaaaatggtttctttatgatcccccaaccccttctttagacctaaatgaattagcaatacttcgattatttcattgggtggattattgtggcaagagtttagcaacatatttctaaagattactttcaactactctgcaaatc

SEQ ID NO: 75885 - DNA, 1043 bp, Homo sapiens
caatgacagttatatcacccacaaaatatatatatatatataaacataagttaatttccattactgcctattaaaagtaataggtacatttaagtttatttatggtagaaatcaattacattttaaatagccaggaatgctaatgcctaaatccctacagttttctctaaaaatttaattataaaggaatttcatttatataaccttggtttgtgggaatcgttatatagcttaaagacttacatttgcgtaaggattcttaaagaagtgtggtgtagatctgttaaaactgagtaggcaagctcagacttcaaagcataagtaacctgtaataaataatcaaagtcagggtactgatgagatttcactgctagaaaatagcatagcttaacattctaaaatttccctaaagggattaactctcatgtctccatttggaacatctccgggaacacttttttcctgactcctcattgtgcatgttataacaatggatcttcctttttacctggaacttgggtgctttcatggcactgaagttttaggtaacacttccttgctcctgttgttgatatattcgtctctaaaaatgggtgcttgagccaaactggtgtagctctcttctgagtgacatgtggggcatctaatgtaggaaagaataaatgtttatctcctagtaagccggtaagaagaatttcaaatttaaaacattaatttgatctagcctgggcaaaagagcaagaccctgtctctaaaaataaaataaaaagtaaaacattaatttggcaggaaattggtctcctgtgccttactgggatggggctgataacctttgtgatctcatttccctccttaattaaattaatacatttggaatttaggatatataggttgaaccatagccaattttttgactgtttttgacactcaaaacagcagtttcatagggttcaatccaacagggtcaggcaagcttccagagagctgaggggcatggaggcctctctacatcctaagtaaggctaagtggaattaaacccaaa

SEQ ID NO: 75886 - DNA, 1032 bp, Homo sapiens
tcttttgggatctttaaaaatagacaaaagaataatttttagttcaaatatgtcaaaggggtctactctgtatgttattcaaccttttcagttatccaaaatagtatcttgtttatgtattttctgaaattaggtgtgtcttcagtagaatacaattttataggactttcatttacaattaagaatttgtttttagtgctttccgtttgagactgacaaacaggaatgctagtcttcttactaaagttccttggagaattcatttatgtaaccttgaaaagtaatttgtcctccccagcccccagtctttctctttagaaacttaagggagatttttgattttgacgtagaatctttctcttaagtgcagagaacacttatgcttattaataaatatgtctgaagtgtttccaccaaacattttagaccataactgctttcaagtgaccagagaggagagagcactttgccagtcttgctggaaagccttgccagtccacaggccagcttagaagatgagaatctcccctctttgtggcaatcgaaagagggctaaaacccacttgatggggtcatttgaataaggctgacattctgtatgtaaaactgagagttgacagatgagtgtattagaaaaggaacaattctctgaggtcttaggacttgggcattattttgactagcaaaataacatgtgaaatttggcaacgtccggatcattaggaaagaaatttttctgaattcagagagttccaaggagaaaaacatagttttataaggaagtaaaatgctaacgtgaatccctaatttaagtcttaaattagagtctgacgtgagaagaaacatttaaatcagtggtatctgtggacccttagaggggctctgagacctgattttccatgtcctgcaaggtcaaaactacctttataacagtgctgtatatatgatttgtcctttcactgtgttgacgtttgtactattcattgcaaaagtggcggtggttaaaattgctgctaccttaacgagaatcaa

SEQ ID NO: 75887 - DNA, 1045 bp, Homo sapiens
ttgtgtttttagtagcgacggggtttcactgtgttagccaggatggtctcgatctcctgacctcgtgatccccccaccttggcctcccaaagtgctgggattacaggcgtgagccactgcgcccggccagcagttatttatttcttatgtcagttggttaatcagaaacatgcttgactggtaagtaaccaagagcaggctttgatgggaggtatgaaatcatggggacctagggagggaagggttaaataaggacgattaatagtgttcaagagagtaggatggtgctgctttgctactttccagcttgcctggaggtggtccccacctcagagcctatagaaagaggtccttattctagtttggtgatgttccttgtgcattgttatctgggttcccctcagcttggctccaaggaccttgtgtaaaactgtgcagaaggtgcttcccgttaactctgctgcttgtttatttttaggtatcttgcaatatattcagaactctccctcctagtgacagcaatgaatttgatccagaagaagatgaacctacccttgaggcatcgtggccacacttacaggtactttgaaataccatttgttataaaagaaaactccattaactcattagctgattagcatgggaattccttgaagggctttattcaccaagaaatcaaattagagtacactaatggaaagttagagaatgttttttatgtttcttattcttgataattagaatgccaaaagaataaaatagtgtcagtgtgatgctttagtgtcccccaaccccacgttgcaggtacagccagcagttcttatttctctattagagcttctttatgatcctgccctctagagcctccaacaaagcacagaattattttcacattagcattagttggatgtgattagctcacagagtatatatctcatttttagtggtatgtaccctgggaactttgtatgtctgtcatcacattaactacaaatgtgtttctttagttagaaggacaaaaccaaactgtaatagctatttcgtt

SEQ ID NO: 75888 - DNA, 1044 bp, Homo sapiens
caggatggtctcaatctcctaacctcgtgatccgcccgcctcggcctctcaaagtgctgggattacaggcgtgagccaccgcgcccggccgaccctttctcttctttttgtttactcctttccaaggtgatccctttggtctggtggctttaagtattatctatatgctgctgagtcttatatgtctctggttctgacctgtccagctcagaggtccaacttcatatttctaattgcctcctagatactgctcccttaatatgtctctaactagatccctgaatctctccgctaaaataagcaagtaaagaaataaacttttcccttttccagtaatctccatcttcggttaatggcctcagatctatgtcttgtccttaattagttctttcacatcatatatccaagccagcagcaaagcactacctttttgaatcagtctatttctgtcttccctaccatccttgccaagccagcgtcattccttgtcacattcacagccttctaacttgtcctcttcctgcctattctatacatagctgttggagtgatttttttttttaagcaaaaatcagatcatgccacttctctgttttaagatccactaatggcctctcattgcactaaaataaaattgaatctccttcccgtagcttacccatctgagctcagtttccatagctaggaaatggggataattgtggctttaactagaatatagtaagttccatgagggcatgggtttttatctgctttgttcactactgttttcctagtgcctagaacagtgtgtacacgtaataggcacttaataattatttactggatgaataaacacattcagattatgtggataccccaaagcctttcttctttcctctttcagagcagtatattatgtagctcagtattttctgcattacataggaaggccagctaaggcttctgatgcaatatctcctttctttttcccttctcactttttacgcatgttctcctgtccctccctgtcttatgtttgggtcattaggaggatatgtttgg

SEQ ID NO: 75889 - DNA, 1047 bp, Homo sapiens
ttctatgacacttgatatgctttgccattctttcccattgtggtagagaactacttcaccaatccagtcaactctgaattgtccaacccagcagacatgtgctttctcattcctcatttggtgaatgttgagaagtaaactaaataaagcatgacaggaagataaatctgaagaaatgacagtgtgtagctaaatgaaatgtatatacttatagaactacctgccttttggattatttacccaacttggccttcttttgctgtaactgagagatgaagttttgactaagtcagaagattagaacacaatatagggataaacatccttagaaataacttaaatttattcaagtcaccaagaaaatgttgaagtttgtttaaagcaaaaccacaatacccagctttattaatatatccaaacttctattttgtgaatatttattaaatgcttagtatatgctgggaagacaaatgtgttgtatattcctaattagttattagtagggagagacaaatacctaaacagatagttgctgcagcgtgcagtggacactgtaagagagtttatatgcccaggagtacaaaggaagagaagtttctgtttctttacccagattttttactatagagaagcccccttttcccccctttcatggtttactttcatgtcttgggagaggaaaaacacttgttaaaaagtgtagtacgtataaatgactcagttgggatgaagactcagtttttgaattacatgtatagtttaatgaagattcaaagttgagtaattaaagaacctttgccctgtcaattacattatagctggctggttgaagggaagtcgtaggttgatagttatctgaaaagtcatttatttcttcataaaaataatttctagtaatcactggaagggacaaaaataaaacaatagaactgtgtgtgctgtcattagcgatagcaaaagcatattctcacatgatcatttttttctgtcatctaggctaacgaataagaaagttggtctaccttttcttctagaaagaacactggg

SEQ ID NO: 75890 - DNA, 1048 bp, Homo sapiens
ccttgctttgtccttatagccactttttggaggccaggccagtgacttcaagcctcctttttttctttctttctttttttaatagagagatgggggtcttgctatgtcaccagggctggtcttaaactcctggcctcaagtgatcctcctgccttagcctcccaggcatgagtcactgctcccagccccttcaagcctttagtttgatcctaacatccgatgtgtattctaatatctttggtatgaaaaggaattagactacctcagaggcatttatttcttaaactttttttttttactttgcactgacaccagtgtagtttaaaatacaatatttgaaaaataaatgtatctaatatactgtaaaatttccttttgttcatttttgatagtccacttttgaatgaataaaataggaggtgtagggctagaacctcatatattttaatataatagagaccgtttgtgactttggaaatacctgaatgcattttaatctagccgcataggctcttcacaaaactgttgcatggtggggagtgatgttggtgcttactcatggctgtgatacatttgcataagcatgcaagtgccctatttaataatccatttaaccgtaaactataaattaaaagtgactgccagtgataaaggaagatttaatggaagcaaatttactatttaggaccttggtttttaaccatttttagatcttggaagtcttttgaaaatctgatgaaggcaactggccttttcccaaattggactaacatacaaactgttgcagataaatcaggggatttagagacacgcctccccgcttcctcccccgtgccccaatggaagcccatccatggatgacctgattttaaatttatgattttggagctcaactgtacagttaaactggttcattcatttaattcttaaatcattcattcatgagccaagctctctggtattgtgggaggctgtgattttttttttttttttttttttttgataagcctttggcactcctggaggctgtgattcttaactctcgctt

SEQ ID NO: 75891 - DNA, 1189 bp, Homo sapiens
attccccttttgctctttcctgtttttccttgttaaacctttttttctaatcttactatatatacattatcattatgatgtaaacatactctcctgtaattaaataatcttttaaaagcataattctgatggttcctaacactccattatgtggatgtaccattgtttacttaactgattttccaatttgggatatttaaacagtttccaaatttccactattaaaagtaataccatcatgagcaccaaagagacattttgaagtaataaataaaatgacttgttgacaaattgtatatagcagataaaggagaagagttaacaaaaactccaaagggttaaaaaaatagtgaacttcttgaaagaatggggaggtgggaggagaattctctttgagagataaatggagtccaatgagagtgaaattggttttgaccagcctgaatttgagatgatagtgagatgtcaaaactgctctatatgtaactggaagtaaagaaattaaggatatccatgtgccctggacacagaggtcgtagtggaaaaggtgataggggactgagtattgagaggagagcagcatactaagggctgggacttgttctacctctagtgctgacctttatttttctttttggggaggttgtgtacttcttcactggatgaaatcatgacttggaggcgttcatttgaattttgcattcagtattcccagatcctgaacatgctttatttttctattttattttatactaagacccactaatgtagttggtgctaattctgagaaagaaactcttgtgaagatctctcagtttattttggctaagattagagtatctgccattttttgtttgtttgtttgtttttttgctgttatactggactcttccccactaaaaagagactgattttttttgcataagcaaattaaattacttgaattagcagaagttactggagaatggaagaaataacttaataggaaataatcactaacttttgagtaaatagggtatattgaacccatgcatatgtttacttttattccctaaaatctccccacaattactgaaatgaaaaagttattactgaaaggaaataaaacccacaagaacaaagcaaaatagagagatctcaaaattaacattttggaagctagaaagcaaatgaacagtggttactacct

SEQ ID NO: 75892 - DNA, 1025 bp, Homo sapiens
cttaaaattgtttgacagctgtgacttgtctagcactgatatatccaataatatctcactgtaatgagtatactccccctgtctctacccctccccccagtggctggcagcagaattttgcaggataagttacagtactgcattcaagttttggtttctcttttctcccaccttttaatttaaccttgaagctgaaaatgtggtttaaaggtataagcaatgcttctgggaaatctattaagcacatggatgacaaagtgtgaaatcttgcttgtggcatgtgcaagtgggtcttggataatcccagctcttggtgttagtttgtatgatttggctgtctctctactgaggagacacagaaatgaaagagagggatttattggctgattgtttggaggaagctggttacaccacagtggtgcatgatgagcaggaaaaagctgagaaaatgagtgtcctcaatgtggaattcacagagacaggagtgcctgaggcaagaatctggcaagcagacaatgagcaggtcatttccaggaggcagttggctgctgaccagtatttaaagccaaacttgatctgtaggaaaacaagaagaaatatgctattcagtgacttctcaggagcaagttgcctctgaaaaatggtgcaaagacactagactatagagtagaaatgccatttctgtgatgagtagagagaggtgagggttggccaagtagtggagagggacagctggtggggtcatggtgaggagggtcaggagtggcacacacaaggaaagacatttctcagtaaaaatcaggctggttataattatttgctaagttggagagcaagtgtatttttttgacaaaatggacaaggaagttctattggaaaatatgatgtttctatacttttcagaaaggtagggagtggggtcttgggaggataatgttaggtgctaaatgggctactttgaaatactgtggaattggccttcctgcagaaggtaagggctttatgagaataggatagaccactct

SEQ ID NO: 75893 - DNA, 1023 bp, Homo sapiens
ggaatcaattaggagactgttttattggagaaattgtggagggcctaagcgaactgcaggcatggaagtagagaaggagaggaaaggaacatttgagattcacctaggaggtaaaattgatgctgcttgttagcatttatgtgaacttttggagtgtgagagaggaaggagtctcggatagctttggcagttgggtagtttgtggtgtggtgctgctgttggggagtagggagagcaggctttggatggaagctgaggagttggttttcgatgagttaatgttgaggttcttatgggagacctagatgtggaaagtaggaggtggaaattggtagttatcagaatgggagtagggcaggggaggaaaagaacaatgatggaactctagatgataccagtgaatcattgtttcagtgcagtggtacaggtgggagctagtgggttgaagagtagattaaaaaatcaagaggttgagatgacggctgtagataattgctcgcaccttgggtgtactgtcttcattagagtaaaatcctgtcacttctctcctacaaaaagtgttcaaccttgtcacactgatcatttgctgttattatttttattttgtctctaggacttggcttttcttggtttcaaagtctgcttcaattctcaatctctgcttatacctcaaatggtagaatatgtaattttccaaagttaatttagttttaagataaaatatattcactggtttttccttccttgctgttgaggtctttctttgagttcgttacgttgtttcttggccactattagctttgttttttcctactctcaaattataacctgtcacttggttatctaagtgctttatttttttttatacattctttgatttaactggaaaccagagctctggttagcctcttaatacaataatatgacattgtagaaaattatgaagttgcaattaaatctctcagagtctgccgacatgtactcttagtagtgcttggttaacctcgctacattattagctga

SEQ ID NO: 75894 - DNA, 1023 bp, Homo sapiens
tgtaaacacaacttttacatgcaccaggaaaccaaaaatgtgtgtgactactttattgagatatttgctttattgtgatggcctggaactgatcctataatgtatgtgaggtgtgcctgtaaagcaaaatagcccataaagagtcccagacagagaacatggaagccactgtcttcatttctcatcttccacttaactagtggtaagaacttgggtaagtagttttctctctaagcctcagtttcttctgttataaatagagggagttgatgatgaatcccttacatctttccatttctgaaaactaacacctcttttgatcaacacagtctaagaaattttgaatggattatgcctttcttaaagtttacaggccattgtgcaaagtagttccttcagaaagtggtttgtgtcatgtatttctcttggggtctcctggagtcatagctgatgaaaaaatgagaatcaggacttccagctcctttaggctttgctccattctgcttcacatcatctcaagtgtcaggtgtctgtccctgaggcatattttttttaaccacattatgctaatgcctttttggttttgttgttatgtatccatttgaaagatttcttggaatttctggctttccaaatcaccttgtgtaaatttttatttacctgagcttgaactctgtgtattttatattgtttatatttgcacatcttttttttttctcgaaaatgttttttttggggatacttcaaatatgagatgaaatctcatgggtgaagacattgttttagttaattcttaatgtttatttaaatgactcagtgttacacttttacattttgctaataaaaaagacagggcttcactttgccagtgagctcacaatctggtagagggaatactcacgtgaacagtaacaagataatgtcatatatatagtagtaaagtctgtacaaggcaaggaaggagtaaagggacgtgaaggtagatagaagggtggttaaggaaggcttgacagaatgattata

SEQ ID NO: 75895 - DNA, 1052 bp, Homo sapiens
gaaccatacagacctgggttcaaatgccagctctggccatactttctacatcaatgtgagcaagttactttaacttaggggttctccatttttgtgtggtgctaagaggtacatagggtggggggagggtagccatagttttcccagtccctccttaaatattccacctaggtaacatgcttgtgcttttgtttgcatatcagggtactcaacaccatacatacatatacagtccatagaacgtgtgcttactgttctgtaaggaaaactggaaccacgtcccacttggtgccctcattccctctaagcccattgtatatatacatcctggtgctggtcactttcctaatttgtgtaatacctgtctttggggggttttgtgaggactagcgacaatatttataaaagttttagaacagtctctaacatgtggcaagtattcagtaaatactatttttacatttcaatgattttattagatacttgattttacgatcattggtggaacccactgttacttctttgtacttaaaatactccgtcactgagatgtgttttattccattgccacagtggttcttaagttctctaattccaagatgatcctgcctgttgggtaatcactgtccccgctgatttctctttcgtgttactgtaaaacaaaatcacttcaccagaattagtgagggaaatgatagtgttttttatgaaatactaatgaagtgatagatgggttttgcaaaccaggatgagtaatgatgtataatggcatgttacagtatcagcattagtaccgagagcttttgatccaacttgatgggacttgtactttgagaactggtattcctgttaggggaagaaaagagtaagagataaaagtaatctatgtgttgtggaaaccatttttaacaattaaatgaagtctggataccacctacagacttctagaattaggaaagcaaagcagctcttatgggtataaacaaatcacatgcacacctcgttttattgcacttcatagatattgggggttgcttttttttttttttttt

SEQ ID NO: 75896 - DNA, 2802 bp, Homo sapiens
aagtagtagatacggtatcccctcccacccatgtgtaactgtgaaaaagaacactgttgtcatgtgaattcttatttttttttagcttgcctttgaagtaactttcacagagaattcctgttacctggaaattgatgacagacttacaccatttcctttttttttcttagacgttccatcctcagagcagcctgaactgttcctaaagaaacttcagcagtgctgtgtcatttttgacttcatggacacgctatctgatcttaaaatgaaagaatacaagcgctccactcttaatgaactggtggactacattacaataagcagaggctgtttgacagagcagacttaccctgaagtagttagaatggtgagtttctttttttctccgcggacacttttaagcatcttccatagtgactcacaggtgtatatattgcaagagtgaggtcattggaggtcaactccacaaatgagagccaacctttggagagctaagcaaatgtagtcggcacagtgctagaatttgaagagcatgatttcatgagaacgaaatccagaactttaactacgacagtgctgaagcaataaatgacttcaaaatatgaagccaagattgccagggtattactggatttctagctttggcaaaagaaaagacacaggaaaataacaaaagtcttagatccgtgtttgaaaaatattcaagcctgttggatgtcttttttttttttaatcttattcattgtggtatattagaaatggcttaatgcttaataaaattgtgatttgtagaatgtagttaaggcctctcttgggctttataactaacgcttctctttataatctccttgaagtcagggttgataccttttatgatttttgaatagtgtcttagattttgtgtggtcattaggagttatgaggaaaaacattattaacataatgtgagtaattacattcttactgtgtgaacaattattttagtttttcaaaagctgagccaaaatgtggttttctgatagatttctgtgggagagttgcctttcttggcatcccagaagatcttggagctggagagtgcacgctatttggggatgggctttgcagggtggggaagctggtctactgactggtgaaatagcctcagagatccttaaggtcagtgcatcgttgaggagtccattgcaggatctggcacactctctgtgtactgcggaacatctgcctggcttttgtatttagttctttatcatttgtattcaaccaatgcagaaaagagacttttgtgatggagtagatatgtttaaaaatgatagttcagatttgcaaaggcacttgaatgatctcagcgtgagactgtgactgaaataatgaaggtcatctgaaaacgatgcccaatatattcctcagttctatatctgaatgtatattggatttgttgttaatttacaggaatgtagcactagaatgttttgtaggttaaagatgaccgtgtggctcttgagcagtgcttctcaaccaggtgtgattttaccttacaggggacatttgtcagtgtctagagacatttttggtagtcacaactagatgtgagaggagagtactaccagcatctagtgggagaggccagagatactgctaaacattttacaatgtaccgggtggcccccacaataaagaattatctggccccagatatcacaagtgccactgttgagaaaccttgctcttgagtttgcatgctatctaaacctcttaatgtgatgcagaggatcttctctagtctacctgccttctgcagagcacagtccctggttttagcctacctgtatcatcagccaacagaggtatcggttatgactttcttctgtatcttcccatggatagttcatgaatatataagtatatgcaaacatatgtataaatatttttttttgtaagcacacaaatggtggcacactatgtattttctgtaccttgcttttttcacttagcaatatatatttcagtacatataaagttgccatattctttttatagctgcataatatttattgtgtgaatgtaccatatttaagcagtactctatgaatatccttatacacacatcagtttgcctttgtatgaggacatctgtatacttatttatttttaaaaatttaattttttaagagcagttttaggttcacagcacaattgagaggaaagtacagagatttctcatatgcccctgtccctgcacaagcacagcctcccccattatcaacacctcccccctcactcccaccagagcagtacatttgttacaattgatgatcctacattgacgcatcattatcacccagaattcagagttcacgttagggctcattcttggtgttggacattctgagtttagacaaatgtgtaatgacatgtatccaccattatagtaccatacataccatacatcactgccctgaaaatcctctgtgctccacttcttcatcacccaccaccttcaactccctggcaaccactgatctttttactgtgtccataattttgctttttccagactgtcatatagttggaatcatacagcatgtactcttttcagatgggcttctttgacttagttatatgcacttaagtttccttcatgtcttttcaagacttgatagctcatttattttagtgttgaataacattttattggttggatgtaccatagtttatccattcacctactgaaggacattttagttgcttcctaattttggcaattatgaataaagctaatataaatatctgtgtacaagt

SEQ ID NO: 75897 - DNA, 1842 bp, Homo sapiens
tgacttggattttggaggtgggtagctttgagttgttaaaatctagtgttactgtattgtggtcagaattcattgcctttatgatatgtttttgttttttatgagattctctttatggcttcttaagtgatccttttaataaatgtttatttaaaaagaatatttggatctacttcagggactgcttacatagacactaaacttttcttatatagtggaaaccttctggactactcagagattgttccttctctgatctctggcctgtcctgccttctcacattctaccttttcacatccacctgggactaggtagatgagagaggagattgggagcagtattagctatatgggacagtctgaggcccagacattatatgaagaacctcttgtttggactggtcatccttcaacatgtataaaactttcctaaattgttaccataaagggattgtctctttaagaacccccttttggttcatcttgactgtgcaagttttttaatttaatgaaggtaggtcattttagaaagaatttagtttatgataaaggacaaatcgcagcttttgctgtgttaattcttggtgcatgggctagaggggagatagagaaggggtttagcatgatgctttatgaatggagagtcatttgttcattttgtctgctttcttcctcctcttctgtgtttgcacacaccctgtgttctggaatagggtatcactctggtctttcactgtgtttcgtgttgcattgcacagtggtgaagggtccaggctttggagccaatccacttgggtttgaatcctgtctccactgcttattaactgtgtgactatgggcaagtcactgactctgtgttttggtttactcatttgttaagttagaaatagtacctactgcagaaggccattgaagggattaaaggagatataatatgtataagtgcttagataaagtgcccaataaatgtacccaatatattcaataaatgtaagttattatccttattccactggacaggtggatagcctgtttcacatttgtctatgacattatatcactttgcacaaataaaggataaatttcaactgcctaacattaaaaaataggactaagtgttaactgcctaaattttttgaactgctaagtatatgaatctcttgagtactattgcagtgaccacaaatgttaattgttgttgtcactgcttaaatgatgatgtactttaggaggaaagactacaattcatcgatgcttttataagttatatatgctatgttaaggagttcaacatgtagatagtctgatttttagactttattaaaatcactatatcaaatattgaattaattaaaatttccctaaagattttgacctgtaacgaatgttatattaataagctttttcttggccagggcggtggctcatgcctgtaatcccaacactttgggaggccgaggtgggcagatcacctgaggtcaggagtttgagaccagcctggccaacatggcaaaaccctgtctttactaaaaatacaaaaattagctgggtgtggtggtggatgcctgtaagcccagctactcagaaggctgaggcaggagaattgcttgaacaagacttcatctcaaactaaaaaaaaaaaagctttttcttgccccctttgcagcatcagtattcccattcggctgctaggtctggggtctgatttcgatctcgaaagattttagtaattaactgtgatggtcctgtgcatgaattagtcattggttaaggatatagtcatgctcataagcagccttatttcatttttatttatttattttaaacgcccaaagcaggtag

SEQ ID NO: 75898 - DNA, 1084 bp, Homo sapiens
ggtgacctttggtttttatttgtaaattggagagcatattgttagcttttgggaaagggaaactggagagcttcatgacacaataataataaatacatgttcgttgtctcatttgggaagaataattaatatgttattattatctaaaacttaaacctacctgcctaaacttgttcactagcttaaggctgattttatactgttgtaagttttaaaacgtgaatatttgtatttaatagaaaagtcaaccaatttttcttttagactgcaacttctcttaaacaaataactaaccatagcaatggaagtatatgtacaactctaatgggggttagttgctgttatttagcatgatcatcaccattatcatcattgttattggtatgccccttccctcctccgcagcaagactgttggggcagtaagactactggggttcagatactagctgcagcccttccagtgtgtcatgttggacaaatgacttagcctttctgggtgtcagtttcctcatttgaaaaactgggatattaatagtggctacacctaagatattctgaggattaaaagggataatgtgtgtcaggagcttagtacagtgctttatggttgtaagtgttcatgattgttattgtctctattctttttacctggaaatttcagtcaatacccacaccttcatctcatccttttgacagtattctatctgtgctagtcattctatgacacgttttgaacctttaaaaaacgtgtatgctaataatcagcaaagtgtttctcaagctctctaacagattggcaagatttctaaaagcagccaactcgacattcacctattatagccaaggccaagaaagaacgctttcactgttgtaaatgtttccagggaccttccttagcttggaaactaaaagttttcactgctagctttaaataatggagagaaagaatttcaaaggaggaggggatgaaagaaggattttagagtgcttactttaaaaacggtggtttttaaccgtagtgacatactgaaatcactggagtcacttttataaaatacaaatgcttagcagtgaaatatcac

SEQ ID NO: 75899 - DNA, 1026 bp, Homo sapiens
gtgtgtgaccccaaggacaacctcagccatctggaagaatgcagaatgggcttacatttctttttcaagttcccaattatgctgaaagaaatcgaattcatttgacatcttaaacgtttctgtgatgtttttccagaattataactgacagacttttgagatagtggacctagttgccgagcttagttttaactttattatacttattaaggtcaactcttatttctcatatgtggtctggctccttaagtggaagatagagttatataatatgttttctgaaagggaaagtcattttcagtacaatctgaagagaaaatgtttgtactaccccatggcatgtttagctaaactctgggttacagtattagacatagaatgctgaattatatcaaaattcagaaaaaggctgtgcttagaattgcactgtaagcatgcatatctttaggtttcagtgactgtcttacccttggagacggatgttttgtggctaggaaaccagcagcatagaaggaacatgttgtaaatagtgttttttttgtttgtttgtttgttttttttgagacggagtcttgctctgtcacccaggctggacagtggcaagatctcggctcactgcaagctccgcctcccaggtccatgccattctcctgcctcagcctcccgagtagctgggactacaggcgcctgccaccacgcccggctaattttttgtatttttagtagagacggggtttcaccgtgttagccaggatggtctcgatctcctgacctcgtgatttgcctgccttggcctcccaaagtgctgggattacaggcgtgagccactgcacccggccaataatgtttttaaatacttttctgttctgaaagtgttaagcttcccagacacgttcgctgtcctttttaaactctctgcattactgttctccaagttttgattttggagtcatatactcaaaactgttcatacacacatacatacatacacatatgtatgtatacacatatgtatacacacataca

SEQ ID NO: 75900 - DNA, 1035 bp, Homo sapiens
ggtattgtggcctttataagcctactcctgagaacagcccactaattaaatgggaggtgtggagatttggtccttgtaaatcaccatttagaaatggagatgtattggattcatattttgtgtgtgtgtacgtttgtagtaaagtcataaaacagactctactactctacagtctaagtgcttcctcttgttcttagttttcagctgttagtggacactagtcaggtataataaagtagcttcttattcagttaagtttgtgttaaatatgtgatcctatctgtgaatgtcatgaataagtaatttatagatgattttatgattactaattgttaatggatctaaaggccttaaaaatctaaggatagaagaacagtgatcaccagcagtatagggttctctgtgctggtaatacatccatatagtagggcattgaatgcctaaaaactactaatcattgattgattaataaaactattagttgggtggacagtagagtctgatttagaagtcagagtatggtatgtgatatttgaactgattgagcagggatttgaagcctccttattaaaggatatgttattaataatataaactttagcggaaggaggagtggtctttttgtagcctataagatatgtacttgaatataatctctgttactgaaatatacttttgagcaaagcatttatctttggtgaatttgggtttttcaattgcaaagtgagtatcaaacctagccagcttagctcactgggttggtaggatcattaaatgaaataactcattttgatccagtgttgtgccttccatgagaacaacaacaacaacaaaaagcaaaagggggggaaaaagaagaagaaataatacattttgagaaagcttgaaaaactcgagcattatacaggtttaagttagcattcttcctactttcaaatgtgagggcattgtttgtggaatattctgactccagcttgtgttaatgcttttactttttttgttgttgtttaggtttatcaatgacagatagaagat

SEQ ID NO: 75901 - DNA, 1337 bp, Homo sapiens
gaattttagtttgttgtcagtatggtgttaggtgctacatagactgagttaaacaggcagccacttcttacctttattgtactaaagacttaagttatgttttgttcagtgtctgttctaagtgtagacaaacaaaccagtcagttcatttagcaaggtgccaagtgaacggagctagaatatttagggacaggcaggtgaagctttcacctgaatagtacctgagaagttggctttatttattttttttactgtaaatgtgtgaggtagaaaaacaaggctgtccagcacgtggcagttctgaggatgatccttgaggggtgatgtctgcctccagtcttcgctgaggagaaaagcacccctcctcccccacccacagcaccatgggagagaggccctggaagttgactttatatagaagttaatcttccagagagctcagagtgtatctctgtgtgttttcatctttattatgaaatctgggaataacagactggagataggtattgttcttaatgatttttttctttctttctttttttgaaacagtctcactctgtcacccatgttggagtgcagtggcatgatctcagctcactgcaacctccttctcctgggttcaagcatttctcatgcctcagactcctgagtagctgggactacaggcgtccaccaccatacctggctaatttttttttggatttttagtacaagatgggggtttcaccatattggccaggctggtctcgaactcctggcctcaagtgatctgcctgcctcaggctcccaaagtgctgggattacaggcatgagccaccgtacccggccaatgatttctttattgagaaggagattggcatctagagaagttaagtgacttaatctcctctcagggtaagtcagcattggagccaggttctcatggtttctcagtgtgtacttcatatcctagattagtggttctcagagcatgctttggggatccccaaaggttcctgagaccttttcaggggtctgtgaggtcaaaactaattttatagtaatacttaagacattatatgtttttccctctcccatgaccgtgttttccagaatctgcattacctgtactgttgcaggaaattgaagcaaaagtgggttttgagaatccagttgctttctattaagccagatgttaaagagatgtataaaagtgtaaaatggtgccacttttctcactcatttttttgaggaaaatgtggtttaaagtagtttaaaaaatatttacaattgtattgaaatgaattaataaatattaaaaattttcccatttttaattttaatgtggtaaatattgg

SEQ ID NO: 75902 - DNA, 1068 bp, Homo sapiens
ctctgtgccctttctgcacgggctatttattctcttggctgggagagcccttcttcctcttgtgattctggccaaccccttctttttgctctctcaagagttggctcagatatcactacttctttgagggagaactaggtatctcctcctcattcccactgacagccttaatctcctatagtacttaccacactgatgtcataattaggcaaatatctatcttctttatgtctgcgagtgcattctgtttaaaactgtgaccccccctccccatgttcctttccttgctctgcttattttttctcttgcacttgtctgttttcaacatactgtatgattttttaaaaaaaattttatttatatttttaaagtacagatgagatcttgctatgttgcccaggctggtcttgaactcctgggctcaagcaatctgcctgcctcagcttcccaaagtcctaggatgacaggtgtgagccactgggcctggcctatattatgttcttatttctaatgtttattatctgtgcatcctgctagagtgtaaactccagcaggacagaaatctttgtcacttttgttcactgcggtattgtcggtacctagaacagtgtctgagccctagaaaatgctcaaaattatttgttcaaggaatgtgtacttgtatgttgagggcccagctcacagtaggccttgggtaaattaaactgatgatgaacaggttattctgttagattttctaggggctgtctgactatgccttgttttggtacttaaaagtaaatataattaaacactttttaagatttttatgcattcagataaaatgttttgttaacagtctggtttactgtatttattagtttcagatgtcggagtcagccagatgtgtttcatgccttctcatattactcccctttcttgcgtaaaccaaaccccaacaactaaataaataaagatttcaccaaaggtcatgttttcagaataccatctaaatagaggctaaaatcacgcgtgactcatggcaacagtttttttttgttgttgttgttttccaagacggagtcccac

SEQ ID NO: 75903 - DNA, 1052 bp, Homo sapiens
catcatgcagtcaaattaagtgctgtaagagagatgtgaatgaggggcccctgcagctcaaaggatgggagagatcacatcaggttcagggaatcagccaggaaagtcttcatgaaagaagtgtcatttgagagaaccctctaagggtggttggagagaaaggctggagtggaaaggggccttcagagttaacagaccaggggttagacatgggattagctgagccacagactgggacttaaagtttatgcgggatggtggggaaaaaggaggcaggaaagcaggaacaggataggaaaggaaatgggagggtgggaaacagtggagtactgtggaccacatgtgttttgcagctttatattctggtataacccaaatgatggtattggtaaacacttgtgatgggattttgtatctagtgtgtatataatttagtatacatttcaaagtaagaatactggcctatatacataatagatatttatgtatgaatgtgtgtgtaacttataccagaaaagagtgctccttttgggatttgttagggaacctaccatttgtgcaaatgtttctacttgtgagcatcatgaagaaaaattgctccctggtagaaatgtttaaaggatgtgtgtgtgtgtgtgtgtgtgtgtgtgtgtgtgtaatggggaaagaaagatgggtggggtcgggggaggagaaatcaggagaggggaggagagaagtgggaattgggaaaagaggacctagaactttaaaatgggattagggtacattttttagaggaaatgcctttaggggacttcgccatcaaaaacgtttgttgtcggccagtgcagtggctcatgcctataatcccagcactttgggaggccgaggtgggcagatcacctgaaatcaggagtttgggaccagcctggccaacatggtgaaaccctgtctctactaaaaatacaaaaattagctgggcgtagtagcgcatgcctgtaatcccaactacttgggaggtggaggcaggaaaatcacttgaacctgggaggtagaggttacagtgagct

SEQ ID NO: 75904 - DNA, 1004 bp, Homo sapiens
cagggatgctgctaaatattctatagttcacagaagagctgctcacaataaatagttatctgattagcttggcttggtggcaagtgcctgtagtcccagctacacaggaggcagaggcaggaggatcacttgagcccaggagtttggggttaaaaaaaaaaaacaacccaccaaaccaaaaaagagttatctgggcctgactatcaacagtgctttacacaaaggagttagggtgctctatcatacaactatctgatgattcttttgcttaaactgattctaccccatttcttatggctgcgtgccacactcacctttagtagatcagaattccttgcctagagcggctggctgctcttgactttgtgttgctgtttctagctttttcatgttttgctcagtggtagggacaggcaggccaatttagtagagcttgacaaagtgaagcctggtatcttctatgaggctataaacgttgtctaaagacgcaatttctggttctgataaggctcctggtaattcctggactggaagacttggctgtcattgttttgctgttaagtaccccttccactcaaatgcaaaagtaaaacacacacatgccaccatccttcccaaccaaaccaaaacaaaaaaattcaacaaacaaaaacaaaacacttgatgatcaaggagaacctatgataactcttcttattccacatttcaagtttgtacttgatctgtgccatcatacaagaaacccaactggtatgactgtcctgagtgcatttccagtgaagaggctgggagagtccaaaagaatgttttgagtcatcagatccttttaaaatgtcagattctttccatgggattaatttaaacctgttatgaccctttaaaaatttttataagaggcctcagagccataataacatggaatactgcttgtttagtagaagcctttctaaaggccacctttatatttggtttaattttttacattgtcaaccatcatgtaagag

SEQ ID NO: 75905 - DNA, 1055 bp, Homo sapiens
tatctttggagatggaagaggtgtggataatccagagatgatgcttgtagtcaagaaagagtaattgtggccttttgatggggagccaagttttatgaaatcccacggagtcagtcttcagatccagggttcttaattggctagagatcttgcaagttattttgccatgttgttttttgaagggaaaggaaatactgtcatacgtttatgcatctgtatataaaatggttagaaatggtatcatataggtattgcatgtttgtgatcataactgcctgaataaaggttaaaatgtcatgggaaaatgggaaaacttaagcaggaggaaatagagatagtttatttttagcaatttagaatgttccatttaaaagcagttaaactggctagagctgtgggcagggggaggggtactggggtggtttaaaggccatagctattatggtgagtgcctgacattttgatttgaagtgtgtctctgcctgtgtattttagaaccagaaaaattcttggaaaactacctttttttttttttaaactgtgtacccagataaaatagtttgttattccaaatctagaattgagattttaatttttattaatttttatttctgtcagtctttcaggcatttggcttctttgcttattcttttaagatttaagtcggagaagaaaaatcacatccattagttttgattactcagatcaataaattgaaaaggaaaattagaatcatttaaatttgactgcatatgatgagattctgctaaattaaactataaattacatgtttattaagcactttgtaaacacttattaaaacaatgttctaaattgaactatttccctctgtatatgttcttagttattgatgggttatggttcaagaggcgagctggatgaggtttcttaactctttgaggttggtttggcaaatttaattaagccttaagtggctcactcttttttttttttttttgagacagagtcttactctgttgcctgggctggagtgtagtggcgtgatcttggctcattgcaatctccgcctccca

SEQ ID NO: 75906 - DNA, 1117 bp, Homo sapiens
gacttgtcatttaatttgtctctaccttggtctcctgatttgtaaagtgggagataataatagtatgtagatgtagagttgtaagaattaaatgagttaacatgtggaaagcacttggctccaatttgtactctataaattttagctgctgttacgctaggatgtcatagtttttctttttctttttttttttagagatgcggtctcactctgtcacccaggctgattgtgtagtggtgcaatcatagcttgctgccaccttaaaatcccaggctcgagagatcctcctgcctcagcctcctgagtagttgggaccacagatgcaccaccatgcctggcaatttttaaaaattttcttgtagagacggcagtcttgctatattgcctatctatgttgctctattgtctcaaactcttggcctcaagagatcctcttgccgtggcctcccaaagcccgctgtgcccacccagggatctgtcatatttctaattggttcatttatggtcttccatattggtatttactgtttctgtgtcattaccagttaaccatacaagtatgtaacaattattcatatcagttttattattttgtcctaaatcctgagtttagaatttagtcaatgtaaacgatttcctgtcacaaagacttagctggtaaaaagaactgcagcatttggcattgtaagtatgcatcttcatttggcaccttggtgtatttatttgaatgagaggtgatgtacccatctgatttagttaaagtcaaaataaatctagggcgtcggtttctgaaaaccaagttttactttcattaaagtgaatttcaagaaaagttgcttttgaaactaattttttaaaaacacatttatttctcatagactttcaatatcaaaggggagacaatatgttcctataagaaaaattcatagtgcccaaaacatacccatcaccaccccctctatagatgggaaaactgctgaggtttaatttgagtgatgtgcaggatagttaaatgaagcttgagaaatacctgtttacaatagttacacattgtccaaataattttcagcataaataatgagtcaaatccagattaggatgtggcagagggattgtg

SEQ ID NO: 75907 - DNA, 1110 bp, Homo sapiens
agtgcttttggggaaggataatagtagggagtattgaaacagaacatctaaaacaactgtcttccttgcagtgttaacatgtgatataaatgtggtgttttttgcccttactgcttgccttatgttacctcctttgctctggaacagttgttttcagacttcagtgggcataggaatcacctgagaaattggttggagttgttgatttgctatcttttacctgggggatatgcagtccaggtggttcaaatgctttttgagcagactggatattgctttggcagtgtcatagtgcttgtttctaacctctacatagaggcctgttcctgcctgtcactccacaccccacgttcttcaatggcctcagtgcctttgctctattcattcctcctaagatggaaattcgtcttctgtctccttagggctcagctcaagaggaggccttcccaagaagctttgtctagtctagctcactctgatgatgcctttcccaaaatccctctgtacatacagtagttaaaaaaaaaatggctaactttccctgtttggctcttatagtatgtaattttttatttatggtctgtattgctcattggaccattcctgtatattgcactgctttactggttatctttcaaggttcccatgtgcaacttcagaggttgtgcagtgcataatattaatgtgctagtcctctgtctttgtatttttgtttctgagatgaggtttcttgctatgttgcccaggctggtctcaaactcctgggcacaagtgattttcctgccttggcctcgcaaagtgctgggattacaagtgtaagccattgcacccggcctagttattgactattactatatttcatgagctttcagacacctttttctgatagttttctactggtagatttgcttttataaaattttataaaatttcaacatggtaatatttatccttcctatagatggcatttgggtattgtggtgggagtgttttctttttcttttttatttttttgagatggagtcttgctctgtcacccagacttgagtgcagtggcatgatctcagctcactgcaacctctgcttcccaggttcaagcaattctcctgc

SEQ ID NO: 75908 - DNA, 1800 bp, Homo sapiens
agcatgttagccaggatggtctccatctcctgaccttgtgatccacccgccgcggcctcccaaagtgctaggattacaggcttgagccactgcgcccggccaatctttttgttattaaggtgaagaattctttttatattctgggtataagtcccttatcaaatatatgatttgcaaatattttctcccatttagtgggttgccttttcttgatggtgccctttgaagcatgcaaatatttacatgctcagaaaatatttgtcaaagaatgaatgaaagaaacactaccttttattgaaagccttgcctgactttacacaacgttgtgattttgtctcttggatacctagggtgtatatattttttcatattgattataatactccccacattgctttgtaatttatttgtagtattttctccctcacccagtgataccttgggaggcaggtgctgtgtctactatgttcctaactgagtttctggtgtgggtaatagggtagtatgtgacggtcactgaatgttgcctgaatgaatgcatggatttctctgtggaactctgtcaagtgagaggggatgcagctggtccagattgttggtcttcaatttttatgaaccagcttagattcagattgtagagtgtgtgcagaaggctgtgattctccagcttgcagtccatactttatcaaggactgcttggaggcagacgagcttgaagaactcagcctccttgcatgggcttcttagtgtggagaaggggtggggagagcagagtgaatggcgaagtgttcagtgtgtgagcaggttgtcattattaatgtatcgtaatgaccatggtgtttatgggatttcttcaattttaaagtggtcattaccaaggttaattatcttcttaaccttagaggtgtaaagctgcttttggcatctttggaaacttcttttggagctaccagattagatggtcttagtatttatttatttatttgacagagtctcactctttcctccaggctggagtgcagtggcatgatcttgggtcattgcagcctcggctgctggggttcaagcaaacatgtccggctaatttttgtatttttagtagaggcagggtttcaccatgttggccaggctggtctggaactcctgacctcaaatgatccgcctgtctcggcctcccaaagtactgggattacagacatgagccaccacgcccggccggtcttagtaatactttaagatttctttcagctctaagatttcataactcaaaactttgtcttcccaatgaaatctttcttgattactttagtccttaatgatccccatcttcttaacctaagtcatgcaagacatatttatgtgaacagcatggtatcattcattcattcagcaaacattgcattaggaacttggctagatgctggagtgacaaagatgaccaagacagcattttttttttaacagtgtttactgaacacatattttatgctatgccctgggggtaaagggtgactaagacgtgtaaggcacttgcattctacaggccattgcttttcatgggtataggttttctctccccagttagactgtaagccttgttttttgtatctcattcccccaaacatctaatacgatgagtaaatagtttctcaagcagtacttgattgacttctttttcctctttttttgaggtggagtctcactctgtcgccgaggctggagtacagtggtgagatctcagctcactgcaacctccgcctcctaggttcaagccattttcctgcctcagcctcccaagta

SEQ ID NO: 75909 - DNA, 1050 bp, Homo sapiens
ctttacttctttaaggtctctgtttatatgtcaccttctcagagaggctgtcaatgatacactacataaaataacattcttgcttaccagtctctggcttgctgtattttattccttagcacttatcaccacttgacagttgtttattttctatccccttcagttagactgcatgctccatgagggcagtgaccttgagtattttgtttgctgtttatccccagtgcctagaacagtgcctggtgcagggtgtatgccacctaagcctcagcagaatcactgtccagtgacattcatcacctggtcttagtggtggctcttccctagaagtgaggtgaggtctgtgtcccattgttgttgggctggaggcagctggttttctcctattcgttgatgctcagctggaccggtgttgtgatatttaaggaaagtttcatcctatccctttttgccaacagaattttaatttgatgactttatggtcatttttctttataaatacccatcttcatggatttaaatatataatcattgtatgcttatggtttacataaatatgagtattcatatgtttgtttttttgaagagggtggcacatggagcaaacactttttacttaggcatggatgctcaggtagtggtgttgatgccttctttgtgtactcttgaaattcctgcaagctcccaaaccttattatactcagatctacgtaccaaattgcttaggtcccagtgggccagacttctgctgagcgttagctaactcagggatagagttgctgtccttcaagtataatttgtctctcagatggctttcccatagctgattctcaggctttgaatatgggttctgttagtccacaggcattgactccatttgcaggtgtgtgtttgtaacatatagtcaaacctctaacatttggaataatgagatgagatgagaatgagtaggaggaggggcagtctggtttagtgaaatatctgatgcacagaatatttaaaattaggcctggcacagcgactcacgaggcctgtaatcccagcactttg

SEQ ID NO: 75910 - DNA, 2054 bp, Homo sapiens
agagaaatggcctagaaggagatacgaggaaacttaacactggtcatctttggggaataggagtggaagttttcactttctatcttaacattaaaaaaattaattaaaaacagaagggtagttatgtgtctcaaatctgcctttccaattaatagaaagtaacaactactgagaagaaaaatgatatctataaacattggtgatcatcacattaagcctttgtatgatcacttacagagtctaccagagactttcaatacagcataaatgcttttactcttaagtattatttgtggtatgtatgtttgtccttctatccttccatccacccatcatctatctctacccatctatctgtatctgctaaggaagagaagtgcagcttggtttcttttctataaggaaagagcgtaactgttcctctatctagatgatcttgaaagagcatattatttttgatgtttggcaagagggtaaagtacttagtaattttcaaaaatggtgtgtgggacattgaaaagatacattgtattggtgtgaaatcttttattttcagtgttctgagattcttttttttttttttttttttttttttaccgcagagtctcgctctgtcgtccaggctggagtgcagtggcacaatctcagctcactgcaacctctgccttccaggttcaggtgattcttctgcctcagcctcctgactagctgggattacaggggtgcaccaccacgcccggctaattttttgtatcttagtagagatggggtttcaccatgttggccaggctggtctcaaactcctaacctcatgtgatccactcacctcggcctcccaaagtgctgggattacagacgtgagccatcacacccagctgagattcttatcttggtaattttttgcacagagaactcagctctctatcatactacattttaatgagctacacggtgatttatgacttgtgctctttccttttctaatcagctcatcaacaccatacccattctatgtcagtttactttagaattgaaattttgccttttatataatgctgttaggtggcttgcattcgatttgggggataaatagattttgaatcagcttttgctgctcaacaaaccactccaaaacttggtggcttaaaacaacaggcatttatttagttcaccattttgtggtttggcaatttaagctgggctcagctatgtgatggttctcttctcctctgagctcactcatgaacatcccgtcagatggatagtctcactcacatacatgacggttggcaagggctacagggatgcctgggctttgtgagtctcatcatccagcaggttagcctgggcttctccacatggtggcttgtggggttctctaaagcctggggttctccacttggtggcttctggggttctctaaagcagtaagagagggcaaatgcaaatgcttaacaacttttgaaatctctgcatcatgtttgctattgtcccattggccaaagtgagttacaagtccagctaaaattccaaggatggagaaagactacctctttgtgggaggagctataaaattatactgcagtggcatgaacacaaggagggaaagaatttgtggccatttctgcaatctgccataaatgtacttgggacttctcaccttggttcaatggatactgtctttattttgaaatatgtctagaatccaaccacttctcactatcttctctgcctcctttgctacttcctagtccaaaccactatcatcttttgcctcccaacaggttccctgctgcttccaccttttcacgtgtgttctacacagcagccagagcaagcttttaaaaacagaagtcggattatgtcactcctctgttcaaaaccttccactggcttctcatttcattcagaataaaatttagattactttctgaggttacaaaactttacatgatgtggctctttctttgacctcatcttaactcactgcttttagccacactccctccttgctgtttctcaaacacactaacaggccgtagggctttgcattt

SEQ ID NO: 75911 - DNA, 1610 bp, Homo sapiens
aataaaattaataaaataaaatctatctgtaggctcagctatatgttctatggatgccactgtgttattaaagtacacaatcttaagtttttatgtgttttaattccctattttatgaactactgcttggaatagtggggaacataatgcaatagaattaattcattaagagaataaaagtttagaagattagatctagaattattgtcagtaccaactgaagttcattaaatgagaatgcaagcaacagtaaaaccgcagttaggtgaagcaattaacatcggtggtgttatggttactgtgaagactggaaaaataaataattgaaagtatttcaaatttgacaaatggaatgaagttaaaaattgaatccacctccttgtcactttctaattttaaattttcctgagctattataatttaaattattgagaattatctgcactgcattttgtgggtggtgaaaattgagtggagtgagtgcttttcagtaccagtgcttgaagcgaaactggatttgtgatggtttacgtaaggaagaaagcatcatccatgattatgtcagactctgacctgacagggtctaacaaaataaataaaggactgtggagtttggggtttttgatagtgcttaaatgaccactcttgtacctaaatagttaataaatttcaaagtgtttttagtcatttcatggctagtcaagacagtgtgcattcctgtgggcccaaatctatatttaatatcaaaatattcttggtgaaattatgtttcttcacagttttacttaatggaatattctttttcatttgtgtgttaatgtagggcactacacctacattacttgactaggaggatatcctatttttattttttattttttttaagcaaggctggtaataattatgtactgtcataacataatttcaccacctcagggtgtcatagttaacaattgatactcatttgtgcccacagatgcaaggatagttgaccagttctctgcctcttaaataatacatattttttgagtcataagacttgggtttcaagtggatcctataaagttgatctctttgtatgctacgtttagggaagtgagtgtttgtttttaaaaatctatttagttcatccatagactaaattgtttaagcaaaacaatatatcactatatattatatattaggtttgctattgagctctaaaaagcattcagaaagaatttttgagtgaagtaatatttggaagctgtcaaagttagtacattactgaaccgaaggattagcctagccaaatatgagctgctttgctctatgacagatgtgaaagcattgtgttcacctgtcttcccagctggtgtgtgttgagatggggaggttggagattggggaattggatgtgtgtgatgatcttggtatcttgcctgtgaaacatcgggattggtggtggttgccaaatgtaggaaatacgttgatgatacgtggacagataggaaatcgctattaacctaacacctttcattcagtgggagcatctaaaagtcttctaaacaagatccaaagaagttgctaggagttttgtgaaagtatctttgcagcaggtggcttagaat

SEQ ID NO: 75912 - DNA, 1050 bp, Homo sapiens
agtgcagtggcgtgatctcagctcactgcaacctctgcctcctgggttcaagcgattctcctgcctcagcctcctgagtgggattaccggcatgtgccaccatgcctggctaatttttgtatttttagtagagacgggatttctccatgttggtcaggctggtcttgaactcctgaccttgtggtctgcccgcctccgcctcccaaagtgctgggattacaggcatgagccactgcgcccggccaactaactggtgtttttaatagtaacccgtcttctagaaataatgctcatttcactttaagaaagtttaaagatattttaatcaaaaacagtttagatgaagttctaaaacttatgttgaatagagctatattgtattatatttagatttatgtcttaacattttaaaaggcagttcaagtaactgggatttattttaactgtactggtttagtgagatgttctagaaatggtatatgctttagatactcttgggcttaggagtggtagactgtattcatactcttgaattatggcaagatttgaataaaatacattatatgcatgtgtttttctttttcttttttttgagacagagtctcactctgttgcccaggctggagtgcagtggcgcgatcttggctcactgcaagctctacctccctggttcacgccattctcctgtctcagcctcccaagcagctggaaccacaggcacctgctaccatgcccggctaattgtttttttttttttttttttttttttttgtatttttagtagagatgaggtttcaccatgttagccaggatggtctcaatctgctgacctcgtgatccacccgcctcggcctcccaaagtgctgggattacagatgtgagccactgcacctggccacgcatgtgtttttctaaatgtatatgaagcaaacagctatgaaaggagtccgcctaggacctggctaactcagtctcctccaagggccttaaattctcatttttatgattgttacagtgggctatgcagttcagtccatttattcattcatt

SEQ ID NO: 75913 - DNA, 1007 bp, Homo sapiens
ccacctcccgggttcaagcaattcttctgcctcagcctcctgagtagctgagattacaggcacccaccaccacgcccagctaagtttttgtatttttagtatagatggggttttgccatgttggccaggctggtcttgaactcctgaccgtgtgattcgcccgccttggcctctcaaagtgctgggattacaggcattgagccaccacacctggccaggagctgacttctaagccttggttttcttctctctaaaactgggagagtaatagaagccatatcatagagtcagattaaattccagaaggcaggtaaaacatttagcctagtgctagatacactgtatgagttgaagaatattaactactataattataggaaaaagtacacaatggcaaatgtttactaacgtcttttagttgatttttgttcctttaacacgttacatggattctttgcatttaaggaagaaaaatatggagtatatacagctgtgagaattatacttttaaagcaaaaaggagaaactagttcttatggaacaatctcagcattactgtttagttaatgtcagtttgagacagatttcttgtttctggaatcagaatttaaagtggctaatgtaattattttcaagggaaattccatttatggagcattaccaggtaaaattattattagataaactttctttttttttgagacggagtttccctcttgttgtccaggctggagagcaacggcttgatcttgactcactgcaacccccacctcctgggttcaagtgattctcctgcctcagcctcccgagtagctgggattacaggcatgtgccaccacaactgactaattttgtatttttagtagaaatggggtttcactgtgttggtcaggctggtcttgagctgccaacctcaggtgatccgcccgccttggcctcccagagtgctgggattacaggcgtgagccactgtgcccggcctaggtaaacttaatttggaagttgtt

SEQ ID NO: 75914 - DNA, 1025 bp, Homo sapiens
taagaactaattgcttaatcctggccaggtgttgtgacttatgcctgtaatcctagcactttgggaggccaaggcgggcagatcacctgaggtcagaagtttgagaccagcctggccaacattgtgaaacctcgtctctattaaaaatacaaaaattagccaggcatggtggcacgcgcctgtagtcccagctactcgggaggctgaggcaggagaatcgcttgaatccgggaggcagaggttgcagtgagctgagatcacaccattgcacttgagcctgggcaacaagagcaaaactccgtctcaaaaaaaaaaaaaaaaaaaaaaacggaaaaatttcttaacttagggttcgtggatttctggttgggacagtgtatatctggatgggcttcagggtttctagaccctcctaaaattatatgtaaagtttctgtgtatgtgcattcttttttggaggagagaattgattgctttcatcagattctcaaagattcatcccttccattcacgttctctctctatagttaagagtttttggcttagactaaatgggaattgtgttgttactattttctgagtatcgtgttagctgctctgtgtgcacatatgcatctacccttaccataaaacactgtaagccataaacagcattcatcataatgtgcgtccgtccaggatgtaacctggatatttatatgcaatatttatatgcaagacagggcatataaatattgaagtgccaaatgaatgttctcataagatgaagtggtccttttctacctagaattttcttccccaacttcttatcattcaagttttagctccagtgggacctccttggggacttccttgatgactttagaaaacagtctttcggctgggcacagtggctcacgcctgtaatcccagcactttgggaggctgaggttggtggatcatgaggtcaggagatcgagaccatcctggctaacacggtgaaaacccgtgtctactaaaaatacaagaaaaaaacaacaaaaaaa

SEQ ID NO: 75915 - DNA, 1064 bp, Homo sapiens
tagtaaaaaggtggaaattggaaatttctctgaaaattatgaagagcataattttgcagccacaaacgtttttcaaccaaaaatttcaaagaagcagtttttaaatatggtgaatttaatataatagctattctaaacatcttcacctggagagttgcatctactgcattagtatcttgccatgttatttagtgtaatgctttttatttttaatttattcattttttgaatagataatacagccatatggttcaaattccaaaggttacaaaaggaagtgtagtgaaaaatcttccttccatcccttctcctagtttcccttcccagaagcaaccagtcattatactcttgtatagtaggtatagagattcttaaatccttggttggatttaaaatgcaatgagcagcctaaaattatgtgaacattttgtatgtgtgtatctattttaaaaatggggaatcaatagggatttttcagattctcaaagggatatctgacttaaaacgggttaagatctattgatctagtttgtacctttgactaatgatgtgtgttcttcaggcatctaagatttgtgtgtgtgtgtgtgttttgagatggaggttcgctcttgttgcccaggctggagtgcagtggccccatctcggctcagtgcaacctctgcctcccaggttcaagcaattctcctgcctcagcctcccaagtagctgggattacaggtgtgcgccaccacacccagttaattttgtatttttaatagagatggggtttcaccatgttggtcaggctggtcttgaactcttgacctcaagtgaccctcccactttggcctcccaaagtgctgggattacaggcatgagccaccgcacccggccgtgtgtgtgtgtgtttaaaaaataaccataagctttactttcgaactgaaagaacatctatatgttaatagatgttaaagttcagttttagaacctttgaaaaagtgtggtaataatttttttggggggaagcaattttaagatcttgcacaaaagcaagtgccaaactatgttatttttttttttct

SEQ ID NO: 75916 - DNA, 1004 bp, Homo sapiens
tctccatgttggccaggctggtctcgaactcctgaccacaggtgcgtccgcctgcctaggcctcccaaagtgctgggattcttggcatgagccaccgcgcccggccgccattgttatttcttgtctcacaattcattatacatttccgaggcattttgcagatagtttgtacattcacttttagatattcttacaactatgatgactagacggagtttagctcttgttgcccaggctggagtgtaatggtgcgatctcggctcaccacagcctctgccttccgggttcaagccattttcctgcctcagcctcccaagtagctgggattacaggcatgcgcctccatgcccggctaattttgtatttttagtagagatggggtttctccatgttggtcaggctggtcatgaactcctgacctcaggtgatctgcctgcctcggcttcccaaagtgctgggattacaggcgtgagccaccgtgcccggccgttttcgtgcctttttaatgattgcctttttcgtctatatctgctttgtgtatagtaaagtaggcacatgcaatataataccagatttttataacgagtgaatgtgctaaaacctattagaataagaatagtctcttaagaggccaggtacagtaaataactcacacctttaatcccagcactttggcaggtcgaggtgggaggattacttgagcccaggagttcaaggccagcctgtgcaacatagcaggcctgtctctaaaaaaaaatacaataaaaaattagctgggtgtggtggtacacacctgtagtcctaggtacttggaaggctgagggaggatagttcgagcccaggagatcgacgctgcagtgagctgtgattgtgccactgcacttgagcctgggcaacagagtgaaatgctgtctcaaaaaagaatagtcttttaaggaataatgtcatctattttagtggttactacactccatgtcgtgatacattgtcgcatgggttttgtt

SEQ ID NO: 75917 - DNA, 1040 bp, Homo sapiens
taaaaaattatggtaaaatatacataacatgaaatttaccatcttaaccatgtttaaatgtgcattaagtgccttgacattgtcatgcaactgtccctaccatccatctccagaaccttttcatcttccccaactgaagctctgtacctgttaaacactgactccctgtttcccccaccagcccttggcaaccgccattctgttttttgtttctatgaatttgactactctaggtacctcctataagtgatgccatgcaatatttgtctttttgtgactggcttatttcacttagtcaagtgtcttcagtgttcatctctgttgtagcaggtgtcagaatttcattcttttttaaggctgaataatttcagtgtatatacataccatatactttttaatccattaattcattggtggacacttgggttgcttccaccttcaggctattgtgaataatgctgctgtgaccatgatgtacagatacctgtttaagttctggctttcatttcttttgggtatgtacccagacgtgtaattgctggatcatatgttgaatttttcaggaattgccatacatattgccacagcaactggaccatttttcattcccattagcaatgcatgagggttccagttttctatatcctcaccatcactcattttctgctttttaattttttgatagtagtcattataataggtatgaagtggtatttcagtgtgatttttatttgcattgccctaatgattagtgatgttgagcatcttttcctgtgctttttggccatttctgtatcctttttctcacttttaaaagtgaagtctgctagtgttgccagttttccaagaactctgctttccaagaatgtgattttttgaacttgtatattttgccagtatgagagaattggagagtaacaggactatatactcacaaacctaattccagagtgactaacagtgattgttatgtagtaagcacattctgggtaaatactctggaaagtattctataaattagaaatccatctctgtctgta

SEQ ID NO: 75918 - DNA, 1274 bp, Homo sapiens
gaaaccctgtctcttctaaaaatacaaaaattaggcgcggtggtggcacctgtaatcccagctactcgggaagccgaggcaggagaattgcttgaaccgggaggcagaggttgaagtgagcccagatcgtgccattgcattctagcctgggtgacagagcaagactctgtctcgggggaaaaaaaaaaaagaaagtgcaggttggggctcactgtggcctctatttcctaggctcaagtgatcctccctttcccgagtagccgggatcaacttcccgagtagctgggactacagaagcatgccatcacgcccagctaatttttccatttttttgtagagatggagttttgccatgttgcacaggctggtctcgaattgccatggtgttcccatgccaggatttaggcgtgagccaccatgcccggcccaacacgtttttaatatgaagaattttttctaaattaggcatttcaacttttgtttgggtatgtggttactttttgtcccttttaattttcatcatgtttgcttcatgtttatgaacaggtgttgtttgaaaaatatcagaacatagcttttatagtgtggaaactatcagaatttacctttgaggtggatgtttatgtgctgaatactgaagaatgggagaaaggggatatgaacaacacaatgagctttagtgtggcttggaggaaaccaggcaacctggtttgctagttcattattgcagacttatttctgtaacagtttgtgaaatcagaaggtattataagaaaaactggaatgtaaccggaaaagatcctcaaaatttagcttaggatatttcaagcttctattttttccatatgaatactttttttaaaaaagagagagagattcataaataagattccaatgtttatacaaaatttttggaaactgaatactgattactgtaaagatgatatatctaccagtcagtaaagatgagctcctgtgagctttgggggagaaaattttgactagagattttgctggtaaaaatgaaaatagtcattatgaggctttggaaagaaaatgtaggaaacactgtagattgaactatgcttgaaatacaaagttgggagacactggtttttagtaatctatttaatctgaagtagatatgtaatgggtgttaacttctgtatctgtaaaggacttcattctgaggaagccagttaaatttttttttttagaattagaaggaatttaaaaacttacactaatttcttggatcttatggtaaacaatta

SEQ ID NO: 75919 - DNA, 1035 bp, Homo sapiens
tgaagagacggcgggggggtctccccatgttgctcaggctggtctctaatgcctggcctcaagcagtcctcctacctcagcctcccaaagtgctgagattacaggtgtgagccaccactcctggtagtgaattcagtattaaagagtgattgaattagaaggcaactgagttttagttacatcataggaaggaaatgattatagtattagaatacatttctgttgattgattgattcatgccagccctcagaggaaaatgttcttgatttaattgcaattttagagaaacttcaagttaaatttttttatgtgtctcccttgttaagcattaatttttatttttattattattattttttacagagttttactacccttggatgctgctgttgacatggaaaagattgaggaacaatttgctaatctgcacattgttaaatgttccttaggaaccaaagagcccacttaccttcttggtatagacacatcaaagactgtccaagcaggaaaggaaaacttggttgctgttttatgttctaatggatcaatcagaatatatgataaagaaaggttaaatgtactacgagaatttagtggatatcctggacttcttaatggagtcagatttgcaaattcctgtgacagtgtatattcagcatgtactgatggcactgtgaaatgctgggatgctcgagtagccagagaaaaacctgttcagctcttcaagggttacccttccaatatttttatcagttttgatattaattgtaatgatcatattatttgtgctggtacagaaaaagttgatgatgatgcattgttggtgttttgggatgcaaggatgaattctcagaatttatctacaactaaagactcacttggtgcatattcagagacacatagtgatgatgtcactcaagtacgtttccatcccagcaatcccaacatggtagtctcaggttcatctgatggcctggtaaatgtatttgatattaatattgataatgaggaggatgcactggttacaacctgta

SEQ ID NO: 75920 - DNA, 2004 bp, Homo sapiens
gtcccagctactcgggaggctgaggcaggagaatcgcttgaacccgggaggcagaggttgcagtgagccaagatcgtgctactgtactccagcctgggcgacagagtgagacaacgtctcaaaaaagagaaaaaaaaaagtcaataaaacacacctagaagtgaattaatcgattgttaccaaggtaaaatgatctagaggaaagacatcgcagtaggcaccagttactgacctttgactggacaagtcagcatcagctttttcacctgtataattgaaataaataccaaacttgactacttagagttctgaggattaaataatttaatagatacaaaatatgttaccgatgaaagccacgtgactgtttctgcttttcaaattctttcttgtggagcctggactgcactgcaacctatggccgagtaaaacagtggtaacttgcagtcaagtaccatttaagtgagaaatcctctgaaacgtctatggactgcttatctccttgttcagtattcaggaatactttcctgtgaatgcagctatgttacttacctggtttgtattcttaccttagattgttgtagctattgtaaagcaaaagtaagatcaagcccatgtaactactttttgggttcttttctctcactttgtaaatacagggtgtttttccagacgggagtgcggtggcacagtcttagctcactgcagcctcgaacttctgagctcaagtgatcctcctgcctcagcctcccaagtggcagggattacacacgagccactgtgccaaacccgtgaagtttttgagttgtacttttgtactaaagtcatgactactttttctgcaactgacactatgagctgcaaatacgactgaagatgctactgcttttttactttttccctatgtgctttaaagaactacattttcagtgatttccatgtgtttaagatattttcatttacttggtagaaaatacaagagaattttgataaatctgaactggaatggtctttatgttaattctgttcaatattttagggcagattatgtacagattatcgccaaactgtcaaaagggtgtattttgttcatatagctactgtaacaaattacaacagatttagtgacttcgaataacacacatttattctttctgcctttgtttctttcttttttttttttcctttggtgaaaagtacacacttaagaaaggggagtgcagatgtactcaagagagtcacctcttccttttttttttttttttttttggtagagatgaggtctcgctatgttgcccaggtgggtctcaaactcctgggctcaagcagtcctcccaccttggcctcccaaagttctggcattactggcatgagccaccatgctcagcctcatttattgtcttttagttctggaggtcagaagtatgaaatcagtttcactggactaaagtcaaagtgttgcaggcccaattccttctggaggctgtgagaagaaaatccatttccttacctttttcagcttgtagtggctgcctgtcttccttggcttgtggctcttttctgcacaggacatcatgctatcatcataccactttctcatctgtagtcacatctccctctgcctctcttatgaggacatttgtgattatattaaggacccccccagataaacaaggatactctctccatctcaacatactttgtaaagtcccttttgtcatataatgaaacagtcatagattccaggaattaagacctttgtatctttgagggccagtgttcagcctaccacaggaaggtataaagaagagtaaaacatcctatcccataaagtctcacagggactataagagaaaaacaaattcacagtaaatggttgctgagttagactttcttattactgtgaaaataacctaagtcaccacaggttggagcttcgccaatttttccactggaatatctttaatagcaaaggtaaatgaatattcctgtgatatttggaaa

SEQ ID NO: 75921 - DNA, 1447 bp, Homo sapiens
gctaccttgcccagccacattcttgtcattttttaaagcaatgtatcctcaacccctaaaataggggttggcactcataaatatttgttcaatgaatgaatgaatgagaaaagaaaattacctaggatgtatatcctgtgtggtcatggagataattacatacataaacatatgaaaatgaaaaccatttctttgaataataagtgtacttttccccagaaatcaaaactacacaattttagcataatttgttgttcagaatttgaatgtaaatttgtggatattatatatgtagttaatttataaaagggtagaattatgaaaatataaatccttttattattaatacagcttttagtgcctcttatatggtcagttaataaagtttactttgagaatttgacaactttaaaaaatttatgtatattcaacatttgaaatgtcaaatataaattattttttaaatgccaaaaatattcagtattatactaaacaacgatacttttatcttttcctaggatattattgctggattcctatataccattttaatcttagctgtcttctatccatttgtggacctgattgacaacttcaaccaaactcacaaatatgctccattcatcatcatcgggcttcatttagctttggggatcttttctttcactcttgacacctggagcacatcccgaggagacacagccgagatactaggaagtggtgctggaattgcatgtggatctcatgttacttataacatgggtctagtattagatccttctctagatacattacctttagctgggccccccattactgtgactctgtttggaaaagccatattgcggatcctcatagggatggtatttgtactaataatcagagatgtaatgaaaaagatcaccattcctttagcctgcaaaatcttcaatataccgtgtgatgatattcgaaaagcaagacagcacatggaagttgaacttccttatcggtatattacctatggaatggttggtttctccatcacattttttgttccttacatatttttctttattggtatctcttgatggagaagtattgtttatgataagaaaggagggtatcagttactgatacccaaaaatatattccaggtaaagccaggtcagaattaggcttttgcaggaatttaacttaaataattatttaagtaaattcataagagtcagtgcattttatcattgcacatccagatactgttttaggtgagctgagctatttcgttactgagaaaatgataagtatccatttagaatgttcatgtaatgtttggagagttttgtattatggattcaacttatatataatatatataaggtacataatatgcaattatatatctgatatatattatatataaaataatatacctaagtgtttttttaaactatgggagtgtattata

SEQ ID NO: 75922 - DNA, 1173 bp, Homo sapiens
ggccaggagcgcggggacagttcggggctgcgccggaggccggcccgccttcccgggggttccgttatcatgtcgctgaggcagcgcctggcccagctggttggccgtctgcaggacccgcagaaagtggcccgtttccagcggctgtgcggggtggaagcgccgccgcgccgctcagcagaccggagggaggatgagaaagcggaggcgcctctcgccggagaccctcgactgcgagggcggcagccaggggcgcctggaggcccccagcctcccgggagcgaccgcaatcagtgcccggccaagccggacggcggcggcgcccccaacggcgtgcggaacgggctggcggccgagctgggcccggcctcgccgcggcgcgcgggcgctctgcgccgcaactcgctgacgggcgaggagggccagctggcccgcgtgagcaactggccgctctactgcctgttctgcttcggcacggagctgggcaacgaactcttctacatcctgttcttccccttctggatctggaacctggaccctctggtgggccggaggctcgtggtcatctgggtgctggtcatgtacctgggccagtgcaccaaggacatcatccgctggccgaggcccgcctcgccgcccgtggtcaagttggaggtcttctacaactctgagtacagcatgccctccacccatgccatgtccggcaccgccatccccatttctatggtcctcctcacctatggccgctggcaggtagggttccttctcgtcctgttcagcctgggggagttcaaagaactcggagttctctttgctctctgcatttattttaattcgaccgttcccctccaaagcctctctttccacaggttttcacaatactcgcaaacaggccctttctgggttttgaaaaattaagtgattgggggaaactggatacttagccgttgaattctattttaatattaaattccaatttaatgccttagaacccaaaggacacacttttcctagagtaatacattgtcattgggctttggttgagttttttaaacggctttaattcttgtaatgcacagtggaagtgaattttttaaataatcgctatgtaaactaagacccagtttcaccgtaatatatggtgccttcttccctaaaactgtttcagaaaga

SEQ ID NO: 75923 - DNA, 1335 bp, Homo sapiens
atataaaatataacttactttaaatgctgttaggtcacctttcaaatcaccaacatacctagggttataatttaaagaccttgtgcatctcatttgttgctaaaccagttctgttagttaatttattacacaagtttgccagttaactgcaacagtgggcaaaaagcttctttttcttttttttctttttttagacagtcttactctgtagtccatgctagagtgcagtggcatgattatagcttactgcagcctcaaactcctgggctcgagcgatcttcccaccttagtctcccaacacaggttcatgccaccacgtctagctaattaaagcaattttttttcaagagttggggtcttgctatattgtccaggtgggttttgaactcccagatttaagtgatcctcctgccacaacctcccaaagggctgggattataggcatgaaccaccttggctggctggctggctggctggcttgctttctttctctctctttctttcattctttcattctttttattctttttattctttttttgagacagagtctcgctctgtcatccaggctggagtgcagtggtgtgacctcggcttactgcaaccttcacctcctgggttcaagcgattctcctgcctcagcctcctcagtagctgggactacaggtatgtgccaccacacctggctaatttttgtatttttagtagagacaaggtttagccttgttggccgggctggtgtcgaattcctgacctcaggtgatccagctgcctcggcctcccaaagtgctgggattacaggcgtgagccaccacacctggccctttctctctctctctctttttttttttttttttaagaggaggaagggcacagaagaactgagaatagaaattaacataggccaattttagtttggtaactatattaatctgttaactacttcatatgttgaatgctcatataaatgtgctgtgctaagtttctgtacagaatcatggggtaaatgagtagactggatatatcttgtccattaagagttctctcatggtactgtttaaggacatgggctttggagcccaacagacttgtgttcaagccagtcttgccagtaacttgctgtatggtttggacaagttatttaacctctctgtttccttaaatgaggtagatggtttctgtgttataggcttataacataggatcaaagagatggtgcatgtaaagtgtctggcaccaattgagtactaaataaatattaacaattttttctttttttgttggagagagggtctcgctctattgccaaggctgaagtgtagtggcacaatctcc

SEQ ID NO: 75924 - DNA, 1064 bp, Homo sapiens
gtcttctcggtaggtatccttacttcgtagggttcagtagtgaaacgtgagtctctgtagttaggttattactccatttaaatttatttattatatactgagtatccatctgaagggaggctttcagtttttgtattatttttagaagcattaaaaattatccaagcttagtgggttaggttacaaacatcgtaatggagatgcaatgtttaattttattcatttactctgtaaatggtgaaccccaatcatgcacagtggtctaggtgttaggagtacaaagaaataaattgggcaccttcaagaagcatgtagtctagatgtgcttttgcttgttgatgtcatgtggaagtgaaaaaatagcctgggccgcaaatataatcattcttaggagatgagttgaagtctttaactttaaagggttatgtttctaattgtggtatccattgtacaaattcaaccaaaatatgaccaaaaatgttgtctggaatatctttttatgtttcatttttatggaggtgaagaataaaaaacgtactgtatatagcattatttgcaatgtgagttataaattcctctcactgtaaaaatgaaacagtttggtcagaacttcactggagattgttgtcttcttactgttcttactcttgaatttcttctcatctttggatatcacttcctgcaataatctttcggagttcctcgaagtatgttgtaggtacatatgatattcctgagttgttattgccaatcaagtttctgaatattttaggttttcaataaacaattttattatgagtgagtggccattttctatattaaaaaaagttctatgaagtaccccaaattagaagaacttttgaatgttcatgaaaattgtcagataggatggaaacatgatttctttaggcttcaggcagtgaagtgtgtctatgatgtttaggggctcaatagtgctttcgtattctgtttatgagagaagactctgttctaccttataactgtgagtgaatgaagccatgtgaagtcttaggaagaggaacactattaataaaagcttctcg

SEQ ID NO: 75925 - DNA, 1107 bp, Homo sapiens
ttggaaatagctcaaaatggccgaggtttccaggtgggcatggattgggaagactccgtgggcacacagtggtcttattcactcagtttcacgctgcatttcacctcctctgaggttgttgagttgtgctcctccttcctgccataactcccctcaagtcagtgcatactctgtctcttggacctgatactattgctgattagtttcttttttacaccttatcatctagatggaaaaatctctcttggtcccttaaaaataaggaagagagtaatctttgtttttgttgttgtttgttttcattttgaatgtctgctctattgctaggaatggatagggccctctctgcttttacatgtgaccccgattagtgtacagtgtgtgcatataacttgatcttggaatcacaaaaacttgttctctggtttttttctattaagatataaaattagcctttgatgctttttttttttgggaagtggcaatacatgtttaaaagttattctcttctcatgctaggggacaaaacaatgaaaacattgctcagagattctaggagatttagtatagttttgaattataggacaaaattgtggtgctctggaattacttcgttgagagaaatttatataagacaggaataactctcaaaagcctgaattatccagttggctaatcagaactcaatttagttcagttagcaattattgagcaccctataaagtgtatatcagtagtctataactaatttaaactggtaatgcataaaaaatggaatggattaaaaaggaaaaaaattccagtgaggcttggtgcatctttaatctctaatcagttgcaatatttactaggcagttggaaacaccacaaaattccatttatgctgctaggccttttaattcttcaaccagagctcttgtctacttcaaaatttttctagaacttaaattagatgtcatacttttgcacatattgcaggccaaataccaacaatttcaattcactatgactattagatagagattaataaggtagagaaaagtccaaggaaaacaatgtagtagaaggtagaacagacaaccttaagagaaaggactgtgaactcat

SEQ ID NO: 75926 - DNA, 1024 bp, Homo sapiens
catatagaagaaaaaagttattattgtcaaagaactacatcttatgtcattaaaatatgtttaattagcactcttcaggaaagaaagtggtgtaacttttttatcttttatttttgaagacagggtcttgctttgttgcccaggctggaatgcagtggcatgatcatagctcactgtagccccaaactcctgggtttaggcaattcgcttgcctcagcctcctgagtagctagaactacaggcatgcaccattatgcccagctaactttaaaattttttgtagagatgaggtcccgctttgttgcccagactggtcacaaactcctagcctcaagcaatcctcctgccctggcctcctaaagagctgggattacaggtgtaactttttgaaaaggaaaattattttgttatgtacatgctgacattttctcagtggtacttttgaatgttgtaggctggagagaaacatgaaaaagaaaatgaagaattcacagggcaactaaaagtggctaaagatgttgaaaaactcattggacaagtggaaatctgggaggcagaagccaaatctgttttggatcaagatgatgtggacacctcaatggaagaatctttgaaggtatgtgtgtaaaagtattaagagggtactttcatggttgtgcatttatgttttaagttaaataagaagttttaaagtaagtagtaataagcctacagttttaattttctttgttgggagttttaaaaatgaatggattttatccctggatcatttgctgttattttgcttgaaagcagaggatagattaggagaccactgataatacctatgaatgttaagctcttggacttattttcttagctataacatgggggttaaaatattttcttgcaccagaggacaatgaggagacgagtgagttcagtctcattatagctcagtgcagagtacacgtaagagataatataatcaggctgggcgcggtggctcacacctgcaatcccagcactttgggcggttgaagtg

SEQ ID NO: 75927 - DNA, 1107 bp, Homo sapiens
tgacctcaggtgatcagcccacttcagcctcccaaagtgctaggattacaggcgtgagccactgtgcctggccgcagcttggtttttatggataatgtcttctttttgtggtttcatatttctgacccatttgaaatttatttttgttatgatatataaagattattttccaacagctattttccccagtaacatttattgaattctcctctccactactttgacatagaacaagatcattttaatatttattaccattgtctcaagtttctttctattgtcattgtattactttcattctttattttattgaagtgcttactgtataaagaatgatccataaaacatgttcagaatctgattgtatcaatatgaaatttcaaaatgactccttaaaatatcatttttcagaatgcaaatttgcctgattttggattaataatgaacttttttggtttcctgagattgttttgattaatgtttagcatataatcagaatgtttattgtgatctcacttcaatttgttttaatagcatcttattgccaaaggctctatgtttgatgagcttatggcaagaagtgaagatatgttacaaatggatatacaaaatatttcaagccaggagtcctttcaacatgttctcacaactgggcttcaggcaaagattcaagaagctaaagagaaagtccaggtctctctttaatattccctatttagtaattctgttctctaaaactgaggggtcactgagtgggcagtgaaggggggtgatagccctgtagcttggaaatgttttgtaaaatattacttttgcattatgttttatttctttataatttaaagcgtatcagaaaatataagtatcataagtatcatagtatataagtatcaatttggatagatatctaaatttagatagatttataatttagatagatttatcataatttagatagatatctaaatatctttgtctagtgggaaaataacaaagtatttgttaacttaagaatttattaagaattggtccccgtgttaatttgagaatttttttgtcttcaagatcaatgtggtaaaactcattgcagcgttgaagaacttaact

SEQ ID NO: 75928 - DNA, 1029 bp, Homo sapiens
agtaattttaaaatatttctttgtgttattttatttttcttatttttttgtttgttttttgtttatctttgtgttattttatttttaatattttaggacagagtgtcgttctgtcgcccaggctggagtgcagtggcgccatcttggcttgctgcagcctccgcctcccaggatcaagtgattctcctgcctcagcctcctgagtagctgagattatagacacccgccaccatgcccagctaattttttgtagttttagtagagatgaggtttcgccatgttggccaggctggtctcaaactcctgacctcaggcaatccacccgccttggcctcccaaagtgctaggattacaggtgtgagccactgcgcttggcctgtgttattttaaaaattaactattgtgatgttgcatttcattttgcccaggtatgatacatacagagatattcttgaacaccacctgcaaaacaacaaattcaggattacttctgatttctctagtgaagaggacaggagtagttcttgtctgcaggctaaactgacagatctacaggtaattaccaaaaatattatttctctgattatcttgtttattagaaaatagtaccactgtgagtctggacatccccttttctgttgaggtcacatatgctaaatgtttccaaagaactctctttgctggattgcatttctagtgtcaccctagtccataaagtgattttctttcaggtaccaaccccaggaaaggctttggtttagggtcttaatttactgcttatactctaatctggtactccagatattgtggcttgaatagtttttgtttatttctttctttttatgcttcaggcttcaagggaattgatcaaaaacaatgtgtttgaagggaatttcatcctgctcctgggttgctccaaagtcaaccagccagtgactctgaatgtttgtttcagtccttcatcatctttaccaaattatcacattgtctaaaattgctgtacagtgattgctgactgtctgatgttgg

SEQ ID NO: 75929 - DNA, 1045 bp, Homo sapiens
cattgtctaatgtagcaaaggttcatgggatagtctgaaaaaagttttctgtttcctgttctctatgagacatttgtgtggttttctttaatactatagaaccccgctatcatacaggctgttaattagattttttatattacaaattaaattctctctaaattataacaaacatattataaaaacctggttgagtcacaaggtttgtgccatccttttctttggtataaacactttttgcttattttgtatttaaacatgtgtaatgctcttttagactccaggatgaccatagaaacctgaggaagtggttgactaatcaagaagagaaatggaaaggaatggaagaaccaggggagaaaactgagctgttctgccaagctttagctagaaagaggtatagctgatcttgtatgaaatacattacctgagattatggtttcttccatggtgtggttactcctataaactttaagtggtatttggaatttacagggaacagtttgaatctgtggcccaattgaacaactctttgaaggaatatgggtttactgaagaagaagaaataataatggaagcaacatgtttgatggatagataccagacattactgagacaactaagtgaaatcgaggaagaggataagttactacccacagaggaccagagctttaatgatcttgcacatgatgtaattcattggataaaagagattaaagagtcccttatggttttgaattcatccgaaggcaaaatgccacttgaggaaagaatccaaaaaatcaaggtataactatggaaactaaatttcagaagtctgagtgaactctagttttgaaaagatttagaggaaaactgtaaagatgtgcttcttaatggaaaatcagatcactgtggaatggttgaagaaattcagatcactgagcttacaaaaaagaagggttgtgacggatctaaaattacttggatgcacatgaaagacagaaagcatgtcctgtcttagagagagcagtgtgcctattgtccgtcttcaatgagtgcagaa

SEQ ID NO: 75930 - DNA, 1044 bp, Homo sapiens
caatcgcaggcattcagcaggctgaggcaggagaatcaggcagggaggttgcagtgagcccagatggcagcagtacagtccagcttcggctcggcatcagagggagaccgtggaaagagagggagagggagaccgtggggagagggagagggagagggagagggagagcactgtctcctcttttgatgggagagagcgtgaggaatttcagaagctgactggggcacggtggctgcaacataggaggcagatggcagaggagagtgacagagatgaggcctgagaggtaggtgtggctggctgtgccttacgagtcacattaacattttagatgttatactaagaaattggcagcctctgagactgtgttgatctggcttttggttttgtctctaatggtgatgatgtatgcttatgcaagagttgtttttcactgctttatattgtaaagctttagagaaaaaagaaatacatcctttagagctggtatgacactctgccccattgttgccaggttacaagtattggatttaggtttctgcctgtcacaaagttaccatagccatgggccatagcccctgaatgggaaaagggatagtgaaggttactgacttgcctcttgtgactgtgctaacatgttggccaagctggagaccatgctcagtcatttagagctcagtgttttcaatgctgaagtggaatgttcactttgtgagtcaggggatgtaaagatcaaaatgtcgtggtcctgcccttaggaggagttcatgatattcttctcacctcctattcttttccaaacagacccaaatgaaaggaaagatacatgtttgagaaaaagcaacattttaaaaaaagagtagacgttgttggccatgtagcccaaccatgctttgatagaatggtcattttccactttaaatttattattaactttgaacattttatttatgctcagaagctcaatatgtaggctttagtacactctttaaaattatactttgtcttgagtttatgctaagtataatttctgttttaagtagg

SEQ ID NO: 75931 - DNA, 1014 bp, Homo sapiens
tttttaatacaatgttatttgcttaaaaataatagtgtaatattgtcaaactgtaaaatgagaatgctaactcttataagactcagagacatgtatacatatgtaacaaacctgcacattgtgcacatgtaccctaaaacttaaagtataataataataaaaaaagactcagagacatattatctatgtaccacgaaaacttaagaatgacaggaattccaaaagtttgacaattttgtcacagcatttaatctcctattcactagaatgtcttgaatgatgcttatgaaaatctaacacgctataaagaagcagtcaccagggcagtggagagcatcacttccctcgaagccatcattataccctacagagtagatgttggtaatccagaagaatctttagagatgcctcttcgaaaacaagaggaattggaatccacagtagcacacatccaggacctcactgagaaactgggaatgatatccagccccgaagccaaactacaacttcagtatactttacaggaactagtttctaagaactcagcaatgaaggaagctttcaaagcacaggaaactgaggcagaaaggtaggtcctcttccaaaggtaatctttaagaacataaaatattgtttcaagatataattaaactatattttaatagttttaagaacataaaatataggtttttttctctgtcattaacacctatgcattagagataatttggaaaatatggttaagtagaaaaaaattacaatgtaaagaaaactctggtaaatattgtatttcttcttttttttttttcctatttaatattgggtacacacaacagattgtttataaaagtatatgcatggtataagtaataatgataaaactaatatctttgtacccaaaaggacatcgagttctcttgtgtgctcctcctctctcttctcagaaataaccattctcccaaattttgtttaccattttcctgacttttgttgtacttttttttttttttgaga

SEQ ID NO: 75932 - DNA, 1005 bp, Homo sapiens
ggttggctgagttgtgtctgtgatttagcaagagtgaggcagcatcctagtcttagaagaactgtagggcaaggtcctgaacaggaggacaaagtacagtccagtttttaaaatgaagcataaaatgagaaccagaatacttgcaaggctaacccagaactttgctgaggcccataacgttggagtagaactgattaaatcctttccacctatggtcagagttagtcttaaaagtcagaagtgtcatagcctagagcaggtgaataagtagccccagccatggggagcagacatctgcaaggcctgacacacccctgactaacagctattgactcttcatctaggagtcattcagctccagtaaaaggcatctgactaagtttggtcctgcatctctttcccaggccacagttaagatggaggaatatagtgaccttctgaagagcactgaggcttggatagaaaataccagtcatttgctggccaatcctgctgactatgactctttgaggacactgagtcaccatgctagcactgtgcaggtaagtgttcttccaggttttctgccactcatagcatctacataaagattcgtggcttagctgattgtcttggtgcttttttcctcctttcctgaaatacaaccttaccgctaaccatgtcagtggcagaaggaagcttgagagagtggcaagcagtagacatggattttggagaccaggattcagctcttactgtcctgataactactttatgactttttggataatttagtatatcttctatggacctcagtttctccccatgaaataagaatgtgggcggatcacaaggttaggagatcgagaccatcctggctaacacggtgaaaccctgtctctactaaaaatacaaaaaattagctgggcacggtggcgggcgcctgtagtcccagctactcgggaggctgaggcaggagaatggcgtgaacccaggaggcggagcttgcagtgagccgagatcgca

SEQ ID NO: 75933 - DNA, 1093 bp, Homo sapiens
cccatcacatgaggttgggtgtggaattttccacttctggcatggtgcataaaaagtttcaggttttggagcattttgggattttggattttcagattaggtatactcaacctctactaagtaactaatgagccgagtgctggagtatgaatatgctggacaaagggatgattcacatcctgggcgggatggagcaggatggtgtgcaattttatcacgctactcaggtggtgcaaaatttaaaatgtatgaattatttatttctggaattttccatttaatatttttgagccctgattgactgcaggtaactgaaaccacagaaagtaaaagcatagataaaggggcctgttacagcttgcttggatgaaggagttataggataaattatttgcaattttgttttaagaatagagttcgtccttaaggaaaatttttaattccttaaattcgctcaatgaatggaacttgttcttagtcacgcaccgagttttagtacaaatgatcatggtgctggaatgtgagtttgtctgttgctgctgacgtgagtgcccagccagctggcatgaccgagcaggctgctgagccccaggagagggcaaacttgatctgttgagcaggaatacaatgaccgagacttactgggaaacttacttcatccagctgatatatttttagatttgtgtgaattggccggttgtatcaataactaaatatttcaggttccaaattatttcttctatggtgttgtgagagtttggaggcttatttgtcttgagaaagagaaggaaaagagcaagggaaataattttcaaacagttacgtggaattcttttttaaattcctactccacacttggattgcaacataaaagattaggaaggtaggcgaggcatggtggttcatgcctgtaatcccagcactttgggaggcctaggtgggcagatcacgaggtcaggagtttgagaccagcctggccaaaatggcgaaacgccatctctactaaaaatacaaaaattagctgggcgtggtggcgcactcttgtaatcccagctactcgggaggctgaggcaggagaattacttgaacctgg

SEQ ID NO: 75934 - DNA, 1123 bp, Homo sapiens
acacatctactaagtggtaggactgggatctgaaaccagatagtctagttccaagatctgtgttcttaaccactatcctctgctggatacattctgctatgttttgtaaggcgactatagagtcatttacttaaattattttacagagtgacatgtgtaattgggattggtttggttgcatccctactgaaaagtacaagaattctgtggaagtttttgtttttccagggtttcttccatcctgtgtttctgggacttcttgtatacacttaagtaaaaagagtaagtcttaacttgtttgcaggcacaatacttcttcaagaacaacattatgaataattaaatgcttttatttcctaggctatgctaacagagattgagcacaaggttgcctttctgttagagacttgcaaagatcagggcctgggagataatggagccactcaacatgaggctgaagcgctttccctgaaactgaaaacagtgaagtgcaatttagaaaaagtccagatgatgcttcaggagaagcacagtgaagatcaggtaaaaaatgactatctatggacattcatcttgatacacatatgtggcagacctgccagaagagaactctggttggaagtgatgaaccagctacagagaaactgtactaagtgtgaaagaatttcacacattaacaccatagatgagtacactggcttgttatttttatttcattctactttgcagttttcctgtctaggttgttgttggtgatggcggtggtttggtttgtgttggtttaatgtagctgagtgttcttgttggcagtgaggtctagtgtaaggcttcttcgtaaaagaaggatgtattataaaggaattttgtgactctaattgactggaaaacaaagctttcatagatgtgactaaaatttgacatcagaaacataaacctgtttccaggatactttgttattcatttgcaagtatttatatatataatcaaagtatcatataaagtgttctcatgatttttaaaagcactctgtgtttataaatgcaaatgtgcatcttatgagtagatcttactataaaagatttgcatgtgcttatgagtggttcctacttagagatttatgttc

SEQ ID NO: 75935 - DNA, 1047 bp, Homo sapiens
tcctctgcagcctgctcctgtttttaagacactgtacctcctctttgtaatcaaccccttcaagcttctcttttgtgacttcttttccttctcccagctatacttgatttcattaaccgctttctcctacattagaatgtggagggtgggaaacagtggtaaaggagacagtgtaatttatctgggaccacactttcacctggatcgccctgctaagggatccttcatctcatgatttaccttttagttccatgcagtactcaaataactacctaacgttgagcttcttaaactcatttttctccaagtttaacatcgtaagtttatttatttgttctgctacctagttcacaaagcgtttgaagcaacttattacaaaagaagcataacataaatcataaactataatggaaactaggcaaaatataggtctaggaaggcaaaggtatcttaattttctttttcttttttcctcttgattcaggaaaatatgacagaagaagcatatatcaatttggataaaaaattgtttgaactattcctgaccctcagtcagtgcctcagcagtgtggaggagatgctggagatgcccagactttacagggaggatggttctggccagcaggtgcactacgaggtagggcacttctcacgagcccatgtgttggccattacagcagccccgtgagttaagcccacgtggaagcctcttgaggtcagagctcattcattgtcttccttcctctccactccagacgctggctcttgagttgaagaaactttatttagcgctaagtgacaagaagggtgatcttttgaaagccatgacttggcctggcgagaacaccaacttgctccttgaatgttttgacaaccttcaagtctgcctggagcacactcaggctgcagctgtctgtagaagcaagtccctgaaagctggcctcgattacaaccgcagttaccaggtatgattccgagcacacagcctattttggcactgttttaagttacagcatgaacccctaatgcctattcctattcctggtg

SEQ ID NO: 75936 - DNA, 1083 bp, Homo sapiens
gtaaagagaaggatctttatcttttagaaatatatactgaaacgtatactgatgaaatgacttgagacctgggatttgcttcaaaatagcctgaaggaaaggagattaggtacagttgagagctggagggaggatgtagagggaagaaggtcagccatgaatcaataattgttgaagtttaatgatgataaaatggggatttctctatttttgtatttgtttgaaatttctagtgtcacaaaaattataaaaaccaactaaatataaaaaaagataatgaaggcctaaatgagattgctcagtttccgacatttatcttacagaatgaaataaagagattatatcatcagctcattaagagtaagacatctttacaacagtctttgaatgaaatcagtgggcagagtgttgctgaacagcttcaggtaatcaagtcaaaataattcagactgacttaactttgaaccacagagctttgcatataagccgtgcttctgaactactttcctttgtgagcagcagcaaggcttaagtaaataaataaaaaatgagaactatttatgttgactttttaaaaacatctcctaattttctgaagcacaatgtattaaaacaaaaggaggccattttcacttatcaaccatgacaaaatgtgtatgtccagtgttggtaagggtattggaaaatgagaccctcatcctcttgccaggggagccctggggatcctttgtctgtatatcagaattttaaacatgaatactctctcttccagcaataatttgacttcatgtatttagcaaatattaattgaggatccactatgttccagcactgtttgaagtgctgaacttgtactcctcctaaggatataagacaagtgcataaagataaatattttggccaggttggtggctcacgcctgtaatcccagcaccttgggagactgaggcaggtggatcacttgaagccaggaatttaagaccagcctggccagcatggcaaaccccatctctatcgaaaatacaaaaattagccaggtgcagtggcacacggctgtagtcccacctactccggaggctgagg

SEQ ID NO: 75937 - DNA, 1010 bp, Homo sapiens
caggtactagaattcatttgaaatgtgctatttctcttcacatattcttttaccttatttgtcgttgtagttgttttcgtcctttactcatggagactctctataccaaacactgaaaagttgctgagaaaaattgaagtaaattagaagcatttcaagtcccattttatgcactcaataattagaggcaaagccaccaattccaacgtcattgacaggctgcaaatccacttggttatctttgttttgtctaatgtactcactcagacataaatatctccataccccaaacccaacagagtatctggcattgtttcctggcaagatatacagaaacagtgatgaagcagtgtctccatgtacagggagatgcctcagggaggaagtgatcctgtatcatgtagcctctatgagctaggagcatagtcagctccaggaggactctaaagtttggaagaaacactacatggtgttgaagagagagtataaaggaagaaagggtgcaagacatctaataatcttacaaaaggcatgtcaatgtcagcattttaccccttccaggaggagagcaccaaaagagagcgagctcaggcatctctagacattgcaaccttgacattttcccacaacagaggaagagaactaaaaatactaaccaattataccaatcaattggtataatctatcaatggtataatctataccatcaattatagatatgtccatgtttcctagagaaccttcattgtgggttgtcacctactaaaatctactttcaaccatttgtaccaagagggaatagggaataacctgcatgaaatccataggcaacactcagcctcattcctcagtcctcattcccccaggaatgtagcagaaaaatagagatgagcttattcagtcatttgttaagcatacattgtgtgaggtactgtgctcactgccagggttacaaaggtaaacaagaaaataaatgaatcctaccctcaaagaactcataggctagtgga

SEQ ID NO: 75938 - DNA, 1046 bp, Homo sapiens
tttagaccagctggccaacatggtgaaactaaaaatacaaaaattagccaggtgtggtggcaggcacttgtaattccacctacttgggaggctgaagcaggagaatcgtttgaacccaggaggcggaggttgcagtgagccgagatcatgatactgcagtccagcctgggcgacagaatgagactccattccgaaaaataaaaaataaaaaagcctattttctgtattcttcggtgacaaaatctgagataactttctatttcctgggctgtttgggtgctggccgtgttgcaggttggtattctagaaggcacagcattgagatagctgaattcaggtcccactctaacattagcaagctgtttgactgtgggcaagtcatttgcctgttcaggccccagttttcctttatctttgaggtaaggagggttttttgtcatctagatatcttattggcatccaaaaacctgtacttcaattttttaaaaatagaatcatgtgctggcactgacagcccaatcacctgatattgaacatttgaatgaagtgagcctcaagctcccacttagtgacgtagctgtgaagacgttacaaaatatgaaccggcaatggattcgggccacggccacggcactggagcgctgcaggttagaacatcccttctctgtcgttgtttcaattaaggtaaaattaacggcttcagctcgggaatggcattgttaacatgggtgtgttttgttttaaacctttgtagtgagcttcagggaattggattgaatgaaaagtttctttattgctgtgaaaagtggatccaacttttggagaagatagaagaagcactcaaagtggatgtggctaacagccttcctgagctcctggagcagcagaaaacctataaggtaaacctgtgttctctgccacccttgaaccgctcatctggggcaggagtcagggaaagatagctttaaataaaacacagggagtgtacctatcagtccctaaacacagaatgtatacctttaagcaaattcagttgtcaattggtc

SEQ ID NO: 75939 - DNA, 1054 bp, Homo sapiens
gcataacactaaggacatttaaacggctgtagttttcctggtccatttgcattataaatgtttgattgacattctatctggattaatagtttttaagttaaataggacattgtccttatgttggtataaggatttgattcgttgttataagggcaaggatttgggttatatcttcatctagcctttcctgtttctaatttttactataaccagatagtaacacacgagtattggataaaaacaatccttccaatcagctacatttcaggtacagtatttattttgttattttttatgacatttatcacaggtgtaaggaacttctgttgatgctaaaccctaggtttagaagaggcaaaaccagacaaggttgagtgcggagagctactgattaaaatgaatgaaactcagtttttttgagggagagaagggggtgctttccttcctggctatactcagctgccaaatgtattttcatttgcaggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaaggtaagggaggacacccaggtggatgtagttatgactaccatggaattgtcggccctcctcactcctaagcccaaacaggggcaatgttacgggtgtttccagtagcattttagaaatttgaagggacttcactattttcgatccttttgagagaacagttggaagagaggaggttccagagagatgggagtgtgagaccattgtcagtgggcatggtaccgaggagagttgctttctctccattagaaagtttcaccagggaaggggcttacatatccttacatgtcagctgataccccaagtgagttagggtttctctagttgttattaagaagctccccttggcctggcgtggtggctcattgctgtaatcctagcactttgggaggccaaggcgggtggatcacctga

SEQ ID NO: 75940 - DNA, 1090 bp, Homo sapiens
tcccattgtttctgatatctgtatgacaggctaatctcactgtaattctctccttggccagattttggaagaggttgagaaatggaaatttgccttccctagtataacagcaccagtgaatattattgtgtcagcaaaagcaaatgcccattcgtggcttattatgggaaatgttctgttcccaacaagttttgccatggcaagttctttctctcacacctaataacagtaaatgtccacccgtgtcaaacttttagaattattttaattggaaaagccagtgcccgtgagggggaatatagacaatcacttaaaattcttaaaatgtcattgtcacttagttaaaaactaaagctagagtagtaggtgaaggaaaacaacaataatgacatttggatgcttttctatggccctgttagaagaaacaggcagtggaagctcagggtaactttctttgaaatcctttctttctcctctctcaacagggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccggtacgggcactgctgcctagaaatggcacctgggctgctcagagtttacgtgagaccaaatttttaaagaattaggggacctgtcttataatggttaattatggtttattttttggttgaaaagaaagggctatatcaaaacattttaatttccacttttattaatatagagccacagtaacttacaagttcccattccccagtggaaagcatggcacttctgaggcgcatgctccacgagtcgcttttaagtattcctcagggctgggcttgtctggcatgcgtcactacccctagaattcttgaagaactcttctggcttttattacattagtaacttaggaatgtatttgcccttccctctttcttagaggctggaagcttttagtatttgtgcctttctgatgctt

SEQ ID NO: 75941 - DNA, 1049 bp, Homo sapiens
gatttttttctccatctaactgaagtcctttggcatgggccaagctttcttcatggtggcttggtttggaactgtttccttgctttactgggatcccctggtggaaaggggtggggggttggggcggtaaagggtgctgatgatttgccacaggagggaaaaaaccttcctttccttgatttgcagctctaatcctcatccttagccccatccctatctgccatggtgggtcggggagagccctgaggagccttttggttcccaagtccatcttgatgttcactcttcccctcactcctgagaggccttctgccatcttggtccccagacccggccttgccactcagtgtccctaccactcgagaccctggctccaaaacgccactcatcccacagcaaatcatgttggtcgtgctccgttgtgtacccatctagtgaaggcacagtgttgctgagttgcatgactcatctcattctcttctgggacatactgacattttgcaaacatgcatgctttgcaaggaaagctgcagaactcattttcatactgtaacctgatgccatgtcacccgtgacccgttcagtaggagagaatagactgtcgcttgctgtctttcgtttcaggtaaatccatttcggatggccactcgtggcatgttcccgacagcccttcctgtcccgagcatcactacaagcaaatggaaggtgacaggaatgttccacctgttccccctgcgtccagcaccccttataaaccaccctatgtaagtcttaacttcactgggagtacagcctatgtctgtgagtcatacttacatttgcaagagagagagattttggtgtaaactgcgtgtattcattccccaggcatattttgagttggttttcttatggtgacagtgtctctgttgagctgtccatacttcattagaaccccggcaaaaccgattagacttagagataggttctggccaaaaaccatctttctgtatgttggtgtggtgtaacagtcattattactgtcgagtcaggtgtctgtgcaaatagtg

SEQ ID NO: 75942 - DNA, 1116 bp, Homo sapiens
tgctcactgcaacctccgcctcccaagttcaagcaattctcctacctcagcttcccgaataactgggattacaggcacctgccaccacacccagataatttttgtatttttagtagagacggggtttcaccatgctggtcaggctggtcttgaactcctgacctcagaggatccacccgccttggccccacaaagtgctgggattccaggcgtgagccacagtgcctggccatgactaactcattccattgagggtcttttctcctgaagttttgtgctatgacttgatatttcaaaagaagggaaatagatgtctcagtattaaatttcaaacgggaagtttaacctgtatattggcttatttagggtaagagtgaagctatcctggacaagaactttgacaggacaatactattcactctgaaggaccaaaaaatgagcagaaaatttgggataaatgtcaacaagatttgaaccctaaagaaaagcaagcatcgagttagacagacgtccatattcattcaactgggaaaataaaactgcagtcccaacatcagaatttccttggtcagttggttattgcgggacagcattcttctgcatgacagtattgtctccttaccagccacagaggaggctgtgagagagaggatttgggaaattggtgcaaatgagaaatcttggaaatctgtaagtatatagatataaaagttattctttccagtttgattcttttatgatgtagattttaatatccgtcaatttaggaaactctgtggctctgaattatagttataattctagttttactattacagtgaaagaagagaagaggctgttcattattatattggaagtagtgtagcatgtttattaagagtgcagagccccagcatgaagcctagctctgccatttgccagctgtgtgtgctcttgggcagactacttatcctctctgtgcctcattttcatttgtgaagtaggggacggtgtgtagttcccacctcacagagtggttgcaaggaccaaatgggttaatacatgataaatgcttagtttagtgtaagttcaataaatatcaaaatagtggtatgttaaagatagtgtttacatgat

SEQ ID NO: 75943 - DNA, 1189 bp, Homo sapiens
gacccgcccaaaactccctggaagccaggcgattcagaccccgccaccgcgtccccagagactgggcggaaaccggagactcgcctcccgaacccgcgaaactatctcccgcgagactgccccgccccaaccccgccccgcaactctactccctgattggctggaattacggccggattccggagtcctttccagctccctcttcggccgggtttcccgccgaatacaaaggcgcactgtgaactggctctttctttccgccaatcatttccgccagccattcatcaccgattttcttcatcttcccctccctcttccgtcccgcagtccccgacctgttagctctcggttagttaagggactcgggtccttccgaactgcgcatgcgccaccgcgtctgcagggggagaagcgggcaggggcgcaggcgcagtagtgtgatcccctggccagtccctaagcacgtgggttgggttgtcctgcttggctgcggagggagtggaacctcgatattggtggtgtccatcgtgggcagcggactaataaaggccatggcgccagcagaaatcctgaacgggaaggagatctccgcgtaagcacctgacattgttgttgagtgtggggctgtggacgagggctctgagggtgtgcaggtcccccggacccattttttgcgggagggacacttgtagcggaagagttaggcccataacacctgaagacctgcagccaaagaaagagaacccgggcacaacctgcgtttgcaagtggactgcctagtggctgtagccgctggctcctgtgcttcggggaaaagtcctgtgccgactatgctcccaaacgcgcagctgctggtgactttctgccgggagagtgggtagttgcggcttcctggagcccccctagtcagaactcagaaatccaatctacttaattcccgttaatttggaggtgagtagatggagactagtgaggtgacaaggcttgacaagactacaaggctgataatgacagagggtccttccagctcatagcttttcccactataccatagtcttatcatacgctaagtgaaatctaatacatttttcctttctcttcaatctcgtgcttctctctaacagccatctctctgccctggtcctagagttacttgaaacgtaatttggctcctgagtcctgagaatat

SEQ ID NO: 75944 - DNA, 1434 bp, Homo sapiens
tgaaggagggaaagatatattctgtgtgaccttactgagtttgctcttgggacctttcacatcacccgttatgtaagtaactgttgccagccacagcagttactaaattgtaattgtcctgtaactcctaactttgtaataggtttttgagtgaattacaaagtcatcggtggtgaaaagtccgggcccagtggctcatgcctgtaatcccagcactttgggaggccgaggtgggtggatcacctgaggtctggagttcaagaccagcctatccaaaatggtgaaaccccatctctactaaaaatacaaaaaattagccgagtgtggtggcaggcatctgtaatcccagctacttgggaggctgaggcaggagaatcacttgaacctggggggcagaggttgcagtgagctgagatgcgccattgcactccagcctgggcaacaagagcgaaactccgtctaagaaaaaaaaaaaaagaaatcacaatacttactgcttagtgcttttcaacatgtggcttgctaaactgtatttctgctttactttctgtttttgtttgcttgtattcaaacttacttccttttccagtggctttttgttttaatataaaaatcttccttttagaaagactgattgtgaagagataatttagtgcataataatagtgcagataatttagtacaataataatgcatctgggccagtactgagaataggtgctcactgaatatactttcgttaattggagagcaaattaaatatgtttatcaactccataagggcaaatacatgtattgtcttatttttgtctatatcctaaacacctggaaaccctgtttcctgccttactacttgtgtggttttaagcaaattaattaacctttctgtgccaaagtttcctcaaatgttaagtaaaagtaatgtctaggtcattgggatgttagtagaattaaatgggttcctaacagatgatcatttataattcttcctggcacataataagtattcgatatatgttgtattaataatcagtaattagttaatgtatatatgaatgattcattatctttttttttttttacatggtagctgctgccttgagatctatttttttttttgagatgaagtcttgctgtgtccaatcttggctcactgcaacctctgcctcctgcatacaagcaattctctcatatcagcctcctgagtacctgggattacaggtgcccgccatcacgcctagctaatttttttttttgagatggagtttcactcgtcgcccagactggagtacaatggcgtgatctcggctcactgcaacctctgcctcctgggttcaagcgattctcctgcctcagcctcccaagtagctgggattacaggcgtccgccaccatgtccagctagtttgtttgtttgtttgagacagagtttcac

SEQ ID NO: 75945 - DNA, 1589 bp, Homo sapiens
ggtttcgccatgttggtcaagctggtcttgaactcctgacctcaagtgatctgtccacctccacctcctaaagtgctaggattacaggtgtgagccactgcgcccccgctggcgctttgctttttctttacagtcttcctctcattagcatgtttcccaccctgctgagaatgctatccctgactcgtcctcttctattattattctccttttatgccttcctgggagctcggacatcaacaaagttcagcattccagattccttctctacctgctctactctgtgggaaactgggtacttacatgatggatttagttgccaaattatctttctttggaagtaacagccccttttctccctcacggggaattctaagtttgcagcctgaatttgacaaccgggggaaggtctgagagttagagacaagtatctgttctttgtgggtatttattcacttactcaacaagtagctgtatgtgtcccctaagccaggcaatcttcaaagctctgagagtctaatagtgaacaaaacagcccaaatccctaccctcatgaaacttgcatactgatgggtagagacagacatttaaataggtgaaacacattgtgagctggtgggaagcacaaagagaacaccagagcagaaaagagggacaggagtttctgtggtatggtggctgcaattttaaatatgggagtcatagtctttgtaaaagtgacttacgggcaaagacttgaaggaggtggagccttaagcctgccaatgttgtgagggaaatagctcctgaccaaaaacacagcctgtgccatagacctttgtcctcaccagttactaacttactgctttggggggtcaatggcaatggccctgtgagaagctgaccgagtggaggctcctgagtagaggaacctgaccctgccctgggcagaagggtggtgtcttttaaaagattatgcaaagtgggagaaggatgtgcattagtgttggaagacccaccttgctttgtaggcaagaaagcatagttgttctataagtgggcctttcaaaggggggcttactacatttatatgatttgtttggtttttccttcccttagtttgctataattaagcctgctctctccattggtggcatttttcttgattaagtctcctttctaaagagactggttgtgaagaggcagatggtttgagtaggtgctgcgagtgtttgctggccaagtgcagggcaagttgggtatatttgtaagctcgctgtggatggtagctccagagcctaagcacggtgctgcctcctctgtgcatcactgggtcatgcaatttacctctgtgccttagcttctgtatattggggtagtaatgtcacctaactcataaggttgttagaattaaatgagtttaatacctataaagcatttagagaagttgttggtacatggtaagttttaataaataggtacttagaaagtactcattgaataaaaaagtgatgtttgtgtttatccaggctgtacctttgggagctggcttataatcttgagacttaaaattagaatttatcctagtgatcaaagataaaagtttggaa

SEQ ID NO: 75946 - DNA, 1058 bp, Homo sapiens
tagctataaaagggaagaatttttttaacagtccttccaggtaattgtgggtatttttctttgatgttgtaccaggactcagtaagtaaattttaaaagattagttgcaatgtagaatctgaaactctatcagtgaactttgatactttgttacatcttctcagacttgcacactttgttacatcaaaatgttacatttggaatgaatatttaccccatgcatggttttgtaacatcctttgttcctcatttggaaaataatagttcccggaattatgcagatcttccaaatgttaacatttcattatgcaatatgaaagaattggaatcattaacatcaccaacaagctcatcagagaagttttcaagtattgagaagctgtcaagctcacaggggtggataaaaaattttaattttcacccaaaaactcacattttatcattggcaacaaatacaattaattgtttcccttgaaataccagtttcactttattcatttttgagaaaatatttgtcaaatactcaagcctgaataatcattgcttgtcagttgttatttcaagtaggtgtttcatataaaaatgcatctgtttcagctaacaaggcaaaaaagcacaagtgcagcctggacaacaaagtgagatcccatctccacaaaaaaattaaaaaatgagccaggagtggtcgtatagaggtgtggtcccaactacatgagagggagacaggagatcacttgagcccaggaagtcgaggctgcagggagttgtgttcatgccactgtactccagcttaggtgacagtgagatcctgtctcaaaaaaaaataaaaataaaaataaaaaagcactaatgctttagtaacaaccacaaccactgtacttctgtatatagcagaagtgcattatgagtgcttcccaattccttacatagactattaaaaacacatgcactcaagagttgaggtttatttatatatatatattttttacttttttgggacagagttttactgttactcagtgcagtggcacaatcttggttcactgcaaccttcatct

SEQ ID NO: 75947 - DNA, 1014 bp, Homo sapiens
caggggtgtgatcacagttcattgcagcctggatctcccaggctcaagctatcctcccatctcagcctcctgagtagctgggactacaggcatccagctaattttagtatttgagacagaatttctccatattgcccaggctagtctcagactgagctcaagtgatccacctgccttggcctcccaaagtgccgagtcaccgcacctgactgattttggatttttgagttagggatcttcaacctgtactacttatatagagtgtctacaataattcaaattgtttgtttatatttctaatcgttctatgttttatactaccctacgatgtaggagatgtccccttatagccatagtaactcatgctcaaagatcttgggtagcttgcccaaagccagtcaggaagggactgagtctgggaaatgaacccagatctgtctctaaaacccatttgttcttcccctttgttttcctaattccttagcaatgcattcaagaacattcatgatctggcccaagtatatatttaaaagttgagttttcatttttttttaataaagtggatgagtaacttcccaaataactgaatatttataggaaattaagacttgacttttcattataagagatactaatgggctaggcatggtggctcacgcctgtaatcccaccactttaggaggccaaggcgagtggattgcttgagcccaggagttcaagaccagcctgggaaatatagagagactttgtctccaaaaaaatacaaaaattagctggttgtggtggtgcttgcctgtagtccccactactgaggaggctgagctgggaggattgctcacgcctgggaggttgaggctgcagtgagctgtaatcgtgtcattgcactccagcctgggtgacagagcaagactttgtctcaaaaaaaaaaaaaagtttctggtaaggtgatagaaatacagcctcagccccatagcctcattagtatctctcactctctctctttttttttttttt

SEQ ID NO: 75948 - DNA, 1013 bp, Homo sapiens
tacaagtttctccctgtctctctcttttttttttaagagacaaggtctctctctgttgcccaggctgcccaggcatagtaccatgactcactgtgcactggtgcaatcatggaaaaactcttgacctcaagtaatcctcccaccttggcctcctgagtgctgggactacaggcaggcaccactatgcctggctaattttttgtaaagatgggggggggggtctcactatgttgcccaggctggtctcgaactcctgggctcaaacgatcctcctcccttggcctcccaaagtgcagggattatagacctgagttgctgcacccggcctcctctctgtgttggggccagcagattgccctttgtcttgcctggctgtttattctgtgtaaactagagggaggtccttccaccctcctttctattgtctgtgtggcggggccagggagctttccattgcccctgcgggtgggggagagggtgtggaatgtgccctctgggtgctcctgcctctcaggcatttttcttgcctgatgacagtttctcagccctccatactctgtttttctggtatggcagcagaaatcccacatgtttctagtaggcctgcagcatccttgcttagtttccagtgcagatgcagatatcctctactttctgtttggggtttggcagtgggaaccaggtgggccttgtttaggggaggggctgtaacaccatctgtgttcacataatccctcctgcccccacagcctccctatactcctgtaaaagttctctgcaacaagagtcgcatgattaaacatttcttttattaaaactaaaattgtagaagcttttctgtgcactttgcctttccctaatcatctgatttgcatgcatttattattctaggttggcaacagagatgattccaatctttatataaatgtgaagctgaaggctgctgaagaggtaacgccagaagagctgtgccatcaccctccccaacctccacctgggtcctatcgattacc

SEQ ID NO: 75949 - DNA, 1795 bp, Homo sapiens
aggggaaggtacattctgaaaggactataattaaagtgttggggggaaatagggcaacctaatttttgccttagaaagtgtttcttcctaccttttgatttctgtgtgatatacaaattatatatggtattacttttaggtgatgaagtacattacatctttgaatgaagactctactgtacatgggttcttagtgcagctacctttagattcagagaattccattaacactgaagaagtgatcaatgctattgcacccgagaaggatgtggatgggtaagtgtggcttggcttcctatgtctcattgcatgctttcatttataatatgtttctatttggggaatacagcataaatgtttctaaagagtaaagacatctaattgcctttatttccttcttatttccatcacttttttaagattgactagcatcaatgctgggaaacttgctagaggtgacctcaatgactgtttcattccttgtacgcctaagggatgcttggaactcatcaaagagacaggtaaaaacaacaaaccaaacaacaagaaagcaccatttcctgaatcctggtcttgacatgtggtggcatagaggaggtacattgtgggccataaataaatggacttgattggcagaagggcctgtctactaaggatgttacctaaattttctctcaattttctcagcaactctgtgaagtaggtactgttattgttcaactgctaagaaaataggctcaggccaggcacagcggctcatgcctgttatcccagcactttgggaggctgaagcgggctgagatcacctgaggtcaggaattcgagaccagcctggtcaacatggtgaaaccctgtctctactaaaaatacaaaaaaattatccaggcagggtggcatgcacctgtattcccagctattcgggaggcagaggtgggaggattgattgaacctgggaggcggaggttgcagtgagccgagatcacctgactgcactccagcctgggcaacagagcgagactctgtctctaaaataaacaaacaaacaaacaaacaaacaaaaccagctcagagagagcaagtaacttgtctgggagacaacggaaccaagatttgaattcagagttatctgagttcaaagcaatttattttaacctatacagtaataaaaatttggatagtttaaaaggatatgaagtgaaaagccccacctccccccacccccaaaatgggcactgaatctccacagtagttccaggactcgacagatggctggaaatgggtctcctgcacagttggccatattgtcccgttactagttagcaccttgctattttaatttcattatgaatacttttagcagaggttattttttacaaggaaatgggtcctggtaaaaagaagtaggtcagaagtttcaagtggaaagttttggccagcataaatgaaaattttctgtggttggcaagaaaaggtcaaaggtcaagctttgacagttcatttctacagttaaatgtatattcttcagcatatttagcaaacattgtagtgccttgcttaaaagaaaaaaatcccacgaggacagcacctgaaggcctcccactgcctcttattgagtgatgctaccatttgccctgatgcagctttaactcttctgctgaatcctaaaaagtatagaaagttaccttttaaaactttgaggtctttacttctagatgttcatgatgttcacattattataagagtttatctttttctgaaaaaaaatgattttatgcgagaagcacaatttaaaccc

SEQ ID NO: 75950 - DNA, 1452 bp, Homo sapiens
aagtcgtcaacttctctctgctttcttctttgtggacagctcattttcgggctccactttgtggccacaaacacctacagcctggttccatcctcatgcctaacagtcatgggattggatcttatcagctgagggaagaaatatggtcccctgtccactactgggtactcactcaggctgtctttagtagagtatgagtcagccctgaaaaggacattggtatattgccagaaaaatggatgctgtgatagcaaaaagaaagctttgctgccacagttcaatttcccctttatcacttccctgcaagtaaccctatggctcaggccctaagccaaaagagaaatttgggtgaggaactgtataaacaaacttaccaaagttagaaggaattaccgatactaatctaatttcttacacatctctccagcctgttacatacaccctatttgttttaactttttttccccatgtaatttaatctgatgtcttcttccgtatggctgattagctgtatgtcagggtttcttttttctttgagtgtaggttttcttcccactcccctatgactcaatgaatgatcttggcttaagctgctcccaaaaacccacggccagaaggacacaagtacaagtcccaatttatagctgaaaccctagagttgagaatattattgccaaagaaggaatgcttttaggaaggtttctgtttgatgttaagaacctgtttttgtgcacttattctaatttctccacgtggcatgcgaaggagggcagcttctatcctccaactctgatgcaggctggcttttctttcaggggtgccgattgccggaaggcatgctgtggtggttgggcgcagtaaaatagttggggccccgatgcatgacttgcttctgtggaacaatgccacagtgaccacctgccactccaagactgcccatctggatgaggaggtagggtgtccagaggagaggtaaaggtgttacggtggggagggtgggtgtgccagaggctgccatgtcctttacactcatgacctcatttaaccccatcatctcatttttacaagatgaaaaaacaaattcaaattaaaggctgagtggggtggctgacacctgtagtcccaacactttgggagtctgaggcaggaggattgtttgagcccaagagtttttgagaccagcctgggcaacatagtgagacgctttctctgcaaaaaaaattaaaaattagccagatggggtgggcacatgcctgtagtcccagctactcgggaggttgaggcaagaggattgcttgagcccaggaggtcgaggctgcagtaagctacgatcacaccactgcactccagcctgggctacagagcaagaccctgtctcaaaaaaaaaaaaaaattaattaattaaaaaaaacataaaattaaaagcatgctgaagtttatacagagtttgtt

SEQ ID NO: 75951 - DNA, 1587 bp, Homo sapiens
ccatgcccgacctttgtcttttttcttttgagacagggtcttgctctgttatttaggctagagtgcagtggcagtccatgagagcccactgcagctttgaactcctgggctcgagtgatcctcctgcatcaaccttctgagtagctgggactacaggcatgtgccaccatgcctggctaatttttaagctttttgtagcgacaggggtctcactgtgttgcccaggctggactcaaactcctggactcaagcgatcctcctggttcaccttcctaaagtgctgagattacaggcgtgacccaacatgcctggcctctcaccaagtactttctaccctaatctgcctcgtggtggacagggattagcagtacaggcactcagattgacctctggcagccagatcccatgtgtgtaaaagtggtggcctcagagtgaaggtgctccagaggcagtcgtgggcagtagtctgctaatagctatggcagcttgttctagatccctgcatcagattcctgagcccaagaatgcgcacacacacacacgtgcctgttgacagtgcagtctcttaaatgtggggagagagcaggagagaggcctagtactttctcttttaatcctcccaaagtagtgctctacattctgtaggagaaggagcagtgtctggacataacacgcagggccccaagcctgtttgcccctctgccttgcaggttgacactgatttccctattgggtaaaatggctggtgaaagggagctctttggcatgtgtagaaatgagcacggcatgtgaagggctgtcagaaacagtgtgtggcttacatttgaggccttaacccaatatcttatgaaatagcttatgacacttaagaatttaatacaaagctcagggatatccttttcatttctgggtttttttttggtgtgtatttcattatttcatttctgatgtccaaatcccctacccctaggtaaataaaggtgacatcctggtggttgcaactggtcagcctgaaatggttaaaggggagtggatcaaacctggggcaatagtcatcgactgtggaatcaattatgtcccaggtgagtgttgttggaggagtaaggtggctgctggtattgaggatggtatctaggtcatcaaaagaagcctgagagagaagcttgtctcattttatgcttgtagtactaaggtttaggagactgactagcccaagggtgcacagagttagtagatagaagagttgccacttgcaggcaggtctgcctggtgccagagcctttgattttcatcatgtgctgtacagcttccaagatgactttgtccagggagaaagtgagagggagggcaggagggatatatcactttatcttcatgtagagatcaccctttattttagcaaagttgatggatggatttaaaatacagtataattattgcaaagtgctatgagagtccagaagagggactcattctgccaagaggagggctttacaaagaagatatttgacctgggtttttttctaggctgagaggataaatctagccttttaatcatgtccaaaactgtactcggcatcctcatcc

SEQ ID NO: 75952 - DNA, 1359 bp, Homo sapiens
cccatctcctctctgtcatgtctgttattccttccaaaccttgtttgatttccccttatcaagggatgatctttccttctctccctccctcctctcccatagaacatgtgtattgtatcttttgttgcatgtgtctcatgtacggcgtcctgtgctctcctgcctagatagctcctcaagggcagtggtcactgtggcgccacatccagcttcctgccatctgaccactggcactcatatctattgaattgtcgaagggagttatagctggaagtcttttttctcccttcccatctcaagtttcagatgtagacgctgagctgccaggaacattagtcactgtcaagccttcaccgtttttaacctccctcccactctccctaccgtgcttttaagacagtagctcataattgatcactcattttcttgtagtgtaattatctaacaggcgataaagaaattgctctcctacaactcctcactttgaatacttgcgatatgacattcaagctcagtctttttatttatttatttttttaattttttttttttttcttgagacggagtctcgctctgttgcccaggctggagtgctgtggcgcgatctcggctcactgcaagctccgccttgcgggttcatgccattctcccgcctccgcctcccgagtagctgggactacaggcgcccgccaccacgcccggctaattttttttgtatttttagtagagacggggtttcaccatgttagccaggatggtctcgatctcctgacctcgtgatccgcccacctttgcctcccaaagtgctgggattacaggcgtgagccaccgcacccagcaagctcagtctttttaaaacctcgcatcttctgtatcatatttctgcttttggcattttttttttggattacatgtgagaaatggagaagaaaaacctgagtggggatcttgagtgttgcagataggtaggaaatgttgacttaaacatgaaacttgccatccttttcacattgattccttatgtagacaataaaatatgaataaaatcaaagcagtatcttcccttctggtcaacagtgtttttactgatcttgggcatataggcaaattaatgctgatacagctggatgttattgtgttccccaaaggatggcagaatcactcagttacagaccagcaaatgggctgcaggacctaaagactgatatttgcaaatgttcactttagaagcaaacttttctaccaccgagctacttcttggttcatattttgattatttaaatagtttgcatggtccactcagggataacattgtaagtcacttgccaaattaagaatgaatcaaggtgtgtatacctt

SEQ ID NO: 75953 - DNA, 2594 bp, Homo sapiens
gttgatttttgtacatgtgatttcccaaagaaagagaaattctagggctgggggtagataaccaaaaggtttgctcattactgaggtcatatgcttaggctgagtagtggtcactttttccactgaccacatcatcctatccacgaagcactgcatgtttagcagtgtctcgtcaaccctgacagtatttggtttaggagcaaaactgaactcaccagtgctgcgtttagtcatgtagtcaaagatatgtgtctcttacctgtgggaaaacgaaaatgactaacattaacacgtagaaatagatgcagcgggtatttcaagctaactacagtgtgaagacgattgaaacttgtacagagggcaaacctctatctatatttccttggcattttgaaatgactctaggggctgtaagaggaaatgttctgccagtttgctgctttataatcttctagaaacttgaaaccatcccaatgagttgtgttgaccagctccttttactccatataaaaaatatcttacgtatctgtggtggaaagagaaactcttgcgtttggaggctgctttttcaatttcagtaatgtacacattttctcattttgccctcagcaaatttgtgataggtagtgttaagccttctttgcattttggacttcagattaatatggagcccacaggagctgcagaactaacttttttttttgagacggagtttcgctcttgttgcccaggctggagtggaatgctcactgcagcctccgcctcccgggttcaagtgagtctcctgcctcagcctctgagcagctgggattacaggtgcccgctaccaagcccagctgattttttaatatttttagtagagacggggtttcaccatgctggccaggctggtctcggactcctgacctcaggtgatccacccgccttggcctcccaaagtgctggcattacaggtgtgagccaccacacctggccctaatttttaataaaagagctgatgctacagctaatctcttttttttctgagacagagtctcgctctgttgcccaggctggagtgcagtgacgcaatctccgctcactgcaagctccgccccccgggttcatgccattctcctgcctcagcctcccaagtagctgggactacaggtgcccgccaccatgcccagctaatttttttgtatttttagcagagacggggtttcactgtgttagccaggatggtcttgatctcctgatctggtgatccgcccgcctcggcctcccaaagtgcctgctaatctcttaattctggcttcttgcctccaccttggagcttcttctcagttgtggcgatctgatcagagagaagtggtgatgtcgctaaaactaccagatgcagcgcgggagccttattgcttcgaggtctaggcccgcccccagcccctcctggaagtgcactgaagccaagtgtaggatgttctttgtgtgagtgagcaatgatgcatcattgggttttgttctcttgaatagctattctttgctggtaagatttgtagttgttcttgtgtccttttaagggaagtgtaattatattctttgcctttagcatacatttaagtagctgtgtctttggaattggatgttgaattgttcctccagctcacacatggagctcacaaaatgctgacagttgctgtagaaacgatatctggcagctgtgacagagttggatctttgtgcacccaaaaaatttcctttgtaggctttagcaaattaacattttaaaatgggtgctcattatatactgggtagttggttttaagaataaaaaacagttggtattttatttgccacctgagagactacaaaaggattctccaggttctgtaaaaccacttatgcatcttgtgaatttttgcaggtaaaataattttctccctaagaaatagcaaacatctgtcattccatagcttttaagttaagtaggcactggagcctgatgggactaacacaccctacaattctgctgagtttttgtcgtaactgatcaccaggactgtgattctgagacttagttttgatttctcccccacttgaccagatgataaaaaaccaaatgggagaaaagttgtgggtgatgtggcatacgacgaggccaaagagagggcgagcttcatcactcctgttcctggcggcgtagggcccatgacagttgcaatgctcatgcaggtaattgtgaataaaagtttctataagagttctgaaaagctgatcgagttttggctgcttttctccccaagtagaaatgtcaaaaacctactcagaagtaaagatgtgaatttattgagaaaaagggaagggaagaatagagaaataagatcaggcacattaatagaggaaagtagggatggcataattccagtctgttttggaatataataactttgaaagaagaaaagtgcgatcacactggcttggccaggtctgttttggtttgccttccctttctttttttttttttttttttgagacggagttttgctcttgctgcccaggctggagtgcaatggtgtgatcttggcttaccgcaacctccatctccctgattcaag

SEQ ID NO: 75954 - DNA, 1055 bp, Homo sapiens
aagtaccagagtgattcttccatgtctatttcaagctctaaattactaccatactcgcactttaccttcagatttttattgctgcggtactaagaacatgtgtttttttttttttttttttttttttgagacagggtctcactcactctgtcgcccaggctggaatgcagtggtgtgatctcggctcattgcaacctctccaccttctgggttcaagagactctcctgccacagcctcccgagtagctgggattacaggcacgcatgaccatgcctggctaatttttgtatttttggtagagacggggtttcaccattttggccaggctggtcttgaacttctgacctcaagtgatctgcctgtctcagccttccaaactggtaggactataggcatgagccaccgtgccaagctgctgtcttaattaaaataatgtttattaattatgataggttcttagagttagctttctctgcttggtgagggtatcacattttgcttgttctagcaattactacaaatgttgacaccgggaacaccttcacccttccacctttttttttttttttggagacacagtctcgctctgttgcctgggctggagtacagtggcacgatcttggctcactgcaacctccgcctcctggtttcaagcaattctcctgcctcagcctcccaagtagctgggactacaggtgcgtgccaccatgcctggctaatttttgtgtttttagtagagatggggtttcactatattggccaggctggtcttgaactcctgaccttgtgatctgcccaccttggcctcccaatgtgctgggataataggcatgagccaccgtgcccagcccacccttccacctattttataaatgtaatcactttgttctgctcttgagcttgtcttaaccccctttcaacttcagcacgagctattccttgttctgcttattgaacccattattttccttttactcttactgcaaattgcctcactgcacggtctctgcctcacaaaaacaaaatacatattaatatatctctgggctgggtg

SEQ ID NO: 75955 - DNA, 2344 bp, Homo sapiens
tctgcctcccaggttcaagcaactctcctgcgtcagcctcccgagtagctgggattacaggcatgcaccaccacgctcagctaattttgtatttttagtagagacggggtttcaccgtgttggccaagctggtcttgaactcctgacctcgtgatccgcccacctcggcctcccaaagtgctggtattataggcgtgagccaccgcacccagcctagattctttattatagctttttctctctggagattagccttttttgtagagctcttagcggacaaatgacttgtttctcagcaaaagcaacacctagggggaaaacaacttaatttgcagacttgtgatacagcttggtttcaaactttggctttcagtgggaatgattattataagcaaatgaccaaatgaagcatggtatcgggaagcaccaacacacagcgatttcagaattcatttatgtaactgcagaaattggaacattacatagacatagagtcggtgctgctcccgtgcactcctcctcgctgttttgaggtgtgtcctcagtaacccagtgtggctgttgatcccagtggtgtggtatttgtggtctctggacatctcattttggaaaaactgcaagttctgtatttgggaggagattcttctgtggacagataattagtcttttatgttttctttttctttttctttttcttttttttttttttttaagacagagtctcactctgtcacccaggctggagtgtagtggtgtgatcttgggtcactgcaacctccacctcccaagttctcctgcctcagccttccaagtagctgggattacaggtgcgcactaccacacttggctactttttatgtttttagtagagatggggtttcgccatgttgcccagggtggtcttgaactcctggcctgaagtgatccgcccgcctcggcctcccaaagtgctggtattatagttgtgagctaccacacccagccagtcatttatgttttcaagaactccctatattgggtgtttgtccactaactgggctgccttcagtattccattggctttaaaatagggattgagctttgcaatagaatgaaagttggaaagatacagagcagctgggagactaatgtggcttctgttcttttgtagtttaatctccacctcacaggtgacatccatgccatcactgcagctaataacctcgttgctgcggccattgatgctcggatatttcatgaactgacccagacagacaaggtaggatgccaaagccccatgaaccccattgaacagttttgaaagtattgaaccatctgaattagtgttggtgtcttgggtgctgaggatgcaggtagcaaagcagtggggctcctctcattttaaagcccctttcttttctttaaggctctctttaatcgtttggtgccatcagtaaatggagtgagaaggttctctgacatccaaatccgaaggttaaaggtaagctttttttcttccacattttttatattgtatggaatctggaatctgatcattgattaggacataaaagtcttcttggagtagcctattttagatgaagttacatcagtaatcatagtcttaaagtcatgatatacatagcaaagatggatggtagaggttatttctcatttatctatagattagaagtggctagtgtggaataaatagaacactgacaacctgccctcagctaagaaagaaacgacacttcctttataacatgaacaagagtcaggatgtcactgtggcggcatagcagcctttggagtttgcatcattgggaccttaagcaaatttgttaaatgacttgtttctccgcttacttgtctgtaaaataatacttgccttgccctgaatagataagggtctgtgttaaacagttaaaaccatagttatatctatattttatttgaatttctgtaacaaatacatagttagtaagcatacaccataccacctgacccagaaatctcacccaaaataaatgaaaactctgttcacataaaaatctgtacattaatgtttttagcagctctattaataatttccaaaaactgggaactaatctaaatgtctttcattggatgaataaataaacaaactggtacatccatccaataaaaataaatgagctattgatacaagcaacaacttggatgaatttcagtggcattatgctgggtgaaagaagccagtctcaaaagcttgcatattgcatgcctccatttatatgatattctcaataagagaaaactatagtgctagggaacagatcaatagatgttaagggtatggatgaagggagggtatgaccataaa

SEQ ID NO: 75956 - DNA, 1025 bp, Homo sapiens
agtagagacagggtttcaccgtgttggccaggctggtctcaaactcctgacctcaggtgatctgcccatctcagcttcccatagtgctgggattacaggctcagccacaggctgagcttcacgcctagctgaagctctccttctttgctagtaaaatcttcccttccctcactaggcatatttgtggcatcccaggttataatcctcgttgctcattcctgaataaactcaacctacttggagataattttttgtaatgtctttctttaggctgacagtaggaaataacccccagctttcagtttttccttctgaatttaagatggtttgcatttcctagaggggatcccatttagaggtaggggtcaaaatttttgtcttacgtttattgtgcttctgtttgtcttattttatgttttcattttcctacactttcagagactaggcattgaaaagactgaccctaccacactgacagatgaagagataaacagatttgcaagattggacattgatccagaaaccataacttggcaaagaggtaccagagcagtatacaagccccgtttgttttggctatattgcacaccctacaccctccagaagagttgttaaaatgtgaggctcagaagcttccatgttggtattttaccagctaaggcatgaccaagatggtgacattatttctttttcttgccacctctctcagtatctctccttattagctatcatcaaatctctttgttggattggtcgaacattttgctggctattcagtgttgactgaaattagggtagttaaaccaaaaatcacattttacaaatttaattttatgcaaaaagttttagtgtcatgaagtagagaaattatgtttaatcacttcttgaatcatgtgtgacctttattcttagaactcttgtgtggcataaatgacttgatttttttctgtagttctctagcttacctaatctttttttttttgagatggagtctcgctctgtcgcccaggctagagtgcagtggc

SEQ ID NO: 75957 - DNA, 1031 bp, Homo sapiens
taagtgtgctatgtttcctaaatttccagaccaggcctggcacccagcgtgtttcaaaagatatttgcacttgccctgatttgatggctcctgcatttcttacggtggtggaaagtcaatgagtcatcatcccacagaacaacaacacaaacctcagtcttttgaaaaaatgtagactgctctgtttttcttatatgtggaatatgctttaaaatagattccagatttctagttaactgtttgaattctctagatgggataaaaccaagccattccacattcctttgctgtaaaaataactcctgtgtatttatggtatatgaacatcatttcttaactttaacacatattctagctttgccatccattttgaaatattgatagacaatcatgaaattagacttattgctttaaaactctgctgcttcctttaactttgtggtccttttactcaaaatcgttctatatcttgcctgtctgctgtagtgttggataccaatgatagattcctgaggaagatcacgattggacaggctccaacggagaagggtcacacacggacggtaacaatttgtccctttccaaggaaattagttcagaggcactagatcttgctgcttctctcctcctccatcctctctcatacgactgatactgccaggtgttgttctgccttctcccttttaaaatggaagtgagtaggtgtgtggcattgagcactcctgacagcttttgcaataaatcccatgtgtcacctgtgtgtttttcccccggcattttttcctggaggtggagagccccaagtgaatatccttgcatagaaattgattaaaattgcttcttttttgtggccatttcactgtatatctccttggtttaagaggtaccatattattcccttgtatatgaaagaaacaataagcgcatgattataagcggccttcatagggataaaatcatagctttttggtcctactataacatttattttaaaaaactgacaactcagggctgggcgtggtggctcacgc

SEQ ID NO: 75958 - DNA, 3921 bp, Homo sapiens
tttttgctattagaggattattttcattaagtattttgggtagtattctgttattctatccttttaagctatttgtttaagcctcagatgtaaaagaggatcacttttgcaattcacacttctggtttaacacaaagtttttgctagtacctcttttccctgcccacaggcccagtttgatatctctgtggccagtgaaattatggctgtcctggctctcaccacttctctagaagacatgagagagagactgggcaaaatggtggtggcatccagtaagaaaggagagcccgtcagtgccgaagatctggtgggtacccagacacgccaggcttggcgacatatctgtgtctgttgtcctagggtctttcagcagttattaataacaaaatgtaatgctgtacttaagacattgcaattaattcatcaatttaatcctattttgctaattacaagataattatgaaatgtttaaaaagtacatcagagtgaataatagctggtatgctttagtaatagatcacaagttccagatgatttgagtaacatcttcatcctgtgggcatctctaaaagtgggtgtatgacttcaatttgcagagaacatcaagagtaccattgctttatctttgttgctaggtagttcagctacactttgatggcttaatagagtgacctgatgttaaaagttggtattgaactcttgcgtaatattgcagtttcagctttggaagacacatattgagtttggtatttatagaaatttctgcccagataccagagttacaaataactgagtactctgggaacgagcattgtcgtgctctaaaatagtctagaatggatttctcacatcagtcagcagctgagcttgattaagatgcttgtttctagagttacatgtttttccagatattacatgtgaatgtcatttgtattctatctggcaactttggccaggcgtggtggctcatgcctgtaatcccagcactttgggaggctgaggcgggtggatcacaaggtcaggagattgagaccatcctggctaacacaatgaaaccctgtctctactaaaaatacaaaaaaattagccgggcatagtggcgggtgcctgtagtcccagctactcgggaggctgaggcaggagaatggcgtgaacctgggaggtggagcttgcagtgagccgagattgcaccactgcactccagcctgggcaacacagccagactccgtctcaaaaaataaataatttaataattggcaacttcatagcatatccagaaaaaaaccatgaatggtccaattcaggtgaaagtatcaattggtccaagatggctaacatgggtaagcctagaatgtcaaatattggtttcagaaggttgggtttttttgctggtgggagttgatgctgcacacatttgttttgtagggggtgagtggtgcactgacagtgcttatgaaggacgcaatcaagcccaatctcatgcagacactggaggtgagcagagtgactcctgccttcttgaattggttttggacagtcagagcagagtggttataaagcacacttgcaaggcgcggtggctcacacctgtaatcccagcactttgggaggccaaggtgggcagatcacaaggtcaggagatcgagaccatcctggctaacatggtgaaaccccgtctctactaaaaatacaaaaaattagccgggcatggtggcgggcgcctgtagtcccagctgctcggaaggttgaggcagaatggcgtgaacctgggaggcagagcttgcagtgagccgagatcacgccactgcactccagactgggcgacagagcgagactccgtgtcaaaaaaaaaaaaaaaaaattaagcacacttaacctgggtagtcaagaccttctccacttgctcatctctttcttctcattcttcctcacacctgtgactgggacgttactgaaataaaagagatgactttatattttccctctgggaagtattcttccttccgattccaaatcaattccataccgttgaatgtgtgatcccactttgaagcaggattggcagctcagctcacggtgtcctggtttccacagggcactccagtgtttgtccatgctggcccgtttgccaacatcgcacatggcaattcctccatcattgcagaccggatcgcactcaagcttgttggcccagaagggtttgtaggttagtgttttttgcaaaaccagtgaatagactgtatgtttcttttaacatcaggggaattgggatggcatttttactgttgctttcctctttacagtgacggaagcaggatttggagcagacattggaatggaaaagttttttaacatcaaatgccggtattccggcctctgcccccacgtggtggtgcttgttgccactgtcagggctctcaagatgcacgggggcggccccacggtgagtggtgggttgaagtatctgattatcggcagtgtgctgacggccaaaaggaagttggatgacttctgcctgtttcttcattgagttgctcttatcctcgtgattaacaggcagcaaaagcaagggacgggcagacagcccttgtgttggctgccttatcactcacaggcaccgtcagcgctcagcattttaagagggccaaaatcggctgcctggcctacctttcggaggacatctgacaatatctaaacccctccaaggacgtgtactcggctagccccacaaaaaactgttttacgttcagactgttctttttaaatctgcatccctctgtatagtgacactggcaaccagccaaccaaaccagttagctgagacagaggtcagccccttcttgagtatactgttcatgctggacagggcctccacaccctagggagggagtgggggagaggagaatggcagatctgcccagggctgccctgggtaacagagaaacaggtggagactggctcatcctcacctccagcctgaattttgtatttctctgaattcctactgcttagaaattcctactactttttatcctagtattttaacaccttttctttagggcctacatgaaaagacatggtgctaggttttctgaaatcatttgaaaaactattaaattcctgtccaccaggagcttgtattataacttaggaaataaggactccctggcctacaggataaaaatcaaatttgttttggtcagggtttgtcctaatgtagcagttctctgttttggcctcagaacctctttacactcttgacagttattgagagcctaaaagagtttttgttcatatgggttatagctattgatatttaccatattagaaattaaaactgagttacatgtaaacataaagaactttgtaaacatgaaaatgcattatcttttcccagcaaaatttaggcattgtacatttttcagatcttctctgggtctggcttaattgaagacagcacttgatctgttgtgacatcacatgtctcataacctttggaaaagtccattatatgctcaatgagagaatgataatgagagtaaaagggccataagatgttacagaatcttatggaaatagttttgacttcatggaccccttcaaaggattgggtccccggagcacactgggaatgctgccataacaaccccagcacccctatccagtcttagttatccctgagtgccaaaggcactcccaacccagcacactcctttctgctagtagcacaggatagactcccttttttttcccagtcacaactaacattcctctctcttacacccctcactcaccctcacaccatcacacctcctttccttgcttcctcctgacctcacagtcaggataatgtcccataatgctgtgcatggaggggaacatttgcacatatggctctgtcaagagagtaggcctcct

SEQ ID NO: 75959 - DNA, 1137 bp, Homo sapiens
ccacacagccccttctggagttggagcacatagtctcactgcaatggaagagggcagagcttcttaatcactatccactgcccatggtggggcccatgaaatggacaccttcacccatttgctcatttctgtggatgcagcagggctgagccacggcatagatcaagactgggggctggggggcggggcggggaggcaccagacacctccatcctttagatatactctacaaaagagaaagaaaatccttctgtattgttttccctcttgtttgtattgaccctgcaccacggttcagctccaccaatgctaggttggcactgtggaccagttcatgaaaccatggcagggctcatcacgggctctatcgacagacatcccagggtgacttccgcaggcccgaccgcttcctctttccccacactccccttgacttccaaccccactgctatggccttcactcgagtcactgcacctgcttggtacacccctttccacctctcctgccatcgatccggtccttctcacctccttaattcaggtcatagaggtcttccacgctgcccaaagcagtcgattttgttctgtgctgtgtgattggtcacataccctaagtccttagggcaggaaataatcttatactactgtacagcctgcaagcattgcagcgtcttgcctttaacacatgaaaagcaccattttaagctaggagatttaaataggaaatgcctctgactctgtttcttttccttccaggtcactgctggactgcctcttcccaaggcttacatacaggaggtaacctgagttatttctcatcacgtgtcctagaaagcaccacaccttgaatcagcatttctccacctggcccatgtggaaatgaatgggttattgctgtgacccagggtgcagggtgccaaaaggcctgcagtgtgctgaggagttatattaaatgagtagatagggaagatgtacctcacaaaatagaattgtcccacatagggtgtcaataagccactgccctagaccagtggttgattctcaacagctgattttgaccccggggacatttggcaatgtctagagactttttttattattacaactggaggtggggagtgctactggaatctagtg

SEQ ID NO: 75960 - DNA, 1297 bp, Homo sapiens
attatccagctcaaatgtcggagtgtgaggctgagaaaccctgtcctagactaatagcagttcccttccattgtcttccctgcattggctgggtaagttccaaatgccattcagatcagaagcaagtagagaccttttttgaaatggcttctcctctgccgatttaaatccatattaacgggccaagatatatggtcaggattctggttgtttttctagacaaagcttcctggatatttatagcatcaaacaggaggctagagaacaactgtgagctcaaatcttttcatatttatgtcatttaccatcaaagaaacatctctaaagccagtttggggtggttacaggaaagacaggccatcagataaggtggcaaggtcacctgctgtcactgctaattcaatttttctgcctttttggaaggcttttaaattatcaagcaatacagggtcactgttcaggccccaaatgaagtatttcaaaactggctagaaaaaattgctggtaccttcagtctgcctgtcttctgagttatggtttgccttttatggtcatttgtctgattcacgcgtaggaggggaattcacagttctggccctcctgccaccccacagcctttcctgtgtctaattacagtgactgcccctagctggcccagctggtgtcttcatttaagaaattctacttatttaaaactgttcttgatcagcgttacatattaattggttttcatgtgactagaggtaaagaattagcagtgttctttagaagctcaaataaatcataatctcagttttcaattattaaaggaaaaaagcataaatcacatttataatgaacctagttgttttccaccttttatcctacctatttctgcttttttgggatcaacaaacattagtgctgggttttgctcgatgattcagtatatgtatttttatagaagactcttttatttttaaaatatttaatgtattgttaagcctacaatagtaatataccctttgtaaaaaataataattaaacattataagaatgtaatatatgtgagttgagtccccttaacagttcggtgcatatttctcgacatttaaaaatttttcatgaattatatacatgtatttttgtgtttgtcctaaaatggaataattaagctctccatggttttgcacctttagtacatcttggacaggttccatgttaacacagatgggtctcactttcataacatctgcatgataaatatttattgagtgtatatgtcataattcattggcccagtcccccttggaggagg

SEQ ID NO: 75961 - DNA, 2386 bp, Homo sapiens
tctgaggcttgatattaaaagaaagtgttcctggctgggtgcagtggctcacacctgtaatcccagcactttgggaggccaaggctggcagatcacctgaggttgggagttcaagaccagcctgaccaacatggagaaactccgtctctactaaaaatacagaattagccgggcttggttgcgcatgcctataatcccagctactcgggaggctgaggcaggagaatcgcttgaacctgggaggcaggggttacagtgaactgagatcgcgccattgcactccagcctggcaacagagcgaaactccgtctcaaaaaaacaaaaagaaagtgttcttaacccaatcatcaacctcaaactatttgcttatgtatatgtatataaaaaccatcttctgccccttttagggactctgacctagaatgtggctatgtcctggttaaatgtcctcacatgtgtccagtcatggtgtccccatctctttcttgtgcattagctcccagttgaggataaaatcaggatcattgcacagaagatctatggagcagatgacattgaattacttcccgaagctcaacacaaagctgaagtctacacgaagcaggtagatgtttggttagtttgtcctttcaactctttgcaaagcaggacttggagtcacaatctctgggtcctcccagccctgccaagtacccgttgcttcacttctctgggtggcagccttctctcctctgaaatactgagtttggattaggtggcacagtccctggttctttatttacccataggcgttatatgaatgtgtagaaatccatgaggaaatacagaatgtcttaccaaaatattgagaacgtctccagtttttgttattttgagatagggtctggctccattgcccaggctagagtgcagtggcacaatttcagctcactgcagcctctgactcctaggctcaagcgatcctcccacctcagcctcctgagtagctgcgcctacaggcacgcaccaccacacctggctaatttttgtgttttttgttgagatggggttttgccctgttgcccaggctggtcttgaactcctgggctcaagcagtccacccatctcagtctcccaaagtgctggaatttataggcatgaaccactgcacctgaccctctccaattttattctcatatctactccaaactattattttaaattagttttatgttatttccatagatggaaataaaatattcacttgtggactacagttgtgagtacctaactccctcacccaacagttctttttttttttttttggcttaataaataagctggaggacagcaagatagagatgtatataaagggagttggatgtttcgaataaattgaagaatccatgtaatcacagggcccagatggtcattgctgggttgtcatcttttcatttgtcctccctctcttcccttctttccccagggctttgggaatctccccatctgcatggctaaaacacacttgtctttgtctcacaacccagagcaaaaaggtgtccctacaggcttcattctgcccattcgcgacatccgcgccagcgttggggctggttttctgtaccccttagtaggaacggtaagtgcatgctgcaagggagtagtgggcgcatctgcacttctcgtctgaagtgtgttgccgaaaccatcaagcaaatgccaagtgagcagagttcactgcccagaagaaaattggaatcgggcctattatgattgctgtggatcataagctataaagcaggagctatatagctcttgctgtggaccatcttggtgtcaaatcaagaatgatgccaggactactcatactgaataaaaaattctgtttcccagggacagtatgctcttcactgaatctaggatgagcccagttgataggctggggtagtgctaacataatcacagttaatgtttattgggagccttacatagattaactcagtccccccacagccctaggaggtagggacagaggttttactgacaggcctagaacttacgtctgaaattcagggggttcattatttttaagtaaggaatttccccattaaaaaatgcaaatggacccttgagatatgaaaggtgaggttgcttatttacgcttcaaggtgaacaaggtgtccattgctttcttatcttacagattttatgcatattcaaagaagaatattgccagttgggaagcagaggggagggatgcttaaggacataatcatagtttgggctgacattgttccaaggttaacttggatcctgaatctaggttatcccctaaatctgccctgtatcctgtatctacagattgtactgccatgcaatacaggactgaaatattaaactaaatcaa

SEQ ID NO: 75962 - DNA, 1579 bp, Homo sapiens
cagtgtgcacttatatccctagacacatcctgttgaaactgcaaaaatatcaaacatgaaaatcctaacatctttctccagagacgaaaaaagtggcttgcctatgaaaagaatgagaactagacttaacgcccgtcttactggcaataagaagcttttagacaatggaggagtgtcctgtaaggtcacagggaagatgactttcaacatgtgctcacacctagccgaatctatctggatattttcagacgtgcaagggtttgccaccccacatctcttcctaagaagttatttagcaatgtacttagcaaaatgaggaattaaccaagaaaaaaggaagacgtgagttttgggaaactgaaccctcatttggacattagcgaaggggcattctgataaccatgcaaatgacctgaagttacaaatcctgtgtggaacaggttgggggagcacctgagaaaaactagaaaaagctagaaaagacaaggatatcaaagggtcatagtataaaacaaaagctcttgcattatttgagaaagttaaggtccaagtagaagcaaactgtagtttgatgctagaacactattctttgagagggtatgtgtgatactcgaaatgcagtcatggctcacggcttggtctggtcttgaacagtattcacacagtactatggaaataccatgcatcattttcaagtccatttatggacacgccctagaagagctggtggcaggaaaggatgtaaatgttaacagctttggcaatgtgagtgggtaatggtgcagtatggaaggaacaggaaacatttcagtgcttgcttagagaaaacatttatttcttgtttttccttccagatcaccatccatcttcaagaagctactttgaaagtctggccagtgtctattcaggcccactgggagttaggaagtataagtaagccaagagaagtcagcccctgcccagaagatctgaaactaatagtaggagtttccccagaagtcattttcagccttaattctcatcatgtataaattaacataaatcatgcatgtctgtttactttagtgacgttccacagaataaaaggaaacaagtttgccatcttggtgttgcaatatgaattacagccttaacagactgtgccacaggtctctgccatcctttgtgagctcatttgtcaggcagacccttgggctgaagatgcaagttgcagtgtgccctttatgatactgttgtgtttagagggaaatgtatgcatgcttgtgtatttctgagaggacacataattcaggggacctcctgagagggttgggttggaagttgatgacttaccttttaatcttatacctttctatattgttgaattttgtttttctaccctgaggaagtattgcttatacaagtttttgcctgaacttccttggaattcccatttctgtcacagctttagcactgtctatgtttagagtgctcaagaaggatggtcatgcagcattagccttaggtgagcctctattctgttggtgcagcaagtattcattgagtttcttctaaatgcctgggctccacccttccctac

SEQ ID NO: 75963 - DNA, 1017 bp, Homo sapiens
tcagcctcccaagtagctgggattataggcatgagccaccatacctggcccagactttctttttcctaaaacattaggttggtaaaaaccacaattacttttgcaccaacctaatattttttttcctcctcttctggctgggcgtggaggtggctcatgcctgtaatcccagcactttgggaggccgaggtgggcggatcacttgaggtctggggttcaagaccagcttggccaacatggtaaaaccctgtttctaccaaaaatacaaaaattagctgggtgtggtggcaggcacctataaccccaggtacttgggaggctgaggtacgagaattgcttgaacccaggaggcagaggttgcagtgagccaggatcatgctgctgcactccagcctgggagacagagctagactctgtctaaaaaaataaatcaaatatttttccttctcttcttgttctttatcttctatctctgttcttcctctcccatttgtttccttccctttttccccttgtctccctccactggatccttccagaggatgctgcatcccactggcgccagtgctaaacactgctgatgttggcaaagcagtatttttcccagtgaccttggttttattatttttaattccctaggtccatgtcaatgttgtaatacagtcaattttacagtccacagaaatgatagcgctgccttgagaggcatatggcaaaggggtcacagtgcagagccccagctctatggcagagagcctcacccacctccctgcctccacatcctcaccatggaaataggagcactgttggtacctacctcgtgagggcggttctggaattactcaaacacatcatctaagatgctttgtacagggcctggcacattgtaagcacttgtcagttcctgttgcacagcatcctccaggccctgtttgcagagttaattgcttctggtactttttttttccttttttttttttttttttggcagggggggtaggggggttgggacaagag

SEQ ID NO: 75964 - DNA, 1055 bp, Homo sapiens
ttaccacataatagaaatattgaaatgagatgtttaggagtctgtcattggaaactaacctggattgcgcaaagacaatcgtttgagaagctcacttgaatgtatctcacatactagaaataaaacgaatacccaaacagaaacttaactaacgagggaaaataatgcagtctgtagacaataaaactttgcagaatgtcagactgcaaatgattcgctcttaaccagcaagggtagctttatcgcctcaggaaatcttaaagtccctgtgctcatttcctgatggaattgcaagtctcatgtcacagaaaacaccccctttcctttttcccttgagcagccagtacccgaggaaagcaatgcatctttcccagcaccagatacggaccacgaagcttcctcctggaggaaggaatctcgaattctggcttgacgccccttatggcaggagacagagcgcaggataaagtactcaaaaaggaaaatgccgggggcgtggaacagataacccagcttcaggctgtctgcagaattataatgtaatggccagaaacccaaaatcacatttctcaaagagggataaagaaggaaaaaagccaccggcaacccatgcttctaagacaagctgtaacgcgaaggggataggtgggcagacctgatgagggtcgccctggccgcggattccagcggacaagcgacctcccgcgttcttactcccagcacctcagagggctcggataccccgtatccagtgggcacctcttgcccactccgcggtccgcggaccggacattgcccccgaccctcctcccccgcaggctccccgccctgcctttacttacgtagggcgtcggggtccttggccaacactgctcccgaggtggcggcgcgctcgcggggcccgccgcccaggcctccagggagccgcggtcgcacccggagcaaggcgccctctgcagagcccgccgccgggtgcgccccctccccaccgcgcggggacagacagcaggcagcgccaatgcgagcggagcggagcgggcgggcaggggcggggc

SEQ ID NO: 75965 - DNA, 1038 bp, Homo sapiens
aactgattttcagggttccagttccttctacagttcataaaattatgggttacccaaatgaaacttcagtgaaggatttacataaaaacaatataaagaatgagtccctttgcttattttagggcatccacccactaaaattcataggatctttgttggataatcacctcccatttccattctttggtgccatcataccattctaaggattaaattttcaatacacctttatattatctaagtttgccaattgcatagtttgccaacttatttttggcttttaaattagttcctgaaccaaaaaaataaaatataaagaatttcaaaagcttggttttcaaatgacaagaactcagtctactcgtggttcaattatgagttgataagtgccttatggttaaatgaccattaatcaattttttaatttttttactaatgaaacactgcagattagtatccccaaacaattcattttctgacgaaactcttaaagcccagtttcagaacataagctttaagcaacaagcaatcttgtgttaatctgagctctgttacagctctgccgtaatctcagccaaattgcttcatctgtacgtggtgataccaccatctttgtaatattgtggtgaggattagagatgtatgtaaaagtgcatgcactgcctaatacccaagaattgctcaataaatgtcagctattactactcttactgacttccaactatgtgcagattatggtggaaacatgtgatacagcagatacagtacttaaatgaaaatgtcaaaattgtacaactaatttaagagtgggaaatgacagtaatgctaaattttcctaagaatatgtatgaaaaatagcacttccttgatggaacatacatttttagaacagaaaccttatgttataatggtaaaactagagagtcaaagtctctagttctaactctggctatgaccttatctagttgcatggcttttgacaagacaactgctcccctctggagttcagttttgtcatctggctggatttgagtaatc

SEQ ID NO: 75966 - DNA, 1050 bp, Homo sapiens
acttcctccaatccagaagtgactgcatttcagtggtagagttttataaacttgacttaatctttagcacttctgcgctggaattgtaccttttaagttctagagatgataaatctctcatttgttactgagtaagaaatgccacaaatgtataaaagaattcttcattaagcttgttttttctgccgtgactctggagagtaagtcactgtagaagattgtttattttattatcatcagaggccatttcattaaccagctgttctattgacaactgaatagcattcttgactagagaagaggctgtttcaattaagagtgtttcatattgttctgaagttctatcctcaaaaccattatcattagcaaaaacccctacttgctcattttcagctgaaattaagaattgcttagggacatttttagattttgtaacatcaaattcactgatttcagtgtctgtaataataatagcaattggctccattcttttgctttcttctgatttggatttctcttcagtgatcccattttctttaaaatctgattcttggctcaattcagtatcttttggcttagtttcttcagctacaatctctgtactttcatagtcttttccatttggtgcactttctagggtactgttactggcttcttccacaatttgttgatctggaattgcaggtaaaggaggaacatcagaaagtactggctgctgatggtctgtttctgaagtttcaagtgggcttgcttgctggggttgaacatcttgtttttccttgatcgtttcaatttcttcaaggattagagttcccgtttgaatagcagaatgcccattatctaatccaagttctactgaaatcactttctctccagaagttgtgctattgctcacatttgattcacagacctcatcaccatctttccgtgagatgccttcacttagatcctgggttgacttagcctttgttgcctgatcattcaatggggtctgtgtttgtatatccaaaatttcagcttcttcctggactttgatgctgcagtctgagt

SEQ ID NO: 75967 - DNA, 1048 bp, Homo sapiens
cagacactgaaatcagtgaatttgatgttacaaaatctaaaaatgtccctaagcaattcttaatttcagctgaaaatgagcaagtaggggtttttgctaatgataatggttttgaggatagaacttcagaacaatatgaaacactcttaattgaaacagcctcttctctagtcaagaatgctattcagttgtcaatagaacagctggttaatgaaatggcctctgatgataataaaataaacaatcttctacagtgacttactctccagagtcacggcagaaaaaacaagcttaatgaagaattcttttatacatttgtggcatttcttactcagtaacaaatgagagatttatcatctctagaacttaaaaggtacaattccagcgcagaagtgctaaagattaagtcaagtttataaaactctaccactgaaatgcagtcacttctggattggaggaagtcagcacagattgcagtgtaaaatgacataacatacagggagttgctaaaatggcatatggagattggagtgctttgggggaggaaggtgtatttattgagcacttatggtatgccataagctttttaatgacctctgatataacaaagtctggtttccttttgataattcagctctgtgtataggctaacatcacattaagtttttaaaaacttattttttacagtgcacatatatgtttaaaatggtgaataaggtgagctacttttgtgaatgtgatttgtaattgttacattcctaagcagcaggcttaactcaaaaaatacattgcattttcccaatttcagcagatagtgtgcagaatatgcatattgatattaaacgtgagtggtttcctagtcttaagtctcttataagcgctatttggccaggggcagtggctcacgcctataatcccagcactttgggaggccaaggcgggtggatcagctaaggtcaggagttcgagaccagcctggccaatgtggtgaaaccccatctctactgaaaatacaaaaattagctgggcgtggtggtgcacgcctgta

SEQ ID NO: 75968 - DNA, 1057 bp, Homo sapiens
ttaagatttagagttctttaggttcaaattcctatgatgttttattgggtaacatgaactctcttatacataattcaaaatttcaatccatggtatattttatggtacattttgaaaagaaaatttgtaatgctccttagttacaaaaattagaaggaagctacataaaattcaggtgtcctaattaaattcaatttgattcaacacacgtattaggcataactcatacctaacactatttgataagggagacaggctccctgccatccaagaactcaacctagggagcagtgacaacagaaaccgggttgggttaaggcaaagagccatggataatgctgcaacatgagtggcacagaggggagtacacagagagagcaattaatttggtgtggggaaggtggtgatctgaatacagcagcagtttgaaagtgttccgtttttaaataaacagtatgcttattttgatttgtgactaggtgtagaaaaaagcctgcatagtgttacatatttatagtagttctttgtaaaaatgttaagtggatgagctattatgaaagtaaaagtttcattttttctcattaaaattagtactaaattactatggatcagatgataatattaaatagtactctgtagaaaaaaggtttcaagttgaattaatttatgtactgattattaatacagaataaatgttatattgactcatgtttattcagatcttttaaaagaactgtgggcaaactatgttcatttcctataactgtaaagatcacattgatggaactactgagttcgcactaccaaaagttctactctgctaattgggaattggacagagattttacaacaacactcctaaaacagtccttcagcaagacaaatataaacacctacaatgctgaactaattcagccaaaagggcagttctgaatttgatgacatttgtgaatttgacaaaagcacactgttttcatctcttgatatactcattattttctgcattaacctatgaattgttcatctttatgatttttcaaaagactaatcaatgtga

SEQ ID NO: 75969 - DNA, 1886 bp, Homo sapiens
aatttttataccaattctgaaaaagaaaatttgcgtggcatttttaattcataaattattttcctcctcaagtttcattgactttttttcttcacagcttatccatggttttaaggttgtatatattagatcttctcataagacatattaatatgtggctattaaaatgtaacattcaattactactgtgaacttttcacaaacgaaataacaatttagaaatcagaaatcaatgtagaaatatggaaaccttaaatagttatttatagaattctaagtttttccagttatagaatcagtaaaatcaaattgaatataaagtaaatgaaatctgttttaaagcatattctaaactatcacttctgcctacatttcacatgaattcactcctaccaggattatttttaaatattttcttccatataggaaattaatagttactttaatgcataactgtatgttatacatatgttataatgtataaaaatttattttaagatataccaaatcatgagtagttttattttttaactactagctccacaacatcttacctacatggcttctctttactttttaacattgagtatacctctttttttttttgagacagagtctctctgtgtcgcccaggctggggcgcagtggcgcgatctcggctgactgcaagctccgcctcccgggttcacgccattctcctgcctcagcctcctgagcagctgggactacaggcgcccgccaccacgcccagctaatttttttgtatttttttagtagagacggggtttcaccgtgttagccaggatggtctcgatctcctgacctcgtcatctgcccgccttggcctcccaaagtgctgggattacagatgtggtatatctcatttttaataaaaaaaacagttaaagggagaagagtcagagagacattaaaaaatatttaagaaacagtaagatatacacacatagataaataagcatgcagagacagagactgagctagaactgcattgactaaaaaccccagggttgttaacttggtctagagtgttttcttagacaccttaaaaagtaatttgagattttatgaccagaggtttacatgagttgaaagagaatgatgataaaatataaatcatgtttctaccctcagcgtcaggatttttggggcttcctgggttgattttaattttctaaaaatcactgaaaaagtaatttttcagtggcacagttttcacttttttcctgatccataaaaccagcaaagtggatacattcagtgttctataactacatttaagatccatgatgttagcttttcctctataaatcaacttaactctcttttataatggtgacacttacaaagctaaaaccccaggaaaattaaagttgatgaaagaaataacagattccccggctctatatacctgggaaatagctggttaagcttcaccacaaaggatagatctaaattgtttctgaaatgtttaaatttcaaaccccgcatagtcaaggataataaaacagactcatctttttttgccctcttgttaaattctaagcttcacgggcatttgaatacatctaaaaaatttggtttgtgagccttagaatttaaccacttacaaaactcttgagctccctccacttctgaggacgtttcctgacacattcaacagcatcagcgtccaatcaggagggagctcaaagagtaatccagctaattctaaggacacaaaggttttctctaggtaaacagtttaggtaaattacaaagtggtaagtttttcttgaggattgaatgaagaaagctactggatattgtgtaaggcagttgagtttctgccttaaacaagtgagtaaaggctcctatggttaagactg

SEQ ID NO: 75970 - DNA, 1051 bp, Homo sapiens
tactgtaagtaatgttgcagtgaacattggcatacaggtatctgtttgagtccctgtttttagttcttttgatcgtttacttgatagactgttaaattccttaagagcaggtacctattttattcatcagttttctaccgctggcatctagtatagtgcatatcacttaggagtcacttgattaatgttgaactattcagaatgtatgtctgtgtttcctaactttaggcagtagattgaatacatgaagactttttgctaggccataaagttggtataaaatgaaagtttaagcctttgttgccatgttttattaaggcagattgctaggttcgaacttcttaggaagaaattgctttagtctcagactatactgttaactgaaaggccagctaggttgtgtttcatttcttgtgggtctgtttttgtttttaacagtgaatgcataaaaatacaaccaactgacatccaacctgacatattcagctatttgttgcacattatgtacacggggaaagggccaaaacagattgtggatcatagtcgtttggaggaagggattcgatttcttcacgccgactacctttctcacattgcaactgaaatgaatcaagtgttctcaccagagactgtgcagtcctcaaatttatatggcattcagatctcaacaacccaaaaaacagttgtcaaacaaggactggaggtcaaagaagctccttccagtaacagtggaaacagagctgctgtccagggtgaccacccccagttgcagttgtctcttgctattggtctggatgatggcactgcagaccagcagagggcctgtcctgccacccaggccctggaggagcaccagaagcccccagtttccatcaagcaggagagatgtgacccagaatctgtgatctcccagagccacccctcaccctcatcagaggtgacaggccccacttttactgaaaacagtgtcaaaatacacttatgccattactgtggggaacgttttgattcccgtagtaacctaaggcaacatctccatacacatgtgtct

SEQ ID NO: 75971 - DNA, 2221 bp, Homo sapiens
cagctacttgggaggctgaggcaggagaatcgcttaaacccaggaggcggaggttgcagtaagccgagatggagccgttgcactccagcctggtcaacaagagcaaaactccgtctcaaataataataataataataataatataacttggggattattccacatcagtacattaaatatgtagttttaatagagtctgccttttttttttttttttttttttgagatagggtcttgctctgtcacccagggtgaagtgcagtggcatgatcatggcttactgtagcctcaatcttcctggctaaagctatcctcctgtcacatccacccaagtagctgggactaaagcatgcaccaccgtgcctggctaatttttgacacataggaagcactataaaatgttagctatatttattatattactgatcacttagctgtctgctgcccaagccactgccaatctttagacggctaaccctgcattacatcactgacctccttagaccttggtctggctggctggtgtggaaacctcattctctttttcagtgtctgctctttcaaaggatgttctcctggccacccaatgatgccctttatactacagctaccttctgcctaaagtaccagggctctctccacagtagggtagagaagatgatgtacagtctgccacctgcctgaaaccagggcacttctgaatgtttttgctgcttatactcggcttcttggccagaattctgcatgttcttcctcatataggcttccccgcagttgttccaccttgccttttacttcctttgggaacctacattataatatgcgtctgaatccagttgagatcagttctttcttttgtgtgtgtgtgtgtgtttttgagacagagtctcactgttgcccaggctggagtgcagtggtgtgatcacagctcactgcagccttgacctcccagtcttaagtgatcctcctgcctcagcccctcaagtagttgggagtacaggtgcatgccaccatacctagctaattgttttattttttgtggagatgacgtttcactatattgctcaggttggtctccaatacctgggctcaagcaaccctcctgcctcatcctcccaaggtgctgggattacaggcatgagccactgcgccagcttaagttctttctcaggaggctcttgggccacaagtaaattggggatgtggcttgacatctattttaagagttcctgagctactgtgatgataagtcccccaaacatttgatgagagttgggaagccagtatcccctgagcaccagaggatccctgaggaggagtgacatctctagctcagccaggataccgtgttatgttattaacatttatagctaacatcgaatagcagtttccattacaacatgattttcacataagttatttaactctgaggcaggaatcagtatctcattttcatttttctaatgaggaaacaagattagaaacattgtgttcacatagatggaaaaggacaggtctgtcttcatgtgtcactcataccaagctatcttcttaccagatgaaaaagggtcatattttatggttcagcagagtttatatcagttgtcataatggaggaatttagtgttagccgtgtttgcagtgaaagtaataggattgaaaacttgaataatttcatttaaatttagatctccttgttactctgtaggtttgtgtgaactgtagacaattttgtattaataaaaaataatgcgtatatacatacacacctatctacatttatcttgtcctttttttcagaaccacaatggacactgccagccatagccttgttcttctccagcagctgaacatgcagcgagaatttggttttctgtgtgattgcacagttgcaattggagatgtttacttcaaagcccacagagcagtgcttgctgctttttctaactatttcaagatgatatttattcaccaaacaaggtaaggatgtgtttttgtaaataagaatttttaatattgtgatttatataagctttattatagtatcattttggaaattctttgttacggagtcacactaagaagtaaaattataattttttttttttttttttttttttttttttttttttggcgacagagtcttgctctgtcacccaggctggagtgcaatggttcagtgtcggctcactgcaacctctgcctcccaggtacaagcgat

SEQ ID NO: 75972 - DNA, 1035 bp, Homo sapiens
ataagttagatactgtcattgtccatattttataagtgaaatggaggcccagagagttaagtgtcttgccaagaccacgcagctagtaaatggcagagctaaaattttaagctgtctgattttagttcaagctttaactaccacgctctgttctccctcccacagagtaagttaactgatcatgctgttcttactcaaacatcttacatagttcacttcaaacacgacactactttttagtcttatattctgtatgctttttgaactgaccacatttcattatttctgttactttttttttctatgccaagctgaatccttctgttatctaactattcatattcttcccagtaattttattcattttattttttctgcctggccttgtttcccatcaagttgcctgtgtttatctccctctgatagcatgttctctaactgctctgtgctactgaatgcatttatttcatattataattatggtttgatgttttatctttcctgtgagcctgtaatcttgagtgtagcatcttgtcatttttttctgtctccacgccttgtacaatgcaggcttttacacattttttctttattaaattgctcttcaaaaatatctgttgaataagtgaagaatttaactgttaccaacagaccattaaccataagattcctgtatgggtggcttattagtgtgctatgtctcatttccctatggttcagtagttcaatataatgggaagaactggtgaaaatgtttatgatccgagggtttggttttgttttttttttttgagacaacttatcaggctagtttaagatgcttcaatatgaaccatttcattgattctaagacacgtttttcacatgctgaaattgtcaatacagatttttagtttgttaggccgggcacggtggctcatgcctttaggaggctgaggtgggcagatcacctgaggtcaggagtttgagaccagcctggccaacatggtgaactcccgtctctactaaaaatacaaaaattagctgggcatggtg

SEQ ID NO: 75973 - DNA, 1062 bp, Homo sapiens
tgctaccacacctggctaatttttgtattttgagtagagacggggtctcaccatgttgttcaggttggtctcaaactcctggcctcaagtggtccactcaccttgtcctcccaaagggctgggattacaggcgtgggccactgcgcttggcctagcctctggtttctaatatcccctgcagtcagatatttggcccttgctgctttcctgtactattgtcagaggttaccaggaatcttttggtcagtacactcgacatgtttgtaatgggcctcacccccatgtttctcttcagtgttttgcaccattgccatctcctttctgcaaggtcattgcctttcctcaatgacgatgttttcttttttctcctcctctgtcttattttgtcttttctgttttccaaagattcattcttagcttttttccctcttatttcattctactttttagtctactttattattttcatacttggttacttcagccttgtcgtttcagaggcctcttctccctctctggctctgctctctctagagccctgtcctgcttcttgtccccgctgatcactaaacatttctacttagatacctggtagacacttggagctcagagtgtctgaagtgaaacccctattcttcttcttcttttttttttttttgaggtggggtctcagaacctcttatcaagacggtttctgtacttcttctctaatgttctgggactctgcctttatatcaacacctagcacatggcagttactctgaaaatgtaatctgaaggaatggatgaattcttccaattacccaagctggaattctgagactcacctttgatttgatctctgtggtgacaagtcatgtcagttttgtgtctgatgtatctcttgtattccttccttcattcccactgcgattactttgataccatagtaggctcctagccagtctttctccatgccttttcccttgctaatattttttatatgttgctgttagagcagtctttactcacgcctaatgatggtgatgatgataatgcctagtatttattaggcactaactg

SEQ ID NO: 75974 - DNA, 1013 bp, Homo sapiens
gagagaaggcaacatttgatcacagctgtgtgtgcctcactctgcctggggatggcctgtggtgattcatggactcatgttctctgttcacattactcaggttggtaagaattgccaggtagaggaaaggggagtgttttgcattgggctgatttaaaattatttgattaactgggctgctattttaggtttgtccttattaaatacttactgtatcatggtgggctatttttcatactttgttcatgttaatgttgttgcccagcctctgatggattgatttacagcagccaaacacatgaaaacaaaagcaaaccctcacctttatagagagtttcataatttataattaggaaggagtgggtatacttgccatgaagaccactgccaatatatccctgtgctgatatgggatggggttcctcttgatcagcaccaaagattgcatgctgaacatatggaaaggaaattggacgaaagaagggtcaatgaccgctgttttcagatgtggcatggaagagactgatactggggaggaagcggcagggtctcactccttagccatgtgtatttaagaagaatgaactgtgaagaagttgatgatgatctaaaaacagagccccaaaatagtacatagaaagttaattacaacattggttatttgagagtgttggggacgtgggtggtttttatactactctgtctttgaatttaaaatagttttcaaaataaaatttgaagattaaagaattaaccagattttcttttgtctatatgagatgcatgcagtcgtttttagagatgagttccatccccactttgaatctgaagtattagaagaggcatgctctggtggacagtggggagttagcagatggaaggggatttagggaagggactggacattcttcctgcaagatggagcagtaagagaatgatgagagcttttagattcatgaaaaaggtgactctaggaggcttagaatgttccaaaggggcacttcagctaatag

SEQ ID NO: 75975 - DNA, 1674 bp, Homo sapiens
tacaatgttcctgactgtttagaagacatccaggatgcagattgttctagttcaaaatgttcctcttctgcttccagcaaacagaacagcaaaatgatatttggggtaagaatgtatgaagatactgtggctcgaaatggcaatgaagccaacaggtggtgtgcagagccaagttcaacggtaaatacaccacataatagagaggctgatgaagagtctttacaattaggtaattttcctgagccactatttgatgtatgtaaaaaaagttccgtgtccaaattatctactccaaaagaacgtgtgtcaagacgctttgggcggagttttacctgtgatagctgtggatttggctttagctgtgaaaaattattagatgagcatgtgctaacctgtactaacagacatttataccaaaacacaagatcttaccatagaatagtagatattagagatggaaaagacagtaacatcaaagctgaatttggtgaaaaagattcttccaaaacattttctgcacagacggacaaatacagaggagacacaagccaggctgctgatgattcagcttcaaccactggaagcagaaaaagtagcacagtggagtctgaaatagcaagcgaagagaaaagcagagctgctgagaggaaaaggattattattaagatggagccagaagatattcctacagatgaactgaaagactttaacattattaaagttactgataaagactgtaatgaatccactgacaatgatgaattagaagatgaacctgaagagccattttatagatactatgttgaagaagatgtcagcataaaaaaaagtggtaggaaaactctaaaacctcgaatgtcagtaagtgctgatgaaagaggtggtttagagaatatgaggccccctaacaacagcagtccagtacaagaggatgctgaaaatgcatcttgtgagctgtgtggacttacaataaccgaggaggacctgtcatctcattacttagccaaacacattgaaaatatctgtgcatgtggtaaatgtggacaaatacttgtaaagggtaggcagcttcaggaacatgctcaacgatgtggcgagccccaagatctgaccatgaatgggttaggaaatactgaggagaaaatggacttggaagagaatcctgatgagcagtccgaaataagagatatgtttgttgaaatgctggatgattttagggacaatcattaccagataaacagtatccaaaaaaagcagttatttaaacattctgcctgcccttttcgatgtcctaattgtggccagcgttttgaaactgaaaatctagtggttgaacatatgtctagctgcttagatcaagatatgtttaagagtgccatcatggaagaaaatgaaagagatcacagacgaaagcatttttgtaatctgtgtggaaaaggattttatcagcggtgtcacttaagagaacactatactgttcatactaaggaaaaacagtttgtttgtcaaacatgtggaaagcagtttttaagagagcgtcagttgcgactgcacaatgatatgcacaaaggcatggccaggtatgtctgttccatttgtgatcaaggaaacttcagaaaacatgaccatgtacggcatatgatttctcatttatctgctggtgagactatatgc

SEQ ID NO: 75976 - DNA, 1031 bp, Homo sapiens
gactttaatagctctctaagaatatgacctctaaaggaaaagatgattttttacaatacatacttctggaactttgagatttgagaaagcttccatgtatattgataaatctaataaaataaagagatcaattataaacctggttgttctataaaagtagagtgcacaaaaaaatgtcttgtgttttatactgtctaagatttggaggaaatgtggcaaattgcagtttatcgccatattttattatcatttttttctgtaaaagactataaaacttgaggattataaaataatcacagagtatatcaatggaaacagtttatcattttttcagttaaagtagtagtattgttagttgttgctgacacagggtctacataattacatgtgaattaaaacattggcaaaactgacccaccaataaacacatctattgaatagaatgccttttaatgtgaattacttgcaatgtagtacccttttcataatgaaagggattttaattaactcctaattttaaaaatataaatttgtgattctgaacactaatagcattgctctttttgttcacatcatatttaaaatatgcaaatcatattttgtatacaatttacataaaagaacaagttgccaaaagaactgagagacatactggtgagtacagatttagttgaaagcattagagcaccatgtgagctcagatttgtggggatatgttgaagtgttaagtaaggataggaacagcacaggaaccaagtgcagaattcaaataacgggaagtaggcaggggacgggtagaatacacacaaaaattaaaaatttaacagcaaaagcaggaaaagtgattcatcttacccttacttagatacaatagtttatcaagtaattaaatttgaaatccaacttaaaatgaaatgtggtatgtatattactgataggaaccagataaaagttctctaacccagagaccatcagagagtggtataaagagatcagataaaccaagtttccaaactacagtatatagtatc

SEQ ID NO: 75977 - DNA, 1019 bp, Homo sapiens
ccccatctctactaaaaatacaaaaaaattagccaggcatgttggcacaagcctgtaatcccagctacttaggaggctgaggcaggagaattgcttgaacccaggagatggaggttgcagtgagccaagatcacaccactgcgctccagcctgagtgacagagcgagactccatctcaaaaaaaaaaaattagccaggcgtggtggcgcgcacctgtaatcccagctacttgggaggccaaggcaggagaatctcttgaacttggaaggtggaggttgcagtgaactgagatcatgccacagcactccagcctgggcaacagagcaagactccatctcaaaaaaagataataatacacacgaaaaatcatgttttactgtagctgaaaaatatatgaacaggatataaaaattgaataaaaaacatttgaaaattataggtgagatgagtagggattaaaaataatatgactataattatagaatgcctatggaacaattttatgaacatgccaaggatatgcctaaataattgagatttttgtaagtaatgatgagagaggaaaaagtaattgagatattatcttttatattctaaaaaaaagtaggaagagaagctggtggtggttgacaactttttccctggttaaacaatactcatttctctaagtcagtagttaaggaactttgtatttaataaatttctggaaaatcttccccaaaaccagtttagccattgtaatatttaaattaaacataaaacttgtgtcgttgttaacaaaaagccaaatcactaccaaaagaaaaaaatctgagtgtatgtgcacacatggttaagaataaagaaatctggtatacctaattttaactgggtttttatcatgaattaaaagttaaaacatttttcttttcttttttttttttttttttttgccattcatctattttgatcagttagttcctcaactttccttactactcccatctcctttgtaacatatacttctcagtaataaatgg

SEQ ID NO: 75978 - DNA, 1095 bp, Homo sapiens
agaattataaaatggcagtatttatagagatcttaaagataatcattagttgaatttcagtttgctcaagggccctcaaattagaggctgttattccatcttttcttcaggccaacattatctccttaagataatctacaacccttgtgaaggttgttcctgggtagagactgagaggattttaggaaaattcacgagttggggtttttttccctagtaattctgcaaaaatgtattattgctcagtctccttagggcaggtctaacacccaggcacatagttttaggccgtatcttattcacctttgtatctctagtacaaatattttcagatatgaatttgtttcaacttttggtctctgcagtgtcatttagtacagaaatataagaggtaggcagtgtatcttcctactataaagaaaaaaactaaattttttttttgttaaataatgtgtctcaggtcacttttaataaatactaagctagtgatttactactgctttccaggcactcttctgggtgctaggaattaattacagaggatttgacatatgttaaagctcttgttttttccaccatttaatctgtggagccttagtctttggattttaaaaatactttgaaacaccctagtatttataatctgccaaagagagagttcacttgttgaaaatcagcaataatttctatgtaagactaatagactttgtttcaactgttgatatggtttggctgtgtccccacccaaatctcaccttgaattgtagctcccataattcccatgtgttgtggtgaaagataattgaatcatgggggcggtttctcccatactattctcgtggtagtaagagctgatggttttataaggggaaaccccttttgcttggttctcattctctcttgcctgctgccatgtaactggtggtagtgagtaagatctgatttttttttcagcatccaaaatctttttattaagagggtaggatccaaggttagtttttgtagcctcggctggcctgtcggcctctgatgcactcgaacttccagcccttggagcagacatagggtttggtgtggctgtgcggggttcccggg

SEQ ID NO: 75979 - DNA, 1242 bp, Homo sapiens
ggtaaggaaaacaaaatcaccatcaccaatgacaaaggtcgtctgagcaaggacgacattgaccggatggtgcaggaggcggagcggtacaaatcggaagatgaggcgaatcgcgaccgagtcgcggccaaaaacgccctggagtcctatacctacaacatcaagcagacggtggaagacgagaaactgaggggcaagattagcgagcaggacaaaaacaagatcctcgacaagtgtcaggaggtgatcaactggctcgaccgaaaccagatggcagagaaagatgagtatgaacacaagcagaaagagctcgaaagagtttgcaaccccatcatcagcaaactttaccaaggtggtcctggcggcggcagcggcggcggcggttcaggagcctccgggggacccaccatcgaagaagtggactaagcttgcactcaagtcagcgtaaacctctttgcctttctctctctctctttttttttgtttgtttctttgaaatgtccttgtgccaagtacgagatctattgttggaagtctttggtatatgcaaatgaaaggagaggtgcaacaacttagtttaattataaaagttccaaagtttgttttttaaaaacattattcgaggtttctctttaatgcattttgcgtgtttgctgacttgagcatttttgattagttcgtgcatggagatttgtttgagatgagaaaccttaagtttgcacacctgttctgtagaagcttggaaacagtaaaatatataggagcttaaattgtttatttttatgtactactttaaaactaaactgaacattgcagtaatgttaaggacaggtatactttttgcaaacaaatgcataaatgcaaatgtaaagtaaagctgaaattgatctcaaagttactgtcttggagttttcaattttccttcctttatattttacccatattcgtcttttaagatgttagtatgatgtgaaatttatctaaccaatcttgtttaattcccagatgagggtgctgccttgaattccaacaacttaaggggagaagaatctgggtaaacttcacccacccttaaatacagaaacctgacttggggtcttcctagtgtactcacactcctacaacttaagtgtccaaatgaaaattcacctgaatattccaggaaaatatgagctatattctggggttaaatgtaaaatgagcctttaacaaaagctgggcagaagttgtcttataattgcc

SEQ ID NO: 75980 - DNA, 1070 bp, Homo sapiens
cataccatgcttccataggggaaagtgcatgaggaacagcctgagggaggaaatcttcagttctgttttgacgggtaagcttgatatgccgattagtcacccaagtacagatgtgtgcgtctagggagagatgagagctggaaatacagatttggaaatagctggccatgggaccagatacaattacctaagaagagaatgcagatagggaaaaaggtaaaggacccagctttcaggtcttctacgtgttagaatgggcagaggaggagcaaataaaatgcattaagttccttgtggtctccaacaacccaaatcagcttcagaatgtgctaacagccagcaagatatcaggaaaacccagagcatggggagtcatgggacaaaaaactgtgtcatcaagtagacaatgggaagctgagtagaaatgctgcagagagaaccagtaaggtgagaacagagaagcggctctcagacttgggaatgtggcggtcaaccatgcaggctcagaggtgtgcagccttcctgaaatgggctgagtagagaaaggcaggtgagaaagcagagaccaagactatggacaaatcagttccatagtccttggatttgccgagcagggaaggaaagaaatagcacagtagctagaaggcgttgtgggtcaaggaggtgaggagtttggggggttattttggcttttggcttctcagagacaggagatactagaacacatttgtatgctgatgcacatgacctagtggagggggtgggtgggggagaactgctgatgcaagagagaggggatgcttggaggaaacgagaccttgaggaggtgaggtttgggatggaaagcacagggtggggttgccttgaatgggaaagcagagcaggtgacgctgtttctccagttctcctgaggctcttagatgcccaggggacccctttatgtgcatcacttgagcaacacacagtccttgaattttcagtagaagaatcccaggtagcaaaaattcttaacccaaagaagtatgtccctaatggtggactttcagagactgcataacgaagacatagct

SEQ ID NO: 75981 - DNA, 1025 bp, Homo sapiens
gggtaggttccttaatctcaagctgcctcagtttccccatccaagaagttgggagggcaatagtctctgcctcctacgtgtgtgggaaggatggcatgagatgatagatacaaagccccaaggagtgtgtgattattggctgatcactaaggatctagaacagacccctggagaggatccttgactctattcccagccgtttaaaagactgtctcaaacttatcgttaaatttatagttctgctttgagtcaactctgtcaacaacacatggtgtctatgttaaacatctcactgacacaatattttaggcataatgtgaaaattgcctcattctatcacatttttatatcacaaaattatatatcttatacaccagctgtggctgccttgcacacaatacacatattcaatcacatggtttgcaaacccggatgtggcttatgagaatatttggttcttggccttttgattaccaaatgctccttatcacataccccagagcatatctgtgcctaaattttgtgttactgtgccagtttaattcaattcaaataaattgcattccattgaactgaacattattaaggacctgtgctaggcctctagagagacaaataactcttgttccctgcctttagagatttcacagactaacaaggaaaggaagaaacaaaaatagctccttttactatcaagtgatagatgccatatttcaggtgcaaattgctatggaagcacacactttgattgatggtttttgcctggggaaatcactaaaggctcacagaagcccacttacatgagcttgcagaaagtcagggagagaagagggcatttctcaaggtgaagctgagaggggggtctagggagtgagagtttctgccaagtccagggacaggcactcgtggctggagcacagagcatgatggtacaggcaaaagtcacctgccaatggtacatgggtcattcattccaggggctggttgcagcgggtgatactccctggctctgctagagccctgtt

SEQ ID NO: 75982 - DNA, 1003 bp, Homo sapiens
actaattatggcccacacccgcttccatctgttgtggtttctgagctaggaatggaagtgtagttggatgttttatcatcactttggaacatgggcctaaaaaagcacaaccttccctgtaatttccacccctctaggcttctgttcagccttggtttttgctgaaacagcacattaagcaaagaatagacaagatatgggtcattttcagaagtgccacccacctccctatcttattagaaaagccaatcaaatgacggagccagtttccatctttaatcatccatccatcaacaaggaagcagatatttaccccatacctgccaagatgccaagaggccgtgggagattcacaaaggtagaggtctgccctctgccccaagtagttcaccacctagactgtgcagtcagaacatagtctcagcatagacccatgaagctgatcaagaacagatcaatactcaacccaggagaagacgcacagcaatatggagttacatttgttgcatatgcggtggacagctttacaaactcagagcagtttgaggtcactgtggcctggagggctcatggaaggagaatcagaagagctctttgaactgagtcttaaaaatcaaggaagagaggccggtcgcagtggctcacgcctgtaatcccagcactttgggaggctgaggagggaggatcatgaggtcaggagattgagaccatgctggctaacatggtgaaaccccgtctctactaaaaatacaaaaaaaattagccgggtgtggtggtgggtgcctgtagtcccagctactcaggaggctgaggcaggagaatggcatgaactcgggaggcggagcttgcagtgagcccagattgtgccactgcactccagcctgggcaacagagtgagactccatctcaaaaaaaaagaaagaaaaaaatcaagcaagaggctgagcgtggtggttcacgcctggaatcccagcactttgggaggccaaggcaggaggataac

SEQ ID NO: 75983 - DNA, 1067 bp, Homo sapiens
gcaggtggatcgcttgaggtcaagagtttgagaccagcctggacaacatggtgaaacccccgtctctactaaaaatacaaaaattagccgggcatagtggtgggcgcctgtaatcccagcaactctggaggctgaagtagagaatcacttgaacctgggaggtggaggttgcagtgagccaaggttgtgccattgcactccagcctgggtgacagagtgagactccatctcaaaacaaaacacaaaaaaactcattggtaattttcctaatgattgtcgtttcttatgcaaaaattgtattaattttaaagttaattaaaaagtcaaacattcctaaaaagttttttttttttaaacagaccactttaacccctccaagatttggttggaggggcaggcatcaggcaggtaggagatgctaggaaatttgaggggaaacttttattaagtctgtcctttgcctattggctaactttaatggggattgctaaatgcctactgtgtgccatgcgatatgatagacactatgtatagattgtattatttagtattgggccattttatggacaggaaaccaaggcttagcacagtcaacttgtccaaagtcagctaacttacaagcagtagccaggattcaagaactttctgcttttctacttgaccacactgcaacataaccaacataacaaatctaaggtaagtgactagttgctggaaatcccccagtctttgtccgaggtctttattgaaatgcaaggacagaattatagttaattcctctgacttcctgggttctcaaatgctcccatgtgggaaatgctatacgtacaaggatgtcctatgactgtacctacaatcaggactggtgttcagacatggggacttccatgtggactagcaatgccatatgctattcaaaagggggatttgctcagcccatgggaaacacagtgaagccctgattccgactgcatgtccttttttattcccaacacacagaactcagtactctttgccctgttccctgtgcacctcctggtggctcttccttcccgctctccttcctg

SEQ ID NO: 75984 - DNA, 1081 bp, Homo sapiens
gtctcccaagggttttacaatttgctggctatgtcccacgtgtgtgccacaaggagacgttagataccaggagccattgttggatgtttaaaacaccctggtcttaatatctcagccccagagtaaacatttgccttaccaaatccgcagctatcccacggtcactgtttacgctggaagaggccaaaggccacggcctgcgggatgaccagggctggagggggaaggctcctctgttgcagaggtatgccttgcccgttctcttctcccagctcccagaaccttgtgaaggctccagctgtaagccaggggtgctgccacaagcccaggccgccctggccttggagggttaaaagtgaagccctctggctattctctgttgtgttgggggttgcagggactctgggagggtgttgcttttgcagctgcactgagggctgtcttcagctcctcatctgtgccccctcccccatctcaggccgcccctctggcccaggccactgctctgtcccgcctctctggccagctgcaagtccacaggcctttgttccgtggctgcaaacccgccctactccatcctccctcctcagcagaagccctccagcgggggccctggcagctggaaatcacaactgccaggaggaaggggctactggagcccccagcggacctggcagatcctcatttcctcttgtcaagctcatctgggccccacaactcacctctggccagattcccacaccgtcttttctcatctctcctttcttctgctgaatggacggatcaccttttcctcccagtactcatgccccttagttctattttaaagtactctattcattcatttaatagttaaggagttagcacctactatgtatgaatgccagatgcagaagacacagcagtgaagaaaatatacaataattattgacccagtggagctgactttagcagaagtgacaataaacaagattgaaatagcaagtgtgttagtgataaacagaaataaaaaatatgatagggaaggtaggtgtgaattgtcatggaaggggtgaggtgacagtttagatagggtggccag

SEQ ID NO: 75985 - DNA, 1010 bp, Homo sapiens
cagccccaagcatgttagtgttgggtgacctgaagtcaggagaaagaaaactggacaacgtggactaaactgatcagcagggggcccatctagagctgctggtagcccctctgtctgtcagctgcctggggataaaggttggccatgctaactgggttgctatctggggacaggaatggtgctggactcatctttgtgcccagacagcattgagaatggtacaaagtgtgatcaacagggagtgatgggcttcagccgtggtcccacccttagagtaatctgggcttgtggtctcatttgctacagcttttgttccatgggattagggagaagaaggtagtgttagggtcgagtccagccctaggtgggctgttgccatctgggaatgcaagcactagggagaagagggctttatacagttctggcggctggcctttggggagggagccctacgtaagctcaaggaatggatttttaaggacttgcactctctttcatgctgagcagacttgggctgaacacaacccaaatagggttctcgtgggcacagtggtagctgtgcatgcagccttttgtgaaacacagtttgagggtcctagaagttgatctgattattgccagaatcggagctgggactggaagggaaagatgcaggaggaatgaagtcgattttaccttgggaacagggtcccaaaaggagagatggtttctacaggtgccggaagctcttaaaaactcacatcctttacttcctaggctgtgagactgtgtgtgtgtgtgtgtgtgtgtgtgtgtgtgtgtgtagtattagaaaggaaccagtattctcatatagcttctattccttcagttcattgctacatccccagtgcctgttgtacagtaggattccaataagtatttgttgaataagtaagtaaaaccctactgtgtgacgagaccttaggaattaaggaaatgctcacactatgaatgttctgttcctgacagagaatgtccataagattcta

SEQ ID NO: 75986 - DNA, 1056 bp, Homo sapiens
aaggaggttattcccctgccctgtctcctccctggtgggcagcggaccccgaccctggcacccaccacttcatagttcagagcagcaggagtgtggaggtcggggcagatcgactgcaaatcaaggcctcacttttcaaggagtagacgctgcttcctcggccgtgtctctacacgtgtgcaccccagaattgggattgggtaatactgccccaccggtctgaattctggtccatgtacgctcccagctgaggcaggaagtgcccctcctctacccaggaactggttggatgagtttcttaggcgtctctggtgaggccccttagtaggggaagcggggaacatgggggatgggggaaggagctatgggtagagaggggccccctgggccctgtaggataggggaagtgtgtgtggccctgctggctgaagggctggccgcctttgggaatttacacgtgtgtgtgtgtgtgtgtgtgtgtgtgtgtgtgtgtgagtccataaggtctgctttggaaaatccactttcctaacttctctgggtcaggcaccaagcccaaggtcagagcccagggcaaagaaaggggatgtgttggagctcttctcttgctgtatcaccttcgaagaagaggcgaggcctgagggagggggaaggccagggttgtctacataactttctgggtttggatgctcatgcttggaattgggaagggagttgtgttttagggaattgccctggcagccttgcctccaagccaccattctgatgggcttgggaagggaaagtgagaactgggggaaggaaaaaacccttgggtagtaagatgcacacaaactcctcccccagcccagttgagagctgctggcctgaaattcctctgagagatttcttccatttaagaactggcatctcagttttctagggtaggtgttctcttcctgctcctagaggcagttaatttaaatgtagtttcatctcttgacgttcatattgggtctcatttcttccccctttgcaagggttggaatgggtctcattctttctagctaatgttcc

SEQ ID NO: 75987 - DNA, 3089 bp, Homo sapiens
gcccttagaagatcatggtctatatggatgttgagatcatagaagatggataaacacacgggtggtgggggaaggttaggtcatgctggttcaccaagtttaacttgtatcattattattaatttgagatgtgggtcaaacatggtaggtacaaggcagaaaaatctcattgtcttgatgcttgcagaacaaataagtgatttatccgttatcatcatcaccaccaccaccattctcggtgggcttactgtgtgtcagatgtacgggttacttacttgtgtcatctcaaccttggagacaacccagtcaggttggcagtattactgtgcctattttcctcatgaggaacttgatgcttggtgaggtgaagtgacttgcccaaggccacatacagccaggaaaagtggagggcctggaagtcaaatggggtctgcctgactccacagcctgtggatgagtttactgcatttgacctctgtgggctctactgcatctgtgcatattctcttttctgccgaggaagcagagggacccagtgggggcccctccacacccacttggttcccaccgagattctccagtgcctttgaacctgaggcagtagtaaaatgcagcttcctcctacccacccaccccgctccagcctagaggcctcaaaacaagcagcccctgaaatggggatgaggccggaaagatggcgaatttgcagggctgggttcttgaactttgctggtaagtagcagcggtcctgtgaacctttttgacctcaagatgagagaggtggggcctctgggaactttggatctgtctgtgatttccagggggtaatttctagtaacaccttttagggctttctttggctcttccggttttggggcacattgcatagtgacaagttgtgctggcagccaagttacctctacactggctgtgaacaagagcaatttataataaacaatacttgcccccatttggctttagcatatgtttacatgaaacttcctggcagattgcttttcctgggacatttgcagggagaccagatcatcacagccccttttctaaacttggctactttccccttcctcccagtctcttgtggctggtcacctagtatgtagcccagcggggcagctatgccgtgctctagctccctgtctggggccaagtaggatgggactaccggggtgaatgagcagtcatcaatcctggcgcttcttggttgatcggaaacttgctggcagtgactaatgtggagactcattaggctaggaggaactggctttggtcttgacctcacccactgtttacctttctcttgactgtgtgagtggtgagctcatcccggcgccatctcagagtccttccagcaggcatttattgaacacctaatgtgccttgctctctggggctgaagggaaggtatgggaaagaaggcccagcccactgggttttactgtattgtccagaagagatgcatgtacatatcaagccccaagaccaatgctttaagtgatagggtgtttcgagttcagaggagtatattacttccctattgccactgtaacaaattctgcaatcttagtggcttaaatcaacacacatttgttgtcttaaagttctggaggtaagaagtcagactgggtttgcatggctgggttccttctgcaggatccagggcagaatttgtttccttgctcttcctagcttcccaggctgcctgtatccttggcttgtggccccttcctccatcttcaaagccagcagtgtagcatcttccagttcccttctctctgtccctctgcttttattgtcaaacttctgtctgactctgactcctgccggattcctcttacgaggagccttatgatcacatcaggcccaccgggctaatccaggataatcttccatcttaaaatccttgatttgatcacatctgccttctatgtgtcccttttgccatataaggtgacattcataggttgagggtcaggctgtagatatccttgggtgggggcattattcagcttacactagtgtgtatgttgggaaatggttgaggaggcctttctctgaaggagatgattgctaaatgtgtataggcagagggtctggggacacattccaggtttgggagacaacatgggcacatgttgggtaggtggggacaggggggtgtagatgaacagccctccctctgagctaggtgcctggctttcctttccttccaaggtcaggccgagggaactttctggacttcagttgcaggcccaggctttctcctggagtccatgtgggagggctcccctggcaacacaatccttttccttcctggcagctgtggtcctgctgcaagggacccagccagactacatgggccctgctgctcttaggtggtgggaaaatgcattcctgagggaaaatgaatttgaaccagctgggctgggtttgggtggcccagaaaccttggtcacactgttggcacagcctctgcaggcagtcacgttgctcacatgcacacaaagtcactccccggggagccttctctcgcgctttattacggtgctcagggctgctgaatctccaggagggatgggaggggtcagagtgaggaaactgctgggaaagggggcaagggtcccctaggagggggtcctcccctcccccaggagagcccctagggtgcagggagcagtgggaacacacaggcaagagctgggcctctggggacagtttgggagccgggtggcccagagtggtgccgagctgtgggtaagagcacagccgagggatttcaccatcttagttgagatcttagttgagagagatctctctctggaagttcacattgctcccacactgttttttctggaaaagttatagcttttctctattgcttccttctggcaccctttttgaagggattccgaaagtgccgtcttggggattgtttgggggaaggacaaaagccgctgggccaccctggctttgagagcccttggaatgtttagcagatgatgtagttgagggatgaaggccacacaggagggctgcgccatcgccgttcctgagtgaggactttctttctt

SEQ ID NO: 75988 - DNA, 1024 bp, Homo sapiens
gattgatgactgactggattgattcatgttgcaagatggaagaggtcatggctggggcatacttaagagaactggagacccgtatgtggtaggatggggtaggcgtgggtacctggtttgagggtttggttgctgcctgcctcatcacctccttctctggcctcctacttccctagcagacagggtcttccgagatgtgtttgaagacctgagttctcatcctggcttgggggaatcttatagtatggagtggtgctcttcaggtaggaaggaaaggctgaccccgcccggggagcaccaggggaggcactttaactgtctctgtgggagtctgagctacacacacataatggttccaatccggtgtcttagggccagaatgcactccagctgagtgcagtgcactcagaatgcactctgagagcgatgcctcttatccgtcaccatcaaacggtgcctcctgacagtctgcactagtgtcctgctttgtactcagtgcctcatttgttcttcagccctccctttcttgggctcttggctcttttccagcaagtcctcctgcccaagagagagagagccttgtgatcgtgggtctcctggtcactacagggcttctctcgtcatccaagaagtttatagtccaatcctggtgacctcatactttctccctcttcctttctgcttacccatgacctgtgatcctttgaccgggaatctgtattttaccatattgttccagccagagaatgaatggccaaaggtcacatagtagcaggcccaaaaactgccctaaggaatcttgactcagtccttccgagtgtcatgtcataagccccaatccttcaggtcttcatatgtcccctgcagcttatgctgaagcaaagccatggcagccagggctgtgaccaatcctttgcttgtggccctgtctggtgtgtagtccattagggaggcagtgggcaggagagcatgaactctggagcctcagtgcctgagttcaagtccaggctctaccacttactac

SEQ ID NO: 75989 - DNA, 1049 bp, Homo sapiens
cctgcctgggaagatggctctagagagcctgtgccacagagactgaatggagtgaagacatgggctctgggcctggccccatgcatcccctgccctgttgtttcctggctgtgcggagcctcaggttcctcctctgtaagaggaagcgacacctaccttgtaggtgaagggcacggaagggcagctgtgtggctgccactgaggaagccctctgccccactggctcagggcgtggattagtttcctagggctgccttaacaaatgaccacacactgggtggcttaaaacagcaaatgtgttctcactcagttcaggaggccagaagtccaaaaatcaatgtgttggctgggttggctcccttcagagcctctgagggagtaggcattctatgcctgtcatccagcttctggggtcctggcagtctttgacattgttggcctggagatgcggcccagcaccttcccatcacctttttctttgtgtctctctgtgtcctccttctcctcttataaggacagcagccactggatttggggcccaccctaaatcctatctgaagtcatcttgagatccttaactaatggcatccacaaagaccttatttccaaataaagtcacattctggggttccaagtggacatgaattttggggtggacactgtctcacagtaggcaatgtccgtgaagtggtgttacagcagggccgaaacgaggtgtggctagggaaggtagtgggcagggttgtgccgggggctaggttctgaccacctccctccacgcaggactacctcttgaagatcattgacacacccgggctgctgaagccagaacaggtcagcgccctctttgggaacatagaaaatatctacgcgctgaacaggtgtgtgaatgggcctgacactcaccatgttctgcctgcgaggcccacctcagggcctagggaggaaccctggatgtccctggtctcatgggcctgtgacatgtgggcctggggcctgatctctgaggacagggaagggttgtccatctctgtgccctgggctgatct

SEQ ID NO: 75990 - DNA, 1032 bp, Homo sapiens
tatttttgatctcttcttagagccaagagtttgatatctacactcagtattgcaacaattaccccaagtgagtaattggggtgagagggaaggcagagccatttggtgagtccagagccccccacttcctcatccaggccttccccaggtggtgactggcccttctcccactcccagctccgtggccgccctgacggaatgcatgcgggacaagcagcaggccaagttctttcgggaccggcaggagctgctacagcactcgctgcccttgggctcctacctgctgaagccagtccagcgcatcctcaagtaccacctgctgctccaggtagcccctcggtcctcccaagcacctagggcctggggagggcagggccttcgggtcaggggcacctaagcgtctatcttctgcgcaggaaattgccaagcattttgatgaagaagaggatggctttgaggtggtggaggatgccattgacaccatgacctgtgtggcctggtacatcaacgacatgaagaggaggcatgagcacgcggtccggctccaggtgctctggggctgggacgctgggggaggggcagggctgggtgggccaggcttccgctgggaagagggactgtggccaccctgctgggatgagctgggcagtggcattgggggagcctttgtggcagggtttgcagagcctcctaaggccccagtggcctgactctagggattggggcccctctgctgcaggagattcagtcactcctcatcaactggaaggggcccgacctgaccacctacggggagcttgtcctggagggcacattccgcgtgcatcgcgtgcgcaatgaaaggacctttttcctctttgacaaaacactgcttatcaccaagaagcggggcgatcactttgtctacaagggcaacatcccggtaaccaggccctgccccatctcctctgccatcttctctccttcccaaaggatctgggctccccttcttgtctgcttcttggggctccagcaccacccttctgagatcac

SEQ ID NO: 75991 - DNA, 1135 bp, Homo sapiens
cacatggtaaggtaataaccaggtgtgtttccttccccttcaggccaaggaagccatcttggaaatggattcctattgtaagtgtacccttttctgcctgttttgtccctaatcgtgcacattgctaggtcaggctgcatcctggggaagctttacctgataattttattccaggagcagggagggcgggggtctcctgttaagggctggggggtgaactacatgattaaggatgctctcctgctgagcggtgggactctcagtgcctgaagctcccagctggaagatggagggagctctggaggctcctggccctggagctgggtgggtatagaggtctggctggttatggacagggtctagggtaggccaaggccaattgggaatcaaaagcttgatcgtctctctcctgggtgcagatcccaatcggtaccgctgcagcccagagcggctgaagaaggcttggtcctcccaggatgaggtgtccaccaatgtgcgccaggggcgccggcaatctggtaagagaagggctgtggaggcaggaggcctctccctcacacccttgcccagactggggaccgtctgcggcagtgtccagggctgtggctctcacctctgcggaaaccctgggaaaggctagagcggggctggacacacacctggggctcatcctctccctgtgctggtgctccccacaccaggtacccctgggccctcgttgcctaccaggtctggagcccacctttttcttacttttttcttttcttttcttttctttttcttttttttttttttttgagagatggagtcttgctctgttgcccaggctggagtgcagtggctcgatctcggctcactgcaacctctgcctcctgggttcaagcgattctcctgcctcagcttgccaagtagctgggactacaagcgtgcaccaccacacccaactaatttttgtattttttagtagagatgggatttcactatatgttggccaggctagtttcgaactcctggcctcaggtgatccgcccgtctcggactcccaaagtactgggattataggtgtgagccactgtacccgtccagcccacctttttcaaggccctaggaatacttgctcgctccggccttggca

SEQ ID NO: 75992 - DNA, 2435 bp, Homo sapiens
tatagtcctagctactctggaggctgaggtgggaggatcacttgagcctggaaggcagaggttgcagtgaatggatatcgtgcccctgcacccacccagcctggctgacagatgagaccttgttgcaaaaaaacaaaacaaaacaaaacaaaaaaagaaatcaatctgttgaacttgtgggaactgtagaccacaaaaagatcaggaaagtcactagggagggacttgggccacatgcaggcactttactgcctgggctcagccatctactctgacttccttgaggttttttctgcttctgcttcccactcagagagctgagatgagctgacaagtgtattctattgataattaagttctattgtttaatttaaattatgtctcacttattaaatattcttgataagttttaaaatgaaagaatagaacattttctacttttcactttaaaaacaattaggcatttacttacattgatacagatagtgtatgtatgttgtgtgtgtcagcagaaaagaggttcttcaacaggcctgcctgctgaggaacagcaagataccttggtagactttccttctgactccaggtgtgtagcaaatcatggcgatccctgggcctcccacttaccgccagctgggcaaggatatggataggcgaaggccgaggctctgtagaactggaccttgagacaaggtcctcttattcctgccctccagtctcaggtgtatcctcaaaaaggctggggtacacggtgatgacaccattggcctaatggatgtgttttgtatcctgtccccagagcctggtcactctccgtacagccgggcaactctccccagcggtcagcgaggcttcgtgatgcccagccttaagggccgtagaaagtcgggtgcgacctctgctttccagctgggatgctgtgaggggcttggcagtgggtgtagctgatgcgctgatatgctcattgccagggaggcaaggggcttgaggtggagccagggacctccggagatgttgctagttggtctgaagggggtagcatggaactgagtcccctccctatggctcctgcgcgagggccctgggccaggtgccctaatgcattgcatcatgggtggtactgctccggcagggctggtagtcacagcgggggtcctggagatggatgggcccgcctccctgtccgtaggtgcaagggggctcgccgacactgtggaaggcagcttccctggggcctatgactgcagggggccaagccagagtggactttgagctggtgatgggctggtggcgctgtgagcttgggacccagccaggcacagcagtttcctggcccgcgctgactctgctcatgctttcctcctcagagccaaccaaacacctgctcaggcaactcaacgagaaaggtgagtgtgtgaggtggccagccattcccagtgagcgggggaggaggagggaggaggggaagcagccgacaacctggggtgtgacctgagggtggaggattgtcagaatagtgtagagggaactctgcctccattccccccagaagagggcctcgcccctggctggctgaggagaggggctggagctctcccccatgcacaggcctcatgccctttcctccggaaacaatgagagccgagcaacaggcacagacctgcgctgctctgtggcccctgggcccctgctctgtcagtcattcttttgaaagcccaggagactaggtgagggttctgggagcaggagcccccagtgaggacttccccagggagctgtccagaggtctttttcctgcttactgatctcttcccctcccctcccctgcccctcgcccgtgtgctgggggacccggtggtgatgtctgcagcccgagcagcaggaatgaaggtaaaggccagtgggaggaggggactggctgacagaggagggtgggactgcccaggtcagcccccggccccttcagccctcattgtcttcattcattcaacaaatgcctactaagcacccactgtgtaccaggctgtgtggcttagggccacagagatgaataagacatgggccttgccctgggggcccttctgcaccctctgcctagaacagcaccctgctgggggcctgcccagtgtggacctactcagatttccctctccctagggtagacaagtaggcaggcctgtttgggttctgaagttttgaccaggtcccagcctttccaccatgagaatgcccacccctccctggaccccagtggcaacctgagttgggcatctaggtgtggctttctgtgtgaaggctccccccccgcagctgcctgcaggaggacgggaggttgcccaagaggctggtcacgagggggtcttgtgctctgaacagcatgcaggcagtgctggaaccctcctggactttgggcagccctcccgtactcggggcct

SEQ ID NO: 75993 - DNA, 1116 bp, Homo sapiens
ttcaggtctctctggaggacctgacagggcatgaaggcaacgagaagggggctgggccggagcccccaggctcagaggaggaggaggaggagcaggaggagagcctggcggtggcggagcaggtagccgactttgccagctccctgctggccgccctccactgctggcactatcgggccaacgctttacttttctcccggggcgctatggtgaggtgtctcttcgatctcccctcctccttgcatgctccctgggatgtgcatgcccacccgagggccccctctgctgccctcctcaccccaccctgccctggttttactcctcccctcagcacttaacaccatcgctcgctgtcacaccctggtgagcccctggcatgctctgttccagtactgggcactaatcaatataacgcccaacaagcatgacaagtggggtggggtggtgggggcagggagaagctagcacacagtggggctggaaaggtcaagtccactttggagggacagaaaggtgggctgaggttttttgaagctgcatgcctgacaaggctttccgcagccccaggcctggcagttcaggttggctctggaatggctcaggtccaagactggctctcagctcagcccagccccttggggcgtgggaggcactgcccgtgttgggatgcagaagggatcagcttccagttgtcttggagttgatgactgacctctacctctgcagggaaaggggcgcagggagtctgaaagctccaggagcagcagaaggcccagtggccggtctccaaccagtactgagaagcgcatgagcttcgagtccatttcttccctgccagaggtgagcgaccagcaggtgggatggggatagtaggaagaacttggagtccagattttcaagtctgcaaatagggctttcaggcacaggctctcccactgggcccatgggaacagagattccccacctcccaggactctcagccctgcatgaagcctgtttggcctagagtatatggtttggtgagcagaccacccctttctatgaagtagagaaaggctcccctttgggcagatgcagtcccatgtcaagggcacgcagctagtggaaatgaaccag

SEQ ID NO: 75994 - DNA, 1052 bp, Homo sapiens
ggacatcagtgtgggggtggccacagaggacagcccttctgtcaatgggatggagcccccaagcccaggctgcccagtggagcctgaccggtcttcctgcaagaagaaggaatcagcactctccacccgagaccggctgttgctagacaagattaagagctattatgaaaatgcagaacaccatgatgcaggcttcagcgtccgtcgccgggagagcctctcctacatccccaaaggactggtaagaaactccatctccaggttcaacagccttccccggccagacccagagccagtacctccagtggggagcaagagacaggtgggctcccggccgacttcgtgggccctgtttgagctcccaggaccaagccaggcagtcaaaggggacccacctcccatctcagatgctgagttccgcccatcttcagaaattgtgaagatctgggagggaatggagtcttccggagggagccctgggaaggggccaggccagggccaggccaatggctttgacctgcatgagccactcttcatcctggaggagcatgagctgggagccatcacagaggagtcggccactgcctccccggaaagctcctctcccactgaggggcgcagcccggcccacctggcccgggagctgaaagagctggtgaaggagctgagcagcagtacccagggggagctggtggccccactgcacccccgcatcgtgcagctctcccacgtaatggacagccacgtgagcgagcgcgtcaagaacaaggtctaccagctggcccgccagtacagcctccggatcaagagcaacaagccagtgatggccaggccaccactgcagtgggaaaaggtggcccctgagagggatgggaagagccccactgtgccctgtctacaggaagaggctggagagccattaggtggcaaaggtatgacagaagcggcaagtgggcccttccccaagtctagggactgaagagtcaataaggagccacttggctcctcggggaaagtgacctctaaggaggctctaccaaagggagaagctg

SEQ ID NO: 75995 - DNA, 1829 bp, Homo sapiens
cccctcagccccacagagaccttcagctggcccgacgtccgtgagctctgctccaagtatgcctcccgcgatgaggcacgccgagcagggggcggccggccccgcggcccacccgtcaacaggagccactcggtgccggagaacatggtagagccacctctgtcgggcagggtgggccgctgccgcagcctgagcaccaagaggggccggggaggcggagaggctgcccaatcccctgggcctctgccccagagcaagccggatggaggcgagaccctgtatgtcactgcagacctcaccctggaggacaaccggcgggtgattgtcatggagaagggaccccttcccagccccactgcagggctggaggagagcagtggccagggaccaagctcaccggtggccctgctggggcaggttcaggacttccagcagtctgcagagtgccagccgaaggaagagggttccagggacccggcagacccgagccagcagggcagagtgagaaaccttagagagaagttccaggccttgaactctgtcggttgatgctgactcctgggggagggaggagtcatgttggaggttggggaagaacctgggcatccttcccctcaagcctgggctcatggagcccctgcccagggccctcaggtgggcggaaagtccatcccctccgcccttcaggaaggatgctcccgtgtgcaggggtctcctgcctgtgccatccactggggctcgagacaatttcccactcacctgtgaggccggtgtggctgcttcccttgtaaatagttgttctctggtaagaagccaaatatttaagctcacttcttcccagagagaggaagctctgctcaggcctccagcgttggctggccatggccacagccagatggaggagcccatccccaggagactcaggcagtggcctggagaggctttgttctgtaacggtgccttttcttagggtccaggcaggaatgaagccaataatttattgctttccattctgtggtatgatgtgcgtgtgcgtgagtgtgtggcccctgtttattcccctcctgtcaagaatgaagtggattcagttcaggtacttttgagggttgttgtgctgaccctgtggttgtcgctgatgtacacacatttcattatttgccaatggtgcaataaccactgctgaccaacccactatgtgtgaactccttcctaggcttggctggggtagggaaggttattcatgggccagggatgtcttagggagatggagacatggaggttgttccttccacactcaattgtcacttgggcttatgaaacataaggcacccgggtactggtgggggaggtggggcaggaggatgtgagggcgggctttttctttctgctgcctagactcccatgggcttctctgtctagcagcagcctgctgtcctgtctagggtagggggtcccgcatgccagccttttgctcttttccccaagggccagagttggaccaagaaaaagggaggtggtgaggtggatagactgtttttctcataagcagatgctcccagtatctggtgccttttgcgtttctctccggtccccaggaaacatcctagaagacaaggattttttttttttttttttttgagacagagtcttattctgtcacccaggctggagtgcaatggcgtgatcttggcttactgcaacctccgcctcccaggttcaagcaattctcgttgtctcagcctcccaggtcgctgggactacaggcatgagccaccacacccagctaattttttgtatttttagtagagacggggtttcgccgtgttgac

SEQ ID NO: 75996 - DNA, 1343 bp, Homo sapiens
ctgccagaccaggggctatctctgccctgcgctgcttctgctcaagagaggttgtcactagcctctgatcttcccttgaagaacccgactggggctcttcagagggtggggcccaggaagttgtagttaaccccttccccaggcagtccttacacggccatctaggtatgcctgggaaccttgcaccaggtcggtggttctcactggctgcccattggaattatctggggagccttctggaaacgcagtgcttacattccatctccctagaccaacagaaactgccctctggaggtgaatcccaggcttagagattctgatgattctgcggtccagtgagtgctgagatctgtcctgagctctgtggggaggggcctggactgatcactgcttggaaatgattttgccctacagtaggccttcaagttgatcaaatgcatgaatgagcaagcttttcttggagtttgtgatgaagcccaggaaccgggtgcttgcagtcgtcccataaggctcccagggacaagctagagaatctggctgtccctctgtctccatggtgccagccctcttaggctcagttcaaagggagaggaggctagttaaataagaaactgagagaaacatggagcattattgatttattagaaaaactagtaaatgggtttcctctggttggtggaagcacggttgagcaggtggaggacaggacccagctggccccagggccagccccagattgcatggtctgtgcccaacagggttgcattcctctgcagccgccgcctcctcatttcctccctgagcttgtttgtccaagccaccaagccatgtggtcccgctggcttcatcctcctctggattcctgcccccctcccatgaagggaggaagaggattcagggtcagcctaggggaccctggctccctccgataggcaggaaggaggagggatgcggaggagaggctgagccttccacgggcctcctgttaggggtgttggtggaggccaggttggggagggaagcctaaggaccctccacacctcccacagccagagtcagttgaggctgggacaaaggggaaggagagagggaaggaggaccgcctgaccttgcccagaaggagcttcctctaaactgccctgggaaggaagcctggtatgctggtgtggactggagctgtgtcaacctcgtttgggaatactgtcaaaagactgtagagtagaataaggagagaaaaaaaaaaaaagaccttgctagggcactgggagagcttagccctggtgtggcacacacagggtctcccaaagctggatgcctgcattttcagtctagttggtcgaatg

SEQ ID NO: 75997 - DNA, 1027 bp, Homo sapiens
taaaggaacaaattttacaaatagggctcatgtcggccgggcgtggtggctcacacctgtaatcccagcactttgggaggctgaggcaggcggatcatgcggtcaggagttcgagaccagcctgaccaacaaggtgaaaccccatttctactaaaaatgcaaaaaaaaaaaaaaaaattagccaggcgtggtggcacgtgcctgtaatcccagctactcaggaggctgaggcaggagaatcacttgaatctgggaggcggaggttgcagtgagccaaaattgagccagttcactccagccggggtgacagagtgagactctgtctaaacaaaacaaaacaaaacaaaacacaaaaaaagacaaatagggctcatgtcaactggcatgtttggtgagggaatcaaactgataacaggtgggctagcccgagccgcttcactcacacgtgggaagcatgttgctgcatttctacagcaacagactctgtttcctcctcctcttcatcctcctcttctgtctccctcctctcctctccctcttctcccttacttttgagggcaggaaggtggagaaactagtagggcacatagggaggaagttctggaaggtcagagagagaaactgacccatacaaagctggctgcaaagccattttacgaagccccatttctgactccgcgctcagggatctttcctctggcagaaaggcagttactaagaaggagctgggtctttggagaaagagcttgccttgaacaaatgacttaacctttccgagactctgttatccccttggaaaatagaaacatcaatgtcacaggattgttgggaagattttatcagtcctaatataatgcctggcacatagtagatgctcagtaaatgttagtttcccctttctgggtagactctccatttaagcaataaataaacctcttcagggcaattgggcccccaaatggttcctttttggaatttggaatccctttcgtgagtcccccagacacatcctgcatgctcatgctgc

SEQ ID NO: 75998 - DNA, 1059 bp, Homo sapiens
aacataccctgcctgcctccaagccccaaggctagatccaggctgtagtgcagacgggaccctgggatgccaggtcactccagaaagcagctgctgggtgccccctcgttatcagccttctcgtcaggaagtcagggaaagctctcttccccaagggcagctcacagatgccattcttccgcgtggccttccagcactgcctgtgcagccagcagccctggagaaagggactgagtatctcgctagggctgaacgtaggagctgagactcctaggtcccttgcgtctccattcccataggattaaaggtttatgtggcttcagggaagtaaccagcacttacgaacgtgaggcgctgagcaggcactggacttgtagccaagaccacctcttggccggtgtctggctggctccagctgctgctgccccttggcaacctgagcacctcccccagcagcagcctccctggcaggcagccaggagctttaatcagcagccagtggtggggctctgacgtccttggatggaagagatgtgggtgtggagacagcagctgtgtttcttctcgcctgaacaagctctcccagtctttccttctcctcctgctactctttcagacattttgcagtgaatgcaaatcctatgtttgttggtaataggcagacccagctggaaacaacatcagttttccccaaaacctgggcatgttcctgtctacccagtatgcctgagtcagtgtggcaggggtgtgtctgcctatactctggcactgcgcctggctccctggagaaacctgccgtaggctctttctggacacctgcccgctgctgggcatgtccctttctccttgctgtggtcagatttaatattcctggcccctctgttctgacgactcttcctaagttcttcctttccagctgtgtttcagaacatcctagatactgatggcctcaggatgagactcagttaacattggaggcatctcagaaatgggtttgaagtggacgatgtgaccactgggtggcagatctggatgggggagtcagtgtcttctaactct

SEQ ID NO: 75999 - DNA, 1968 bp, Homo sapiens
gggagcagtggctgccaggcgaggccccacctcggagccacctgaacacggggccccacaggccgttctgcctggaacctggctcccttctgaagaatctgccttggcttttccgaagaagtcgctgggcggctccttgccaagcaccatccaggctgccggctgactggagggggagctatttggtgctcctccctgtgggcgcaggtgaaaagccaggcctcgcaggaggcactggcctcagaggggtgcttgtttctaaagagagactgtgtcttccttaggcctcaagaggaggaaggcgagacagcaggggaggctccagtttcccaccatgcggccaccgagagaacgtccccggtcagtctctggtctcgtttgtctagttcctgggagtcactgcagccagagccctctcacccctactaggctcagcccaggtggaggcgagatgagctggcgcagccccgccctccatcctccccacatccctgcagccacctcccagcagagcaggctacgtcctcactgaggtgttcttcatgagagtactagcctcctccactcctccccacagcgcagaggaaacaggccagcccagtgacatgacgttattagttttgttttacctaatgtaataaattttattgtataaatatatcaccatttacatgaggggaaacactagccagagatgattagtgcatttctgtacaccgtccttttccccattttccaactccttcctctaggcagtactcaccccctgcacccacacctacacacaggcacatgcccacacacacatgcatgcacacacaaatacacacccacatgcacacacaccacacacccccatatatacagacacctcacgcacaaccacacacccacatacacatacacacacacatacacatacacacaaacacaccacacccacccacatgcacccacaccacatccccatacacacatccacacacacccacacacgcatactcatacagaccacaccccccatacacacctcacgcacacccacacacccacatacacacatatgcacacacaaatatgcacacaccacacccatccacatgcacacaccacaccccatacacacacatccacacactcacacccacacacatacacactcatacacaccacacccccacacacacacacatgcacacaccgcaacctccacacacacacacacatacatgtgcacacaccacacccccacacacacacacactcacacacacacacaccccaatcactcagctgtcccatcccacctgccccaccacaggcatcttcagtggtgaagtgggggtgcccatccttgtaggcgattctttccccctatgcagagccctctcctctttccaccgatctggcctgaggcctgtgggtcagtgagtctggatatggagctggttctggggcaagaacagacttgaaggaagcctgcaaaattgaggagaatcccagggctttgagtaacagaggtcagccccccaacttgtcggaaaggaggatgagccagaggcctggctcaagggacagggagagcccaagacagcagctgccagaggcctagggcatgcgcctcaggaccttacctggagcaggccccttaggactccatggggtctgtgcagggagcctgggaggctgtcacccaggcttagggagctgctctggggagcagctgaccgagaagaaagcaagaattcagcacacggcttgcacggcttccccctgcatgtccccgctgtggcaggctgcactgggggccaagggagccacagatccttcctgcagcccacctctccaggtgtcccgtgagcccgcctgaacctgggggtgaggttaggaagactggcattccacatggaagtttctggtacaccagtcacacccagaaacatatacagatagtgaggcctccctttt

SEQ ID NO: 76000 - DNA, 1019 bp, Homo sapiens
gtatgtgtgtgtgtgtgtggaggttgcggtgtgtgcatgtgtgtgtgtgtgggggtgtggtgtgtatgagtgtgtatgtgtgtgggtgtgagtgtgtggatgtgtgtgtatggggtgtggtgtgtgcatgtggatgggtgtggtgtgtgcatatttgtgtgtgcatatgtgtgtatgtgggtgtgtgggtgtgcgtgaggtgtgtatggggggtgtggtctgtatgagtatgcgtgtgtgggtgtgtgtggatgtgtgtatggggatgtggtgtgggtgcatgtgggtgggtgtggtgtgtttgtgtgtatgtgtatgtgtgtgtgtatgtgtatgtgggtgtgtggttgtgcgtgaggtgtctgtatatatgggggtgtgtggtgtgtgtgcatgtgggtgtgtatttgtgtgtgcatgcatgtgtgtgtgggcatgtgcctgtgtgtaggtgtgggtgcagggggtgagtactgcctagaggaaggagttggaaaatggggaaaaggacggtgtacagaaatgcactaatcatctctggctagtgtttcccctcatgtaaatggtgatatatttatacaataaaatttattacattaggtaaaacaaaactaataacgtcatgtcactgggctggcctgtttcctctgcgctgtggggaggagtggaggaggctagtactctcatgaagaacacctcagtgaggacgtagcctgctctgctgggaggtggctgcagggatgtggggaggatggagggcggggctgcgccagctcatctcgcctccacctgggctgagcctagtaggggtgagagggctctggctgcagtgactcccaggaactagacaaacgagaccagagactgaccggggacgttctctcggtggccgcatggtgggaaactggagcctcccctgctgtctcgccttcctcctcttgaggcctaaggaagacacagtctctctttagaaacaagcacccctctgaggccagtgcctcctgcgaggcctggctttt

SEQ ID NO: 76001 - DNA, 1136 bp, Homo sapiens
gcacggccgagtccttccaccgggtgcacacagccttcgagcgggagctccacctgctgggtgtccaggtaccttcagccccctgccgcccacctgctaccaatttccaggagccctgggtgtcagtccccacctggctgtcagcaggaaaacctctaggataagtgccaggaggttttgcctccttagacagccaggagctcagggctgggagcagtggctttcagatgttccttagcttcagaagtcattctttaaactgaatcctcacaaaaggccaatgcatacaatactatacggttgcagtttctccagttgtgcagtactattagtggacacacgcacagcacttttctagcaccaggtgctcttctgagcaatgtatgtagccgctggaccctcatggcagtcctctgaggcagctactaatattccctgcactttgtagatgagaaaagggagaggtagaagacccataagtttcccaggaacatgtaggtacgaagtggagccagggctcagaccctggcagtctagctatagaccccacatacttagccaccgggcacttcagcctttccacatgggagctggagagcccccaagttctactgttcagacccctgccccatcactggagtgccctccgcagatccgtagggtgccccagagcttggtgtgatagaaagggcaaatgcaagggggcccctgttgctgagggctcccccagcttccagtgcagcagggagaggtaggctggctgcgcaatcccaggccagccctgcagggcttggggacagaacaccagggttggctgggcccctggttcatccaaaaggggacctcttagggaagtgtcctccagctggagtggagggcctggtgtgtggctgttgcatttggggatgccagggcccctgagataggtgtagccccactgaggtcttaggagtgaggtttcactgtccccagggccagcctcaatcaggggatctggtgcaaccacttccttggagaggcagcacacagaatggttaagaacggggactcaggagcacggtgcaaatcccagctgtacccctttactagtgtgaaggaccctggaccagttacttagcttccttgtgcctcgtttt

SEQ ID NO: 76002 - DNA, 1028 bp, Homo sapiens
aaggaagcatgtgtggctctcctgcgggtgtcccacaagcctactcccctcctccctcgggcacctccaggagtgggggcacaacttgccaagggagggatcatggccagactgagctctggcgctgaccgtctgctgcctcctaggatgaagagggcgccattgtgatgctgaagcgacatttgcggcagcagcgtgcggtggaggactacggccggaacatcaagcagctggccagccgggcccagggcctgctgtctgcaggccaccctgaggggtgcgtgcgccccctgtggtgactcggtcaggagatggggattgagccaggggcccaccagccaacgtcccttcagatttaaaaggaaaatggaaagagttttcccatcaaatagggctggagaaaattgctgcgggactggtgatggatccaatttcattttatgccttggttttgtgtgaatcacttccagctgggccatcgaggccctggttttcgaaatgatcagagaaggggttagcaaaactaccctcttggtgacctgagagcaccaattttccgaagggttacaatatgctaagggacactgaagactactttagcttttatttttatggtccagaaggtctccaggacttcacagtccagacagaaccatgatgtaggagtgcaggtggaaacctgtgcccacatgggctgcgaggttttgtggatcctgcataaatggaagcccactgggccacagaccacacactgcccccagccatggccctgtcctcagctgccattagggtgcccaccactgtgggtcctcagcagccaccccagaggtttccctgggagccacattgtctgggcccctagtatgtcttttccctccctggagggctgagcagagctgttgctgcgggagccccactcaggtagtgctgctcccccagcctctctggaagaacaatggaggcgttccccatttgcacttgtccctgtaagcttgccagagtgaggggcaccatgggaagcacccctc

SEQ ID NO: 76003 - DNA, 1298 bp, Homo sapiens
tgtggccttgggcatttacttggttcctctagggcagctggggaccctatgtcctgaagcattcttgaagttaatgtgagccttttaattattttgatatttcataaactctggggaaattgtatatttgcctgaactccaactacatgcatagactttgctttcatgttcctttacttatggttggagtcacataattaattgccccctgctgatcaaaagatctgattgacagttatatatgtcttgagtaaaattggagaagtgaattttgctcacctacacttcgttaggtagatttttttttttctttttatcatacaaagtctgtggggggagacttgtgggaaatgtgggaaggggtcagggtctcctatgggaagaagagctaagggagaaggtgtctctctcctccgggctgtgtccccatccggcaggtggcaggcatttcagaccctggtgtcggagcggcgggaggctgtggactcagccctccgagtgcacaactactgcgtagattgcgaggagaccagcaagtggatcacggacaagacaaaggtagtggagtccacaaaagacctggggcgggacctggcaggtatcatcgccatccagaggaagttgtcagggctggagcgtgacgtggccgccatccaggcccgtgtggatgccctggagcgtgagtcccagcagctgatggactcgcaccctgagcagaaggaggatattggtcagcggcaaaaacacttggaggagctgtggcagggcctgcagcaatccctgcagggccaggaggacttgctgggggaagtcagccagctgcaggccttcctgcaggatctggatgacttccaggcctggctctccatcacccagaaggctgtggcctctgaggacatgcccgaatccctcccagaggctgagcagctcctgcagcagcatgcaggtatcaaggatgagattgacgggcaccaagacagctaccagcgtgttaaggagtctggggagaaagtgatccaaggccagacggacccagagtatctgcttctgggccagcggctggagggcctggatactggctggaatgccctgggcaggatgtgggagagccgcagccacaccctcgctcagtgccttggcttccaggagttccagaaagatgccaagcaggctgaagccatcctcagcaaccaggtagagaggcattcagggctgggacaggcgggtctctcagggcagtagctcttgtggtgagtccacaaatgtgctgtaagactcagggaccacattactcttgt

SEQ ID NO: 76004 - DNA, 1127 bp, Homo sapiens
ccaaagaaagggtgaagagtacagctcacccaccccccaacttcctctaaagctgaccttggcaacattgatggctcctgagctgaattccaaagcaggttgatggtctgtcctgaaaggtaccacagctggctgctctgtacctggcgaacacctggtccacctgagacccatgtctcatggacatccccacaggaaccctccaggcttttatgtggtttgtttattgtgattgcagacctcttaggcacccacagtgtaccagaaactcacccattggtatagaccctcatgccagattccttccctctgctagatccttagctcttagagtataggtaccatttctcattcatctctgtgcctcatgtttagtaaagacaatggctggcagcctttgactcctcatgaacatttaaaaataaacaaaaccctggccccctagtggctggcatcctggcacagcaagcttaccaatcttctctagcactggggaggggaactgcacccaacccttaacaggccagctcgctgccgattggcaagaggagggcctcacccaattccagtctactccttctgccctaccagcacacttgggctcagggaacaaacccagcctagagcactccagggcttaggaggtgggagccccatttcgtggcaccttgattgtggtcctcattgatatcctcagtggtggcattgcccttctgatgagaataagtaagaagatgattccttaggttattgaccatgccattgagactgagaagatgattgaaaagtacagcgggctagcctcggacctgctcacctggatcgagcagaccatcactgtcctgaacagccgcaagtttgccaactcgctgacgggcgtccagcagcagctgcaggccttcagcacctaccgcaccgtggagaagccgcccaagtaagggccctggcacatgggagggtggtcctcagtggctgggaaactgaccaccaaaaggtagagccaggttctgggccttatgaagtgtgtccacaaggcacaccctcaagattagagagctgtatgtgtgtcacctgccttgtgcccctcttcaccactcttctcccaagccatcagcttagagaaacca

SEQ ID NO: 76005 - DNA, 1041 bp, Homo sapiens
ttttggctgactgaggcagggaagcaggctgctggggcacagggcctcaggatgtggtgttgctgcggggctggcggctactccttgagggcaagaaatttgttttacctctgtgtgtcctcaggcctagcacagcgctgccacataataggaacagaatcaatgtttgtacagacagccacaatacagctatggagtactgatggtgcaccaggctccaggccctggagacagacaagtgaccaagacagatttccctgggctcagggagcatctaggagagagaaggaaatgtaaatgcagggagcagggcacatgaagggagacccaacccaagcgccatttatactggctcttaaaggatgaattagtgttaagtgaaggggggatgagggagggagcctcccagggacggcaggaaagcacagatccagatgcacatcctcttcaaatctctcttgttctgctaccctcagattcaggacattgtggtccaaactcaggaaggtcgtgaaacacgctcagccaaggatgcgttgctgttgtggtgtcagatgaagacggcagggtatgccctgggaaccagctgttagcacatccaccaccagccccttgctccgcacaagcactgccatctccagagggacattagacatcatcacccagaactacagctgcctccctgtaattgatgcaaagtctgtcctgacctgattctttgaggcctggaatacaggattcttttccaaagttgcctgcaggcagactggggggtctgtgtggtgttcacatctgatgggggagcctctgtgtgtggttagctgctgccccctcttggtgacctggctcaagaaaggacagttccatttctctcctggtatattggccctcaatttgtacacttgtttgggactacaaaaaatctaattcttagctcttactgtttctcttggatgcagctaccctcatgttaatgtcaccaactttacctccagctggaaggatggcttggcctttaatgccctgatacacaagcaccgg

SEQ ID NO: 76006 - DNA, 1036 bp, Homo sapiens
tttcctgcctgggcctagagagaggaattaccatagtcctctctgtagtcccaaaaggagtgattggataggaaatcgagaacagataacatcctccccactgcctcaggaaggattttcttgatgaaacctttcatccttaaactggaattagatttttgcttagcaggttcataatagatctctctgtgtgtgtgtgtgtgtgtgtgtgtgtgagagagagagagagagagagagaaggtgggggtggagaatatcttaaatctctagtagaaatgacttctcctccccctgttggctgatatctgattcttgggattttttttttttccccaactcctgtgactattgcctccctgaacttgacccagggtaagtatattccgaccttaagtcttcggccaataagaaagtttgagttacatggggttgtgtgtgtatgtgtggaaggtgggttccttcacctgatccaccagtcagcagcccacactggacctgtttccctatcattgactgttgccgtcttccacctcctaagaagagtacaaccttccccataaacactttctggagtgattctcccgctgcccccataccttatggcccaaattgaaggttgtagtaatcctcttccccactccctccctgtactcagctcccagataccacagtccctggcagaccttgaagcctgagcagggccctggacccctctgggaccataatgacctcacatcttgggagtgtctgggcttctcatgccgggaaaggaatgctgcggtgtctcatctcccttgtcatgacaaggaatccacttgggtctcagtcattacccctggtgtccttgctctttacaggaaactctctttcttctttctttatctccttctcaccctccttgaccccacaaaattctcccttggtttcccttggggacggaccataacggtgacccattgcttttgtgtatgttaatttaagccaaccaaacttggaaccattggctttgtcgtcagtctggttttaccttcttata

SEQ ID NO: 76007 - DNA, 1051 bp, Homo sapiens
cccacaaactcagtaccgagagacactgcatgttatttgtaaataataccctggggcaatctggtactatacagtttatacattattttcatataacttcatttaatctgtgcagcagctttatgtgttaggtggcgagtgtattaattagggcaccctaactgctccagtaaagaactccaaaatgaaattttattttttgcccaaatcataggttagtaaatcagtgtaaatagagggggaggctacgctcccaacagtcatccaggacatttggttccttccaccttatggccccatcctctaggtcctaggaatttagagcaaagagtaagaattatggggaagattttatggctaaggccttgaagtggtgcacatcatttctgctcattcgacctcacagcctcacctaaccacaaaggcaactggaagatgtctccaagctgtgtgtgcagaaagcagaatattgatactggtagaccccaccagtctctcccacagtagcacgggatgttcccctccttttacaggtagggaaactgagatacagagtcattaagtgaactatagaagaacacatcactgctaagtaggacaggatttcaacttaggtcttctgcttagatagaatgggaataataatggcagtaataacaataatatctaacagtttgtgagtgtgggtgggtattcaatggaacaatatacataaaggccttagtatgttccagattccctttctagctctgagctctgccacacaatcctataaagagccaaatatccctcctgagcagcagagcgacagcaggagctggtaactagtggctgcctgtcagcagagcccagcacagggctgaatcgactctagtggtagagtgctgctctccctgcagacctgggagattgtgcataccaagaactgactctgggctgggtgaggtggctcactcctgtattcccagcactttgggaggccgaggtgggcagatcatctgaggtcaggagttcgagaccagcctgaccaacatagtgaaaccccgtctct

SEQ ID NO: 76008 - DNA, 1208 bp, Homo sapiens
acatcctcttctaacaggcagacagacctttcctgtagcccaggacgtcaccttccccttctcccaggcagggtccaggcaccagccttttactgggatgcgtacttagaccaaatgccactgtcatttgtttggcgtttcccccttcttccctcctttcctgtcttcttttccttccttctctccctgctttctcctactcacttggtgtccagttgcagcttccgctgtctctctcctctcttcttccagtcacctgtggttgtccaggctctgctcgcttcccttccccacagcagggcctcctactgctcctgactgtgttctcatttcatacctgctcgaatttctagtttctctagatggtgcctttcttagtatctgctgccttcacctatcatctctgcaaaatgtattaaatctactgctttcccaagtacttgccctaccctttaaaggatctaaataagaatcaagtttaacaccgctgctgcagcagcctctttactccatgttacctagctcttacctgcaccctctgtttactgcaccgtgagtagtaaatttccgttcctcgtgaggtgacttcatttgtagtagaaactcctgctgtgtggtgtggcagagactacatgctttggctacggtctgacctggcttcaaatccaggttctaacacttgctagctgtgtggccacagcaggtaatttaatctttctgatcttcattttcctcctcagtaaaatgggaagaataaataatacccaccttgcagataggattgtgctatgctgtggataaaaatgtgtgtcagatgcctggcacatgacgggtgaacaaaaatgctagctactgttgtcattatagctcagtttctcttttgcaaatttgttgctttttagcagatctcattatgtgttataagggatcaaagaattgatgtatccaaggtcctattagaaatggatcccataatgatttacaattttgaacataaatatctttgccagcagttcccatctttctagcaatagtaaatagagtaattaataaaacaacaatttagaacaagaacttagatattttcttgaagtcccttgtgctagaaataatttatatttttcagagaatagctgttcccattcaccccaaatgatttccagaatcaggattttttttttttttttttttttttttttgaggcagtg

SEQ ID NO: 76009 - DNA, 1044 bp, Homo sapiens
aaatctgaggaagaagagtagatgcagtggtctgtgtgccagaatcatcatgtggcatttgctgggtttatcacagagatgcttccttcttcaccccattaggggaaggtcacctgttttggagatggagatagtgattgaggaagagcgtaggaggcagtcaggagaattaactgtcagatctggctctgctcacggattgccaactccccttggtaaatatttagaaaatgccatagtgtgtttccctctgttgctgcgtgtatttcttaattcacagccaagtgatccacattcttccattttcagccagcctcagctgaatatcaaaccatcaggggatccctagcctttatagctcacgtagtcttagaggtggtcatagacagaaaatgcttccttaatgaattgtctggctagcttatcaaattcccagaccacctttcatttttctctttccttttcctggttgcaggaaatattacaaagccctcttcttcctacctcagcaagcccttctcaggctttgccataatgttttatttccacatcatacctgtgcagacctggctgagggtagaattacaagggcaattaaaactcagcatatatcatgtgagcagtgggggcaaaagtgggcttcctttctttcatttgaatgttataaatttagcaagtgaaaaggcacagggctgaaaaaaaaataggctttgcattgaaccaggctcagatcatccaggatatttatgaagagactaacggcaccttgatagctaaagaacaataattgcttcgaattatagtcaatttaggagtttccaccattgtgaaaaggagaagaaacttgaataattccgaaaatgaatactttgaaaatattttccatttgtaccagacttaaatatgggcgtgtctcacttgagaatgtatagcaattcaaataaaacaaagcatactttaaaggcataaattatgtggaccagaaagaagtctgtaaccttattctgtccctcttttgagtcccagcctgtttctagaagaacc

SEQ ID NO: 76010 - DNA, 1049 bp, Homo sapiens
tgcagcactctgagtgtctcttcccaaacacttcggttactgtttattcacctgctgagatctggtctcttattcactctcattgccttaagaaatggtacagaaatgtattcattaacatttcagatttgtatatgcggtagcgagaaataattccctttcttgtgtgtcgtgatttgcctttcttgtcagcctaagctcaggaaggtgtctgtgagaacttcgctcagcccaagatccctttcccttcccgtcacatctgttagcgcacaagatttcttcgtctgtctccaaaggtttctgaagccccaccctttgcccacgcacggtgccaaggagactgtgccctgccttgacaacagttgctaaggggcggagacttcggctcggttcccgagacggaatacccaggagtcgagtacttgggcgcatgcggcaaccgtatctcagttctcgcgaggtttcgtcttcccggaagcgttggaggacattccctgttgactgcgtcgcgatgtgtggcgactgtgtggagaaggaatatcccaaccgggtgagcgactgggcgctcccttggcccgcgggcggcccccgaggtgtctcatatccaaggctggccttcccagagaggccgtacgtggggcggactcggccgcactgccggtcccggtgacccagtagcggtatttaggcacaccagggatggcctgtggcggtctgcacctctggtacccgccctggcggctgacctcagttgtagtggccgttctcttgagctccaaggagcaacagaggaaccccaccaccaccacaacccccgtcgacaaccgagggactcccccacccccacttccggtctcatcctcaagctcgatttgatgaagtacaattttcttaccgaattctagcgctggaggggacctctgtggtcatctgttctaacacttttgcagatgaagaaaccgatgcccagagaggggaaatcacttgcccaagttcacattctagttgcatggatgagagccaggactagaatttaggtttcctgcctg

SEQ ID NO: 76011 - DNA, 1057 bp, Homo sapiens
catgtataacagtatgaattctcctgtagtacaactactttgaaaaagcgggtgagccttataaaatacagacatgacccagtgattcccattctagaaaaatgcatgtgtatatgcttctgaagacttttataaataagtgttcataacagcattatttttgtagtagattggaaaagtaactgatacattcattagaatggaacaccattaatgaatgaggaatggaagtgaatgaattagagcagtagttctctaccaggagtgatttttggctcttaggagacatttggcaatatccagagacattttttgggtgtcaaaaggggaagtactactgactgctaatgggtgatgcaagggatgccgctaaacatccagcaatacatgggacagccaccacaacaaagtatcactcccaatgtcaatagtgtggaggtagagaaaccctgaattatagccgtgaaaccaaactagaattacacagcagcctgaaaagtcttacaaatagtgttgatgaaagaacacataaagtataattcaaaaagaggcaaaccaaaatatattattcaaggatgtacctgggtggtaaaactgtaaggaacgtatacaattactgttaagtcgagatagtggttactcctaagggattagggtgtgatcaagaagggtcacatgagaaaaagtcttcccgggtgcaagcagtgttttatttcttgatttgggtggtggttctacagatgtacactttataatcatttcttgttcgctacatttatgtttcatgtactttactatgtactatttcatttttttaaagtttaaaaagatttttatgaaaccagtaataaacatgagctattatgagaccatgagggaggagtttgcagtagagaatattaaagagattaggttggattcttttttgttgttgtttttgtttttgagatggagtcttgctctgtcgcccaggttggagtgcagtggcatgatctcggctcactgcaagctccgcctcactggttcatgccattctcctgcctcagcctcccgagta

SEQ ID NO: 76012 - DNA, 1057 bp, Homo sapiens; identical to SEQ ID NO: 76011

SEQ ID NO: 76013 - DNA, 1057 bp, Homo sapiens; identical to SEQ ID NO: 76011

SEQ ID NO: 76014 - DNA, 1057 bp, Homo sapiens; identical to SEQ ID NO: 76011

SEQ ID NO: 76015 - DNA, 1057 bp, Homo sapiens; identical to SEQ ID NO: 76011

SEQ ID NO: 76016 - DNA, 1429 bp, Homo sapiens
aaagcaccattgtaattcagtggggggaaagacagttcttcaacaaatcttgccaaaacaactggaaatccatacgcaactaaataaaccttgatccttacctcatatataaaattatttcaaaatggattataaacctaaatctacaaactaaaagctataaaacttctagaaaaaaatgtaagaaactttgtgcaaccctggggtaggcagagatgtcttaggagaaaaaaagtataaattataaaagaaaaaatgttaaattggactttatgaaaatcaaaacttgtttgctcattagaagaaaccatcaaaaaaggcaaatcaatgacggagaaaatatatttgggaaaaaacttgtatctaagatatataaagaactcttacaactcaaaataaacaacctaactttttgaaaatgggcaaaagacttgaatggacatttcataaaagaagatacatgaataagcaccatgaaaagatgctcaacatcattagtcatcaaggaaacaaaagttaaaactacaatgagataccactttacgtcactgaatggcaaaaataaaaagcagtacctagtattgatgtagctatagagcaactggaactcacacattgctggcaggaatgtaaattggaaaaccatttggcagtttcttgtaaagttaaatataccatatttttaccatattagcaattccacttctacatatttacccaagggaaaggaagacatgtatccatccaagacttgcacatgaatctctatagctgctttattcataatagccccaaatggaaacaacccaaatatctaccaacagctgaatcctacagggaatactatttggcaatgaaaagcaacaaactaccagtacctagaacaacagtgatgatgaacataggcattatatcgagcaaggaaaattggatgcgggagtatactgattctgtttatataaaattctagaacgtgcaagactggagatggaaatcagatcagtgggtgtctggggtgggatggaggttagagatagactgaaaagcatgaaggaactttttggggtggatagaaatgttttataccttcactagggtagtggttacatgggtatatacattggttaaaagtcattcacctatgtatacccttacagtgtgtgaattttattgtatgtaaattgtacctcagtagattttattaaaaaaaaaatcaaaggctgggcacagtggctcattcctgtaatcccagcactttgggaggccgagacgggcagatcacgaggtcaggagatcgagaccatcctggctagcatagtgaaaccccatctctactaaaaatacgaaaaattagcagggcgtggtggcgggcacctgtagtcccagctacttgggaagctgaagcaggagaatggcatgaacctgggag

SEQ ID NO: 76017 - DNA, 1429 bp, Homo sapiens; identical to SEQ ID NO: 76016

SEQ ID NO: 76018 - DNA, 1429 bp, Homo sapiens; identical to SEQ ID NO: 76016

SEQ ID NO: 76019 - DNA, 1429 bp, Homo sapiens; identical to SEQ ID NO: 76016

SEQ ID NO: 76020 - DNA, 1784 bp, Homo sapiens
aacttaagcttctctgcctcaatcatgtgtatccttaaggactgacatctatagagctgagagtttacttttgtttattttgtattatgatcaaggatcaaaactatttgaacaaacaactaaacatctatgtaagatcatctttatcattgactcagtttctattttgattgaatttaattttagttggtaagcctcgtttaatattgttggttattaaatttttctaattttctattttcatattttatattaaggtttccttaagttgtttctaaatatctattttcagtttatcctcccttttcaacatagtggcagtccttacagacttaaggatctaacactgcactttagttgctttttttttttttttttttttaacatgagtaacacttctttaggaaagctagtaatttcaaaaattatttggtatatgacctagaagtaaatgctggccattttttagttttgttttgcctttagacattttaagtctgttaatcatcttcactaaagattttgaaatgtaaagaaattaaattcctgtttctgatattttagggtaatacctgcctggagaatggatctttcttactgaactttacaggctgtgcagtgtgcagtaagcgggattttatgctgatcacaaacaaatccttgaaagaagaagatggagaagaaatagttacctatgatcgtaagtagactttattttttaacctgagtgtgttagcaggtgtcagcttttggaagtcgatatgttacacaaaatattctgaggcctatttcaatattgtattgcgcacataattactagttaggtctttaagaggaaaatgtcattaacacctcatttatctgggatatcaaatagtctatgtaaatgacttttgcagataactaaagcttacgattcaggaactgaattttttttgtttatcaaattatttttcacggacatatttttaaaagctttatgctgccttaacaagatatactttttattattgttattattgtgaccttagggtcatccatgtgagttttcacttttctgctacagtataataccatgatatcctccaacagctattaaagtgtttagggctgcttgtccctatactaaatgacttcaggaatgcagtgtttttttcagtcttgtttctgctcagaatgtctagctttttttttcttctccaatctcactgtcagtctgttgttccttacttttgctgctaaataataagctgccttcctatccttcttctcgtcctcaatactgggaaaccaaataaactatgtataaaaaaatcaattctgaggttagcactaaggatttctgtaagttaagtatatgtatacttcagtgcccaatattgtgagaagtatttaactgttcacattccctttttgcttgtctcctggttcttgggtaccttctaaacacatgaggaataaatgtacaggtaatggtattttgtcagaggagtttgaaagacagcaggcctttagaatggagtcagataataataaatgttctaagctagaagaatctttttctttctttttagcatatgttttctttaagctgtatttcattccaggcagtagggcatagtggtttaagagcaagggccctggagctaggctgtttgggtttgaattctggttccaatacatcctggctcagtcgtcttgctagttacttaactgaagtatgccattgtttccttatctctaaaaaggtggtgatgatactatctacctcattgggtttttta

SEQ ID NO: 76021 - DNA, 1046 bp, Homo sapiens
gagtgtgttggcacatgtcttgagcctctcctgggctcaagttatcctcccagctactcaggaggctgatttgggaggataacttgagactgggaggttgaagctgcagtgaggcatgtttgtgtcactgcactccagcctgggcaacagagtaagacccggcctcaaaaaaaaaaaaaaaaaaaaagaaattgatctagctagtttaaaaatacacttaaatatgttttaactgcttctcttaaagaacttttggtggcaattaataaaagctcagactcagaattatgtaacgttgttatgtggcagattctgaatcttttaaaaatcaaggtagatactataatgggtttcctcctatgttaaatatgacagacttaagattctctttaaataatatgctgagaatagaaattttaatagaagttttaagaaactctctaagacttaattacgtaagtctctctttgttttagcagatttgtgtaagaattgtcatcatgtaatagccagacatgagtatacattcagtatcatggatgaatttcaggtaaatataaatatgggtataaatataaatatggggaggttaggggaataataaaagtgctcttgagaatctaaatacggttttcataagtgaagtgcaaagcgttagcatatattaaaggagactatgcctttttttttttttttttttgagatggtgtcttgctatgttgcccaggctggtattgaactcctgggctcaagcagtcctcccacctcggcctccaaagtgttggaattacaggcatgagccactgtgcccagccccatgcctttcttatatctgtgcaagttgagagacagactttagatgtgggtggatttgtgtaaacctgtcttcacgagaatcacaaatcaaaatgtgtagtttacaaatgatatctcagccctgtcatttttgtttataaagaatagtagcacattctagcttcttatgagattaccattgtgctgctttttttctgcccagttacgtgattgcacagttgtgggctttt

SEQ ID NO: 76022 - DNA, 1048 bp, Homo sapiens
ctgtcaactgccaccatacttgcccagcatggaaactgtgataaggaggttttctttgttttcccaagttgacatgtagagttgaacaactctgcagtctcatttgtggtaagacattatagtattgttaagtaaaattacaagctgtgtgtaccatggttggaggagaaacacagaaccactgtgaagctggagattaagagatttatcataaggattaatccttacacaattgtgagagtatgtgaagaattctctggaaggttgatataggcctgtagttgctgaagatacacaggtctgacggtcagaaagaaaagctgggcagtcggggagagccagggacaaactgaaacctatctctgtccctcactgcctgttttcaagccttcaggttgagttacttattttgtgtgaactacatatttgtccataggatataaatatcaggctagagcttttaacagccgagagaattttttcaattcccttcacatttggatagtacttaattaggaaaataataataatcttccatagcagaatcataagatagtaaaacccctcttattccttattttagcatggaagaaagtgcttagtcacctgtcagagtctggtctgatatgttgtggttaatctaaaataacatcttgactatattttatatttcttcagcatccaaaaattatgcctcaagaaatatttatatgatatgcgtaacttagggcaaaattgacatcttagtgaatgagtagtggccgcatagggagatgagcatctcctgggcttaaagaaacagtcctattcttttatgggaggaaaggagtgcttatagctattttcaagacactcctgaatttcacgtgagttatgtacagctcctgaacggatattgaggttgcctgtttatgtcctaaccaagccattgtaaattagctagaccaaagtctagctgatttttcctttttgactgaatgcagccgttttcaaagctgccctggaaattactctgggacaggaagaaggtaaaggaaggtggcttgta

SEQ ID NO: 76023 - DNA, 1048 bp, Homo sapiens; identical to SEQ ID NO: 76022

SEQ ID NO: 76024 - DNA, 1048 bp, Homo sapiens; identical to SEQ ID NO: 76022

SEQ ID NO: 76025 - DNA, 1048 bp, Homo sapiens; identical to SEQ ID NO: 76022

SEQ ID NO: 76026 - DNA, 1029 bp, Homo sapiens
gtcccaactttactcttccttctctcctgttagagagaaagatttttatttacccctctctaatgctacccctactgcatttcctcaggaatctcatgttatcgtctttctttccagtgtactttgattcatcctgtaatcatttcttcttcctcttgcttctttagttgaacaggttgtttgtttgttgcaacaaggtcttactctgccgcccaagatggagtgcagtggcctgatcacagctccctgcagccttgacctcccgtgctcaggcgatccttctgcctcaacccctcgagtagctgagactacaggcactagcctctgtgcatggctatttaaaaaattttttttgtagagatgagatctcacttggttgcccaggctggtcttgaacccctgggctcaaacagtcctcctgcctcagcctcccaaagtgctgggattacaggtgtgagccattacctggccacttgaatgggtctttaccctattttccttattttcctatactcctcttaagtacctacaaagtgattttcattttctctgtgctaaaactattctctcatacgtttcctataatctaaccacatcctgtgactgccttagttcttttctctcttacatggcttctgcatctagttttattaactattgttgtctttttgaagcatttctgcccttgaggtccaaagtgcttgacttctttcctttttaaatcattttaactgctcctttgtgttttctcttagttttctttcctgttttctcgaagtgatactcctcagcttttgttctgtggtctggaaccttctttatgctctctcttgtagtgaacacacatgtactcagtctcagtagagacctattagatacctttctcatttccttctctagccttcgtgcctacacccctcatcccctcttttttttctttgttttgcttgccttttctctgactctggcaccacacctcatgtcaaggaccataaccattgaaggctgaattactgcagcattccccag

SEQ ID NO: 76027 - DNA, 1029 bp, Homo sapiens; identical to SEQ ID NO: 76026

SEQ ID NO: 76028 - DNA, 1029 bp, Homo sapiens; identical to SEQ ID NO: 76026

SEQ ID NO: 76029 - DNA, 1029 bp, Homo sapiens; identical to SEQ ID NO: 76026

SEQ ID NO: 76030 - DNA, 1086 bp, Homo sapiens
cagtgtagccagagtgaagcatctttgttagcagttatgtggtcagaaaacaactagaatgggagcacacctggtgcccagattttggtttccaataaaaggaaccaggactccttagaaaatgaactgattctagaactgggatatgaactgtacaagatgagcctagagtatcttgtgccacagaaaaatgaagtactgaaattaaaaaaaaaaaatcatagtgattgggagtatgtcagcatgatcgaactgaaggatctctgaaaggccacagctggagcaatttgagtaacaaaataaagtagtattgggttataacccaaactatataataaatatttacaagcccaaactaatataaatgattgaatgggaacaaatctcttgtgcagaagaatttcaaataatttatgtagatactccccacttagtgggctctgcatagtgacttccttgcagagtataatatggaaaggggggaaaagagtaactttacagtggagaaatctgacagacaccagctcagccaggtgattgaggttaacatcatccatgataagcccttttgatagcatgtatccttgatagcatcacatcatacagaatgtgataagaatggcactttacctctgtggtcctcctccccagaactcagaacccaagtctgatcaggagaaaaacatcacacaaattccaattgagaagcattctttaaaatacctaaccagtacttctcaaaactatcaaggccataaaaaacaaggaaaatctgagacatggtcacagccaagaggagcctgagaagacatgactgctagatgtaatgtggtatcctacatggaattatataccacgaaaagaaaaaaaggtcatttggtagaaactagggaaatctgaatacagtgtggacttcagttaatataaatgagaaaatggtttcattggctttaaagggattttagaatatcttactttgcatagtttcatgagcactggccaggaggttataaactggcatttaggcctctctgccatttagtagcagtatagtcattaagcaaagcattactctggactttattg

SEQ ID NO: 76031 - DNA, 1091 bp, Homo sapiens
cgacctttagggctctggtttcctgtaagcagtgaattatttacctctgctcatagatatcaaattggcccttcccaggttgcagcagggtggggcggggaggcggccttgttcagtctgttaataggaggagcaacctccttgttcaaacagcacttacaggtggggacctgtttttgctaagtcatcctggggatgctcaaagctccattgttagatcctttctgtcctccttcctggctcctccttcctccccacccctctaataggctcataagtgggctcaggcctctctgcggggctcactctgcgcttcaccatggctttcattgccaagtccttctatgacctcagtgccatcagcctggatggggagaaggtagatttcaatacgttccggggcagggccgtgctgattgagaatgtggcttcgctctgaggcacaaccacccgggacttcacccagctcaacgagctgcaatgccgctttcccaggcgcctggtggtccttggcttcccttgcaaccaatttggacatcaggtgaggggtccctccttgtaatgcaccaaaagtgttgggttggtgtagctcaggtgggataaaaggagaggctgaatgaccatgttttggagtgtctggaataatggggtatgttttgttaagctaggtctttaggtgcatgtgacataccaagagaaggtatatattttttaagattaaacactgaggctgtgtgatttttatagtttactgtctttctactatattactccatgagggctggttccaggtctgtgtttctctccactgtgtcctcagtgcctagggcacagaaagcactcattaaatatttgttgaataaatgagtggagaaagtagaggccaggaatcaaacaagaattggacagactcaagagaccttagctctagctggacttggttttgctatttaatggctctgtgccctcggaaagggcgcttcatttttcggtttagtttcctcatctgtaaattggggataataccacttagctcataggattattatgatgtttaggggacaggatatacaaaagtaacttgaaaaata

SEQ ID NO: 76032 - DNA, 1393 bp, Homo sapiens
agctcctatgtatcaggttaagagcaagggagagctggccagggacagcagtttgcacagcagaggggaatgtagcaacagcagggcctcctaggccccatcttccatttcttaggtaagaagagcatttcctcagactcccaggcggaggactgagcctagccttcagcaaccaaggttctcctgggacccaaagtttatgggagaagggcaaagacttcatgggaagagagaaggaaggccctgggtagaaacgcttggtgctgttctctttggcctttaagacaaagcgctcatcttgccctctacctcctgataggcttgagggtttgccaaccacactgtggctacaggtggagggaagaggactccttcctccagagtgctatgttcaggaagtttctttaaccccatatggcccaagagtagctcgtaggaggccctttaaagacggaacaagtaatttaccagttctactggggttcctgcccaccgtcccaaggtgggcgaggcctaggaagagggtcattcttaagccacacattagctgcactgcgtggctgcagccaaaacaaagaactgggtgttgagtattcatcaactaagaaccaaaatccagggcactcatatgtgaaggataagaacctcacttccttactcctccaaaaagaagtggggaaagaaccatcaaacctttcctcctgacttaccaaaccaggaaaacagcaggagagggtggctcaggacttagggacagggtatagcttagatggtggaaagcaaaggagagcaggaagttgtaaatcactggctaatgagaaaaggagacagctaactctaggatgaagctgtgactaggctggagttgcttccttgaagatgggactccttgggtatcaagacctatgccacatcacactggggctagggaagtaggtgatgccagccctcaagtctgtcttcagccagggacttgagaagttatattgggcagtggctccaatctgtggaccagtatttcagctttccctgaagatcaggcagggtgccattcattgtctttctctcctagccccctcaggaaagaaggactatatttgtactgtaccctaggggttctggaagggaaaacatggaatcaggattctatagactgataggccctatccacaagggccatgactgggaaaaggtatgggagcagaaggagaattgggattttagggtgcagctacgctcaccctaaacttttggtggcctggggcatgtcttgaggcccagactgttaaccaggctctgctggcctgtttactcgtcaccacctctgcacctgctgtcttgagactccatccagccccaggcacgccacctgctcctgagcctccactatctc

SEQ ID NO: 76033 - DNA, 1120 bp, Homo sapiens
tgcagctggcgaaggagtatggcatggacttctatgaaacaagtgcctgcaccaacctcaacattaaagaggtgagagccctggtgaccaggcgcccgctctctcgggctgagtccagcagaggtgggaggaggagccataagatggaccttatccctcaggccgctgcagggttgccaggggagaggaggagacactggactaacctgtgccctttggtttccagtcattcacgcgtctgacagagctggtgctgcaggcccataggaaggagctggaaggcctccggatgcgtgccagcaatgagttggcactggcagagctggaggaggaggagggcaaacccgagggcccagcgaactcttcgaaaacctgctggtgctgagtcctgtgtggggcaccccacacgacacccctcttccctcaggaggcccgtgggcagacaggggagccggggctttgccctgctgctgtcctctcgtgtgatgaccctattgagtatcagtagccactactccccctgcctggccctgagagcggctctgctgtcatctcaagcagcccctgtccccagcccgtccaccctggagtggtcttcttcagcctgtttccccagccacaggcctgctacgacccccacgatgtgccgcaagcactgtctcaccatcccgcacccaccagacaacagccagggctggagtccaggccactttcagctgctcctttctccgtgcatcgtgtctcttctctgctttttctctcttcccccacttctctttctctgacccctcccctccggtgcgtttcgtatcaaagctcctcaaaccccgtcccccgtgtgtcctgctgtgtgcagctcgctctttccttccttcctaagctatccaaggggatggacccaggctcgtggggaggttccacccttggatccaggaagaaccctccaccctgcctcgtgggtgggccaaaggctacagggtgcttcttcctcttcccccacccccactgtccctcatgtgccatgggcctgcctccccagtgacctgcgaaagtggagcatcgaggtaggagggaaacggcaaccagggagtcctcgagcctggggctgccctacctctac

SEQ ID NO: 76034 - DNA, 1008 bp, Homo sapiens
caggttcaagtgatttccctgcctcagcctccagagtagctgggactacaggcacgcaccaccacgctgggctaagtttttgtattttagtacagaaggggtttcaccatgttggccaggatggtctccatctcctgacctcgtgatccgcccacctcggcctcccaaagtgctgggattacgggcatgagccaccacgcccggcctaaaagtgggttattttctaattgctcttccctgattaaaattttctctttgcccatcttttctctagatatgtactgacttcattcatccatttattcgtctcacttgctcattcatttttgctttcatttactctactttgttgaataatatttagtgatctacctgctgccaggcagtgagagtctgaagtgaacaggatgctgctttgccctctgggagcttacagtgtagctgggaaccagacatccaaacaagcagaatattatgcaaaagaaatgtcaggatgctttggaatcacagaggagtgagaaatccctcccggggaggctggtgaaggctttgaagaggaagtgacatttgagtggagtcttgaagactaggcaggattctccaggggccctgggtgtgggggaagcacacatcctcttccctgtaggaggtgctgtggagaacacctccagtggggctgctactcttcagccttgctggggccagctggagtggccacaccatggtcacaccagctgaagttcaagaagccccttgccaggagattgctttgctggctctgggtgagggcaggtgcatctggaagcccccttctttctaagatgtttgctcctgagtttctatgtcctagtcttttcttccctgaaccttttgctaccagtcagcacagccctgcctgagaaggaggctggaggagtgagtggtcagtagcctggtgggtcttggctgcctctgtggtgcccgctggcctaagtagcaggcttagggaggcgagacccagttccaggg

SEQ ID NO: 76035 - DNA, 1064 bp, Homo sapiens
ctgtgcagctgtgctggcctggctgggggttggtgcgaaggggtccccaaaatactaccttaaacaaattaattgagcattcactaccaagctctgtgccaggcattttagagacatattgcagtctacgttttctgcccacagaagcccataacctagatggggaggcaagacaaagggaaaaacaaaaaacaaagagctagtgccaaaatgagatatctgaaagaacttggtgaatcactcttcaaatgtaaaggatggattatgatcattgcagttactcttaatgaaggtctcacagtgggtatcagaagctaaattatgatgcaagatgtaccatgaggcagccggagaatggcgatggatgggatgggtgagtgctattcccacgactccatgctgtcggaggctggggaagagagaggcccctgtggactagaaccggcagggaaggctgaagctaggcctcagtgtgggctgctcgtcagttcctgcagcagaagggagcagatggagtaacatgagcagagataacagaggtgggattgagtaggtgtccgtggggctctaggcagtttagatgcaacagaagggattcttcaggaaagtgagaagattcttctgtttctctctctgtctcccaaattataagtgccttgatggtgcgaccaaatcttattcctcattgtttttatagtccctagtacagggccaggcagattcaatgcctgttgttaaattaatgaatgaatgcagggaccagttggcagagggcattgagagcctggccaaggaggtggaacatgagccttagcaatggtaggaggggttttgagtagggtactaatgaggttggctggaagaaggggttaagacttgaagcagggagactagtcaggggctgcagtagtatctgggcatgaaggaacctctgaatggcccctcacccccagtggtaccaacaccaacttccacacagtcagttgttctactttccctccagaatggggagtggttcaagccaatcaacctggcaacttctgaaagaatcttatgggacctgt

SEQ ID NO: 76036 - DNA, 1060 bp, Homo sapiens
gcgtgatggaggaagtggcagaggaaccagatggtgtatgaggacaggttgtgggctcagggacaaagggcggtgggttatcccttaaggaaactaggagtggctatttttgggagaggcctggtgcttggaactactgagctatctccagagagctgtgggctgcctgggaggccctggctttggcctgaagagctgttgtttgcacctgctctcctagtcccattccaagtcctataggtgacatggacttttccctttgagggcttcattcaaccacctcatttcagaagctctgggactcctgcttagtgctgtgggaggcagcctcccctgggagacacataccctcctttttgagggcacccctctttctaaaataccaggatggccctctgaggctcgtgctctccttaaagagagtccattgcctcacacctctaatcatccacccttctccttgtcccttccccttgtaatctcccttcttagacaccttctgctaataggtgaacactaaataggtcacagggacttcctgaaaccctccagggcagaccactttgggcacataggtgaatcagtgaactgagtaggggtgtctctgcagcactgtctcccctcaaggcccttggtatattggcctaaaacctaaagatggctcccagatttcttcctccgcttctgacacccgggttcccctttctacaggacacagaggattctctagggtccccctttccacaggacacagaggactctaggagtttggattccatggaatagaaagaaacctgtctttcttcacaccagccttttaaaatctgccccactgggtatcttaaatgctttcttatttaaagcttattaagggacttgggattctcccttatcttgggcgtgtttttcagcattaactaaaacttaaaggaaagagttggatggtcaagaaaagctttttccttaagtgatatggacagtttctcaaggaggtagaaggggcagccaggagacaaatcaaggagccaacgaaatgagtgctaccaagtcatagtcattc

SEQ ID NO: 76037 - DNA, 1931 bp, Homo sapiens
gctgtcaagtaccccaaggtgcacaataattcttttagtaattgcctgactgaggcaaatcagtagagctgtcagaaatgctttcaaacttaacattcattgggttcttgggcacctgaaattgcaaacaattgcattacaattaagtgagaattagcagaatgttacagttctttaacaatttgcgtaacaaaccgaggcgtcctacgccatctcgctgaaatgaaattcggatgtagacacccttgcgcttcaggactctacgctcttgcagcagctcctctgcccaatggggggcggcagcatctcagtaactcactcgaaagacgggtaggcgggaggagacattcgcgttcaaaatctttttgcctctatccgctcgccgtagcgctttagcccgctcgagtttcaatgcgcgttgttgcttaacgaagcagagtcctacacactgtctgctgctctcctgatcatggcttctccgagttctttcacctactattgccctccatcttcctcccccgtctggtcagagccgctgtacagtctgaggcccgagcacgcgcgagagcggttgcaggacgactcggtggaaacagtcacgtccatagaacaggtgaggtggcaggactgggcgaggcgcccgcgcgatgtgttctgggagcgcgagtcccgttcgtagggccgcccgggtgcggaactcaccggggaactacgactcccacagcgcaccgcggtgcctttcctctgggaagctccgggcgcccaggcttgggcttcgtcgtggagcgtttgcgcggccagcttggggaagggtcgtttcaaggttgggcttggaggagagggcagtagccgagtcccctctgccctaaagaacgagaagaatcgtgttctatgcctggaggacagaggcagcccgtgcgggtcggacagcccactctgttctgccagtacttcgggaggttctggggtgcatagtgcacttttcccaacctgccctcagcttctggaggcagagagcagggccaggctgctgtcatgccgtttcacgatctgtttaatttttgacctacagtgccaggtttgggggcccgcctcgtgggtgggcattttggtagtcattcagccatttgagcaccagctacgtgtcggacacaatattaaacgatggaagtacaaggaaataaaacagctcctgaccaggagcctggttgggggacaggcaggaaaacagtttggaaagtgatctaatagaaagaatggattttggactactaatcattccctaaggcctagaagtaggatcgaacctatcattttgaaaagtgtttggcgaatgagtatatattcatatgcccaaaaccatagttttgtttttcttcttattccctaattggaattgttcccaaggttgctatgtggaactgtttatccatctgtccctaggagaagtggttaggataattcttaacactaataaatgaacattctgctgcttactgaaataagatctcttagtgagatcagtctccaggctttaccttggagagacctgttttgtatttcctactttaagttggaagcctgtactttggcaaaattagtaacaataattgttttattgtacagttatgactaaatagaattataaatttataacagaaacaagggcttgatacgtggttattcacaaagtagcagagaaaatattttaactggagatttaaacttcatggaatttagggtagcaaaggaaatcctcacctctcgaatctagctaattctccaggttggtttgcctaccagtgtgtcccagggaaggctgactgcaaaagattgtaaagaaatttcccattgatgaaaaacctacaggatctttgcagaattcctaaatgatggattgctgagttgattcaggtcaagtgttttactta

SEQ ID NO: 76038 - DNA, 1063 bp, Homo sapiens
tgtgtggggtggggtttccttagacttaaggtcacatttcctgtcatgtgccttctctgcggagctctttgtctccctccctctccatccttcacaccttcaggtctatgaggagttcaggtacccctgatttaccagctccagatactgcattttctcttgtggtttccctacacctgcccacatctttgtaaatagttcctttataaactctcctcaaatcacccactttgtgccatctgtttcctgccaggacttagactgatccatgatcagagagttttgagcaggggagtgacacagtctgactagcattttaacaggctcatttaggttactgtcaagagtagatggtggggagtgagggtggatacagggaaaccagttaggaggctattgcagtatcctgggagagaggtgacggtggcttagctcacagtgacggtagtggaggtaatgagaaatggtcagctctggatatttttatgaaggtctctaccttgctaagctgttttgttaatgcagatgcagggagggcctttcatgacactagagaacaagacatggttgtattgttagtgcctgccttccttattgtgccatctggaatcatcccattgcagacactctgattcaggccagtaggttaatactgatagtctcagaggtagcagccttgccaaaaacaggtgtttacaaaagatactactgtttttctttgagtttgtctttgaacagaggcaaacgcgtcctccactttaaatggcatggtgtcattgaaccattggcatggttcattgtcaatgaagtgacttgaactctgaggggaatataagagaattattagtcttgatccctgccctcaaaattcttttatcttagagagataaaaaagaatatgctgtaaggccgagtgcggtggctcactcctgtaatcccagcactttgggaggctgaggctggcggatcactggaggtcaggagtttgagaccagcctagccaacatggtgaaacctcatctctactaaaaaaatacaaaaattagctaggcgtggtggtgtg

SEQ ID NO: 76039 - DNA, 1543 bp, Homo sapiens
ttcagtgcagcctccgcagtagctgggactatgggaacacatcactatgcctagcttattttatttttgtttttattttttgtagagatgggggtctcactgtgttgctcaggcttgtcttgagctcctggcctcaagcagtcctcccaaagtgctgagattacagctgtgagccatggcacctggccgagagaacacttttccttgacatctctgaacaaagtgtggttaggtcactggctgattcactctggctgggaagttgcaggtctgaagttcagcctttcctccttcatcatgtctcttgacttcttgagatcttctaacagactaaatcctagcaagtcagtctctaggtacttctgcttactggaacattataaataggtccagctttgtttgttacctttgtgtctttttttttttttttttgccaccatttccttaagaaactttttctgattagccatggcagaaaacagttggaaaaggcaagtgttcataaggaaagacaggtgggagggttaacttcatctttgttccctggggaaggaaaggaggaaaaatatcagcttactagtatagtctttcccttaactgctaaaccaaatctctgcattaacccaatgctctgacctcaataaaatgaattattcctcttgtcatgagatacagctagagattagcaaatgacgccatttatttaaatagcttgggagaacgagctctcttaaatgtaatggtatccttggcagttcgctgcccctaggcacaagctggttcaagcttagcctccccagaggggacaagacttcataatggtgagggtgtgggtgattgcttttggaggggctttgttgttgtggttgtacccccgatgactcacccgatcgggctgagtcactgtccactgcctgggctctggggacacacagcctctgtttctcacatgaacctttgattatttgacattcccttttcacttaccatcaggatagagcccttggtctctttcattccttttttaaaatttgtttttccttagctcatgagctgaagaaagacttttattcacactgagatatgagggaaaatgggaggttatagtctgggaggaagcagttgttttttgagagtggtggtagatgatattaaaggagtgaaatcccctgattcatagctggtaggtcaagtatgggtgggaaaaaaaaagtgttcctcctgggctcggatccttgtggaaatagaatatatcagggctctgggttagtttcaggaatttcacaattacccgtttttatcattgttgcctatgaaattgagtgttttaaaggatgctaattaatattggagatactatacattttggctgaatggctgagtatataattcaacatatcaatataaggctgaaggcaaacatcaccatcatagaataagcgaggatataagaataaattagaaaatttatcagaattttaaatcattatcacagtctcaatatttaacatattaatagtcaaaatttaaaagtctgacactt

SEQ ID NO: 76040 - DNA, 1543 bp, Homo sapiens; identical to SEQ ID NO: 76039

SEQ ID NO: 76041 - DNA, 1543 bp, Homo sapiens; identical to SEQ ID NO: 76039

SEQ ID NO: 76042 - DNA, 1543 bp, Homo sapiens; identical to SEQ ID NO: 76039

SEQ ID NO: 76043 - DNA, 1057 bp, Homo sapiens
tcacagctcactgcaacctggacttccccaagctcaagtgatcctcccacctcagcctcctgagtagctggggctagaggtgggtgccaacgtgcctggttaatttttataattcttgtagagatggggttttgccatgttgcccaggctggccttgaactcctgagctcaagtgatccccctcacctcagccaaagtgctgggattacaggcatgagccaccacgcctggccagaatcaatcactttagatcagtcctcagccatcacctaagagtcccaagtaaactccttataaggctgagaggcaatcgctgatatccctgctttgaacttgaccctcttacaagatttacatactctttaatgatggaatgataaaagtggtggtgtccagcagaactttctgtgataatgaaaatgttctatattctgtaaatgtctataggtgtctataaacatctatacgtgttctatattggccactagccacagttagttgtggagtacttgaaatgtgtcttgtgtgactgaagagctgaattttctattttaattaattgagaatttaaattgcctcatgtggctagtggctgcctattggacagcacagatgtatctcattgctactcaaaatgtggtccccagaccaggagcattgctatcacctgggaacttattagaaatgaggactctcagccgggcatggtggctcacgcctgtaatcctagcactttgggaggccaaggcgggcggattgtctgagctcgggagttcgagaccagcctgggcaacacagtgaaaccctgactctactaaaaaatacaaaaattagctgggcgtggcggcatgcacctgtagtcccagctactcgggaggctgagggaggagaatcacttgaacccaggaggcagagcttgcagtgagctgagatcgctcaactgcactccagcctgggcgacagagggacactccatctcctaaaaaaaaaaaaaaagaggactctcagacccatctagttctactgaattagagctgcagtttagcaagatccacag

SEQ ID NO: 76044 - DNA, 1057 bp, Homo sapiens; identical to SEQ ID NO: 76043

SEQ ID NO: 76045 - DNA, 1057 bp, Homo sapiens; identical to SEQ ID NO: 76043

SEQ ID NO: 76046 - DNA, 1057 bp, Homo sapiens; identical to SEQ ID NO: 76043

SEQ ID NO: 76047 - DNA, 1055 bp, Homo sapiens
gaacctgggagacggatgctgcaatgagctgagatcacaccactgcactgcagcctgggcgaccgagggcaaccccgcctcaaaaaaaaaaacaaaaaaacaaaacttgcttcttactggtggagtagaaatcagtggcccacagaggcttaggtggcaatgggagtgagaagacctctatttacatgttcatgataggcctaggtgatggatcctgactaggatggttagtgtggaaagaagcagttgagcaccatgttttggcaaaattcaaaggctgggaggttcccaaaggcaaggaggaggaggctggtaccacaggtccagggcagcaagttgagtggaaagtctgggaaaggtttgtgtgggaagcacgggagactcttaccccatagctacgaaagtcggtttcttcccagccttgtgttccctgcttcatgaccaacaagcgcttaagtacgaaactcagaggagggcagacagaaatgatgatagctggagagagaattaagccctttggggagaggttatattcaacaagtgggaggagaggttcccctcaacttttgagggagtgggggatcattggaaaggcctggaatctagtgggaatttggtgttttgacatgaatgctctctgactttgtttttgccctttggctgtgtacctagtgtgtgtcagttcctggagctgtgtcagagcccagaaggtggctttggaggaggacccggtcagtatccacaccttgcacccacatatgcagcagtcaatgcattgtgcatcattggcaccgaggaggcctatgacatcattaacaggtacagtgaaagccagcagtgacagaaacctagaggagttccccgcctgctgacacgcactgactgttgcctctcctacctctttccctgtttctcagagagaagcttcttcagtatttgtactccctgaagcaacctgacggctcctttctcatgcatgtcggaggtgaggtggatgtgaggtgagtggggttttgcacaggctgccacatcagttgactctagagctcatctgc

SEQ ID NO: 76048 - DNA, 1048 bp, Homo sapiens
agatggaaactaggcccttcttttatgtttcttaggagcccttaggaatatactttttgtttgttttgttttgagatggagtttctttctgttgcccaggcaggagcgcagtggtgggatcttggctcactgcaacctctgtctctggggttcaaacgattctcctgcctcggtctcccaagtagctgggattacaggcgtgtgccaccatgcccagctaatttttgtatttttagtagagacgaggtctcaccatgttggccaggctagtctcgaactcctgacctcaaataatccacctgccttagcctcccaaagtgctgggattacaggcatgagctaccatgcctggccaggagaaggatttttgagcagaattcaaaccaatgatttttgtcttccctgtgccgggtatttgaaaaaaccatagaggggaaggaaaggcagtctgtgtgtgtataccatgacagagggagaagctgaaataaaatgtgccccgagaagaattagggctgggaggatggaacagcaagaatgatcctaaatcaagtataataattttttgtgtttgtttttttttttgagacagagtctcactctgttgcccaagctggaatgcagtggcatgatcttggctcactgcaacccccgcctcccgggttcaagtggttctcctgcctcagcctcccaagtagttgggactacgggcacacgccaccatgcccagctaatttttgtgtttttagtggagacggggtttcgcaatattggtcaggttggtcttgaactcctggcctcgtgatccacctgcctcagcctcccaaagtgctgggattacaggcatgagcaactgtgcccagcctaataatgcttttttaaaaaatagcccgggcgcggtggcttatgcctgtaatcccagcactttgggaggccaaggcaggtggattgcttgaggtcaggagtttgaaaccagcctagccaacatggcgaaaccccatctccactaaaaatagaaaaataagccaggcatggtggcatgcgcctgtaa

SEQ ID NO: 76049 - DNA, 1048 bp, Homo sapiens; identical to SEQ ID NO: 76048

SEQ ID NO: 76050 - DNA, 1048 bp, Homo sapiens; identical to SEQ ID NO: 76048

SEQ ID NO: 76051 - DNA, 1048 bp, Homo sapiens; identical to SEQ ID NO: 76048

SEQ ID NO: 76052 - DNA, 1024 bp, Homo sapiens
gcaaaacaaaaaatatagacgtgcgcctttttcatttaacgtgtgtgtgtgtgtgtgtgtgtgtgtgtgtgtgtgtgtgtactggtgagaggtttgaaatcaaggctcttttctccctctagaggtttaaggactgtattggagtggactcacctgttcctatccttgtttgatctattacaatttggtggcctgttttgcagtttatctgttgcagaaaaagtatagttaatctttaatgtgtcaaggctgtaaacagaaatcctggctctgaaacagtactaacatccaaatgaatgagcatatcagaagtacctgaatgataccatagatttatggcaaccattataggtctttgaaagaagagctgaatccacttttgacatgaattgatatggctgttatttcctctgatgtagattggaccatgtggaggtagggagaatagaatgtcatgttctttcactgaagccatgccgtgagcaactctatccaaatagaatgtcacacctctcagttggagacccaggaggactgaccgtgtgccaagagtgaggacaggaggtgattacagcttactaggcaaggcgagcagtccgcccgcggagttcactgagcctcattagctcttccgtagagcttaatgtgtttcccgtttctgtctttccagaagcgcatactgtgctgcctccgtagcctcgctgaccaacatcatcactccagacctctttgagggcactgctgaatggatagcaaggtgagagaagccagggtttctcctggcctcttggagagcaggcggtcacgacactacttcagaaaaataaagaaaatgcagagggacttggaaggaaatacaaaaatcacaggagatccattagggttatctaatgatttttttaaatacttaaaatgtcttcttttttccaaactttctttaatgttatattatattttagattggcaaagataaaaaactttggtaaacaatattagtgagagcctgaattgatttaaccagttt

SEQ ID NO: 76053 - DNA, 1126 bp, Homo sapiens
ggcagcccaacatttatgtctggaccccacgctcctggccagtattcagaagaaactcagaaagcagtcagcttcagggagtcactagattgtagttaaatgatcagtgggtgcacaaacacacacacctccacggccaccagggagaaggcattccccgtcatgtcatttggggagcatgtaccccctgaccatgacgtcaaagcaaaccagctgcaactgacatgcacctcctctccctgagttcagatgccagcctcccgttatgcggcccatcgtgagcttcctggagagtttctgttgtaccctgtagacatgtaaccagcagtgtcttgcctccaccttcagaaagcctcccccggtgtagtctttttaaagattcatgaaggcttgaaggctcatgctgaaacagccaactttgtatgctgaacttaagagtttctcagatgttttaaaatctgaacaccaataaggcatgaaacaaaaaagtcccatctcccaggcagagataaggaatgtgattagggagtgcctcagttataaagacagtgttctagatttgaaccctgtccctactacatttgagacatgagtccttgggcaaattgtctaatctcttttagcttgatatttttttcttttataaggtagggataacaatccttatttttttaaggttaaaggagagaacatttataaacagcctggcacatagtaggtacttaataaatgttagtgtccctctaacccacagtaataatctttttggcacaagggaccagttttgtgggagataatttttccgtggacctggggttgggggtgggacggggggtgatggcttcaggatgattcaagtacattacatttattgtgtactttatttctattattacactgtaatatataatgaaataattatacaactcaccataatgtagaatcagtgagagccctgagcttgttttctttcaactagacagtcccatttgggggtgatgggagacagtgacagatcatcaggcattagactctcatgtagagcgtgcaacctagaagcctggcatacacggttcacagtagggtttgcgctcctatgagaatctaatgctgctgctgatctgtc

SEQ ID NO: 76054 - DNA, 1126 bp, Homo sapiens; identical to SEQ ID NO: 76053

SEQ ID NO: 76055 - DNA, 1126 bp, Homo sapiens; identical to SEQ ID NO: 76053

SEQ ID NO: 76056 - DNA, 1126 bp, Homo sapiens; identical to SEQ ID NO: 76053

SEQ ID NO: 76057 - DNA, 1067 bp, Homo sapiens
ttatgcctatagtggtataagtgaaaaacataagctacacagttataataactaggtagaaaaacgcatagaaccaaaaagactggaagaaagaacaattagctttcaggtgccatttaccaattgttgggcatcttttttttaaaaatgatttattgtcaggcatcttttagcccaggtatcaaaatataaaattgaccaaggacttagtgtacatcctatatgtatatatatttttaatcgatttctatgcagatgtttctgcacacctgtccgtgatttgtccctccttcccacttgataactgtgtggcccacagaattctttgaccatagtgattggacttcagagtgaagaagtccagttgcttgtcagtaccttagtagtattaccagaatacccagtttttgctagggtatcatatgatgcaggagggcagttactagtaatgtttcttaggtaaattctttgagctgagagacaagttagagaattccctttggagatcaattaaatttaggcttagaaaagtagaagaaacagactttattacccattaagagttctctgagctaatcagtctggttaacaagttatagagatatgctagagggaatgtctcttgaagtccagggtagagttatggaccaagttgggagcagctaccgaggtcagtctgggaaggtaagctaaacagctaggctggttcactgcctgccagagatgtggttgaggatcaccatccacgttaacagggtgcatttcaagaaagtgaaagtgccactttgaattgctgctctttgacacatgtcaaagttcaggagaagggacatgctgtgcgtaggacatggggaagatagcagttgtaccaagaatgaatggaagaggaaggggagcaggaaaccttgactattcccccaggtgagaaagtggaattaggtcattgatacttggctggatctgccgggcccttactgaccctttgcccttcaacaggtgaccctgcccttagcatgagccactggatgttccatcagcaggccctgcaggagtacatcctgatgtgc

SEQ ID NO: 76058 - DNA, 1028 bp, Homo sapiens
caaggatcaaatgagaggcggtagaacaggagggactgtcttaggggttattgtttgggcagatgaggcaagagtggtcagcactttttaagcagcaggtaaagccttggtcttggggctaattggtggtagagttttgtatatagtcacgccacatcatgttttggttaacaacagaatgcatgtacgacagtggtcccgtgagatcataatactgtatttttactgtaccttttccatgtttagattcacaaatacttaccactgtgttccagttgcctacagtatccagtacggtgacaagctgcacaggtttgtagcctaggagcaacaggctaccccatctagcctaggtgtgcggtagggtaggccatctaggtctgtgtaagtgcactccatgatgttcacacaacgacgagatcacctgactgcttttctcagggtgtatcctcgtcattaagtgacatgactgtattaggttgctttcagttgcaggtaatagtaagtccaactcacattgtctcatataactgaaaatccagaggccacgtgggcctcgggagccatgtgatcagggccatgtttctcagtctcagagcatatgtgtgtgctggcttctcacgctggtttccttctaggtagaaaaatggttataggaggcccaggccacacattctaccatcccctaataggaaagagctgcttttccccgtcatacagtgtccacgacgtctctctctttagactattttaggtcacatgcttgtgctctgaattgatcactggggcaaggacaaatcatgctgactgacttaagcctgagttactcccaacctgaacaaattactggggcaaagagagataaatgaaaattattggcttagccagtcagggcctgggcctggaggtaggagggcatcaagccctggcaaaccttttggctgccacaggtggggaggagtggcatggatgccaacagtgtccctacaggcttctatcccagtaatcactgtttgagagcaatggcc

SEQ ID NO: 76059 - DNA, 1057 bp, Homo sapiens
acatggtgagcggactttggcacagggtggaggtaccactggaagcagcttcctgggcaggaacacagggcaggggagctccgcctggaaactgctcagctgaaaaggccaagtcaaagtcacagccaagcaagccccttctggtatgtgtgtctaggaagcgagtgtgagtattccctcaggataccaaagtcggaccatagcttactctctcacagtaatggtaatctctggtttattttttatattactctggacactcacttacacaaaaccagataagctgtagatttgcttggtcactgtggcaggtggcttcactgaggagtctgttaagcgtgctatttccctacctttacagttgccccaagtgcaagggtatttaaaatggcccagtttttaaagttcttgatacgctaaccccattgtaaaacatcaacaacttcttaggtaaagaatctaagctcacagagctgtcatcttagctgagacaggtttaaaaaacaagactgagtagacaataggagccagagccctgaactgggactgaagtaagcagaattctgtttctgatagtatcatgtgtgttttatgcttggcctctgaaagcagactggctgggttcacagtcctgtctctgccactcggtggctgtgttacttctcccagcctcagcatctttatctataaaatgaggataataatagcactagcctcatgagatggttatgaggcttaaatgagataatgcttataatgtgcttgacctcaggaccaagcaagcactgaggtgcctctgctgtcattatctacacaaagcatgtaaccagggctgactcagcaaggtggaaaaagccagctcccagacacctttcctaaagtgagtaagggttgacttcttggtatatcacaaatgcttcccactcctcagagatgtgccccatccttaccaggcacagtgactaaagagagcaaggtgacaccaggactggactgacaaactcttcgagactaaagcagcccctgtgggtacattaattagatctggtgtcaactc

SEQ ID NO: 76060 - DNA, 1013 bp, Homo sapiens
cagtgaagcagcagccaccagggagtggccatttggggttgggacagggagggtgttttgggtggcatagaggttttgtattgagggccagtgatgatgttttgatatttatttcctgctacttaaatttgaatctgagtgaattgtacctatttctgatgatgtcggtcttgcaaagcgacagattcataaagtaatgatgaaatctttctttcttcccgtgtgtatttctaagaaatagagccaactgattttgtatgtaaataccaagagcaatttacctggtactaaacccgcaccccagtgcggacccttcccagccctcatcccacttcctttcctactgtcctggaacctgtctccattgtgtgatccagccctggttctggctgtggtcagcagatgccagtgaagggttttgtgtgtttaggcctcatttctttgtctttttcctactccgttcctggcatttgctgatttctagtgtatactctgtagtctcagttcgtgtttgattccattccatggaaataaaaagtatgttgtacatactgccgaagaattgtcttgcaagttaaggcttccccctttactataagactataaataaaaacttattttatccttcttggtggtggtgtcttcttacccttgttaaggccaaggtggttgatgagagacccctctggaagctgttagggcctcaatgtaagtctgagtgagaagtggaggtggcttacccggtcttgcagaaccaggagcagccataagccagagttgcttcccctttctcagctcagcctgagagagtaaatgggtggtgatggctttgttcattggatgaggcttttgaggttcaacagggatgtagccttagctgtggcaacatttctagatctagtttctgctaagcaagtgacctttgggggaattggtagcccagagctgtggttcaggttctcctggtaatgagtgcccagttcagaggtggctgttctccaggacctttcagt

SEQ ID NO: 76061 - DNA, 1410 bp, Homo sapiens
caaataaaataaaataaaataaattaaatgggttgaccttccaggctcaagctgagctgaaccaagggatgggcagtgggtggtgtcagtgggttggttactgggccaggcagcctgcatgtaggggctatttgaaaagcccaggtattttatgtgtattggtgacttgcttccaagtgtccagcttgtcattccaagtggatcttgtacacgagagctaagccaaaactgttctttggctgatacgtcttatgtcatcctttcctgctgttgtgtggcctcacaccttgtggagcctcatgctcctgggccagcttctcctctgttattgcactgctgaatcccacagggagctcacgctccagtctctccacggggcttccacggcaggacggtgacatcacaagccttctcttcagagttgggtgggattgcagagtgtctgctggctcccaggtccagctgggaaaggcgggagggaaatgaagtgtgtgagtgaacagccacccgaagggagctacttctgagcatcttgagcctcgggggccaacaagcaagcccttaggaagaacaggctggaccctgagtctgagactcggttactccccaagtctccagaaggcagtaacacactcccttggttgccttttagtccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggccagcaataaaaactgtctgtctccatcgtctcatcctcctttcagttcgttggtagagccctcagaaccatttaagagactctttatttttctctttctcccttttttttttaaatttttatttttacgtagaagctcttggacaacagctctcgttctccttccccatttccactgtatattttttaatgtattcccttcagggattccctgtccccaacaggaatttttaaaccaaaacaccccaacttggcagctttttctgtggaggacagacggccggccggacctctgagcacatagtgtcctgcccaccctaccagctcctccagccctgccgggcacatgcccgggggacgcctgccctgcccaggtggcctcctggcccgccctcacctctgatagactttgtgaatctgaactgctctactttgagaagatgaccggtttggagtaatcagaatgaaccctcctcctttttaagggttttttttttttcctttttctaaaaagctatgtatcgctcctattgaaagaccagatccttagagaag

SEQ ID NO: 76062 - DNA, 4390 bp, Homo sapiens
ctgctagaagcctgtttagttctcacctgtctttaaaatagaaagaaaaataaccttccttcaatgctgctatcctgctattacaaactaccatttttcacttttttttttttatacagggtctcactcttttttttcaggctggagtgtgttggcacaagcctgtctcactgcagcttcagccccatgggctcaagagatcctcccacctttgcctcccaagtagctgggaccacattcgtgtaccaccatgcccagctaatcttttgatttttttatagagcccaagtgtcttgctgtgttttctaggctggtccccaacacctgagccctagtgatcctcccacctcagcctcccagggtgctgggattacaggcatgagccactgcacctggcctacttcttacttttcaaccaaattctgaagactagtcttcatcattgcctcacttgcaactcaattcttatgcctgttaccggtgcagagacaatttaccattgggcttcggctgtcactcctccaagaaaaccaccttcactagggtcttccatttgacgtccttgtaggcaaatcaggtgactttcgtagtccttttcctcctccaactttcccctccatgacaacagtgtccctgcaattctattgatctttttaaattagttccatagcttcccctgtgttcccaaagtatgagtgtcctggaggcttggattcaaatcctgactcaacttcctattagtttacataacattgggtaaattacagctctgtgtctcggtttcctcatttataaaatagggaaaacatcagaaggttgtgtgaggatgcctgacacttagtaagtactcagtaagtgttagtgctgccattgttaccacccccatcatcattgtcacttgtgttgctatgtgcagccatggctttggagcaagatctcgcaaggctgcccagtatccctttgtgtggctcccagaggtgagagagaggcctgctgagccctttgcgtttgcttacatggctacatgggaggcctggctacctcttcagtcccttcagccaccatccaccctgtctcagggctccatccaagccatttaaagagccatttctgttcacaaagacagactcaaaattatgattctgctaattataaaaactatcaggaaaaaaattttcaggcttttactgagtacccaaggcagcacttgctctgtggacatgttgacttaccaagttctatctgatcagtcacactcacatgaagataggcagttgactcagctgacttagagcaattttcagaaaacagaaactgaaagtccagggttattccatagtccatgccataaatcccagggtttcttgctggtttcgtgtttgctggtcacatattataaactcataaagacaaggaaggccctgcccccaccttcatcctgtgtttggccacatgatcttgtatggagtggaaagatgggaggggaggattgcaggtgagtctagcatttttagcttcagccttttgctttttctttcctggactacatgcacatgcaaatttggggtatttctgtattttgtgctttaaatttttttcttgttgggccttaattcttgttgggtaccctgggaagagtaaaataaagttaactctgaaccattcttttggacttgctgagggatcagggcaccctaagtgaccaggggcacttctgctttcagcagaggatggaggaagggctgtgcttagcattctgaaggcctcgttctgagtttaaaccaatccagccttctttggactcctgttgttcccaagacactatgttctgaacatctatgaattttatcttcatccaaaaattaccctgaaatggaaactgccatccctcacagatctttttctctcttctggcttgttttgctgtgcttactgctcacttttcacttcttgatcctaattccctggtttcatgtataaatatttgaaggagaaactggtagcaaaaaggctgttactcagtctggtcattcattaaaagttatcactgaacatttgcaagtgctctctggtttcagagattgtgcattttttcccttgtcccggatgcacatgggtagttaagagctaatgttgccttctgggaactattagttgaaaaaatagcttttacataggcaaatttaaatagagggatgtaaattacatcagtgatggaaagggtagactttggagggctagatggggtcttagagaatttctagtcagatgaggaataggcaaggtgagaaatgtgtctgcagctacagaacccattaatgacaagcatgcagagcactcctctgtcctctaattcccaaattcttccttgccactctaccacctcttatcaatactaatcatttttcattccatctccagtatccagagaggaaggtattttaattagtcccttctaattatgtgctccttttttccaccccattttgtcacctaataaaccctaataaggtccctttgtagaaatgggaaacagtgtctgaagtatccattgctaggctaggaactctcattccttctgcataagctgactgactcaactaaagaaacgcatctcactttttccccatcccatcttgactgtgctattccaaacgccaccttggtctaacacagggctcaccatttcagataggagcgtgttgcatgcacacatgcagcaccaaggccaatgcgtagcacacagtaggtaatcaccccagccagaagccatctttcccgtggtgtctctagtctctgctagtcaggttacgcttgtcagcactgccctgtgatatttccatgtatagacatatttatctcctcaactagatagtaagtaagctttggggcaaagaagccatgactaatacattttgtttccccacagtatctgcctagtatcttgtacgtaatttgcacctgataaaaatggttgattatgaacaatttccttgaggaaattaccttaagggtgctaaagaggaaagcctggaaattctagtacttgtgaggacttatgaataagcacgggccttacaaacctttctgaaactcagcccaaactgaggcctataaattgagattgttaggatttaatatgagtagatctggttttgctagccacggtgtacatgttttctttgtctttctcccgctgttgtgttctggttgtttaggacccattgggcttgtaatacagaattgtcaagcactccctaccctgagtaagaagctttccggctgctcaggagtctctggctggaaggccatacttaagctactaggctaccccgccttgagcttcgcttggctttgtactattctaccagtttggctggctgcctggccataagtaactctgactatgtttgtagcctggagagaatctcccagacaagtttgatgtctaggggcacagtaacatgacatccatgttattgacttacgaacttactctagcaaggcagtacccaggcaacccacagccattgtagaggtgtggttgtttcctgaaatggcccaatctcatgctcttcctgtgttgacatcaagcaccgacagctttttatgaaagtctctttagccaggaaggctgaagtagtgacacagcagcattgttcagttcggaatagttaacagtggtttcagagtttggctggaatcttgggtcttgatgaaacacattgtacccattcctgtctcaagccaggccctagcagaattagtgacctaaagctttcatttaagtagtattttaatgtttccagacatagccaagctaaagactttaaagcaacctaaagaaccagaggagatgggaggagtacagttcaggagtcggatggctctgagtttaaagccaggccatgctactgtgcagctggtgattttgaataaagcggtgtacttctctgatccttgggttcttagtagagctacctctgagactaatcttgtgagttaagctctgtaaagcacttggcaccttgtatgtcacaaagaaggccttcacggatgcagtggctcacgcctgtaatcccagcagtttgggaggccgaggtaggtggatcacctgaggtgaggagtttgagaccagtctggccaacatggtgaaaccccatctttattaaaaatgtaaaaattagccaggcaacgtggcatgtacttgtaatcccagctactctggaggctgaggcagaagaatcacttgaacctgggaggtggaggttgcagtgagctgagatcacaccactctactccagcctgggcaacagagcgagactacgtctccaaaaaaaaaaaaacaacaacaacaacaacaacaacaggctgggcgcagtggctcaca

SEQ ID NO: 76063 - DNA, 2112 bp, Homo sapiens
gcagggaaactgctgtttttaaaaccatcagctctcacgaaatttattccctatcacaagaacaacatgggaaagaccaacccccatgattcaattactgctcactaggttcctcccccgacacatgggaattgtgggagttaaattcaagatgagatttgggtagggacacagccaaaccatatcaacccctcttctgtttgcccaggaatttcattctcagcttatctgagtgctttgcttttctcaaggtccaaccccagccacactgcccaggtgacttgggggttccatattgatgagccctgctcacaaggcctacctgcagcctgtcctctatttcctgagttccccccttccctcagtctccagctccttgccttagaggccaatatcaaatactgcccctcccttagaactctcccttgaacctctgtggccttttgtgggacctctcctcagtctccctaatttctgtgattaacttatcacctaattaaatggtatgctcctgtagggcagaaatctaattattccttctgggagactgtcatacagaatgagagaggtctcactcccccaagagtactagagagctcttcacctaacatttttcgcatcttgagattcggaaggatagagattgattactaggccttgcctttagcatttttgttttctccaacaaaattgcaaaaactttagaaaaatgggaagaagaaaaaacatgaatccctccttcctctaacacaactacagccttccctttggctatgacaaatgctgcccaacagaaatttagcatgagtcacaattgcattttaaatataacttaaatacaattaaattttcgagtagaaccaattaaaaagttaaacaggtgaaaatttgaataatataatttatttagcctaatattcaaaagtaagtatgatctcaacatgtaatcaatatatttaaaattatttattcaccaagtctttaaattcaacttaacagcacatctcaattcagagtactcacatttcaagtgtttattagccacatgtggctagtgactatcagatcagatagtataatccaaaaatagactctccgtaccccccctgccccatttaatgtgactaaaattagacatcatcttaaagtggatgtgaaaagaaacctgcctcctttttttctccccaaaagctgctattgttcaatccatggatttattgatggagtctaacaagcaaggaaatatagtgttatcaatttgtgtattccttcctggtctcttcatctacatgctccccacagggaaagtactatttatagcttgctgcttttacataatatattttttcgctaggtcatacagtgtgctcatgtttagtcattaggcatgtttcttttgggcaattggggttgcattcaatttttaaaatttaaaatttataattataatatggacatctctgtatatgtagccatttccatagactccaagaagttggatttctgggttgaggggtgcgagcatctgacctttttccgtgtgttgccaaaatgctttccaagaggattgtttttatatcctctttcttccatttctttctttttttcaagcaaattctaaagagtagtcttttggtagtgttttgagagtaccagtttcattatcactggaatttttttttttggaagagggtaactaattcagtaaacaaaagttagtaattttgtattctatttattacttgtgaaattaattgcttttccacatgtttatttactagctctatttcctcttttggaaattgtgtactcctgtccttcatcgtcaaagtttgatgcagaaatgccacaccttcatttcaagctaccaagtgcacaagaaaaaagaatgcaagatttaaaaaatgattgttttgaccccttacacaaatgtcttactcctggctttaattaagctgcttgagggctgatagctctgccttaccctggtaatcagcaaaatggtcctgtggctggggaggccctggcagcaggaagccttcaaggagccatgggtctgtgctgactctggccttacaaccttccagcctcctttgctggcattgatggggt

SEQ ID NO: 76064 - DNA, 1154 bp, Homo sapiens
aaaatctggttttcttaacaggtagatgttgaaaccaaatataatagttcccttatggcagggaacatgattcttaaggataaaggctctcatagcatttatacttttatgtacacacatttatatattatacttaatatatgaggttttatatatatttgtgtgattattaaatgactgtctgctggcactacactacaataagtaccgtgaaggcagggagaatgtctccttttggttatatttcttccctcagtgcctgcacatagtagggagcatagtgaatatttattaactgaggggaggaatcccccatcaacctggccacattattttgggagatggctcattcctgttgatgcgtttaaggctgacagttcattcggtaacctatgtctatagcatatctgagctgctagagggattgtcgtttaaatgaaatgtaaactatagccctatccacttctcctcattactcattaaggttatattagctagtcagactccaacttgggcaattatctttttaaagtttctacatcttaaattgttgcccatagttgcccaagtctcccttaggctccaggctcagcaattgtaaatgcatttaatttcttataaattatttgcatgctgctgaaaacctccaagggcttttcattgcccatttaggtaaggactggtattccatgttctgtaaataagatacccagcttacctacctgctttttcgcctccttcctgacattaaccttccagttactatacacccttgtattagtccgttttcgtgctgctgataaagacatacctgagactgggcaatttacaaaagaaggaggtttagtggacttacagttccacgtggctggaaggaagcctcacaatcatggcgaaggcaaggaggagcaagtcatgtcttacatggatggcagcaggcaaagagagagagcttgtgcagggaaactcctgtttttaaaaccatcagatcttgcaagacttattcactatcacgagaacagcatgggaaagacctgtccccgtgattcaattacctcccaccgagttcctgccacaacacatgggaattacaattcaagatgagatttgggtggagacacagccaaactatattattctgctcctggcccctc

SEQ ID NO: 76065 - DNA, 1060 bp, Homo sapiens
tctactataaattaaacattttaaaaaatggttggctgggcatggtggctgatgcctgtaataccagcactttgggagacaggcaggtggatcgcttgaacccaggcgtttgagaccaacctaagcaacaaggcaaaactgcatctctacaaaaaatacaaaaattagttgggcgtggtgatgcttacctgtagtcctggctacttgggaggctgtggtgggaggatcacttgagtctgggaggtccaggctgcagtgagctgtgatggcaccgctccagcctggatgacagagtgagaccctgtctcaaaaaaataaaaaataagaattacctttttcttgaggaaaaaaatcagtaataattgacattgtattgcaatgtaaaattaaatccacacagcagttgtataaggtatggtactgttatttgacagttagttattactgctgttgctcctgtcagtgttgttaacaggctcaagatcactatcccatctgtaacaggacaggggctagaactcaggattgccagttgcaagttccatctttttcctataccatatgtgtaagcagtttaaggatattttaaagaaatcttgcttaaatacttgtatcttgtcattgtcctgggagcttcccctggataggcctattaatcttggcagtgtgtcataccacggctactacagaaatgctatcctctgaggtggcgtatgtaggtaacactgaaatgcagggtattaaggatcatttaaagcctataatttctttctgagttcacatagttgctctgagctcaagaaaatagaccattacagttggtggttcatttgggttttgccataggtcccagagttagcaagtagaccctcgaactctgttgtttgagtcttttgtgttccttgcagtttctcaactgtatgtggagttccactgttgttccactgggaacaataggatggaattagaatcatcagccagccaaccagagtaatggagtaagggcaagatcaactgtggccccctccccgctttttttttttttttttttttttttttt

SEQ ID NO: 76066 - DNA, 4764 bp, Homo sapiens
ggattgtgggtaattctggtgcacagctcttagctgggaggagggccaagaatcagggtgatttagtagacaggagtatcttgggctgctctggagaccaaagatgggcaattaatttgcatgtaaataaaccaccttaggtagtatatagcaaacaggagccgcagacacatgccaaatattgtctcttggcctttaagctccttaggtatagtcgcagcccaacttatctttatgtagatgatcagagggaacaacagtaagttcaaaaggactagatacttaaataggttcaattctgtcgcactatttcatgctactgttagaaggcatctataattttgcgctaaagttgtatgatacagagtacctacctctaccctcaggttatgtggtgttccaaacttgactgtcctctcagcttcatatttcatgtcactatagttcagtaaacattcattttacagtgaatccagacttaacaagattaggacaactttagaagtgctccaggcatctgccccaaaaagagagatatgctatggagaaccatggttgtcatgggaaccacatgtccagttcaacagagctgtaggtgaggtattatgtttaagagaccaggaagtaactcagatgactacaggtgctcccagtctcctcttcctctgtaatgactgggacttttaggattaaataacaggagaatttcaagtcctttcgttttcacaactcttgatagatttttgtctgtacatcttctctagtacaaggattaatgtgaggcagcattattcttgtgctaagccaagttatttactcttgttccattttttgaatttctggccctctgtttgtatagatttaagctacctgaacttcccatgtacagactggctctctagattagctcagtgcaacgttgtgcattcaaggtgaatgttcagagcataatttccgtaattcctagagtgtaggtgtgatgaagttcttcttgctttgggttgtttgtgttccatttggaggggagacccctctgatggggacctgctgaagtgctcttatcatgctctccagcgctatctcttctgcctgaagccagagcattttgccattcctgatttggtgttggcagttttggtccatctccagctgaccgttctttgtgattccaagcaggctaaggctttgacttggatatttagatactgccagttagcctgacctgccacaggtacctgagagaatttattctgagtatgtggtgtcagaagttgtgccctctaagaactgcctgtcaggcactgcctgtgtgcaaggaagcccttggcaggatagcaccttggatctacttttaaaaaataggaactcagaattcagttgtcatcttatcagctctgtcataatgatctcagattcatgcatctaggttttatagaggttttagcttctgttgtatgatttggtgagaaggtcttaaactagtgccttttagtgggcttgggactcatggtgatggtttcacattaaagaagcaccagtgacttaactctttcttcccctggacacccatctggggaatctcttacagtggaggtgatcacatcttaagaaggggccactggagctttctctagtcacttcctaaccacagactggtggctcttctgtcacataagcaagttgggggggaccactgatgttacaggagagtcacactttgtccccctgaataacttttattttacttatgcatgagctggatgcatcgagctactttggatgttcctgtcgcaagcgttgctcacccctttctccccctttagcagagcctaattctggagactcctaactgcccacctcgagaaatccttcccagtccactcgccagggacagtgctgacagcgtgtacttccaggctgtaccccacccaccttgtaccaagcaaaaggagtgacattcctaatgtgttctttctcccattcttctaggctgacaaacgggctcatcataatgcactggaacgaaaacgtagggaccacatcaaagacagctttcacagtttgcgggactcagtcccatcactccaaggagagaaggtgagtttcctgagaaagctgagtagctggccactactagcttggaacttgttgcagagcttagcagagcactcacctattgggaaggaaatgtagtcagagatattcaggtagcatggttgccttatttttgactgtttggaggatcactgcacaccttacgtactccagtttatccttaacaaaatatgtcagatataatggagctatttgtgagataatggtaggagttatcttttaaaatttgtattatttgtaataaattcaagaaattataactatacactatagtataaagagtggccaagagttcgtttgggataacagtaaagattccagaggtcattaataccctagacctccatgagaattcctttcctatggttcaaagttaatactttattgtaaatgagcacttgcagaaatgtgtgtaatgtatgtgaaaaacaacctgggcaccattgattttccagccccaataattgttatttccaaggcgtataaagagcattttaagctgtgggacaaaagacttgagtgaagagacatgttcatgtgaaacagaaaaaaaataaccattcttccccactcccttctggaacctagtgttttccctggagggctaggcaccagctgtttctacatttgaaaaacaaaattagaagctttgagtaaaagcctatgggttagggtcactccctggaatttggagaaaacatctgcatggctagttccatccttgacagagagtgtagttgtctgtagcaattcattggaataactggcaagctgggaagaggacctgtgtttttgctttagtgatccagtgttttataaagaaggaactattctgttaagaacaatctttgcttttgggtgcactttgatttagttctgtggtgggggtcctggatttgtttggttatccaagatcaaatttggaacccttatgctttcattttttatattgtcactctggtaagttatggcctctatactttatctaaggtgtggctttccatgtggcgtaaacatggagaagttctgacctttataaagaacaaaacaggccatgtacatacctggtattgcaaaaccagaatttgccatgggttaagcctacttagtgtggacttgatttaatgaccttaaaccaaggtacttacctggaataacaaccttcctgggtacaacactaagtaccacggaaatctttatgactagagacagactcacccctttagtcaaagtaaacacatgccaaagattatctcttaggcttctttgacctgttgacagttggtgcttattcctgtaccatagtatcaattaaaattgctttggtaaactatatggaaaagagctgccttctcctaagtctcacctaaccaggagtggcactggggcagtgtttctcaaggggtgagttgcggaccacccacatacgattcactactgaatcagcctttctggatggaaacctgggaatctgtatttataacaagcagtcagatgattcttaggcattcttaagtttgaatacattgggagaggtgggtcataggatcacaactataccttttccttatccagcctattttacaatgccataacattcttccttaagtccttataattacattattctaaatcctattttctcctttctttcttcaaggaagttaaaggtttgaatttggtagtcttacaaatggaatagtctgtcatttgttgtggctcatttatttactcattcatgccattcaacacatacttactgagggtctgctacatgccaggcactatcctagatactgggagtacagcagtaaacaaaacagacaataacaggagctcttgctctgatgaggaaatgattaaaaaatgaagtaagaatttaaaatatatgtattatgtcaggtaagtaccatggagaaaaacagagaagaagagttgcaattttaattatggcagagaagaagagtgttgctggcaaggtgacattttagcaaagctttgaacaaagtgaagcaaagagtagtgcatctgtctggtaatgagcattccaggcagagggaatgcaagtgtggtagcactgagacaggaacctgtaagcattcctgggccaggcagggaaaacagaggccagagtgggtagagtggaatgagtgaagggatggtggcaggagatgctggcagaaaagtagcaggactaggagagaggagtggtccaggggaaccagattctagagccagtcaacaaaaccccaatttgagaatttactagataccattctaatttcagaatcctcctatcctgtgttataatccaaatatgtcctactgacagtgaatgaaggaaatgtctataagctctcaacctcttcctctttaaaaagcgagctgccagcgctgtttcataggtgccgtgagtcgaacagaatattttggtcccttagacttatcagttctcactaaacctggcgtttttttaagtgtggtatttgaactaaaggaaataggctcattcttagattgtggtaattaaggttatgacattatgtaaataatcatgaaatgattattttaccatgtgagttttgggaaacttagattcttaaagggaaagcctttgatttgggtctctctgtgttccagtctcctttg

SEQ ID NO: 76067 - DNA, 2837 bp, Homo sapiens
cctaggatttttccttttgattttgggggtaggcaaaggaagttggtttgacactttgtttttaatttaacacatctatttgttgatatttctaaatattactctgcacaatgtaattacaacagcatggagagaaaaagcagatatgttataaacaaattttatagtatatcaaacaactattgtgactgtgtagggtaaaaaggattccattttttcccctctgtgaatgcatctgcttacttctcaatatttaatatggataataaatatattttttaaaatttaagagggagctattcttaagttttgccttagaaaaaaggtttaaaaaaagatgtggactgtgaacaaccaaatacttaggtattcaggactacagaagatgttgaaaaagttatttgaaaagggttctgtggatcctaatataaaaacattcatgtatgttttataatgtcactacaatatataggccttactacatgagaaatgtaagatactgagaagagagttaggaagttaggctaactctaacagaaagtgaaactgatttggcaaatatttttttctattgcttcagtacaaacggaaaacagcttctccaatggccagtaagctttgttaaaggaagtaaccccaaagagtattcttactactaaattcagtacatcgcaaaatcccactgatgttatttttattatattttggagggaagaggttgcattttaaagataaatttgtgggacaggtatattatattgcaagggcttccttttgctttatttctgtttgggaaatttctttaggaaagagtgtaagtatacaggaaatgtatgggttagtgtgttggtcaggaaatgcaattttttttccagtgaccatccttgatggcacctgactgagttgcagttgcagtatacttgtgaggggtttgaaaacagatttgtgcaattccacttctggacctttctggcatgaaatatttttaacttctcagagctctttgcttctttaggaatattcagaagagaacgagcttggtagcctccgagattggaattcactcaggaaactactgtctgttttacctgcagtcagttgcatggcaaaagtgctgcacaatgcatgtactttttctctgcttagagtgttgacagtgatgcttacagtgataacaaatgccagagttagttcctaaatgtgcctgtgttagggtaaaagttgttcttatgtctaaaagaatttttccaagatgccagtaacggtgaaatagttggtcaaagaattcagcttggtttttaattaaaatttcctgaccaaggcatccttctctgaaatggctatagtatgaggccctgtttggattatagcatttgccagttattttaggcaccaaaagaaaaaagtttgaaaacaaatacatacattagataatgttggaaatgtataccaggcaatcagctacaagcaggacaggtattggaaaattgaaatccatgtctttctcttagggagcttggtgagtttatcccatcctacctgcctattattttatgttataatttttgggttgattaaaatgaatattttaagttgcttagaaattgagctttatcctatcttgttcttatctatcagaagtaagaaatagatcttttcggatgagatttttgggtctgtgtattctcgtgtccttagtctctaataagaatagcttgataagaatcataagcaacacaagcttccctctaaaatacaaccttcacattttgtaaaggtagtaaatattgagtgggcaactaattccctatatgctgagaattttctgtattagaattgagatggttccccttataggtggggttagctgtcaggtagcctgtaagacatggcattgttctggagaaccttgtgcatcctggaataatgaagcatttatttccccgtgctatttgcctagaacttggaggaaataagattactgactgatgtgatgccttgaacaaagatgcagtctctctgcagtaagttggaaggaaataattttaagagatttccctcaattttgaacagacctccttagcctagatgacttcttgccaacatagcaacttcttggctaacaaaataatgtttgtcttcaacatctaacaacacttaagatacacgtgcttggtagtgtcaaagatggacaaattgtaggtgaagatttttattctgtctaccagtgtggaaagttgggtagaaatataactgagaggctgaataaaaactttggcagagatgtcaaagctggaagtgatttggtgcgggagtttctgttgagcatctgtggaccactgcatagccccttagtatttctgttagggatgccctggaggaagggttttctggcagacatccagacgtacaaatccagcgtactagaagagtgggcagcatccagccactgtaaccataggatgtgtaggggagatgtttgggagcctgctgtacagtccaagaatacctctgtggtctcctagaatagggcctaattaattccacaagggggttttccgtaccatttgttttcattactgaacatcattctcagtacaggctcatctgagtagagttttatttgttcaagacaattgtttgggcttgttttttaaaaccagttttgcatttgggggaggatattagatgccttacactgggagtcttcacccagtttttcttcttcaactctgaaatcttggccctctcaaaaagggttgccagcaagcaaagacagttaacaaggcagtgataaagcctgcaaactagtcctccaatgggggtggggatgaggc

SEQ ID NO: 76068 - DNA, 1065 bp, Homo sapiens
gtcagtattgccagatcttcctatttttaattttattttatttatttatttttgagacagagtctcactctgtcaccaggctggagtgcaatggcgctatctcggcttactgcaacctccgcctcctgggttcaagcgattctcttgcctcagcctcccgaatagctgggactacaggcgcgtgccaccacacccagctaatttttgtatttttagtagagacggggtttcaccatgttggccaggctggtctcgatctcttaacctcgtgatctgccagcctcggcctcccaaagtgctgggattacaggcatgagccaccacgcccagccgatcttcctattttttaagaaagattagaaatctaaaactttatgttatttttctgatttttaaaatgatgtgtggaacaactgtttgggggcttgttagaatttgcaggatgtcactttgatacctctggtataagaacttgataaccacagggtaaaggcaagccatctcagttatacctgctcttcattagagcaagcaaagattgtgcaggttgtctaagcagataggcattaagaaaacttatttattgagagctgatatttccataaaatccggggatgtagttgttccaaaagtcttaaaaattatccctgggtaatagtcattaaagataatttgttttattttatttatccttgaagtattctcatatacttatgcatatatttgaaaattgaattcctttttcacatttacttttatccttcatgtttggggcctagtctgttgaaaactttttttttccctgcaagtctccagttgtaaaatctgtgctagggcttgatcagagctggagggtaaggatcgtttagccttcctttgcagaattatcctttgaattgaaattatactgacttcccagtaagagaaagttgtgttttttttgtttgtttgtttgtttgtttgtttttttggtgaaattttggctcgcagttcttgaaagctttctgcttttcaaaattttcatccatatgatcgttgatataaatttgttattaaattattata

SEQ ID NO: 76069 - DNA, 1909 bp, Homo sapiens
gcctcctctgccgcctcgggaggaaaatctcctgacaactcgcggtctgcggactacgactcccaggaggcgccgcgccgcggctctccccgcccccccccgcccccccccccctccccgggacgcgcaggcgccttgggctccgtcaacaagccgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgaggaggtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgtgagtcctggggcttcttccttcccgtgcgggttgtcaggcggggacagcggccggggctcttagcggggcgacggcgggagggggccgggctgccgccgcctccttccccttcccctcggggccaggagtgcctccgtcgcgttcccggttcgctcccctccggctcctggccggagcggcctcctgggactggaggttgggggaagacacgcggcttctgggacccccacctcctcccttgcgggagggtgctgcggcctcccgctcccaccttccccggctcaggatccgggggacaaggatggggggcgcccgggatcccattgtccggatccaggggaaggggacggcgttcaggacctgccccttcggactgcgatcctctcctcccgtgacccgcggatcctgggggccggggaagggcggagaggggttgggggtgcctagatgcccgagctgggtctgcagggaggagacagtgctcgggacccctctggcccaggtcggatcccggaaggaggggcggcgctcgggacccctctaccctgctaccggatcccgccgagggtggaagggtgggggcaaggggtggggagggaggaaggggtgtcgggctgactccccaccctccgcttcctctgccgccggcattttctttcttattattgaatgttaagtgtaaaaataacttctatattttctatttttttttttctctcttattccaggaagagcaaccgaggtttcaatctgcggtacgtctcctactctccatttcatttttatttccgttcagttctattcctttttggggtcagagagaaaaagagatcgtactattacttttaatattgtagtaaactctaatgttaaccactaaggtgaggtggggcctggttctggagggtgggggggttgcaaatcccattattctagattctcaggtgataagttcagtgattctaggtgagtaagaggagctgtatgcaaagaattgaattgttctgtagttttcagataggggatccagatgccactatgtaagtggaaatgagaaatgcagcattctggtctggtagtattatttcagggcaaagtggtcagaagatttatttaggaacaagtaggttttaaaccatatctgtataattgtgtgaagctgaagccacatgcggtaatcgcctttaaccaagtcatgtgactgctatagacccgtagaatctagcacaacatggtattctaatgcaaaaattggaaatgtagaggagccaaacgttacatcatcaaagtgtcacataaagttattatggtctgattctctgtatttgaagaaaaggtataaagaaaattaaaaaatagctgaag

SEQ ID NO: 76070 - DNA, 1051 bp, Homo sapiens
atgcccgtgcgttatgggctctttctgagtgctgctcgggctagaaagcagggagtggaccctcacaaagatccgcgagggactgatgcagggcagttaaaggcttgagtgcagctgtactcccttttgatgtgcaaatgacgagctggcggcttttgagtatcaacttatttgggaaggttaaatgagtccatatttatcagttctaggaggtttgtcctgcaggattgagtgggttgtcgggtgcagcacctgttctttcttcacagtggggattgcaatcttcagagacgcagtgtatttcttaagtggcagtgtcatgcttagggtttgtcccggatgagcttttattttagcattttgccatataatatatagattgaggccttggttaaaggcacggacaggtggtgtttttttccttcctatgttttaattattcacagtttatttaaacccactcaggaaggtggacccagaaaagccaaattctgtagtacataaccccaaatttcaaggttttgcggaacaaattcaacacaagttttgtgtcagtttagagttaaacgcatctcaagtaactgacttaactggcttgcctctatgaaaactgtaggcaggtttcattatagattttttttttcttgttattccggcggttaggtgcatgtttattttcttgattaaatttacattctatgttttatgactaattctttaaataggtgcatcatatagaaagtattttaggagagaaattattatttaagcactacagtatatcagatatatgagaaataatggagttgtagtctctgctctttaaaataactgtaaaaacatcttaaaaccctatgccaaataataaggccctgtaccttgctgtccttgtgaaatctggtatgtgtatagaaaatcttaattacttgatttgtaaatactacagtagtattgaaaaggtgggaattcaagcatttgtaattgtgatttcacaggtttagtgtgtaaaaaatgcagggagttagagatgaataggctataagacacgtac

SEQ ID NO: 76071 - DNA, 2196 bp, Homo sapiens
gaaacagatgcaaaaatgtatctttggtcaagttgtgagttaacttgaagagtgtcttgtgtaataggatagtgattcaaaataatttccataaagtacggccttatataggttatattttgaggatatttttgaatttaaaaagtcacctgaagttgttttcctacaaatcagttctgtttaagatgtatggaatcgaaaaaaacaaaacaaaactaattctgattacatcctgcattgttttgttgcaaattcttaccagttatttttacgcaattggagtgtccttaaaagtggtgaatcttaaaatttgccagtggattggaaaaaactgttaacttattatttttaaaaatgctgttatattagtacattggtctggagggggagctagtgccaaagcaaagtatagcttaatagctgtttgaacttttaaaacacccaaaaccagatttttatgaccaaaagaaacataaatttttaattaaaagagtaggaaattgatgtgggcatatatatgtacatagttatttgtggagtgaatatattgtgtattacaaattagtttaaaaaagtcttttcatgcgctgcaataatggaaagctaaatgcttaaagatttattggatttctcacttaaaaatctctaaaatgtacccccaaacttagagtatgttatagtattttcttaaccttcttgtcctgttcatcagaatctaaggcatgtattcttgacccattgtacatgttgtgtgttcttaaattttgtttttataatagctacaatcctaaaatttcaaaaacgaagcttcaagtagaatcttatatgggcgaaggtattaattgtgtggtaagctaggtatttatcaaaagtagatataattccttttttttttttttttaaagtagagataattccaataaaaaaatggaccttttagacatctggagaacaatatccccaggtcacttaacccttatctcctgcagtataatgcagtgcgtccagctgatctaccaaattgaatgtgtgcctttgaatacgaagcagttgttttgtggcctgtggcatttcatttaggtttctaagctgtaataaattagtatgttaatttacttctttccattcacatattctttaaatccaagcctagaaactgatagttatatgtatattaaaatcattggaatattggtttttttgcagatagtgtttgggctgtttattatccatagctcttcattatgtaaatagaatctcaatgctgataaagtaaatagattcttccatttcattaatggttatttttgatttatgataaactgcatttaataaatctcttgatttagttaaatggtggatacatcatttcatattatagcaaattgataaatataaaagaaagttttacaatcataagagtaaatatttaaaaaaacttgaataagttactttactaaacataaaattaagatttttaaacaactctgaaactaaaagtattactattatggtacctttttttttttttcccccaaagagatgtgatcttgctgttttgtccaggttggccttgaactcctgggctcaagcaatcctcctacctcagtctcttgagtagctgggactataggcatgtgctaccacagccagctttattatagtacttttgtaccctgcatcaatgctgcttctgttgatacttttcaaaggagatatcaacttctggtcttcaacagtagtgtagcatcctcttattgattctctggctcatatttcactaccgtatagtatggagtttctttcttggagtttgaattgtttttacattgcagcttgttatagtgaaacaattaaacatatttaaaagtaaaagatatttacgactgatttttaaagaacctgtaaaaaaatctccaacagaagaatattatatggggatgtgtagatttaacattttattttctttaatttttttttttttttttttgagattggggttgggggttgtctctctatgttgcccaggttggagtgcagtagtggcgtgatcacggctcactgcagccttgaactccctggttcaagccattctcccgccttagcctctggagtatctgggattatgggtgcatgccaccatgcgtggctaattattttttaatatttgtagagatgagaccttggtatgttgcc

SEQ ID NO: 76072 - DNA, 1033 bp, Homo sapiens
gatatgcaatatgccctttaggttttcatggctacctcttttatcccttctactgttagaatgtataggatcattaattaactcttttatcatttttattttaatcttccctagcaacaatttaatggcttaaacaaaaacctttccttattattattatttttaaatactgtgcaacaggccaaaggaaaaaaaacaatttatgtctgttgtttcaatttggttaccttattttttactaaaactgttctttctgttgttaccagtgaccttctgaattgccaaatggggattcttcagtcttgttgcttcagatttaacactgtgaaccacttttcctcctcccttctccttataactttgctgtcctcttggctcatttacaaagtcaacttgtttctcaagtatttgccttacatgtttttcattctctagattctttttcttgaaatgttacctattcttttggctttagtgagaatctcttccaggtgacccctatactgtaagttcctgaacgtcagtttccagctggagattgtcatctaattgtcatgctgtcatgcttaacccactcaaatttgaattttcttttcttttaaaatgtattttttctactttccttttttttttttttaaattattggcttttccttcccattatccaaacttgaattgtgaatcatctttgtattccccgtcagattcattcgcttgtcaaactatcagaggcctgtgaaccagagcaattgcatcttaaacaggagttgggtaaaatgaggctaaaacctactgggctgcattcccagacagttaagacattctaagtcacaggatgagataggaggtcggcacaaaatacaggtcataaagaccttgctaataaaacaggttgcagttaaggagccagccaaaacccaccaaaaccaaaatggcaatgagagtgacctctggtcatcctcactactacacttccattagcaccgctctatgacagcttacaaatgccatggcaatgtcaggaagttaccct

SEQ ID NO: 76073 - DNA, 1011 bp, Homo sapiens
taggttctgagttgctgacttgagggaatttgatacacaggagtccccaaggccccccagtggatacctgaaaccatggatagtactgaaccctatatatacaggtcaggcatcccaaatctgaaatccaaaacgttccaaaatctgaaaccgacgtgacactctgaagaaatgctcactggagcattttggatttgtggatttgagatgctcaactggtaagtataacacaaatatccccaataggaaaaactccctattcccattagtttttacttgatattctgaattcttaagtgtgatttttttttctaatttggggatagctcctatttttgtgagagaaattaatgggaaattttgagatggtaactagaaattgtctttgcagtgttaaatttttagttgggaggctactaggctgggtggctctagctgtttaagttcctgtctaagcaaaccaaagcccaacttagaaagtaaaaggaaactagatattttgccaactagaaaccacctaagtaatctctaactagtgtctttccactctgaccaatgagatatgttttctttgtcttccgtgttcagcctataaagcttacagcccacactgctgtgaatgaagctcttcaaaccttttatggttcagagtgctgcctaattgatgaatcattctttgcacagataaactcttttgtctgtttttgctttaaacaacaaaggaacataaattctgttaattgattgtatgaatataacagtgaaaattccctgttaggctttggttatcagtattttaggaatactttttaaaacatcccctttagcttttaatgtgttttggttagacaagatgatgtatgtgtcagtataatgccaggctcacaaaagttgctaactaaatgttagttccttcaatacatacattcattccctgggacatggttccaaaagtagattatcataagaattctgtgagaagctttgaaaaaactacagatgtctatggca

SEQ ID NO: 76074 - DNA, 1126 bp, Homo sapiens
ttcttccattctaataaaaagacaatccttttatttctttttcttgcctgatttcactggctaaaacctctgatataatgttgaatagaaaaagagcagacatcttagtcttgtttctaatcttagggggaaagcatctattctctcacaattaagtatgatgttgtagatttttcaggatgcactttactgggctgaggaagtttttttccattcctagtttgggtaaagtgtaaaagaaaattaggaatggattttgaattttgtcagttttttttaatgtgttgaaatgatcccatgtttgttttttttaaagttttttattagccagacatggtggcacacacctgtagtcccagttactcgggaggctgaggtgcaaagattgcttgaacttgggtggtagaggcttcagggagccaagatcatgccactgcactccagcctgggtgacagggtgaggccctgtctcaaaaaaataaaaaaatttgttaatatggtggattacattgcttgatttttaaaggttaatccaactgtatgtttctgaaataagcccacttggttatgatgtatatttggcttcttgatgttgccccacagttcactgatgctctttatattctttttgtgttcttttctctttttgtgttgtatttttggatcgtctttattggtatttttccaagttcatggatttttttcttctacggtgtctaatctgttaattctatgtagttttttatgttagatattatagttttcatctttagagttttgatttagatcttttttatatcttccatgtctcttaatgttttggctatatgaaatgcatttagaataacttttagactaggcgtggtggctcatgcctgtaattccagcactttgggagtctgaggtgggagaattgcttgagcccaggtattcaggactaccctggccaacatagtaatacttcgtctctattaaaaaaaataataataatttttaatgtccttgtttgctaacatctgggttggtttcagtcaattgattgctttattcatgttttcatgcctctttgcatatctggtaatcttcagctgacagacattgtgaattttaccttttttgagtgtta

SEQ ID NO: 76075 - DNA, 1085 bp, Homo sapiens
agaggccctcaaacagagtacagctcaagtctcaggtttaccacttttttttttaagtagtacatggggcaaattatttaatatcttattttgccataactaattattaataaatatctactttataggtgtgttgatgattaaatcaatttgtaaagaataatgggctgggtgcagtggcttgtgcctgtaatcccaacactttgggaggccgaggtgggaggattacttgagcctaggagttcgagataattctgagcaacaagcgaggcctcatatgtataaaaaatgaaaaacttaggctggtgcggtggtgtgtgcctgtagtctcagctacatgggaggctgaggcaggaggattgcttgagtccatcgaggtctatccaggctgcagtgatctgtgattgtaccattgcactccagcctgagcaacacagcaagaccctgtctcaaaaaaaaaaaaaaaatgccagcaaatagtatgtgttgaatatttagttataagtattattcactctctaaaatagtcttcttagtaaactctaattgaccttagggtaaaaaaatttttatatttaaaagctcagaaaaattcagcttagttatttttaggctggtgtttggtctcacatacacacttaacgcccctttcaaactgttatggaacaatgtttttcaaactttaatgtgcatatgggattgtgtagggatcataataacatgtagattcttattcagtagttttggaataggatgagatgttacctttccaacaagctcctgttggtaatctggatgtagctcattcttataacacactttgagtagcacagttatgcagtgttccattaagtggttctcattcctgctttcagtatattataaacacttagatattttttgttctttatgccttggctctgtgtcataccagttaaattagagctttgcctttggggttctgggcatcatcgtcgtcatcattgtcgtcatcatcatcatcattttttctttcggtaaaaatatcctggatcattctcttgtgaaactagcattaagagccaccactttagttatctgaagga

SEQ ID NO: 76076 - DNA, 1827 bp, Homo sapiens
aattttcctggaaggcgtgagactgcttggtaattgtgtacatatttaagggaaactgagtaatggaggacagaatagaacaattaacaaattcatgcatcagataacttgctttcattaaagccattgttactcttatttattgattgttcctgatgataggacatctgcagatttcaaaaagtgtgtttagtgtgaatttcatactgatggcatttctctgcttttgacagtttcatatacttaaacttgtcattaaaacacagcatcttgccttgagccaaatgaaactttgaatagagcccaaatttatgaaattgttaatttctctttacatctagattttactttcagtaatttctatctgctaacacaaatagaaaggtaatctttcatttggttgccatccttcaagagcctctctctgcccttccctccctgccttcctggatctttccttttgtctttacagacctagattttgaaaggttctaggttccttttgtctgttgatactatgtgaatgttatccttaagtttttaattcaggctacaactagacagataatgtgtctcacaattagctggggtgagagagttaaaatggaagttaaggattcaggggattcctacagatgggtgaagaaaaaagctcaatgttaggatccttaacaaagcattttgattggcatatggagacctttgcgtgaacacaaatgttcatatttgaatatttatagaagataatctgtcaaaattactgttattttaatttgccaagcttggctgattgccgcagttggatgttagttgaattcaagttgaagagttgtaaatatgttctggtgtgggacatgctttttgtccttgaagctgtttgaatttcttacttctcccacctacacccccttctttaaaactgcgaggcttttttgtattagttgaactttcatgttcttttttaggaaaaaatattaaagtaggatgttaactgtatggattaaaaattttttttaactaaatttgttgacatttggtgatcaggaattgtttaaataattttaactatttgtccaatctttgcttcaaaggacctgttcctggagactcaaatgtagggatatatatcttatttgaatggttttgtgtgggatatgtttcacattaacagcaaagaaaatgtagacttctagataattgatgtttcccctttcttttatctcacttgaacagctaataattttagtgacccagattcaagcaataatacctgtcttcataattgtcatgtggttttgtcagcttcttatattctaggggaaggaagataagacttttttaaatatattgaaataacttggttaataaatactttttttctctttttagaagccaggaacctgttctctttccatagtgtctcctcactcagaaaacgttgtgttctcctgcctcagcctcctgaatagctagggttacaggcgcccgccaccatgcccggctaatttttttttgtatatttagtagagacggggtttcaccttgttggccaggctggtctcaaactcctgacatcaggtgatctgcccgccttggcctcccacagtgctgggattataggtgtgagccactgtgcaggagaatggcttgaacccaggaggcagaggttgcagtgagctgagattgtgccattgcacgccgggctgggcaacaagagtgaaactccgtctcagaaaaagaaagaaagggaaaaaaaccccaacacactgtattaattattgatgcagtatcactattcttactgagactacattattttagctttag

SEQ ID NO: 76077 - DNA, 1032 bp, Homo sapiens
atttggatttagttattaataaatattaggttgaactgcacttttaatctaaagatttattttggcactcatttttgcttattatgacttctcattttcttaattagaggagagaagacatgttctttgggcgtcctggttatgtctagtcaatagtcttagttttcacaggatagtacggaatgttaaattattactacctattttcttaatttatttcaataacttgctgtttttatcaggaaaaattaatgaactaatcaaaatgttccattctatacatagtttgctcataacaaactcatttttttagaaatgttatagcaaccttattttttttttatcctccacaagatcattttagtgtagttactggagtttcaaatcatacgtaattcagtttgaaaactatgtctatggttctgtttagtaacattttagatgatattatttaaaaaggttaacattgcttagttaaaagttatcattattcttttaaaacaagttttatttttcagaccacacagtcctttgaattctgatgcatcaagtttcaaacagttttttgtttttggggatacttacctatgagatctccagaaattgtatatttagctatgaaaatcttcagaaactgtgagcatattaagcacacatataagactgtaaaccttagaggatgattttagatttctttctcttttttactttttatttttgaaaaaaataagcccattccagtttaatgaatatgataatttgaaatccaggtagaataatgtatctcattttcgccctcatattttaaagtgagatagtttataaaatggagaataagtcatgttgttagatgttgactcttatagtataaaagtatgaatcttatatagtgatattctattttaaatgctttatatgtttaaataatttagaagaagggaattatagaaaaactgaaacaaaatgcttgaattaatactataaacatgatgttagcatttataattgatattttaaattgttacataaaaa

SEQ ID NO: 76078 - DNA, 1180 bp, Homo sapiens
tgacaatttgcctgtcacctgcagagttaagtggtataatggcagctgaacaatgagggaggagagtggagttgagaactggtagaaatgaaatcactcatacagggaacatgttttttcttgagataatgaacatatagcccaaaatatgtggttgagtacattttgtttttgattgattgttcaaagatataatttttaagtcttcatatataagttaatgtataattatgcaagaaggaaaagaaagtgatgatggcactttgaggactttcaggcttagagctaattagtctgttatctggtagagcactaatgtacatggctgatttaatatacagattaacagatttaaagcttttaccctttacttgttattaggcagttaggttatcttccaacttgttggccagtcaacaccaatgtgtttcctccaagaatctcagtatatgctattttatataccttaaataatttaaatacatttcttactctttccacagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccgagaactgtccaagattctggcaaagcttgaacgcttaaaacaacagaatgaagacttgaggcgaatggccgaatctctccggtaggtcctaaaatactgaatgaagaatgatgaaatattgtactttgtttttaggtgtagggcttcattccgctaggaaaaatagttaattatttttataacctgctgtctttgccacaacttagcatgacagttttctatctctgtgtatttaatacagaacaagcttgtccaacccacagcccatgggccacaggtgacccagaacagctttgaatggggcccagcacaaatttgtaaactttct

SEQ ID NO: 76079 - DNA, 1040 bp, Homo sapiens
aactcacctgagatttttagcaaaatactatttatttacctgattggccttgatagctaataactagtagagcctaatctctgcctgcaaccacagttgggtaatcaactggtagtaattagtaatattcttgggcttttagaagcttttacaggctgttttaagaatttagaggtgttgatggtataataaatttagagtagcatattaattattatctgctatattgatatcaagttttagcatcactagatttctaaatgatgatttcattctagtgattgcatatgaccattcttcccagtaatacagttaaatatacttgtagcttttgatatcattgatcatgaattgaccctagcctacctctttgcagtagagagaattaagcggtttagagttagtatttttgccattgtggttttaccatttatcttgtattgtaggttcagtgcttcgatttatggcagtttagatgtgtacctcaacctctaagcatatcatggagtctgtcttatcaacctttcaggctgatgcagagacatgtttaacttaatcactgttgctctgattctttttatcatcttcatattgccaaataccagtttatgaaaagggtaccaaagctgcttctttctgcttttaaaattaccatattttttttaaatttattcatttattttattattttttttaccaagttctgtttatggtaatttataacaattataaaactaaagtacaggagatgagccatttttcaactgtgttgactgaaactattgaaaaacaatctgttaaagtagcaatctcatctcccttacctagtttgcatttctcattatcagtaatatatagggcagctgtgcttagactaaattgtgttctccaaatagtgaatgatacttatgttaattatgctgatttgctaatgtacaaaaagacattgtgggggattatgtaacaaaagaaatgactgtgactcaaggggtacactgggaaagattgatagaatagcttacagattttttttaagttta

SEQ ID NO: 76080 - DNA, 1041 bp, Homo sapiens
aaagttaagtttggtgaaccttcaaaccttctattctttgtgttttatttcatatacacaaaaacagagagagagacagagagaggaagggaggaaggaagatcttactaagttctctgagatgtgatttgattgagacttatattaagctgggatgtggatattctttcttgaatttcggatttgtttcaacaaaatgtttttgtatgattgtcttctaaggaatccaagcttattttcaagtggtgctagaacattcatcttaatattcatgtgcaaagggatacatttctttatgaagtcatccttattctgctcatcacttagtctctatcagccagataatgattcttcatcgcctgtaatggaacagtgtctcctaaaataaagtttgcattagaagaagaatctccaggtggaaaagggtgtttttcatctagtagttctaattctgttttgcttcctacgaccacacatcttttgggtgtgatttccaaacttaagaatgattttagattaaaaataatcacttactaaggatttcttacatgccagtcactatgataaaggttctgcattcattatgttactttatcagcacagtagtcctacaaggtatgcattatttgttcctgtttttttttttgttttgttttctgagacagagtctcgctctgttgccaggctggagtgcagtggtgtgatctcggctcactgcaagctctgcctcccggattcaagcgattctcctgcctcagcctcctgagtatctggaactacaggcacacgccaccatgcccagctgatttttgtatttttagtagagacagggtttcaccatgttggccagaatagtttcgatctcttgaccttgtgatctgcccgccttggcccgtttgtgctaggatgctaggatgacaggcgtgagccaccacgcctggcctatttgttcctctttttttttatttaagatggagtttcgctcttgttgcccaggctggagtgcaatggcacgatctcagctcgctgcaacctctgcct

SEQ ID NO: 76081 - DNA, 1071 bp, Homo sapiens
aaagaaggatcataatataactaagagtaataatttcagttgtttttagtcttcctggcccttgaaaatcagtactcacacattttacatatttattcagaaagacactgtgttatgccttgagtggaatacaaagatggctaaaacaaagaccctgtcctaaagggagctacttcttacacacgtacacacacacacacacacacacacacacaatacaatacaaatataacatcttacattttataggagagaaatagatgaaatgcttattggagttttgagtaaggagacatcagggatagtcttgtagagaatgtattgtttgaagtaaactgtaaaagatagttaaataggatttggacacacagaaatgaaggaaaagaatgtaccagctggaggttatcagctaagcagtggctcgtaactgggaaagaacagtacaggaacccatatgataagtgtggcagttcagtttgtctggaattttaggttgtgtgaaaggagggatggagaataagttggaaaggtaggcttggaaacagattacagaggttaaggtttatggtacataggcagtaaggggtcactgaaagattttacttatttgttttataaatgttattataacaaatagaaagtattggtaaacatcaagtctcagaccctttaaaattaatttcactttgttttttgtgttcttttctagttcttattaatatgtacacaccgtcttacatatatgtaagaaaataatttatttttgattttgtttttctgcttaatatgccataagcatttttctattttggagtcacaacctgcttttgaaatgttttacatacaaaagtggtatgagagtggtacttaagtgatattaatctgaaactagtattttagttgaacttgattatttgaagagactagaagcagggagaccatttaagataagaggaccatagtgcaggtaagaagtattaaggtatgtggcagtttgctttggaagtgaagagacaaatttgagagagattgggaagataaaattgataggcctttccaagtagatgaaag

SEQ ID NO: 76082 - DNA, 1059 bp, Homo sapiens
cgctatgctactggtggatgggagactgtatttaggcctgtaagtgagacatgcacagacagatctggcatctccactggacactggtcaggtaaggagcttgtgcagcatatgagatctctgggctgtttcactcaattaccagattattagatttctaggtagaccttcatggaacatacttatcttttcctctggatccatgaatactatacattatccagataaaatctagaagaacagtattttatcttaaaagtattttattatgtatttcatttctgatgctcatttttatgtgaatttagcaaaatcactgagtttttttcagggagcataatttaatcttttaataataatgatatgactttcactctataagatgatttcacattattgaactcattttaatatgaagtaatcatcatataaagtagtccagtttatatggactactatatatgagtagcatgagcatgcatgagaatcatctggaaggtttcataaaactccattttctgttaaggaaggtctaggctgcagcctgagagttttaatatctgacaaaagttttaggtttagggaccgtgctttgagaaccactgaggtggaccttgctggtaactttatcttcaaatgaagcctaatttgtttatgtgattttaattgtattcaggaaacatttaatgaatagtaatgtgactaaggtactatactaggcattataagcagatagaaacatcagtaagaaatttcctttctctccaaggaagtggtgaaggagtagaatatagaaaagaatttcttaccgctagtctagtgcttttctttctacaatcatgatctttaagatctaaagttgggctaccttgttaaaattgtggctttattgttttgtaatcttggacaagttacttaacctaggtcttagtttccttatcagtaaaatgaagagtaatcactttattgaattgttggtagattaaatgaaataatatatgtaatgcacttagtactgatatatgaacttatatctagtaatttttagctattatgaat

SEQ ID NO: 76083 - DNA, 1006 bp, Homo sapiens
taatgtattataattagcatataatgagcagtgaggatgaccagaggtcactttcctcaccatcttggttttgatgggttttggctggcttctttatgcaagttgttttatcagcaagacctgtatcttgtgctgaccttctgtcttatactgtgatttagaatacctgacctcctgggaatgcagcccagtaggtcttagcctcattttacccagcccctattcaagttggagttgctctggttcagatgcctctgacaactccagagtagagaagtggtgaacagaggccacagaaatgatgagcagtctacctaccatgtggagaagacacctcagaaatggagagattttatatttttgttgcatgatggtaaacagctgtaaccaccagcttggcctttttggcagctggctttatttagcattttaagctttaagtttgcctctggtgcctggaattgttcaattaaaattttaaatttattcttatcatcctctaacacaaagcttacttatacaataccaaatctagcctgagacacttgttcttgaatcgattcttttttaaataataagttcagtatgaaataaatctctgctgaaatgaaagaaagcacccattatcatggaactgtggttcctgaaagctacttaggtaggttaatagttgaggcctattaatggatatgccatattattacattaaagccattctcaatgaaggattaaagttgttagttttaagagttgtttttgttttgttaagaacagtttgtacaatgattgatttttgtcaaagaattgaaaatgccatctaatacaggtagggagaggaggttgattgtcagtttgatttaagtcttaaaagttcatcaattagcaaagaacaagaaactgtttttttaagagggcaaattttatgtatctgtttaccatgaaagagaacttaagagaagctgtatttccacttttatcaaattagaacctttatgtcaatattaac

SEQ ID NO: 76084 - DNA, 1073 bp, Homo sapiens
catgctctgttagttaaggtttcatgccttttgcttcatagttctttttcttcatttatggatatcccctcttcttcccaattaaacccaaaaggataaaatatagccatttttttgagtaatacctttacactatttgtttcagctatgccaccagaagctatagattgtaaagtattaattagctctctttctagagattttacacagcgcaaaaggaagggagagtggagtgacctatgtcagatcatcagtagcagtgacagtagcagctgtggtttggcacataagaccatactccacaccccatcatctttcttccacaatggaagcagaggcagctggggaagaagatacattgtgcagtctgagatggcagcaagagttaaagatgggagtgtgatggtagggtgaccgttgaagctactggtactttttagattggtggaatttatgatactagggagatttgctgctccagttcctgttttagtaggctaagatgtacgtctgttttatcagcaatttgtacagcactttagctatgcaatactaaattaagctatacagtgttacactaactgccctctttcctcatattccatagaaatcttaagtgttttgtttttgcttcctttaacatgactctgcgttttcattttcttctcttacgatgtggccagaatttctacttaataattcttatatcttagggtattgacctttacgtataatgaagaaacccaataggtctccctgatttaacataattggatgataatttagcagaaaaattacaaatagccttaaagccattgtgaaacatctcattcgtaactcctcaagtatgctaattacagaggcagctgtaaaattcacccagagcaaaaaggaatccagtgtgctgactgacagcttcatcctgcgagatcctgatggcatacctgcttattctagtcgtttctttcaagggggcatgacatgtagtgaaggaataaggggaacttaagagtggaattgtgatttttttttttaaatagggcaatggaggaaagtgaggctggaatttagct

SEQ ID NO: 76085 - DNA, 1041 bp, Homo sapiens
attttgattgtcattttatttctctctctttttcagttggtttcaaactcttaggaaatgtaagaggaaaagcagttattaccctttaaaacctcactaataatctccctttttaaccgaacttcagcttagagttttccataagcaatggtattcatatagaatttaataacatgtttttttcagtgaatttatatttatggttaacatctataaaagaaactcatttaagttttaaaagatgaattggcttttaaaatattaaataatacatatggtacatggatataaaaatcataaagatggtacacaaatgactaaaatttagaaaatactgaacaagattatttgtgagatttcttttagattaaaattcttttgcatgtatatttgaatagaatatataatgttatatggtaaatcaagtaaaagaagggctttctaacatagcatgtactatgttattttctttcattttgaaatatgttgttattgaggaaattaagcttttgttctatgccaattttcttctataagtgtaaatatcttttagtagtttactagacagtagcgtgtatctttttgatagcatatttgttggtgatgatttttttttaatctatttttctttcattgaatgcagtctagtctggatgagggttttgaactggaaatcttgagtagttattatttagaggtgaagaatcatgtcatcactgtataccctttctagcacagtgttcacgtagtagttgttttagctcgttttgcattgctataaagtaatactcaaggctgagtaatttataacaaaaaaagatttatttggctcatggctctgcgggctgtgtaagaagtatggtgccagcatctgcctctggtgagggcttcagaaagcttgcactcatggcagatggtgaagggacatggcaagagaggagggaagagagagaggggtgaggaagatgctgggctctttttaacaatcagttctgctgagaactagtagagcaggaactcactcattacctctagaacagt

SEQ ID NO: 76086 - DNA, 1028 bp, Homo sapiens
ttgtaatgtcaatgaagaagacatttacaaagtctaacccaaatctgaattatcagaaattctaaattaaaaattttaatgaggttttatcacagtatttgtattctaaaggaaaagctcagtgaccaaatatgaaagcagtttgaataaactcttaaaagtcactcattacaaaaggaaaaaggagacttcaattttcagctatttcatgaattgataaaggacattttgatgtgtgtatgtgtgttttatatgatatgccaataaaatttaatatacagggcattccagaatggtttctgccccactgatggacttcaaatatgtctcatcaactacagtattaaatgccataattaaaggtctcctttctgtgagaagctcttagtcaaaggagaaagtctgccttctgataggatactgtgatatctatgaccatctataaattaatttattttttcaggtaccccaattatgaatttattagtgataactctatttcctggtcagctggactgcacaatcgatacacagaaaattcacttcgtggagtgatcctggatatacattttctctctcaggcagacttcctagtgtgtactttttcatcccaggtaagtgtcagtagggcattttaaaataaccaatactttttggttgtataggagtcagaaaaattatttgtgtgtctatgtgttgttaatgttcattattgtgactcaggtgcaatttttctgatactcagtaatgatcccttttgtgaaagaatggaaagatcccataacatagccattcacatgcactaatatttagttgtttgcaagtaatggttgactacatctccactgaagccagttactggagttgtttaaagtacttggcttgttcacagcatttaacagaaacaacaagtaattaagcttacttaatactttctaattttgcatatagtcaatatgtaaccagaatccatccatttctacacatcatcgcactgatactgagaggcttaaatgccctaaattttg

SEQ ID NO: 76087 - DNA, 1085 bp, Homo sapiens
tttatttttattttttgaaatttacttaatctttctgtggcttagcttcttcatctgtaaaatatgaataataatagtacctcacaggtttgtcataatagttaaatgagttgagacaaggtgagggaagagcacactattataacactgcctgggacataatcggtgctcattaagttcagctgctatctttaatggtcattcttatgagaaaaataaagggccacacctgtgtagcactggtatgcttgcagaggcctacagtcacatttgtcatttttataatgggccacctcagtgtctgaaatctctactattattataatagttatttctttggtttaagaaaacagttctgttatccaccaaggttaacacatgaacaactcttgatagcaaaacatacactaattattaggattatccccagaagaaacaggtctctaagggtgtgggacagggtgcgatgttgtttttatgagagtaagacgtttaagagtggagaggaggaaacacatcacggttcattgtcacagtagagattgtggtcatcctaagagtaacacaaggtcctgcattcctggctagggatgactgaagagtgggtgaagacaccctgaaaagaagactgtcaggtttacccaagactgtctttggtcttatgctatatctttctggtgttacaatatgaacatggagaataagatttacaagagaaaatatatatagcagtttcaagcatatgcagactgcctgggttccaacctgaatttaccacttattagtataaccttgagcaatgccttaacttccctttgacatttgtaaaacaaacataatgatagaattttatggggatgctgaaaggaatctaattacattagataatgtctaaaaacaatgtctgacagttagcaaaagctcagtaaatattagcctctgtcattgttattgtagtttgctattattggagctgctttaattatttagtttcttcttttcctgagtcccacttaattttgcttgccttctatgagcctttggctgaatttgaaattcaaaagttccaaatctttttgatccct

SEQ ID NO: 76088 - DNA, 1882 bp, Homo sapiens
caagcaattctcctgcctcagcctcctgagtagctgggattacaggtgcccgccaccacgcccagctaattgttgtatttttagtagagacagggtttctccatgttggccaggctggcctcaaattcctgacctcaagtgattcgcccaccttggcctcccaaagtgctgggattacaggcgtgagccactgtacctggccgcgaaggtttaacattttttttctagtaagtagaagagtcagagtttctacccagggttgagtggttctaagtcccactcttttctttagttttaaaaaagtcataaaatttttaatcacccaaataagcacagtatacatagacatcatattcatatagagttgaagtcttccttatttcctgtctcccagagaggtgcaccacggcacttaggtctacatcagccccatgcatgacttacattattactccaagtaaatgtacctgtggacatgtgattgcagtgtttttcatttttaacttttatttgtgtaaataaaaaagtatctgcgacaggtctcaatcaatttagaagtttgttttgctaagattaaggacgtgcctgtgatgcagcctcaggaagtcctgaaaacatatgcccaaggtggtcaggctacatcttggttttatcattttaataagacatcaattaatacatgtgctctacactggttctgtctggaaaggcaggataacgtgaagtggtggggagagaggagggcttccagattataggtggattcaaagagttcttgactggcagttggttgaaagagtttatctaaagacctagaatcaatagaaaggagtatctgggttaagataaggggttgtggagaccaaggtttttattatgcagatgaagcctccaggtggcaggcttcagagagaatagatagtaaatgtttctcatcagacttaaaaaggcgccagactcttagttaattctctcctggatcaggaaaaagatctggaaaggaaagggaatatctacattttcctcataagagacagctttgcagggccatttccttttagtgtctgctgtctgtcatgttggtaccttattgctacaaacagtctgctttgtcagtcttaaggcctctgttttaatgttaaatgctggtcagctgtgcccgaattccaaagggaggagggtgtaatgaggcatgtctgacccccacttcccatcatggcctgaactagcttttcagatcaacttaggaatgaatgcccttgacagagaggaggggttcatccaattggttgggaggcctagaattttatttttggtttacaattggtatcagactgtgatttactctttttccttctgtaacttgttttttactcaacttttatgtcttagacatttccatgcttctgtgtctagttctagttcatttattaactgtggaatcatgttttattatttgataagccacattttatttatccattttctggttgatgtgcattctggttatttccaattttccagtattacaaatggtgctgcaatgaacatgcttctatgtgtctctgtacacacatttgagaatatctctagaagtgggatttctgggtcatagagcacaaacatcttcaatttcattgattatttctgaattgcatgccaaaatgcccacatcaatccacactcctcttagccacatacgagttttcatttcttcgcatgctcatcactgcacagcactgttagaattttacattttgctgatttgatggtgtaaaatggcatatcattgttgttttccccatttctttcccctactttctttaatgaatttagaagaagagctgccacagtctgcaaagatgtttctgtgtgctgattt

SEQ ID NO: 76089 - DNA, 1009 bp, Homo sapiens
cagccatctgcacttgttaagcccctcgagctttggcaaaatagcaatttgtttagattcatattgaattatgcttttggaccagtcactaaccaggcaacgtaaaaaatatacagagtctttttacaggtgtatttcattccatgtagtgatctttggggtggaggcaggatgaaccggagcacacccttttccaaggagagaatttaatttcttgagtactactgggctcagcaccttaccacattctcttatgacagccatggaaattagatgctgttattctccccgttttgcagatgaaaaaactgagtcaagtagcctcctcgggtactcagagtacccgagtcaggactcaaacccaggcagttcaactccagaacctgtgctcccacctactgaggtataaggatgccatccagcacagcgatgctggaccttactgtcattaaggggcaaggtcaaagacacaccatcaggagaaataagcttcctcataggagactggactgcattttctataaggaaaattaatgttcatgttggagaaacatgaacattaattcctagacaaagcagtgagaaaatcagctgtgaggctcgctggtgggaataagctggggtgtgggctctgtctctgctctcactctcggtgcctgagtgattcttactgggattagttggtgctttggctggaaaaagaccgtctcaacccttgttggatgtttggcatccctggccctgcagcactaaatgccaatagtgtgccccagtcactgtggctgtccccaacactccctccatttccaaatcttcccactctacttgggaaccagccagaggacatgagatgctggagtcggaggaggtgggaagggaggggacagcacccctcctctgtgtttgtggaaaggggtggagtttccactgtaaagaggagggctgggtggggcacctgaaggagaggggctgcatgaaaacggtagagactgagaaggggagagagatg

SEQ ID NO: 76090 - DNA, 1010 bp, Homo sapiens
tttgccccttgcaggctaatctcaacacaggtgctggagtggtccgattaaagtataaatcaggtcatggcgctcaaaccctctgctcaaaaccctccaatggttccccatttcactcaaagtaaaacccaaagtcctcacaatggcattacatgctctgcctattttggctatgatgacttctctgacctcgccttcttgtatgactcctgtcattccctctgttccagctacgttcctgtcttcccacatactgtggccccctcagggcccatgtgctggctgctcctctggctagaatgcgtcttccctacatatctgcatggctctctccctcacgctttaaaaatctttgctgaaacatcatatttttagccaggcccaccctgaccaccctagagggcaaacagattttccctgatccctaatccttcttatcctctttaccttactatatattttccacagcagtttccaccagtatctaacatacccaatcatgtatttatttcatacatttaggctctttttcctcacagggacataagctccataagagcagaggtttttgtctgacttgtctagtggtgtagctctagtatttaaaacagtgccaataggagcttaatacatattgttgaatgaaatattccccttaagttggaattccttggggggaaaggagctctagggatctcaccgaagcgctttctgatgcatctcatgtttctacttgctagcccttctttcagtatggttgctttccatttaatctttgggcagccatggcatctgagattctaagtaccctcctcacagcctcgcctgttttctctgctttccagatgaggttgtgctgatctggtgaactgccctttggagctcaccttagccaggtcataccgccactctgggaaccctggaatgttatttgttagtacgggctttctgggcctcctgggtcccttacccaagccctgacctgagagtccgtgaaactgaatccctcc

SEQ ID NO: 76091 - DNA, 1049 bp, Homo sapiens
taaggtaatgcaaagactctaagaagaggataactcattttcaggtgtgcaaagtaaggagagcccacttgtggcggtggtgaagagagccggccgtgtggaggagggagcgctggtctggctttgaggatgcaggaggtcccattgctggtccctcactccctcatcttcaccacctcctggagaggcctgtgggctgtgcagcctctgatgagcatgtgagagagactgttgttgctggtctcattatctgtccttttaggcaaaggaattcctatatgtttcagaacagagagctcactgtgtgcctgtaaatgccaagaaaccaagacaccatccgttagggagcctgctctgtgtgctgaagcaggaggtggggcacgtgggccatctccaaaggctcatagtgctggtatgggacaccccaaagctaggcttggactccagtctgtagaggcagggtttcctctcagtggtgcttggcctcctgcgtcaggttcccctgggggacttgttagacatgtagactcctgagtctgcaaacctaccacctcagaaccagggggactgggtctgggaatctacgggtttagtaatctgccctggatgcttctagcacactaacttggagaaccaccaccctgaaggaaattaccccagcccagcaggaccagcaagaggcctcctgtgcaggctccaaggccctgtgggcaagtacagtgctccctcaggccttacaaccaccctgttctgcacacgtttcctcttctctcctagtggcttccaaacatacctgcataccagaattgcccggaaatatttttcttaaatgtgtattttaaggccccctcccaggttaactaaatcaaaatctcaggacaggtgccagaaatcaacaagtaattttagaaaaaaatataaaaaacactctctagtagtctttgatgcccaatcagatgaggggaccactgggctctgccaatcagggtcatacgcagaggacaccaataggtgattcattcttaactcagtgctcaaggatccaaatc

SEQ ID NO: 76092 - DNA, 1054 bp, Homo sapiens
tcataatgctgggatgcaaagaagaatcctgccccgtcgctaaggggtgaaataggaggggacttctgcggcagaactgcccaccagtctcctcctgtccctgcactctcttcccagaggacttacatttactctaatcagacaaggggagtcctttcatcatgtcccctctctatcccaatctcattgaccaaaaagggaccaattctgactggccagaagccaatcagatttcctctcttggaaaatgaagacgaagtaatcaggctgctgactgggatcaatgcgcaggcgctagagtgatggtccaggcacgcttgctgcaggggtctccaaatgggcccagctccagggtctgcttggtcaccttctccttggatcctcttaatccagacctttagaataaatatccctttatttaaattcgcacaagtggtttctgtaagtaaaatgattcctcgcttgtgcaacccttaccctactttcttcatcaaaggacagtcacagaaaccatgtcactgccttgactgtaactagtccccaaatcctgaaatgtcagatgcccaccactgtgccaggcaaaacattcctgagccagcgccacagtcaggttcagtcatgaatggagtgggaccgtatctgaatgtccctcacctgtgctctacccactagcgtacatcacgttgcttgagtcttaaaaccatgacatccgtgttctttcctctagttgccaaagggaccatgctgaaggggctgaccttctgtgtcttgggcttactcagcgatgttggggtcatcataccagtagggttggctactgattgtactgcttgattgtcttgcctttaccgtaaggtggtttagagtagagagaagcagggcttctcatgacagaggtagcttgggacatggatagtcgtccagtgaggaggcagctgggctcaggcgcagagctcctggaggcaagtataggaaatgccctgtcagctggagaagtcagtcgttttggttttatttctttggtttgcttgcttttgcttatttattttctcaa

SEQ ID NO: 76093 - DNA, 1240 bp, Homo sapiens
acttctgccttagagatattatatcatgattacagggatcaaggataattatcaattagaaggaagcacacattagggtaatgtgtcattgctgcaagctaaaaccgcataattggaaatgatgacatcacacgttcctaattacacattcataaatatgtagcaagtgatccatggggaaactgaggcaactttttttttttttttttttttttggagacagagtctcaccctgttgcccaggttggagtgcaatggcgccatctcggctcactgcaacctctgcttcctggattcaagcgattctcctgcctcagcctcccgagtagttgggaaacaggcacgtgccaccacgcccagctaattttttgtatctttaatagagatggggtttcaccatgttggccaggctggtttcaaactcctgacctcatgatctgccttccttggcctcccagagtgctgggattacaggcatgagccactgtgtatctttctcatgtgtgtgcttatagaaaactaggggtgatgattctgattggccactgggagcttctctcaggctgaggaagaggggtgagaagtagcgagagactttcctgattttggagggaggggtttaggtgcttacaataattattcccattgccactaggtagggccactctgaggaaccgccctggtgaatgaggtcccatgaggctcaggagtatctgtggtgaatattttgcttccagaatgagtgccctccccatacaaaaattaggaaatgagctttattagaaccatcttgtgtgactctgaaaccaagggatgaattgttcagtgcttaagaatttataaactacatttcacgtaacacatgtcctcatgtggtcctcccagcaactgtaatggaaagtttagtcgttattcctgcttgacagtcgaggaaactgagagccagggagttgcatgattactcaaagttacacagccaagtaagtgtcagaggaaagtaagtgtcagagcaggggaggacatggattccttaactctaaattctgatgtatttcctttgttttgtatttccatttattgccccatctggcccattgtccagttggaaccctctcactatttctgtctatggggcaggagaaaagctggagctttggtccagaggcttcattaagactttcgactgaatgtggagtgaaggttctggacctccctgacactctgatggggatcctcatct

SEQ ID NO: 76094 - DNA, 1071 bp, Homo sapiens
agacccttttgggaaagagcatgtagcccacaggtgaggcaagacctctgcagggagaaagccaggagctgagcgcatgtgggagccctagccctctggaaggctttgaaggcctctggagggagtggcaccagctgagctgaggcaggaggaggaatggcctggagcccaggagagtgcttagaggggactgcagagaccatagtccctctggctggagtttagggtagtggtaagagatgctgcggggtggagaagaggctgggaaagacttcctaaaggaggcgacaagtgacctaaatgatgtgtagagttggccaggcaaagggtttggggctggggaggctgagagccctggggggtcgaaagggagctggaccacagggtgctcagccaatgggtcccatcaggtggtggggtcaagagaagtggctggggggtgggaacacgcccaccacacagctttgaagctgcacgcaggaagctggatgtgattctggagagcactctggctgcagcgtggatcataaatcccagagggctaaaggggcagcgatggtggggatgcgactcctaggagtctgggtgactgttgagggccagggtggtgggaaggaggcaaaagggagatgatgtgtgggataaccagaaagcagggcggggagagaatggggtccagggcgacttctaggaacccaacagatctgcagagcggtggcaggcacaccattgtgaggtctgcagccttcctctctgagttcaggtcacacttccctgacttccctttacttacagggggagggcttcttcaccaaagggaaatgactgctgccgtgggctgctctgctccttccctgctccttccctgctgtcccccaactccaactataccccactgcccaccttggtccttggagtccagcacataccattggtaggtgtccacataactctatagccacaggggggccactttcagatatacattctacatggccaggctggggctatggcccaggtggcttccttagggcccatttggccgggctcagtgtctgagctttatgcgca

SEQ ID NO: 76095 - DNA, 1715 bp, Homo sapiens
actgtcccaagtgcacgttgtacctgaagttgtcataaccggtaggacataaaaactttaagcattcagttcgatcggtagcgggagcggagagcggaccccagagagccctgagcagccccaccgccgccgccggcctagttaccgtcacaccccgggaggagccgcagctgccgcagccggccgcagtcaccatcaccgcaaccatgagcagcgaggccgagacccagcagccgcccgccgcccccgccctcagcgccgccgacaccaagcccggcactaccggcagcggcgcagggagcggtggcccgggcggcctcacatcggcggcgcctgccggcgggcacaaaaaggtcatcgcaacgaaggttttgggaacggtaaaatggttcaatgtaaggaacggatatggtttcatccacaggaacgacaccaaggaagatgtatttgtacaccacactgccatgaagaagaataaccccaggaagtaccttcgcagtgtaggagatggagagactgtggagtttgatgttgttgaaggagaaaagggtgcgaaggcagcaaatgttacaggtcctggtggtgttccagttcaaggcagtaaatatgcagcagaccgtaaccattatagacgctatccacgtcctaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcagaggccctcctctccaaagacagcctagagaggacggcaatgaagaagataaagaaaatcaaggagatgagacccaaggtcagcagccacctcaacgtcggtaccgccgcaacttcaattaccgacgccgacgcccagaaaaccctaaaccacaagatggcaaagagacaaaagcagccaatccaccagctgagaattcgtccgctcccgaggctgagcagggcggggcttgagtaaatgccggcttaccatctctaccatcatccggtttagtcatccaacaagaagaaataatgaaattccagcaataagaaatgaacaaaagattggagctgaagaccttaaatgcttgcattttgcccgttgaccagataaatagatctgcattatctatgcagcatggggtttttattatttttacctaaagacgtctctttttggtaataacaaacgtgttttttaaaaaagcctggtttttctgaatacgcctttaaaggtttttaaattgtttcatatctggtcaagttgagatttttaagaacttcctttttaatttgtaataaaagtttacaacttgattttttcaaaaaagtcaacaaactgcaagcacctgttaataaaggtcttaaaaacaaaacaaaacaaaacaaaaaaaaaactttaagcattcagaacccagatacaaacttctgcaattgcctcagcaatagtctaggtcatgtggtacccaatccagtgtttttaaaaatgctactaaactacaataaagaagcatctttaaa

SEQ ID NO: 76096 - DNA, 1648 bp, Homo sapiens
taaaggcgtattcagaaaaaccaggcttttttaaaaaacacgtttgttattaccaaaaagagacgtctttaggtaaaaataataaaaaccccatgctgcatagataatgcagatctatttatctggtcaacgggcaaaatgcaagcatttaaggtcttcagctccaatcttttgttcatttcttattgctggaatttcattatttcttcttgttggatgactaaaccggatgatggtagagatggtaagccggcatttactcaagccccgccctgctcagcctcgggagcggacgaattctcagctggtggattggctgcttttgtctctttgccatcttgtggtttagggttttctgggcgtcggcgtcggtaattgaagttgcggcggtaccgacgttgaggtggctgctgaccttgggtctcatctccttgattttctttatcttcttcattgccgtcctctctaggctgtctttggagaggagggcctctgcggaatcgtggtctatatccccgatacatattctgcctcactggtctaccttgttctcctgcaccctggttgtcagcaccctccatcacttctccctgcacaggagggttggaatactgtggtcgacgcccatagggtctccgcatgtagtaaggtgggaaccttcgcctgcggtagggccggcgttgttgggcctggccttcgggagcactctccgatccctcgttcttttccccactctcactattctggtaattttgctggtaattgcgtggaggacccctaggacgtggatagcgtctataatggttacggtctgctgcatatttactgccttgaactggaacaccaccaggacctgtaacatttgctgccttcgcacccttttctccttcaacaacatcaaactccacagtctctccatctcctacactgcgaaggtacttcctggggttattcttcttcatggcagtgtggtgtacaaatacatcttccttggtgtcgttcctgtggatgaaaccatatccgttccttacattgaaccattttaccgttcccaaaaccttcgttgcgatgacctttttgtgcccgccggcaggcgccgccgatgtgaggccgcccgggccaccgctccctgcgccgctgccggtagtgccgggcttggtgtcggcggcgctgagggcgggggcggcgggcggctgctgggtctcggcctcgctgctcatggttgcggtgatggtgactgcggccggctgcggcagctgcggctcctcccggggtgtgacggtaactaggccggcggcggcggtggggctgctcagggctctctggggtccgctctccgctcccgctaccgatcgaactgaatgcttaaagtttttatgtcctaccggttatgacaacttcaggtacaacgtgcacttgggacagtttaaagatagttaatgatagtggatataaatacgtattttaaatagtaatcgtcttcatcatttcaattttttccccttttagctgacttctctggagggatcacatcacctcaccactgtgtcactttgcagtgtggctgaccaagagcttgttcttgtggtgggctgctcatcagcccagccatttccctgttgtttttggtcagtgggagattagcaga

SEQ ID NO: 76097 - DNA, 1033 bp, Homo sapiens
gcagcatatggggcaagggtacataatttggttatttttattttgtagtgcctaatattgtagatggttattgttaaattgagaaaattataccagtggcatactttaggttgttcaatcatttcagtagaggtggcagatgagcctatatgagtagctaacgcagaactagataatttttgctcagtttagactatggagactactttttattttggctgtggaatatgactagattatctaatttgagatgtattatataacccagccctttacaaattttatattttatctatttagtacttttctatgtcccctataatgcctaatcataggtgtcaagaatatttgttcttttgggttttctcattttattttaaaagtgttacttctgtcattcactctctgacacactgaatctaaatctatcaaattaggtaataagatcaaactggcatttcatataatttaagcaaaacaatccttgaattacctggattaaatgccttctttaaaaatcgttatttcattgcaaaaaaagaaaaacctagcacagaaaaagactgattgagtatacaaaatgacagcctgaaggccaggtgcagcctccaagcatgtatttactctacacaatatttaaaagtcaaaagtcacaacaaattcacatttccagctactcttgaaaatcattaggaactgtcaggattacgtctctacattttcagctggagctgattccccatccccacaccctactgtagacaaggcctctgctctcctgtaaccctgcacagtccctgctgcaatgggctcagtgcttgcacttagcactcccactttgccagtttctctcatttaaggcatctagcaggcatgtggttgtgctagtggttacctgataaagacactctcactaagaaggaagtgggggcttctttcatcaaggaaggaagatatcccctctaagccccctcaggaggagccttagaggggaaatcattttcccctctaaaattattatgaaaatcatttc

SEQ ID NO: 76098 - DNA, 1032 bp, Homo sapiens
tgaaactggcccataattagtgctaaatgaatgcagaatcaatttaacacattgatccattgcctgtggctacattaatttgtggtaactaagccgtatagtaccctatcatttaattctccaggaacataaaaggaaaggagagaaaagaagatgtggatctgtggctgttccaattcaaagttgattcaatgttttacatgcaaggagaaaaaatatctcctgagacaatcaagttgaatggaacccttatttactaatttagacttaatttgattctggagctaaaaagcttttggctctttaccatatagatcccttgagatgaccttcagctaattttgaatgaagtaaaacagggacttgtctgtcttcctcataaccctcttctcttctgtcttttaaatttgtatcttaatgatttaatactgcttcttgttgcattccaggattctttccaattttatgctgtccaattcttattagaacataaattgaaagaaaaatatgcatagaatactgcctgaaggatagtcagttcagtcttactagttttctaaaatttacctatggatcaagccagaccagagagtcttatgtacctgaatcaaatcatcttgaggtgatttgtcacttaaaataaatttcagattaatatctttttatcagattatgccaaagaacagaggagaaacaacctaggaaatttagattctgaatttattttgaaatattgttgaagacattggcgactatcatcacacaaacaatgtcctgcccccattatatggacctggaggagaaatttctctcagatttcaacaccaggaaaaactatgtttctcctgagcaattggtttgttgttacttcatgagtttcataaatccatgtttctttttactggaaaattcagaaccaaatttgtagcctacctctgccagctgtacagtactctcattatgcattcttgtgtatttgcccggcttcaacttattttcccttttctttgatttactcatatatttatttaa

SEQ ID NO: 76099 - DNA, 3008 bp, Homo sapiens
cggccccacgccagtatctgtgcttgcctggacgagactcaggtgttaatcagatgaaactgctcctcctcgggttgtccctcgcgggccgggcgtcccctcagccacccatggggcacccttcgcctccctcgggggatgggggatcggcttgcgtccggacctcggaaagtgtctgccttctgcctttccgcgcaaaaggccctctgtctgcctcgtcgtttccttagcgaggacgggctgcagcctgctgccggggatccagctttttacttgagagggcaggattcccctactcgggctcctctccccctcctttctgggaacccccaccccggtagagcgtcccgaggctggtgaggagcgcacttttcccgggtcgcgtttccctccctcgcgaaagccgtgtgtgttctgcatgtctgattccgttgcgctgaatttggttaatatccgtcacttcggcgatcggcagttgctgcagggcatgacttccaagatgaacagcaagcggatttgtaggggtttctgctgtggttctgtaattggcaaggtttatgtgtaattgagtggcgagacgggggttaaagaactatatttggaatctgagggcttagtttggagtgaaggaaatccaagactcagtgatgtgatttcggaaaaagaagcagtgtggacgggaatcctagtgtttcccttacttctttttttaattttttctttaactgtcaaattctgacaggtcgagacggtgctcgagaagggactaaattgaataagacttgcttttattattaggtagaaaaaaaatgtctgagactgccggcagatattgagtgcaaagcttaatttagctgctgaattttatgaaaaggtgatatccaaagcctccttttttctcttttaagtaaaggattgcctttccctggtattctttccgtatatcgatggtgattaattgaattttcctaattaaaagacccttggatagagaaactagtctaaaccagttgcagaaaagggaacccccaaatcagaaggtgcgctgttctcttcttttggtcctgaaactgtttgggtatgtgaagattcagttgtatttcagaattcctggagctgacattgccaattttcgaataatctgatggtgggatgtcaaagtgtatatcttttatctaccctcaacttgcactttaaattccagccattctttgacaataatagagtagtgagaaaccaaaatatgtcagttgtctgtggaaataaaaaaggccatagatgtttaaaagttaaaccgtagaaacatttttaaaatgaacattttctacttaagctttccattaaataatagtttcatttaacgaatcaacttacctttgtgaagtgacatagcagataggtgttgtacagactgctttgaaagatgcagcccttatctggtgtccctacagtctaatatggataacattgatacgcaaacaaatgaagaaacattgtatgtaattattgtgcaaaacttttctaaatacattacctatgagtttggggttaactgcaaaagaaattccgtattcagatggattaggagagaatgtgactacctgaagggagaatttaatacatttactaggtcaagaagaaactgtcaattttaaggggagttgaaagtcagcagccactttataaataaatatatagttgatgatgaggcttctgagctaaataaaaatgcaatgtaaaggccttgaaaagctgaagtggaatgggtaggtggcataggtaaaatgttagagagaaggtaacattaacattgacagtggaattaaagacagtcaggggaagccgtctcatgagaatgaggtacagtagtctagggggaaaagtctagggccaggaacaaggatgtagctgaaggaatgaaaaggcagctacagatttggaataagtgataatagaggaaaataggttttgatgataacatgtatatttgaagtcagaagtaactcaggctttttcttgaaagttgttgatacagatattgtctactatgatggagaggaaagaaaactgatttttctcaagtctgtaactagtgggtttcattatcaacagcttaatttctgtggtcttgcctgatataccatatgatttgggggaaagaacttacaaaaatgaagctgtgctgtacaattttgtgtattctagaacttgaggttttgcagttttactatgtagaattattctttactgaactgaagtattgtgatttcatacttaagaaagttgagttgaactgtggtttttgtaaattattatttgtggctcttaaaaggtggagggtctcttttagaaaatctccttggcatgcttcgtaatactaattttaagtattttatctatatctattttacaaagatagtggaaagtgtgatctacccacacacacattttacaatatgttacttagtattttgtgaagtcatattgtcatttctaaagtttttaattgacgttgtgacattttttattacctgttgaaagatatttgttctttgaaacttttcatccattagatgttttcgttatcttcatttcagttgtaaatttggcaaatttagtacatagtctgttgagacttctcattaaataaattaattgtattaggtttatgaaagaataatggtagaaagggaaatatttagcagaagcatttttttgcttcattattttgaattattaagcacttgaaaatgagattatgataattaatgtaacatggatattctaattatacttttttttaaatcaggaaaatgagaacatatatgtatataaaataggctgtatgtggaaacattttatgttgaatattattgtccatctctaacaacaataactttgttcgaaactgtcttatgttgacttgacagaaatgaaagtcacatggtgtttggtgacctaaggtctagtttgaaatatttctgtgtctaattagttgtctacttgta

SEQ ID NO: 76100 - DNA, 1065 bp, Homo sapiens
tcagcctcccgagtagctgggattacaggcgcctgccaccatgcctggctaattttttttttttttttgtatttttagtagagacagagttttaccatgttggccaggctggttttggactcctgacctcaagtgatctacctgccttagcctcccaaagtgctgggattacagatgtgagccaccgtgcctggccagcaattatatttctacattctattctgaatatctgttactgtgacatgatagtatgtttccataacgtatatgcttttcaggttttacccacttgcccttcctcttcctgccctgcccttctaatctactatatccttgggaaccacataaacttgctaagaattatttgtgatattacatccagttagatttgaagtgagggtctaaaggcacatattttcacttttgggttcagggcatcagaaaatgagtggatattactataataaatagctttatttctttgtatagtacttcacgatttcaggatcatggctaaatgtgtctgcctgatgctgtaaatgttaataaaaatccactctatgagtgaaagagattaagtgcaatttgaatgctaagtaaaaatgaaatgtttcttttaattatttcttgttcttttaaaaaacacattaatgtgcacttgaaattaataatctttaaagtctaattaatggttaagaactgttggatatcttataaataagaaactgagccaggcacaggggctcacgcctgtaatcccagcactttgggaggctgaggcgggcagatcacgaagtcaggagattgagaccatcctggccaacatggtgaaaccccacctctactaaaaatatgaaaattaggcaggcatggtggtgtgtgcctgtaatcccagctactcgggagtgaggcaggagaatcacttgaacccctgaggcagagattgtagtgagccaagactgtgccactgtactccagcctggccacacagtgagactccatctcaaaaaaaaaaaaaaaaaaaaaaaaaagaagaaactgaatagagtaaaaatactattttca

SEQ ID NO: 76101 - DNA, 1033 bp, Homo sapiens
ctagtttctctctagtgttaaccacttaaaaaatctttttgtttattcttttgtatacagtcatatatttgatatatttgaatatgtgtatgtgtatcatacaatacatcagagcttgcaaattgatggaccactggccctaactaaccagtgtttcattagtcccctactgtattttagaaaaagtatttgtttctaacacttaaaaaaagatatttcatataaaatccatattttttttgcttcttaagattcagcaacacacaacatgtttctcacataatagttgtttagagttactgtctgcataagatagaacatgcgttcttcagtttcccacagtttctgtttaatacgtgttggctgcctgaccttgataggcatttgagattgtgattcttgctcatacatagtattttgcactttcttccttcactccctaactctgtagcatattttggacatcttttcatattagtgaaaataatagtggttaactttattgagagcctatgaagtgtaaaatactttctagagcctgttacagagcctattcatttaatcctcgtaataatatgttagtgttgtcaccattttacagctgaagaaattgtagcagagagagattaagtaacttgctcaagttagtgcagtaaatgaacaggctgcaaattgaatctatgtaatctgtccgtagagtgtaagctcttaactactacatgatactcctctttggcatgtcagaattatttcatagagatcttcaaagatgttcatatacatatttcactttaatgggtcttactgcattgtaggttatgctatatttaattagtccctaattgatggacatcgaggtttctgatttttcagagacagatgttgtagataataatattatacatttatcattacaagtttataagttttttataatgtaagattactatctgtagaattttggggtcaagggtatatgaacttaaaaattttaatagataatttactttccaataaggatgtattaattaat

SEQ ID NO: 76102 - DNA, 1075 bp, Homo sapiens
tgcactccagcctgggctacaagagttaaactccctctcaaaacaaacaaacaaaaaaattgtcaattatgcatcacaatgaaacattcatttctgatttttagcacaattcaggagtaggtcatataatacatgacaaactcaaagatgaataatgcagtcttcccaaatagtagaaacttttaagcagctgaatggtaatggatctaattttgttattttattgtttttctgtctatgagtgatatattggtctgaccatagcctgacttgttaacaaacaatacagctcaactcaatatgtagtgtatcatgtactttgcatggtgttaggctaaaactactaagtatttataatgttatgctttaagtatgattagttgattgtaaaatggttcacattttaaggtatttttatattgaaacccttgccaagtactgtatgacagggttttcaaaacttttttagtaaaagactagatagtgaatttttaggctttgtgagctgtatatgatttctctcacaactattcagctctgcccttgtagcatgaaagcagctgtagacagtgtataaatgaatgagcattatagtgtcccaccgaaattttagttataaaaagaaatggcaggccagaattggtctaagggctgtagtttgccaactcctactcaagacgtagcctgttgtaagggaaatataattccaagttacctgcatgtgaatcgaacttttatattagttaacatttgcattacaaaacatcacaaaatttagttacttgaaactacgatttagtatttttcacatttctgtgaactaatttggttctgcttccggtggcatttgttggggttctgatagagctgtgatatctggaggctcaactgggattgttggccagggctttggttctcctacatgtgggtctttctatatggctgattccttagcctcatggtgtgatagttgggttataagaagtattctaagagcaagcattgtgagacagaggaagcagaagatgccaggccaagggataggcctgaaactttcacagcatcacttctgcca

SEQ ID NO: 76103 - DNA, 1032 bp, Homo sapiens
caaaagtaagaactgaaattaattcagtatcttgaatatttattgtaatctcttcctgctttgagtagaggatggcagcttttagtatctgctatcttactttgccaccataaacatagaatagtatgtaaagatgatcttactctgttgccaccattgatttccaggtttgacttagctgatctggttggctgaatgggtatatccttcctttggaaagggaccacgtgcatacatgaaagcaagtagctaaaatacagaatgaaataaaagctgtaatagaagtacaagcaacatgccgtgggtgcacagaggaaggaacaattaattttgactgaatggctgtaggagggatggcattttaaggaaggtagtgtttcagtaaggcctggaagaatgaataacttatccttagaaaagaaagggaaggtaatctggctgtcaagtttctcatctgctgaaacggtggtaccagagtgtctaggctaaagtagatgaacttaaatataggtataggacattcaggataaatggcagcatgcagttgtctgattttagccatcttaaattggaattacaggagtgaacacagttttgttacagttacgccttaggtgactatctggtaatttgaaatttgagacttcagtttttaaaattaagcagtttatttcaaatactcagatttttggatataggaagaaatttaaggattatctatactaacacactctagtaggtaaagaaactaagacctagttagatgatttatttgagcttacgtatctaaatgactgagttggggctaaaatacctttctcctggtcttgggtatttttgaagaattatccagtgtatcctttattgtaagaagattttctccaagtatacatccatatgaattgcttgctgtagtagcaatttttaaatttgagatataacatgcatatagtaaaatgtacagatgttaattgtatagcatggtgagttttttatgtgtacaaactcttacaattaacactcagatcaaga

SEQ ID NO: 76104 - DNA, 1021 bp, Homo sapiens
cactcctaaacttaggggaaaatgttcaatatttaccaattatgatgttagttgtaagttttataggtaacctttatcagattaaagaagttcttatctattcctagttttcttttcttttttgaaaaaaattttatagagagagggccttgctctgttgcccagactggccttgaactcctggctcaaatgatattcccacctcggcctcccaaagtgctgggattacaggtgtgagccactgcgcccagtctgatagttttctaaatcatgaataggtggtaaactttgtcaaattttttgcttttgttgagataaatcatatggttgtatccttaattctgtgatgtggtgaattacattgattgatttttaaatgttaaaccaactttatactcctaggataaacgttactttgtcataatgtattgtcccttttatgtaccattagattcaatttgttaatattctctttagaatttttacatctattcatgaaagatattggcctgtaatagtcctttattataatatttttgtcagattttgttatcaatgtttgttagccttgtaaaaagaattgggaagtctctctctgttttatttcaaagtgtttgtgatagattgatacgtttcatgtgtacttgaattgggaagtctctctcttttttattctctgaaagcatttgtgattgatagattcatacacttcatgtgtacttgaatgttgattctgcagtctttggtgttaatgttctttgtcagtaaggtcatattggttaatcaagttgttcaaatcttcaaatgactgatttcttttttcctgttctctcagttttgagagtagtgtcttaaaattataaactatgactgtagttttgttgacttttagttctttcagttttcccctcatgtagttggaagctcttactaggtgaattaaaacttggcattgttattttacggttgaaatgacctttttgtcattatgaaatgaccttctttatctctggtaatattt

SEQ ID NO: 76105 - DNA, 1026 bp, Homo sapiens
ctcgtgagaactcactaagtatcactagaacagcaagggggaatccatctccatgattcaatcacctcccaccaggccactcttccaacattggggattacaattctgcatgaaatttgggcagggatacaaatcaaaaccgtatcagcaccccttcatgccccaaagagaaaccaacctttatctttgaaaccttgtcactgaagctcccagcctggttaagagggacttctgattctataatctaaaaatcatgaagtcatcttagacacctccctttcatttttccccacatctacttactcattaatgtctggctccctagtatgcctggaaatctgtttactttcctggtttttattctgtataatcactatcatgagcaaaataagaacagtcccatctcatcagaaagttatttcatacctgacactttctacttcactgttcccatctcattttctaactcatcctgcttccagcttctaatttccaatgtaagaccttacaactaaataactgcatttactcactcccctagtgtgatttttaaatcacattttaaacttttatatacgttataagccctactttacagtgttttattttgctttaaacagttatttgatttttaagtgaattatgagaaaggaaacagtttttgtgtttaccaatttatttaccatttctgaagctcttttttcctttctgtaagtctacatatccatttgatagaatttgtctttggtctgaagaacactcttcagcatttcttacaatgtagattgactggcaagcattctctcagcttttgtttagctaaaaatgtctttattccaccctcatttctgaaggatatttattattgatgaatataaaattctaggtcgatagccttcaccccccaagtactttaaagatatcattttactgttttctgacttccagtgagaggctgggaataattcttatttctcccatacatgatgtctccctgcctccctttctttttgtcccttttctggc

SEQ ID NO: 76106 - DNA, 1058 bp, Homo sapiens
agagcaacagtagagcctagaggcattatcagtcttaggtctttttagcagcgtaggggactttggatggtggcgtagttttggcagcagtggctctaatgctaggccctacaagtagataaggctatttaatactgaattactttcatctgaagtcttccaggggcctgatcattctgtccagatgtggaacaagaaaatgatagatctaggattgttatgattctctttaaaattccctagggatttgtttggatctgggattgtaaagccatagagtacattgtgggttctcagtaaatcctttgagtgaatgaataaatgaaagcagccacttggatctcttatggccagtaatgcaacctggtttatttgtgaattatttccttagggaatgataatctcataacttcagcactcagatataaagtctacaggttaaattaccagtctgggttataggttttattggtattacttttgttgcttttgtttactgatatatgctccactcagtaactaattgtttaatacattttgttgtagaatattatgtttagtgtttaactttattttgtacctttgttaactaggtgtttttttgagtatattgtgggtatacttatgtaccaagtgctgcaagatctataaaaaaatataagatgtattccctgccattaacgagctcaagttagtgtagctaactcaaagaaaggtaggtaactatgccagtcagtaaatgaagagtacgatgagtgatagttaagaagaaaatgtttataagtgcacattcaaaactggatgatgtcagcctagtattttgaaaacattctcaaatattcaatttttaatgcactgttaaaaaataggaagtacttttatttcacattttaattagatgagaataactaatttatttttcattagtggtgttattagagcattaattttccaaaagaaaatttgtagaatgttaatgaagctacagtaggaaataaataaatgttctgtaaataatcattcaccatatttgatatttgattggtttagaacattaa

SEQ ID NO: 76107 - DNA, 1026 bp, Homo sapiens
gtctaactggcaaatccttccagaaattaaaataatcagcaggattagctgacttaagagatattaatcatcctgcaaatttagtttctcctttctatttcccttgctcgccaatatttttaaaaatatgattttgtagtttgtctctttttttcctagttgttgtgggggcagtgacttgctactgtgtactagtaaattaatcttgtaacagtaagaacaacatttagaccgacatgtttattattttatgtaatgtatttatatagagttggtgtgcttaaagtagtggattgttattgaaatgttggcttgtttagaatattaatatttgttgctaaattcaccaggcctataaataaatcaatagtaatgtttggggaaaaatgaaaaaaaaaaagctatttttcatttcaaaatgtcttttggtcagcaatagcttaaatgaaatgtagacaaaaattaatttttttttcttttccccatttctatttagtgagtgatagttgcttcaggaatcttgcagaagaccgcagtgggataaatctcaaagatctcgtacaagatccttctttgtgagtattgtgctttcagtattaagtataaattaaaactttattattagtgttccttttctcaaaagagttttatgtgaaaacttatttaaggtacaacaattttttcttttctaataatgcgttttacacatattgaagtctgacagaacagttcagaaatagaatagattttagaaggaatgatgtcatgattaatgattgattttcaaggaggaatcctgatggctgatgatatcttgccaatgtggcagtagctactagccaagaaagatgattagtagttgatttccttgggaaagagagattgaatttgtttacaacaatttgaagttttttgaatatattgtttatagtaattatttgtaattataattagaaatataaagtagttatttgttataacaatatacatttgaatatgttagatatatttctgatgttttacata

SEQ ID NO: 76108 - DNA, 1088 bp, Homo sapiens
gatttttggagtttgggtgctgtcttaagtgttttagtaaatcactttgcgtttatgtatgcctattttttgtgtgatggtttgatattttcatattttttcataacagaaaaatagaaaaaatttcaccagaaaattaattcataaccaaataacagtattatttttaattccttggataattgatcgtggggaaataatttacatcacaaaatgttttgtatcctactgggctttcagttaatacaaaatgctaggctgaaaattcaaacctttgaattctggctctgctacttatcaacaaggtgaccatagacggagtgcttttactcacacttctgatgctaaatgtgggtttttttactcgaaccagccagttcttcaactctccagatatcaaatgtccttctttttatttcaattaaattctgacactacctaccaggaattagtactagactctgcagatttaagggctgtgtccacaagattgccttcacgtcacatgccagtggcaagtaccagatccccaggctagtcaaaattctgtcctacttgactacaaagtcagttggttcccaaaccgcgtcccccaccccactctgcattttcagattcactaatttgctagaataggtccaaaacctcctggaaacactttacttatgcttaccagtttactataaaggatacaatttaggaatagccaaatgcaggagatgcacagggcaaggtataggggcaaggaggttccatcccctctcagtatttagcgcccctccggcaccttgatgtgttcatcactctggaagctctctgaatcccattgttccaagatattttatggagctcagtctccaacctcacccctcagtgagtggaactgaaaattccaatgctcataataacttagtctttccaatgaccagaccagccccatcctgaggctatctaggcacccaccctaagtcgtctcattagcataaactcaggtgtgatctgaagaggtttgggcctggcatggtggctcacacctgtaatcccagcactttgagaggcccaggcgggtggatcagttgaggcaagga

SEQ ID NO: 76109 - DNA, 1088 bp, Homo sapiens
tagcagtctttgaagcgtctttctgactttaatgttgtcctcaaagtatcaagaaaaaaaaaggaaaagatcacaattatgtgatttttcacagaagtttgcaactttcatattggaaaaatatttagacgtcaaagataaatattttatttaaaaagaatagctaagtccaattaaacctttatattttagaccgactagttcagaaatactgatacctgaagtaagactataaatttctaccatctttcaaggaataaaagaatctggtaatcaaattaataatgtataagagggaaacagaactttaagctagttaaggaaaaaatggtttcaagcttttaatggcatctttttgccattgataatgaacagtctgttaataatgaatacttgtgttatctattcattaacagatacagataacctttatttgtctgtattgtactagcatatgtgattgaaagtgataaagctacattcttcaaaccattcttctgttcagattttctaataaacaggtatctttctcttgttatatttgtaattaagttttattctcttattctttgttttctagttgcatctccccatttatagtttacaggtctttgtactcagctcttgctctcttgtccatcttccagtccccatctcattcgctgcctgctccctagtttagatccctaatttcagtattctacttcctacgtggcatttgccagtgctcttgcatctgggttcttgctctccattctctttttcctagtctttggttctctactactctttgcaggtagtttctggatttttgtattatttctgttctctaactgatatgtgcagaactgcaaggatgtaagaagaattggaaagtagaagcatagaaagagctaacatgtattgaatacctattctatgctaagtgatttatcatttagttctcagagccctcttataagatgtaggtatgttttattattacctccattatattcataagtactctggaaacttaggttaaatattttattctaattcacatagcaaaactacatagtaaagccaagtttcacatctagattggt

SEQ ID NO: 76110 - DNA, 1006 bp, Homo sapiens
ttccatattactcctgaaggatattttcactagatacagaaatctgggttgactgttcttttctttcagcattaaaaaaaaaaaagtaaaataaaatatgattccactctcttttgctccatggttcctgaaaagaaatgagcaatcaattcaaattgctgtttccttatgtgtaatggcaaatttctctggctgctttgaagatattttttctgcagctttagtttcagcaatttgattatgatgtatctgggtgtagttttcttttagattatccttctgggttcagtgaactttatgattctgtaaatttatgtctttaaccaaatttgggaaatttccttttttttgctgctcctatgacatgaattttagattttttggtaatgtctcacaaatccctgaggctctgttaatttttaaaatcttttttactctgtattaattttaggttatttctatgatctatcttcaaattagctgacttttcccctctttcatcttcattctgcctttgagaatatctagtggtttttatttcagatatattttcagttctaaattctccatttggtttttttgttaatggtttccatttctctactaagaacttgtatttttacatttatttcaaaagtattgccctttatgtcatggagaatagttataataactgcttaaaattattcttcggacaatttcaatatctggcttaccttggggttgacatcggttgatttcttttcccatgagaactggtcaaattttccttgttctatgttgagaaattttggattgtatcctggacattttgaacactgcattgtaagtaaattatttaactcctgttaaaatcctttggggaattttaattagttagttttagcaattgatctgattgggttcagattgtaaattctgtctcactttctgtgggtagtggctcagcctttgctatattgttagtgtctgcccagtacatgaatgatttaggagttagtttgag

SEQ ID NO: 76111 - DNA, 1452 bp, Homo sapiens
gcctctctacagcttcctgcccaacaccaaaagtaagtatggttccttcgcatcttacacctgctcttctatagtaatctgggaaaactaaccaatatttcctcctgcttgtcaaggttggattgcatgcaagattacactgtgaaaaatgaataaagtgtaagatagttcccacccattgtgtcacaaattgtcatattaggccactagtaggacaatacagatttcattcaaaatgtcttactcctacatcatagctaagggtattactttctgtagctcctgtttctttgttgtagatttgttattttttagtatacttaacattatagatgtaaagttatttgtttatgccgaggataaatgtacttttggccagtaaacagcaagattaacaaaattgtgtcaccaaagggatttctttaaacttgtccgggctggggtagctccctgctctagtatcattccaaattttttcaaacattcatcttggaatgttgctgcctaatatttgcaaacaaatctaaatttattagaaagaaagttttaatgccaacctttgggaagagggtagaagtttcttagtctttttttttataatctgtcactgaattgtatagggtgaggaaaggatgagacacttatatgctgttcacatctttgtatacatgataaattaactagcagacattattactgctgtgactactttctcctggaatgctccttgcctgattaagttagtcatttgtgctttcaagttctctatgtgatggatgcaatattggtatcaaaagattaacagtaacattccttattatttaataagacatgatgttagacactaaatttgttttaggattctgacagttaatttttcaaattatagttttttctctgtcatcaaatttaaggacctgtatagctgtcttcctcaattccatcttttctatcagttttgtgaatgttataatttaatttgactagaagggatctcagtttctgatgtgaatagtgcagtttgttttacattacttgttacaatcttctcagcaatgtttccagtgttactgttgtatatcattatttttagatatatgtcaaaaaaactgatattaattttatcatttaaaaaactgaggtcctgaatcttcaataaagataaactataagaacattgtagacattaaatgtatgccagtgccatttgggtgccagtaagctacattttcaaatgcataaaagcaaggaattcttaaaacctgaattagatggaagaatctcatctatatcttttatattattaaaacaaagtaacttacagtttgactgcattaaaatccagttgtaccagctaaactcacttgtaaagtctagaaaatatttaaaactaaaagttaagttcactataagatgttttgttcactgaatattaagacctaaaagttggga

SEQ ID NO: 76112 - DNA, 1068 bp, Homo sapiens
aatatctgttcttttttatttaaaataatgaatctttttgcctttccccactgagtcaaatatcaagaccatagattttagcaccgagctctgtttaataaaaaattaaaatttattttaattttttagcataaaaatttggggccgagaagtccaaaagcaatttcggggtttcaaatttgagatactgggtagacaataatgttattaactataccaaggaataaaagagaagtaccaagtcttgagggtaaaagaaaagagtttaatgcatcttgattgggaatgtgtttaatctgaggcatatgtgagacaaccaaggagtgatatccagcacaaaattggaaatacaatttgagtttgaaattcttatttttactgcatcttggttatgatatttataacttagtacatattagtgttagccaaatcccatagaaatcctttctacatttcaaattcggcatgcacagattttcatgcacagaaatgtatgtgcaaacgtattttgtctacatcagaaatacaatatagttttgaatgatcggtactagaaagagcacttgacttgataatagaagatctggatggaaatgcttttttctctacctcataaccacagtaaattaagcaagttacttaactttactgagttttgtgtctattatttgactgaccatccttacctctacaacagtgtttattaactcattaaataagtctttgcctggtagtagaatagcaacagtgagcaagtagacattgttccaacttctacaaatagatcagacaactaaaaattaaaataaagcataataaattctagaattgattatcaagaatacataatattatggaaatagctaccagaagcacttaaccaatatatagatatattgcagtataacatcctaaattatatattgaccgtttaagattctccagctatagtgagaacaaaatctataaaactataccaggtcttgatttctttttgttttttttggtaccctcattacaacctaatgaagataaccatgtattatcttttcttaacaattcttcata

SEQ ID NO: 76113 - DNA, 1413 bp, Homo sapiens
taccattcattttagatgttattaaaatgaagaatatttttaaacactaattttattatcgttttattccctaaacatctgaagtttgattttgagtaagtaaatatagtctatagtcacatatgttcctgtaccttaaaagttagcaaagaattttgtgcttagaataaccagcaagttgtgttttttttttttttttttgctcttaggaagaaaatataaatactatcaatatctaattgaagttatcaatatctaaagtttatacaacaattaaaatgtagatgtattgaaatatctttatatgagggatatatacctttaatccactaatgtctaatactatattcaaacaaaatatgtaattattacttctttgtaggtttctcttactgtcctttgagcaaaagaatttagattgctctggttaagttatattcttaactcagggtttttaatgtatgagtctgaaaggcagtgtgaattcctttacctataaaaatggcactgctgattctatatcagcataatattttctctgggatgttttcctagtagtgttagtttttacaaagtattgaatattgtcactattttcctttgtgaacaccagggtgattatgtgatatggctaggtcattggctaaacctgggttcccaagtctctggagaagctcataaaatggccatacttccagcctaaatcaagtcactaactggtgacggcaaattatttttttcctatttttaagagcctaaccaaaatcaataagactatactagacatcaagcttctttgcttttgctgaaattatatcaacattggtatgacaatatgttcagctattaatgacattatagaaatagattctacacataccgtcaacacacaacaaaaaggttggaaaccagtgaattagtgagatcaaaaatacattctctgaacaaaaatatgttttcttttgtgaacatttacctcatctggggggtgttgagcaataatattctctgcattattggttagatccagcatttctcaaacatactggtctccagaccccttcatgcttttaacaattattaaggaccccaaattacttctgtttatgtgggttatatctaacaatatttgttgtactaggaattctgagggccaggcatggtggctgtaatcccatcactttgggaggccaaggcaggtggatcatctgaggtagggagttcaagaccagcctgaccaatgtggaaaaaccctgtctctaccaaaaatacagaattagccaggcgcgttggcacatgcctgtaatcccaggtactcaggaggctgaggcaggagattcgcttgaacacgggaggcggagattgctgtgagccaagatcatgccattacactccagcctgggcaacgagaac

SEQ ID NO: 76114 - DNA, 1076 bp, Homo sapiens
cagctgaacaacctcaatgcttgggtcagcaagcagaggagcttcactctgtcacctatcaagaatgatgcttgtcaggactgatctttccacctacagagcattcatgtttctagtcataccatttatgttttctaatattacaatggaatagacactaaaacactaagagagaaaagtacataggtatatttgtaattctttgttttttgtaagccaaatgcaaatgtaacactactccagatactgcttcatcagaagtccccaagataaccaaaagtaagtgccaatttcctcatctcagggatagtgccataacaaagactgaattctagggaccagcctatttgcagagcatgtcatacagcctctgggttagttaactccttggcctcctaagagctaccacagagagtcaattgatgtttttgcatgtattacttactaatgtatagaaaaatttttaagttcactttttctttattctgtctttcttacccatcttccctcattgtagcaaattagacggccggatgaaagcaaaggagttgctagtagagttggatccctcaaagtaaatatgtttctaacattttttggcaagatttcgtctatagcctacacttcttcctttttggagggtggtgggaggaagggggctttttccatttttcaccatcccattttttttattttaatatttttattggctgttgggtcatattactttttttttgtttcagctacacatagagcaaccagctgaaggcaagctgccaaataactagctttgaatggcaccacaaacaacagaaagggcaactgcctcattacaggtgcctataatttggggttctagaataaaccgttcctctgattgatgtcactgtgtgttaagttcctgttacacagagaactaacatttattttcagaatattatctccccttttagcttttttttgtaaaaaaaataattttaatgttattttggtatcatcaccatttatagttcatttcagagaaaagttattatgagttaacaatatgtattcaatacacataatcttaagaaatt

SEQ ID NO: 76115 - DNA, 3283 bp, Homo sapiens
tatcactcttatgaaacacagaccaatcacatttaatgctgccaccttaaatgcaagttagaaaatttgctgaattctaaaaatatgcagaagaattacctcacaaaagtaattattttcttatatctcaatctcatttgccctaacagcaatagtaactgttaaattaatcaaaatgctagaaaattcagtgcactgggatgtcctaaaatttaatgactaccttgaggcctaatattcaatcatttcaaaattttgcacacctccaatttatttccattttacaatttatgaaatactaatttctgcactctttcctctccttgcctcttctgccttcttagctttacttttttgttattgtttatttgtttgtgtgtgcgcacgcacatgagtgcacatggatgaaggtgtgtttgtatgtttgtgtcctttatttcagaaaagccatcctctctgttctctaacactgctttatagtggatagctattttattaaaatgttatttcaccaaggataagaagaggggatgggaagtgttaatagtgtgcctatttcaaaaactaggcaatttaagattattcagtcagaaaaatgtgagtttgtgtatcctgatgatatatcagtagcattcctcactgtctatctgtgaggtatcatattttatctttgtctttaaaggaagataaatccattaatggtttaaactatggattatgactcaaattcaggtgagaaggtacagaacgacatgactttttgaaaattactgaaggtgaaataaagataaaaatggcatccataactgtagcaccatgtactgtaaactggattgtatgtgcgagtgcgcgtgcgtgcagttatctccgagttcaacttctggatgtatagaacttcaagttataaatgtatgtttattgtttttaagtgtatatacaatatgagtatgtatatacacatatatatgtttaagaacaaaagatacgttttataattaaatcagtttatattaatatggatgcagtcttgaatcaaaaagtgtgtttgggaaagaaagtcaaatttcataatatttaaatatctttactccatgtttctacaaaatagaaaatgtcaaagtgaatctctaggggatttataaggatggttatagtatttattttctctaatgctttggggagaaaagatgctgtaattaatcaaaataaaatgttgacttcctagtcacgggtttgttgagcatgcattcttacgttatagaaagacctttgatgtttgaaatgtttgccaaaggcagtgagaaatgtataatgctatgatcttatttttaaaaggaaaaaggaaaaccgaaaagagaacaagttgctttttcaattcattttctgatgtttacatgtagctccatcgaaagctggaggagctcagagatcacctagaaggcaatgtgaaaggatactctctcagagtaaatgtacgatttcacttggtgatttttttttccctaaacttctgctgactggtaactccaaatctgattggtttgtcctctcatctccatctttttcctttctgtctcttttccccctctttctttcttttctagctgcggcttcatgctcccatttatgaaataaagattaaattagcagggtagaggaccctaaagccacactgactaacattgctgttgacttaataatattttggccccagtgcaaaataaaatctttcttttcaaaaatcactatttcttatacaattgtatacttttttgaggatcttgtcatgagacttcatttggagatttttctattggtcatgtcttctaccccttgttagttatgtcagcagaataataaattatgagctggatgtgaggggtatatccttgatggtacaatttcaattttcaaggaaaataatcagtgttagggtatcataggtaatctggcaagtagacacatttgttctgagttaatagacttaactcagactcttttagaataaatgtatgtcattttgtttaaaaataagaaaattagcagtaagtaccttcaccaggaacaccttcacgtagcatcttacaaatacttgagctaaagtctaatatacccaagacaaccattgaaggaggacagtacctcgtatccactcaatcctgtacattcatcatatagtcagaattcatgatagtattttttgtgacagatagttcagactatcaagattttcaagaaaaatctctaaattggttttggtataaatgtagcagaagaaaaactaaattactacagtaatttatggctttcatttctggggtttccaagaaagttcctgtgaatcctggtatccgatttacttctcacaaggttattaccattcatttaattcacacagctgtaatagttttgttataaaaactagaattaaagttagggatatgataattatcttatttctcagcttgtttttaattgtataccacacatagtcatgtgtatctctacgctaaatttctgattattgaaatacaaagtgatttttattaataagttgttaattctaataactaaacagaaggaattaatacacgtgtctcatatctctacttcttcctttgagctactctttgttttctgcacatattcttatagaattttgaaaaccatccataatcactccccaaaacctattttgtcattttttttaaaaaaaagattagtatggattttatgattaaatcagtctggacatacctaattattctagaaacccataaaaatattttaatatgtgtattttagtcttgtgctctttcctaatcagtcatgagaagtaatttttcttttcaatgaaactgagaccaaaaagttgagacttgctgatttctgtatggtaataagttagtaagagaccaacatcaaatttaaaatttgatgccttaaaaattaggttatctcatgccattatttaatttcttttttcaacacctgtactactatataatgattaatctcattttatttcactgagaaacactttgttctgattaccttgtttctaaaaatattaaatataaggtgtatctgtctaaggatcctgttaactgtccaatatagaaaaaaaaaaaaaaaaaacctatccaaaggcaagtagtatcttctctagagagttcagctaaggaaacatgcaaatcaattgcttagctgaattttcagtttctctccttaccctttaattcctactacccaagtataccttaaagtgccttgaatattaaaa

SEQ ID NO: 76116 - DNA, 1579 bp, Homo sapiens
aaaaaaaaagaaaagaaaagaaaaacatagaataagataatccaaagtaatactttctttacagaatataaatcaaggtaaatttacaaagaatttgattagttgacgagcagtggggccaaagagagcctaaatattaagatattcaggaaaaaagtagataaatgttcatgaaataaagatagttaaaagaaaagaaaggaaaggaatgaaaatactcatatgccacaattttgtattttcatctgaatactcagtttatgtattatgatattaaatttctattcagctacaaatatgtgtagataggttttggctgaccaagtgtgatttttttaagggctatgataaacaaaaaggaatatggttcatgaagacagattactggcatataagtgaaactaagatggaaagtgatgaaatggaaggaatatgacaattatctataagtacttaactatactaacacaaattaaaggatggtatttaaagtgaaaaaagtcaagggaggagttgtcacccaaaataagactacctttttaataagtgttaagaaaaatacctgaatcaagttagaaagtaatgatcttttgaaccatgatttttaaatgtttaacaattaatttcctgaatgccaatatgggatagtatgaaatagtgctaatataaataatgaattgggtaactgtgattttatagatctttaaagatgagtattttcattgcagccttagctctgaactactttcttatatttttgataaatagatacctattgtctttaggggggttttgtacttttatttttattgagttaatgcgataactcagagatcagcaaatcctgtttttttataggcccacaagctaagaatgagttttgcatttataaattgtggagaaacataaaaagaagaacattttatggcatgtgaaaattatatgagattcaaatttcagtgtttaaaaataatgttttattaaattataaccatgctcattcatttgcacataacctgcagttacttacacaacagcagagttgaatagttgaaacacagattatatgtctcatacagtctaaaatatttactctctatttaaacagaaatgtttgctgagtcctgctgtaactggttagtgtgtcaaaataacgttgacgtaggaatggttataatggagtttgtgaaatttcttcattttaaagcttgagaaaagaagcctgctcatttttctgaggatggtttcagattattctacaaggaagcatatgtttggaaaggttgatctcctcaaattgtctacctttacatttttattttcttcttttttattgtcttctctagctattctctctctctcttcacatagatttccccctctacacacacacatacacacaaagtcttcaaatatggaactctaatgtggatagaatatagattataaatttctcttttattggaggctcatttctgggttttcagagtacaaagataaatctcattattgctgtcttaaatgttatataaaatatgttattagagtattttcatttaacacattgcatttttctatt

SEQ ID NO: 76117 - DNA, 1053 bp, Homo sapiens
ctgggcgatagagtgagacttcgtcttaaaaaaaaaaaaaaaaaaaaaggacttcagtagcctatgaattttaagaccttcattctttttttacaacataatttctacatgtatttactttgtataggccactgtagctaccatattaaagccagtattatcagcttaattctgattgcagaaatattatctcagaatgtcatcccaaagaaaacccttgaaagatagtactgtttaaaatacgaggtagtatatgcagaaccagaggcagaataccatctgcagatctcaaattttaagaaaaaaccaaaagaaatagcatgacaaacccatagcctcacaaagttgaatttattgagtcaatagaattgcagctatcttcttcaatttttaactttgcaagttataactgtgagatttttttctcttaaaactgatttcctggggagttaacttcttgaaacataccactagggagaagcaaagaaaagaaagccaaatgagctatttttagtatcaacaaagacatttgaaagagaaggttggtatcatctcatcaccacattttctataggtcttttcttaattcccaaagattatgagtgctagtgtaaaaaatatataacccatttctttttgccacttcatccaggcaattctccatttcccatgagagtgtgtaagaagtctaccattggcatcatctccaatcacagcctacagcatccatcagggtattactttctctatgacagcatgtgtgcaggagggctctcacgttggaatgtggaactggcttcttgggggcattatgtatgctgtggcatttgcaccatggcactcagctcttaactctggcttcatctagatttgtttctttcattgtgacacatgggctttctttatttgtcatgaagtgtgtttctctttctgtcactcgtggtagggtttctctctttcactcaatgccacatctctgtggtctccataggtgctgtttatgtttaatttatgatgctataaagaccaataaaatgaagaactccttaagta

SEQ ID NO: 76118 - DNA, 1048 bp, Homo sapiens
ggtcatatattgctatggttcatctccatggatttacacagatttggtttaccaccaatcctagtgtaatttttaaagactcaaataagtatcttcttgaccagcaacaaggcaaattttcttttgctccttttgggttttactcctaaacatgcatttgggtgaaatgtatagcctagactttggcaagtagaattatcaattttccctggtcaccttttttccctttcaaagcatttccttcccaaccagtgttcttcagctaagccacagaacacaggaagtaatatgtgtagctattttcttaagatcctgtaaagatgttgacattctatattcaaaaaacagaagtttattcattacacacaatgaatataaatgcattaaggcttaattctctcccagaattgaggaagatatagtaatcccatcttttaagtagctcagtacttcttgaagtcatttgttatttaaagacgcacttgaaatttcatgtttggaaattctttgtgttgcttttttttttttttttttttttttggatacctagagtctctgaatagcctgtgcttaccatgtgattttagggcttgagatcgtgagacatatttttattttttttaaataacctctttatttttctgaaagaaacagatttaatcagcttctcaccatattctaaaaatgttcctgcttggcagttattaacattttgtcggttttcttgtactgttgaagcagacttactgaagatcaatttaacatactgtttaaagtttggggctagatttgaatcctaatcctggatttgaaacccaaccctgtgccttactaactttgtgaccttaagcaagttaacttctctgcacctcatattcctgtaaaataggaatgataccaccttttggggtatcttaagtatttaacagcttaatattacttggtgcaatgcctgatatgtgtaagtactcaataaatattaactatattattatcagtatttattgttatattaaaggtccaaaggtaaagttattttttgtttcaa

SEQ ID NO: 76119 - DNA, 1074 bp, Homo sapiens
ctttttatagccatagttttcaattatattagcaattttccttgtcctatttctgtctgcctcaggataccaaaaaaagggtctattttcgaaattttgttcataccattctgcacccagtattgcctggagtcatgaaaacccagcttgctgctattttttctctttggcaacttgctgctataccaacactcagcaattaaatctaattctgtttgggctaccatgcttaaatgttcttgttgagaatcatggcatgaactaatgcatggctctaaaaaggctactgttgtgtgtctgcactgaaggaaaaattccatagcaatctagcccctttggattttatactgaagctgtagattaatggtgaacttctgtgtaatgcttgacaaagaagggaaatccctagaaatgaaagtgtgaactgaggtaaaaatggtcttcagtcagatgctgctaaattaatcactagtaatcatcagttgtggaggttaggagtcccttcacagaatgcacttgggtggaagagtaggaaagagaaaaaaaggatgccagtgagacctgaaagagattatatgaggaaatgttgagtccatcttcatttgtgtgctgtctcaaacatttagctcagagtctgaaatacttttggtcaaattaggactgattttaattgtcttattatacaatttcacagcctcatcatccagcataaaatatatcaaaaatgacttaattccctcatatccatgacaattccaaactgtttttaataaactttataattgcctccaatattttaaaatttattaggaacactggtttcatgtttaaacaatcagcatcctttattagttcccttaagcattcatcttattttaatgtatacaatttttacttggtagaaaataaaccagatgttatttttccaagtggaaagaaatcttttttctttccttttacattacagtttcaccttgaaaatataagaagcaaatgaatggtcccaaaatttggcatttatttttctaagtcatgtttctgggctatgagttactgaattttgcttaatttatt

SEQ ID NO: 76120 - DNA, 1007 bp, Homo sapiens
ctaatcctaaccaaaccactgtgtcatacctctatactagaaatatataggaaatcaaaaggaaccaaactggaatgcaaatgaaacaaaaatcactaacactgaaccaacgcacctcctggcattattaataacattgttctgtcccaaatgaaacttcatatactttggacatggaggttaatgattgctaaaaagagaaaatctttataattaagttttctctggtttgatggttattccatgtgatgcatctttccataaattttgagaatgcctcaacacttatagggatagatttaacagtcaggagaatactagcaagtgtagtagctatcatggatcaatagcattatgaaatcatagctttaatgcagaaatttatttatggtaaaacttcaataaacaacaaaaattgtattctgtcttttaagagatgccttcattgacttttatgaaatagcagattttttcccaaaaggtacttttgtatcccactttgctggaaccctaagtctgaacacccgtgtgtctttttattaccaatctttggcctttctgaccaattacaacagtcttctttgatgtggaagaggttacaaatatttccaggctaggagggattggggagagtaatttcagtctggatttcggtagtttgtatcatagtcattatagccattattattgtcactttcatcattaccagaaaaacatgtatttgtcctttatacaatgttggatatgataacaaatgctctacatgcattagcttattttagtctcacaataattctatgaggtggaaattcaacaaaacatttgagcctttgcacacctttagctgtttcctcagtctggaaagttcttccccatgatcttcatctggctgtctcaaatcttaactaaaatgatacttattcagagaagtcttccttgcttactcttgtctaaaatagctataccttatcactacttatttttttattccattactgtattttatt

SEQ ID NO: 76121 - DNA, 1052 bp, Homo sapiens
tcaagagaaccaagttctattactactttactgtatgacctaaaaccagtaataattcctaccttctaacctttagaatgaagagtaattactctgtaaaataatcagttattcatcttaagattgggaaataatgaataatctgaaattcctcttagccaaaaatacttcatttagctttataatacattatataatttgggtagtaatttttcttcatatttatgatcaacattaacattttcagaacaagcaccaaaccaaaacgattgttggtaccaagaggagaccagcctgggatttgcaaagtttccagaggtcactgaacatggttcaacttggaattaaagctttatataggaaatacattaagaacatttaacattgatgcttaaattcatatttccttgagtcatggtgataaccagttctaaagaatagaaagtgtgttctacatattatagtattttctttaagaacaaataaggaactcaccaagttacctataaagaagcataaacaagctttgattttcagtggtaattataattaacttcaccagctatataacctgacacacttccgacttctttaagaatgggtcaatactgaaaaggaagtgtttttcacattaacctagaacttaggaaagctcggtggaatttaacaatgaaaatttatataacagtgggaaaacatttaagaatggtcacctggaaaagatttataaaattgttttgcttataaatattgtctatttgccggcattctcttatgttgtacatagatttaaaaaaaacagcagcccaggcgctgtggctcaagcctgtaatcacagcactttgggaggccaaggcaggcagatcatgaggtcaggagtttgagaccagcctgagtaacacagtgatacctcatctctactaaaaatacaaaaattagccaggtgtggtggcgcacacctgtagtcccagctactcgggaggctgaggcaggagagttgcttgaacctgagaggcggaggttgcagtgagccaagatcatgccactccact

SEQ ID NO: 76122 - DNA, 1341 bp, Homo sapiens
gagacagatctgtgttaccttctttatagtccataagaacagtagttgtttctcaagtgtatcatttcaagtgtatgccattacattgtgagttaagtaaaattttcattttgaaattgtataaaattaagtacatattataaagagaactagtttcatggtgcaagagaaaaagttatttgctacatgcataaataataaacaacatttttaaatttttcttttcttcagtggtgtataggttgattgattgattgatttatacacacacacatactcaagatcactaaaggaattcttataatcattgatattaaagtgattctccccaaatctggttcaaatagccaatgtaatataaatgggaaagcattgattatactgctgttggcaatttatgaaccttgataaacgctcagattcagggaattgaattgttttcatcatccaaatttctccaccaaagctgtttgaaatatgtagttctaaactgaggtgccacaaagcaacacttgggtttctttattcaattcatgttatgaatgattttgcttgttaattttttaagttacctagggaacgggagagggtattttgttgttgttttggtttggtttgggtttttttggtaaagccaactagttcttcaccaccatttccattatatacattagaaaatgtatataagaggcattatataaatctgttggaacattttatgagacaatttgaactactcatctgaactgctctgttcattgtaaatctcttgtttctatccatacactagctccactctagattggaagggcttaaagatgaactctggaggaatagaggctacgacttaagagtaactattactgatcaaaggagccactttccattcgcaaacattgctttgcgctatgggtttgggctccttctgtttctacatcttgttgaatgaagactttcttgacttccatttgacttctttgaactctgtttttgtcttttaacatttccccctttcttttccttctctctcccagatttttctctcactcttctagctttctcttgtgttctttgaatcactttttgaaatgtagtttctctctttattaagcttgtctattgtctgttagtgtgtgtttcttttctttaaggctgtagtggtatagttacacttatgttcattccatagtatagcaacttgcttatttattttgcagcaagttcattagtcattcttaccctcttggtatgaatttttaatgagaaatagcagaacattctgcatttacatattgtccccttctgtaattccatactttattttccattgtttagatttac

SEQ ID NO: 76123 - DNA, 1032 bp, Homo sapiens
tcaaacttgctgtttaataagaaaatgcctattacaaagcatattcaacagataaaacctatgtaactaaaaagtagaattttcttctcagaaactaaacatatttttaaaagaaacttttgtaagattatatccagtttgcaccataaagtgcagcctatcacaaaaaaaaactgtctgatctgagacctataaagctgaataagaagcagaagcagcaatatcattctgcctagttacactggttgtgaatgatttttttatatttgaatgagtaggtcaagacctcaatgaaaatgagttataaataagtttatatttcaatccttttttaagtgttcacccacaatttgaatagaaaattctgtctagcaataaataatctctaaggtttttcaaactttgaaaattttgcgattttgattgaccatgagaagaaatcacatattaatagtataagcaactttgtatatatttttcttaggtgcctatgacaatgtcattagtcttagaatgaaaaccctttggggtagtgcctttaagtcagttcattgaacatgtctggagcagccactgggttttgacacatgatgtaacattgctaacttgatttaatgttccaccagagcaggctgtattttggaggcaggagaaacagtttcttacctgctaatcttcatctggggacatttgaaattgggagttgtgatattataagtcattgccactttttaatcagtgttacagcatcatattcttagttaattatcttactgtttaggtcacagtgctgtcgatatcaccaaggtggctagaagacatcgcatgtctccttttcctctgacatctatggacaaagcctttatcacagtcctggagatgactccggtgcttgggacagaaatcatcaattaccgaggtactattatatttgaccattgccctttcttttcttcatttttttccaaataagattcatgtaacattaatgcacagttttcctgaaaaagaaagattattaaccattattac

SEQ ID NO: 76124 - DNA, 1122 bp, Homo sapiens
tatacttttttttttaaagaggttacttaatatactgtatatactgccattatcttgaagtactctaaaggccaaaacatcattgaaaggccaacatgttggtatgctgatatttttctgggatccacactgttaatttgtggtggacatttcctaataatggtgatattgcatttaactccaaaatatactttgaaaacagtataaagaacaacaaaactataaacaggttaaggcaattcagtgaatgtacaaatctctagtgtatacccttttcttgaatagtaataccttatatcaaactgagaacaatttaaaaaaaaaagaaattgatgcaaatctaggctttcttagtcttagagtgctatattgaaggggtccagagtgaatggtgtagaatgcagaggtggaatgtgggaggaaagaatttataattgttctaatggaaatctgtgctgggagtttagcaaagaaaacaaggtatttaatctacagcctattgatattctgtgaaggctaccctccttcattcttcttcatcctattcagccatttgctaaggaaagcaaatattgtcacacagaagcatctgggtaaagctctccagggaaacaagcagagtcatgggagaaactgtaccctaggtttaaagcagggagagaaatagctcaagaatgtcaataagggcgaggtgcagtggctcacgcctataatcccagcactttgggaggccaaggcgggcggatcacctgagatcaagagctggagaccagcctgaccaacgtggcgaacccccgtctgtactaaaaatacaaaaattagctaggcatggtggtgcatgcctataatcccagctacttgggaggctgaggcaggggaatcgcttgaatgtgggaggtgggggttgcagtgagccaacatcgtgccactgcactccagcctgggtgacagagcgagactctgtctcaaaaaaaaaaaaaaagtcagtaagcacagaaccttactcaactatgacagataagggtagagagtgacagctctatttgtatcattaaaaaaggtttgagtctggtttttaaattctatatgattctatttctcagctcttattcttatcacctg

SEQ ID NO: 76125 - DNA, 1081 bp, Homo sapiens
aacagatgaaacaggaaactaattagcagctgttgtccatctgtgtgtttatattaaatattttaaaatagaaatgtatttgcattctgaatactgtttctgaaattcataaatcctaaacttgggtaaatgctgtaaaattcaaaaccaagacagagcctttaccatttatcttcatgataaagcaaaaataattttatgccagaatcaggattatagtaatttgaggcagatgtaaattttaaaaagcaaaaaaagtcttaacttttttaagttgctttggaattgagcccccaaagcaatcaaattgaaatctgaaaagatacagtgttcaaaagatgtcataccctctgaatatattctttcttcacagaaactgatgagtacatacacttttgagaaagctgcattcattctctgacagatttattttgaaacatgctcctcctttctctttttctacctttctattaagtgcgtggttctttgacatgtgatcaacttagaactctacagagagtgctattaatattggtagccatcttccaagttgaagatgaatgtcatggctttaggaagaaaagataccgttattcatttcactcaagtcaaataggcaaatgtttcttatgttcaaaaatgaaagggagaagagtattatctacaagacaagtatcaaattgcatcagtcaggtcagattggtgtttccctctatgcttcagtttatatgtgaaaagaaaatagtcattgtgtttatgtaactttcagtatttccatagaatcacagtatcttattctgatgttagctagtccagactttcacccaagggggtgttaaggaaaatctgcaacaacttagctgttaggtttttgtttgaattcttttagtgagaaagatctctactgcctcatgaggtagcacattctattgttcgatggctgttaaagtaagtatgtttttccattacacagagccagtctttcttcctgtgtctttcatctgttagccctaattctgccctccaagcaatgccaaataagttggcttcctcttttacatgatatttgaatatacagttg

SEQ ID NO: 76126 - DNA, 1035 bp, Homo sapiens
aaagccctgtgaaatcgccagtagccactacttcagcatgtacaaggtcctttctccataataagacttaatgctcctgttaggcagagacccttttgattcccacttcatacagaatatagtgctgtactcatgttaatgcctattagtgaataaggcgatgtagttttaagttggcactatatctaaaatcttttccttgtgtgttaatttctttgtctttatttttttccagcccagatgacttactcaatgccttgaatgagggtatcagtcgtgctgatgtcatcatcacatcagggggtgtatccatgggggaaaaggtatgaaagatagggctcgtgaaaatgtatctgctgtaatgttcttgcatatggtcgattaactgtggtctggtaggcatctgatattcataacgaggctcccacaaagctgaaaatccatggggcttcagaaattactggtctctttaaaagggatacaatgtgggtaggtcagggagcttaccctcaggagcaacctggagaatcccacaacttacagaatggtttttgctattcctgtggaaacttctgacctgtttctcactctattttactacattaggacatcctttatgcatgatatttaccaccagggtaaaactctaagatccttccttctactcaaatttaaacatgactccccaggagccaaccaattcacccaccatatattccaaatctaccaagaatgcttagctccccttccccacaaggaagaaagggaggattaggcattccttttgctcctccttacaaaataatataataataataatgaaaatatggccaggcacagtggctcaagcctgtaattccaatactttgggaggctgaggtgggtaggttgcttgagcccaggagttcaagaccacctgggcgacgtggtgaaaccccatctctacaaaaaaaatccaaaaattagctgggcatggtggcacgcgcctgcagttccagctacttgggtgctgaagtgggaggatcgcttgagcct

SEQ ID NO: 76127 - DNA, 1046 bp, Homo sapiens
aaactgcctaaatttataacctgactctttggacagtgaactctgttggctcggagaacaaatgtcagaacttagcaacctgaacagaagaatgcctgccttccattcacaaactttagtgtcagagcctttcagaatagcactgcagatgctaaaaagtttggaagaaaaaaatctcacattacatccaggagtgaaagtgttgtagtgtgtgtaggtgttcttaaagcagacaaattgctggattagtgttccctcaaagtctcccagagtctttagccccaggtagagcaaattgccgcagagctctcctgagatcacaaaggctaggggctgagatctgcactgtagtacagctgaaagaaataatttgcaacttgtctgttttcattaccatcaaactgcctgtggtactctcaatattacaagagcaaaccatgaagtcaggtctatttaaatgttaaatttgttatttccagggtttgtgtcttgttataatttctcttagtttctgattaacctaattgtgggataatagctatttggcagaactaaaacgtttatcttttctagtactctggagaggtaacaaactcatagcatacataggcttggcaattgtggctcaattgtggtaaggacagaacacttctcaacctaaccttctttattagtgctaacaaagatgtcagttatgccagggatttgctcaccagtaaacaaagccaatatagttaagcatattggttttattttttttactctctgtataataagatacttacactaaacctttaatttactaggaaagaaattttagaaactgggcatcccacggtattccttaggagctgctaattgtcccttcctacctccttgagtgggaatgagatgatagaggaaccaggaagaaagagataaaacatacatgcagcaaattcctgccagcaaacaagttttaattccaaaaagaatttagggtacctccatagtagaaagaaaataataaaagacagaacatttgcttcagcccaggagctaagcct

SEQ ID NO: 76128 - DNA, 1056 bp, Homo sapiens
cacctataatcccagcattttgggaggccgtgggggtggttcgcttgagcccggaagttggagaccaacctgggcaacatggcaaaaccccgtctctacaaaaaatacaaaaattagtcaggtgtggtggcacatgcctgtagtcccagctacttgggaggctaaggcgagaggatcacttgaggcggaggtggcagtgagccatgatagcaccactgcactccagcctgggcagcagagtaagaccctgcctcaaaaaaaaaaattaattgattgttctatttgcagagggaaagaagccaacacgacttgcccttacctctagagaagagttatttgtgtaatatctatcatttaaaatattctcagtgcctgtgataacttttatactctttttttcaatctgttatttaccactcacttcaactttagcagttcatcaattcctaacattttatttcctcccttaaaatcataacactctgacttcagccattgtgtaaatgctgttatagtctgagctcaagaggagaactgaataataggttttgagttccaaggaaatggcttccagagcttaaaaaaaaattcacagtttagcaataggacatttatgatagccatgcataataacaaaatatttttttgcaatggaatccttttttaaatgagtaactttacagaaattacattacctacctgcaagatgcaaaagattgcttaaattggccctataatttcaatgggctttaaatgcagtggaaggaagaaggtgttatacattctctcctcattcttattatctgtaggtttgctaaaataaagtagttttgaagtttaaatgggcttcttttagttcaccagaattttatgcttgtctaaaggtaataagaacttaaaggtaattgctacttaatattagaacaaaagaaatataaaacacacaaatacaatctggctttgctatttccacgtaacagtgctttcagaatgcaattaagctctttcattttagagacaaagatactcagaaaagcatttggagtatcagcaacc

SEQ ID NO: 76129 - DNA, 1025 bp, Homo sapiens
taacatttcagcctgaattgagaaattctatggcattttgcataatgctataaaatcctggttttactctttcaagcaagaatttctaatgtttatttttaaagtttgaatgagaaggtggtaggatataatagcatggccacctgaaaaaggtactggaaagtttgatcatcccttctcctcttgaagacccgcatttctgtctgtttacattttgaaaaggtctacaagggcccaactgtatacgccatgatgcttatgctgctgtaataagagtatttctttctaggtaatcaaatgagcagccgtctgatgagcatgcgcagtgccaatggattgttgatgctacctccaaagacagaacagtacgtggagctccacaaaggcgaggtggtggatgtcatggtcattggacggctatgatggtcaccagcaggagaaagctttgatgcatgtccacatatcattgactgtatcctgtaatatgcaacggcacagctagttttcccgatttggataaaagttgatctgtatagtcaacatcttgaactatatttcaaatgaatttaaatatcttttaaagaaaaaaacacctaaaaataaatcttaacagaaaattctgttctgattatatcaaggcaaatttttcctttcttgcaaattgctttgtgtgttcaatgctaggtctgatagcgatagcttttagtagacagcggtaggtgcctgcagaacttgtgtttttctcatctttaaaatacaactacttatgctcttaaatcaaggctgtctgcttatttatactagcgtaggcaacacttggatttcccttcttagtatgcttcataactgctttacagagagcttttgcttgttctttctcatgtatctcgtgtttatgtgcacagtgccaaaagaagactgactgggtggaggctctgccttgcctcaagaaccatcccctgcagagcatccagggaggtttctcgccccaatagcctcacggcacagtactcttgggcagtaac

SEQ ID NO: 76130 - DNA, 1050 bp, Homo sapiens
cagggaaacatacagataacttctttcttaggcgtagaagacattctaaagaacatctatgactagggattacaatgaatcttaactcctagttctgaaggtaaattgtcagatggtgtcggggagaaaagctcccttctcataagaatgtccctacattatgaatgaaactgcatttctatgcatttgggagcaatgctaacttttctctaaacattcaacattaaaatattcagacaaagaaatggtgaaatgagttcaatgataggggtcatacctctaaagttcctagaaattccataacaaagtctaacactaaacactgagctattacctctaactcttaatacattcgagaagctgctcagctgatttcacagaggggtgacaagggaggacaacagacacttcaaaaggcaagaagaggatggcaggagctcttttgccatggctaccaggccgatctccgagcggaaccaggatgccactgtgtacgtggggggcctgaatgagaaggttagtgaaccgctactgtgggaactgtttctccaggctggaccagtagtcaacacccacatgccaaaggatagagtcactggccagcaccaaggctatgactttgtgaattcttgagtgaggatgatgctgactatgccattaagatcatgaacatgatcagactctatgggaagccaatacgggtgaacaaggcatcagctcacaacaaaaacctggatgtaggggccaacattttcaatgggaacctggaccctgagattgatgagaagttgctttatgatactttcagcgcctttggggtcatcttacaaacccccaagattatgtgggaccctgacacaggcaactccaaaggttatgcctttattaattttgcttcatttgatgcttcagttgcagcaattgaagccatgaatgggcagtacctctgtaaccaccctatcaccgtatcttatgccttcgagaaggactccaagggtgagcgccatggcttagcagctggacgacttctggcagctcagaacccgctct

SEQ ID NO: 76131 - DNA, 1055 bp, Homo sapiens
ttttgtatttttagtagagacggggtttcaccatgttggccaggctggcctcgaactcctgacctcaggtgatccacccgcctcggcctcctgaaatgctgggattacaggcgtgagccaccgccagaatataatttttttttttttttttttttgagacggagtctcgcgctgtcgcccaggctggagtgcagtggcgcaatctcggctcactgcaagctctgcctcccgggttcacgccatttttctgcctcagcctcccgagtagttgggactacaggtgcccgccaccacgcctgctaattttttgtattttttttttagtagagacgggttttcaccgtgttagccaggatgatctcaatctcctgacctcgtgatccgcccgcctcgccctcccaaagtgctgggattacaggcgtgagccaccgcgcccagcccttatgatttttgatcatatacttactgaatcataggatcgttgagttggaagtaatcttagtggttatatagtctaacctcttcattttccatgaaaaagaaagtgaggcttgcaggagttaagtaatccgtagtctgactgctagttaggggcagacttggaactacatgaatgctaaaatgctgttctccatattctaagtctccatattctaaattcagtgctcttctcaggatgtctcattgttagataaaccaataagttgccttttccaaatcacttaactggcaggattctttctgtcatggattttttccgttttcttttttaataactactaactgcaattcattcccctactgaagaattttcagttttttaatatttcaaacaatgtttaatgaatatctttgtgtatgtctccttgagcgcatgtgtggacgctttcctagaatgtatgtatacctacctataagtggaattgctgataataggttgatatgtgttttcaacattactagctacagccaaattaccctttttaatgctgtaatcatttacattcctgcaaacagtatgagtgacagtggcttcacattcttgcccacactgg

SEQ ID NO: 76132 - DNA, 2511 bp, Homo sapiens
aaaaaatacgaaaattagctggacttggtggtgtgtgcctgtggtcccagctactcaggaggctaaagtgagaggatttcttgagtgtgggaggttgaggctgcagtgaaccatgatggcaccattgcacttcagcctggtcaacagcaacagaacgagaacctgtctcaaaaaaaaagtagttgaattaaagtgaagaactttgagcctgtaaattgtaaataagctccttaagggtaggatagtgggttgtatctttttgtcttagtatgtcagcccttaatatggctgtgatacaataagaaatatatatttggtctttgtccctgacagctgacctagagcttctaaatcccttggaattttcttaagcatagagagtcttttgtttgaatgagggtgataagagcatcttttgtttcagtgagtcaactcttggcaggcccctataatagcttcaggttaggggctggttgccagaaagaccaaggcatggggccccaccttcaacctctgggaaggcaaagaggggctagagatagccagtcaccaatggccagtaatttaatcatgcccatctaatgaaactcctaaatgacagtgtttggagagattctgggttggcgaatatttcaaggtgctgggaggctggtttgactggagaaggcatggaagctccacaccacccgcctaaaccttgctctttgcatctcttccatttggctattcctgagttgtatcccttataataaaccagtaatagtaagtaaagtgcctttctgagttctggggccattcaagcaaattatttttatttatttattttttgtttttcttagaatcaaggtcttgctctgtcacccaggctggagtgcagtggcatgatcatagctcactgcagccttcaactcctgggctcaaataggcgtgcaccaccatacctagctaattttatttttattttttgtagagatgaggtcttgctgagctgcccaggctggtcttaaactcctggtctccagcagtcctccagccttggcctcccaaagtgctggtattacaggagtgagccaccgtgctcagcatttagcaaactattgaacctgaggagtggtcatgggaacccctgatgaatagctgggtggtgtgaagtacaggaggcccaaaacttgtggctggcatctgaagtctggggcagtcttttgggactgagccattagcttgtgggatctgattgtaactccaggtagatagtgtcagaatgaaattgaattgtaggacacccagtcggtgtccagagaattggtgtgaggaaaagacccacacatttgatgtcatcagtgttgagaatgaaaaaaagctcggaatggcacatagtagatgcttggtttcaatttgtacttttatcatttatttgtttaaactttagccttgctgtgagctaaatattagagactgttctgttctagtcatctcccataaacagataatttgacatttgaaacacaatttcatttattctaggttggccataaatgtgtttactgggaggaaatctaacactttcacatgttcttgattagctttttctacaaagacataaccataaatgtattaatttgctgatgactttttcttgtttttccataggcacatactgacaggctttacagtgcagttacagtactatcactgacttacagtacttttacagattatagagtcagatgtctgcagaaatactctcttgacttgtgtgtgacaatgaacaggttaacttatcaaagcctgattccttatctgcagaatggggatgcttaattcagtaggttttattttgaggattgagatggtacatcaagaatggtaggcatggtgttagtatatacatattaagcactctttcaatgttagataagagataggagttgtgtgacttggttgttatagtctgaggtaatgatgaataattataattgtatgttgaggtcagctttctaatctctgaaataatagtgaaagtcaaatgagagaaaacaatttgttgtcctaaacagtttacttatatagtgagattaagttctgttcagctttatcagcttctctatttgactcaagaattactctggggtgtttttcagtaggttgttttcactacacatttttaaatagactttaaaaatgacgtagttaggccaggcgcagcagcttatgcctgtaatcccagcactttgggagactgaggcaagaggactgcttgagcccaggagttccagacccgcctagacaacatagtgggaccctgtacctacaaaaaatacaaaaaaattagctgggtttgcattcctgtagtcccagctacttgggaggctcaggtgggaggattacctaagcccagaaagtcaaggctgtggtgagccatgtttgtgctgctgctcttcagtctgggcaacagtgagaccctgtctcaaaaagaaaaaaaaaaaaagacatcatttccagagttcagtt

SEQ ID NO: 76133 - DNA, 1021 bp, Homo sapiens
ttgttttgtttttttttttccattttgagtaatggatgtctttcatgtcttttttgggccttatattcatccccccccccttacaagttttcttaggatgctcttcttctacaagtaactcctgtgacattttctacagttctagtgtggcatttaccaaatagcactgtattggttttttatttgtttacttatctgatatctatactagattttaagtgtctttctttttttttttttttttttagattttaagtttcttaaggatacggactctgcctcagcagcctttttcttgacaatgactatccaagtttttggtaccaagtgggtactcgccttgttgaatgaaaaggtagttttagcttaaccctttttcctattagatttgcagtatagttatcttatagattgaccttttattcttatttcttgtttataagaatatcctcatatgctttcctcccctgtaagactgtcttgtcaaaatcagagcattactcataccctcagtcagcagtactaccataataaaagttaattgtactctaaacctgttgacatttgtattctcattagccttcctttcttatcagatttttcttttttccttttctactgatacagtcgtacttgtcctgaaatactctctactgtcactgcttcagtttaatttatagatagcaccagatatgagtccttattagttctgataactctgaaatggttatttggtatttcttcagtgacaagcaaactatccccccacctgcctttaatggccagtgtttttgatttgcataccaataagcgatctaggtagaggtaatcatctactaatttgctaacctttggaacataattttttctctagtaagctgtaaatcacttgaagttagaagttggaatctctggccgggcgcagtggctcacacctgtaatcccagcactttgggaggccaaggcgggcagatcacgaggtcaagagattgagaccatcctagccaacatggtgaaacct

SEQ ID NO: 76134 - DNA, 1037 bp, Homo sapiens
ccatgttggccaggctggtctggaactcctgacctcaagtgatccacatgctttggcctcccaaagtgctgggattacagacagttgtgagcctctgtgctcaaccaactgactttaataagtaattgtaatttaaagtttcaatatttgtttgttttcagaaaagtaatatctttgtgttttttcctcaaattataaaagcaacacatactttttttgtgtgaatattttgtaagatatccaaatagtatagaagtggaaagtagggaatatttggtctattatcctcatttttcagagatattagttgaaaacaatattgtatatattcttctgaatattttgttaataactttataaacatcttctatgtatatttgtaaaaatgggatggtagataaacactgttctgaagcttgcctttttcacttgcgtttgtttcatgtcagttcataaagagcttcatgctctagtagtcacaataaaaagtagaaagatcagactagtctgggtattatatattttaaaaaaacaagtgaaaagaaaccatgaaattaattttaacagtgtattttatttaatacaataaaggtatatcaaaattattaccatttcaacttgtagtaaatataaataaatgagatactttatatccttttttcttttttctttttgttttttgagatggagtctcgctctgttgcccaggctggagtgcagtggtgtgatcttggctcattgcaaccttagcctcccagattcaagtgattctcgtgcctcagcctcccaagtagctgggattacaggcatgtgccaccacacctgactaatttttgtattttagtagagacagggcagaaagaaaaaaatctaatagagtaagtaggaggacgaagtgttccagaaactattgacacacacacacacacacacacacacatgaaactgataggttacctgatttgtttgaatgtatacattaaaaaaatattgattctttttaccaaagaatgtgggtattgtgaacccaaaatatc

SEQ ID NO: 76135 - DNA, 1597 bp, Homo sapiens
taagtaggtaagagacaaatggttgcattctttcgagtccttgatcagtctttcactgaatacacggtttagtctggcccagtgaatctgcatttttacataaaccatagggcagaggaagcaatcagatatgcatttgtctcaggtgaacctcagaggggtgactgagttctgtctgtcctttatccacaaggaatttccttgtgggcaaatggtgagggaggtatgtagctttttatccttgtagctatcttatttaggaaaaaaccaggagacaggtttgtctgacatagttcccagcttgacttttccttggcttagtggttttggggtcctgatacttactttgctttcacaggatgtattagtgatttaaataaaaagtgagacacaacttgtggagagagggaatgtactatgagagacagctaaatattcatcttcataataaatgctcaacagataactaaaaaaaaaagaaatggcatgtatgtatacatagaacatacacacgtattttatatatgtatatatgtatgtatatataacatacagcctatttttatacatgtcactagaaatatgaaggtaagtttaagaagaaactgagagttaaaagtgttctctatgcagaactcaggtagaggaggtgagacactgaattgttcttcatagtaggtttaatggaactgtttgctttttttaaaaaatacacacataattttgtgttacacaactatacgtacaacacatatgcaacacaaaagttgtatattaggggccccttatatggagtgtgtaaaaacattgctgtcaccaaggtagtgaatatttgcatcatttaactacttcattcgattgtcattgaataatttgggaaaaatctctctcctcttgagttattaaatgtttggcaataggtaggtgtggtttttctcttcctgtcttatctagtatttaaatattcaaatttaatgcagcacgtattgagtttctaatatgagcatacatagatagcagtgtgcagggttctcagagccactaccagtagatgggaagtctatagaatatttgcagtctagttgagaagataaggtactcatccataaaaatttgataataggccaggcaccgtggctcactcctgtaattctagcactttgggatcccaaggcaggtggatcgcatgagctcaggagttcgagactagtctgggcaatgtggcgaaaccccgtctctaccacaaatacaaaaacttagccggctgtagtggtgggtgcctgtagtcccagctacttgggggattgaggcaggaggattgcaactgttgtccaggctggagggtcgtggtgtgatcacagcttactgcagccttgacctccccaggcttaggtgatcctcttgcctcagcttcccaagtagctgggactataggcacacgccaccacaactgcctatattttgtactttatgtagaaatgaggtttcactatcttgcccaggccggtcttgaactcctggactcaagtgatccacctgcctcggcctcccaaagtgctgggattacaggcatgagccactatgcccagccttcaga

SEQ ID NO: 76136 - DNA, 1097 bp, Homo sapiens
tatctgtaaagtgaaagtacttaatctacttaacaaaataatattacatacttattattttctacgttgtatggtgattagaagtgggctctgtaaaaacctgcttttatattgtaattcttacacttttttcccccccatctttccccttagatttccttcatggatactttttcatagcattattatgtgatgtgagaagtttttttttttgaagtaacatggattttatactacagaatcaagagaattggcttataggaaaaattgatttataaaaagtggtacaggttttcatagataaccatgacaacatcccatatgaatgggcatgttacagaggaatcagacagcgaagtaaaaaatgttgatcttgcatcaccagaggaacatcagaagcaccgagagatggctgttgactgccctggagatttgggcaccaggatgatgccaatacgtcgaagtgcacagttggagcgtattcggcaacaacaggaggacatgaggcgtaggagagaggaagaagggaaaaagcaagaacttgaccttaattcttccatgagacttaagaaactagcccaaattcctccaaagaccggaatagataaccctatgtttgatacagaggaaggaattgtcttagaaagtcctcattatgctgtgaaaatattaggtaagtaaaaatagaggtataacagaaaacattttgctttaatttatctgtgccttataatgtatatgagaaggaagagggtttaagagaatgtaagtaatgacagtttgaattccagaccaagatcctttgttttcgtggaaacgccgtataactattgtttactgttaccaacatagagctaaaagcatgtggcttaaatgttaagtcactataacatgtttttttagatattaaagagttctgcatgggccctaacatttaaagccttgaaatttaccttttatatcaaaccacaaactttatgcaaaatactaaaaaagaattttcagattttgaatttctgatttccttaaagttttgtaaaatagtaataaatttgtaactacagtttaaattctttgatttttttaaattaatgatt

SEQ ID NO: 76137 - DNA, 1008 bp, Homo sapiens
tattctgttgtgtaatttttaaaagagttttacttaaaacctatgaaatgaccatgattgacaataatatatgcagattttggtatttttctgaaaacttaaattgttactggttcaaagaaatgttctctgaaaatgcatgttgaattaatactgaaacagttaatttttggataccttttcttcttctactagaaatagaagacttgttttcttcacttaaacatatccaacatactttggtagattctcagagccaggaggatatttcactgcttttacaacttgttcaaaataaggatttccagaatgcatttaagatacacaatgccatcacagtacacatgaacaaggccagtcctccatttcctcttatctccaacgcacaagatcttgctcaagaggtatgtattctaaacatcttgttgatgtctacaaggtaattagtagtggcaggaaggcaggattattggaaaatactaatgtgactataagatttgtttgaattaattactgttaattacatgttaataatgtattgtgacagtttactacatgcattttatcctaaaaacaaaaaaagtttacttcagagtcagaacactgtttcatgaagagttaattttttatatataatcataaatttggatagtaacaaatatttgaattactagagagcaatttgttaatgtttttagtatagttttatgaattttaagcattatacattataaactgagatagtgaatactgatgagataattataactgataatcaggcattatataacgcctaagatttattatgtctaggtatttggaagttttcctcctataaaaactgtagacatttcaaattattaaatcttaatatactatgggagtttttattgttaacatgatgacttaaattcttgtttctgatgctaactggtgttcagtgtttgatctgttatgcaaacatcttttaaatttaagatttaaaaagggtataaataaactctcctg

SEQ ID NO: 76138 - DNA, 1036 bp, Homo sapiens
tggtgattgttccattacactcatataaattcatcttgttagactgtcagtctttttttttaattatataaaaaaatttataaaatagagacagggtctcactgtgttgcccaggctggtctcaaactcctgggcttaagcaatccgcttgcctcagcctctcaaagtgctgggattacaggtgtgagccactgcacccagcctgactataactctttaagttgtcatctctgattttaaatagtcacataaatgatttaaaaactataaaatagcaaggtaactgttaggacagtttttcttttcttatgtaattattattaatgaattttatggtatgttgggtgaaacgttcaagatggaagtattttgtctataggcgtaagtaccaaaatattatttagtgtttttttaataagaaatactgttgttttatccataataacaagattgaaaactctaataattctttttagtgattttatttcttacaagtatttttattattttaatttgtacttaaaaaatatgaccctgcatacaggtgctactgatacttcctataatctaggaagaataatctttatttttgtttcttaggtacaaactgttttgaagccagttcatcataaggaaggacaagaactaactgctttgctgaatactccacatattcaggtagaaaatggacagaatactatatatgtggtttttccagcattcttctatttttttaaatcaaagactccagtactggaagagatgtcaaacattctctagcctattttgatgtttacaaccccatctataacatagtagttattgttggattatatattttcagatttaaaatgaaccaaattatttttgaaacaactttttctttaaaaattaggcaaaaattcttcccccctttggttgtattttctgtaagtttaattatctagggtgtgtagacctttacattgatgttatcttccgaagtttagtaagcattttagactttcataacccattccagagtatgcccttagta

SEQ ID NO: 76139 - DNA, 1035 bp, Homo sapiens
atagctatttctgtttaaattaagtaaaatttaaaattcagttccttattcgcactagctgcatttcaagtgctgagaagcagtatgtagctaatggctaccattattaagatacagaaatagcacatttccatcattggagaaagttctattggatagtgctagtataatcagaaaatcatttctagacatcttttgagtgcaatttatgatcactttgtacacacgcacagactagatttatggtcctagttattcagcatctgttattacagtggaatctgtactatctactgattctgttgtaaaatctagagacatcttcacacacttattttcatccagccccattcattgctttggtagagcaaagtgctgctggtcatttaagtctgtggaggggttctgaaatagtccagtttagggaatatagatcataaaatcatggaatgattttcataaatgcaaatttaaaaaataacctgatctttctattacagtctgatatgcatggtactttgacttttgtcctgattcccagtcaacagatcaagccgcctcctgccaaggaaacagtagtaagtgatttttaaatgttcattatttatgtgtttgtggatgctgtttacttctgttactgtttactgttacagaaatgtcactgtttcctgtactcaaataaattcaatcatttttatttaaataaatatgaaatatcaatgttttaaattagtaaactctgcacctttttttttggaaggtggaagatggaatctccatctgttgcccagggtagagtgcagtggtgtgatcttggctcactgcaacctatgccttccaggttcaaatgattctcccacctcagcctcttgagtagctgggattccaggcgcatgccaccacacccagctgatttttgtatttttggtagagacagggttttgccatgttggccaggctgatcttgaacgcctggcttcatgtgatctgcctgcctcggcctcccaaagtgctgggattacaggtgtgagcctt

SEQ ID NO: 76140 - DNA, 1056 bp, Homo sapiens
ccagtcacaaaaggccatatattggttcatttatataaaatgtccagaataggtaaatccataggagagaaagcagattagtaattccttagatgtggagatgaggatttatgagggaatggtgattactaatcagtaccaagtttctttttgagggcataagtatgttttaaaattgtttgtggtgataattgtacaaatctgtgaataaactaaaaccatccaattgtgtacatgagtgaattgtatatgaattatatatcaataaagctatttaaaaatgaaactttaaagtgttgaattaacatggaagcttgatgtattgcatctgttattcttaactttaaagcatagcagtttgagaaagaacacagtttcatttttctctcaatatttcatcacaggtatgctttatagtttggctatcattccatgttttcccttaattttttacagaacatacggaagttgatattgtatctgcaacctactttatgtttacagtttttttgcaggaagagaaatgaggaaatatagtttgtctttgaatttaaacagcttgattctctgtgcattgtgctgttccctgtatctcttctgtgtataagccctgaacttcaaaagtagctctgcaaactgaggaaacataacagaggagggttggaatatactcctacttacttatctacaataatccatccctcctgagtaaatgacttttgtcttttgagaataaatgtcagaagttaagacattttttttttttgaggtgggatctggctctattatccaggctggagtgcagtgatgtgatcacgactcctgcagccttgactgcctgggctcaagcagtcctcctacctcagcctccctagtagctggaaacacagatgcatactaccacatccggctaatttttttgtacttttggtagagatggctttcactatgttgcccaggctagtctcgaactcctgagctcaagtggtccacccgcctcggcctcccgaagtgttgggattacagacgtgagccacaatgcccagccaagacatg

SEQ ID NO: 76141 - DNA, 1002 bp, Homo sapiens
tattaacccaacctgatttactgattttattacctccttagtttgtttttatgggcatttgagtttgctacttctgtttggttcacattagaagcaacccaaataataaagcaaaggctttccttcttatgtaatttataaggcttttctgtcaagaatttgaaatatttgggagcagcacacattaaactaataaagataaaacattatagatcattataatattccataaaagctaaatgaggtttgatcaactttaataaatttttttctaaaataaatatcctttaatgctaattgacagattatgtaactaaaaagatttaatgagttttaaattttatcctctatatttgtgattaatatctcttttattttttgaaacagactgaagttaactagtccagctctaagagctactgtactgtagaaaacgtggcaaatctgaaccttatggatatacacactgagtctataaattaaaatgctaccagtcttgattatacgtgttagaataaactcagatttttcagagaaaatcattttgagaggagaaggaattacatttgctgtttatgatgatgtcatcatcatgaatatttttaaataaataactacaattcataataactgctgtattccagggcagtaactatatgatgttgttctcacaaactccttgaggttacagagtaatagattcaagtttagatattaggccgggcgcggtgggtcatgcctgtaatcccagcactttgggaggccgaggcaggcggatcacgaggtcaggagatggagaccatcctggctaacatggtgaaactccatctctactaaaaaatacaaaaaattagccaggcgtgatggcgggtgcctgtagtcccagctattcgggaggctgaggcaggagaatggcgtgaacccgggaggcggagcttgcagtgagccgagatcgcgccactgcactccagcctgggcgacagagcgagactccgtctcaaa

SEQ ID NO: 76142 - DNA, 1929 bp, Homo sapiens
tattcagcgtatacattatgtctgattcttaaaacaaccttcttaagtagaatattaatatctgcattcttcaaaaatgacggatattactcttactagttcattccctggtaccgcatccttattcaaagtattgactgcaaattagctgtttaatgtaagaatcagtataattatattgtattagacattcaagcatgaattttttatttcaaatatgaaatgagataaaaattaatagaaggagtattatattgttgtctgattcattttcatgataccctagcaaggatgtaatgacaataaattgtgcttttgtctaattttgggtgaagatctatgagtatttatatctttaatacatggccataattttgtttgaagagcttaacttttttttcccaaagattatgacaacgaggagatcttaacctatgaggaaatgtcactttatcatcagccagcaaataggaagagacctatcatcttgattggtccacagaactgtggccagaatgaattgcgtcagaggctcatgaacaaagaaaaggaccgctttgcatctgcagttcctcgtaagtttgaatgcattcccattttcctgtgcttttcaatttaccagctcagaacctaactatatcatgtagggaaattttttattcatttcattaaaacactgttgtcagtgaaagaggaactttaaccaaagattttgacaatttttaaattaaaaatagtcattattaagaaatttaaatttgtccttcaagtatgtactgattattttctaaacaaatttcagtttgggccccttataatttcctgttccatagagaatcagttcctgctgctttaaagtgatacagaagatagaaacttaggcataatctgaaacagaagttataagattatatggtacctaatcttatggagataaactttaggagaagatgagtagtagtgttttaaatgcaggatgaagtaacttgaagtgtaagcataaaatgtattgagataaatataactattactaagatactacaaactcatttttgttcatttttcaatctacaaaaaataaaaacaatgttaaacatgtaggcacttagcattttctcagtttattattttataatctgtgttacaaaatagaaattctttctgactagcagaattatcccctgtcctcactctaagccatgcctgttatttctatctgattttgtttgcctagatacaacccggagtaggcgagaccaagaagtagccggtagagattaccactttgtttcgcggcaagcattcgaggcagacatagcagctggaaagttcattgagcatggtgaatttgagaagaatttgtatggaactagcatagattctgtacggcaagtgatcaactctggcaaaatatgtcttttaagtcttcgtacacaggtaaagctagaactttgttttagggtttgaacttagaaggaatgtcatatagagtaatctagtggaagctatattttggtccaagaacagcgcgacctaattaagttctcatacggtttttcccactgatttgctatctgaaatcacacaggttgctaaatctctttcagtttcctcagagggaaaacatatacatacttacatatacaggttgactatctcttattcaaaatgcttgagaccagagtgttttgaatttcagaatttctcagattttagaatatttgcatatatataatgagctatcttgaggatagacccaagtctgaaattaaattcatttatcttttatatacaccttatttacttagcctgaaggtaattttatttttcctggggatattgaataaactgtctgctcctgtattttgactatgacccgtcacatgaggccagggtaacgttttccacttgtgctgtcatgtcactgct

SEQ ID NO: 76143 - DNA, 1059 bp, Homo sapiens
ggctggggtgagaggatcacgtgggcccagagtctgcgcctgcagtgagccatgaacatgccactacactccagcctgggcaatagagtaagaccctatttcaaaacagcaacgaccaaaacaacaacaacaacaaaaaaaacaatcaaaagaaaggagtgtaaatatgcttttaatgactatctttaaggagatttaaaggcatagtcaatgaaatgaggcaatctgagtgagccctctcaaaagtagatctatttaataaatatggagcaaaaaaaacaaggaagaacatgttactctgatacagtaagtcacctgacagagttaccatcttacatatttaaataaaaagtcaatgctgtcttattaataacatgttatcagtcaattattaatgtttaatatgacatggactacctcaaccatatctagcatagatctaaaataatttaaaaaaatttttctgttccaaaccatgtgagaagaccaaagggagaaaaaaagcagaacataaagtttcagtgggataaaaagaagagaaaagcaagagcactcaaatttggctccctgaaaatgtggagtatctacagagaaaagtcagtaatcctgaagagttggctgataactttggtggcagtcacatctccctagaaatgtcacagacccatgtgaagacgctcaaaggttaccaaatgtagatgccccaactttggaaagctgccatagtccaacccagtggcaaccatggcaatttttgggcaagtaatattacagaaaaaataatcagtttgaaagctcaagctaatgtagcttttaagcaccaggacaaattagaccaggactgtttcatgtttaccttcaatggaatagtacaatagtgtgaaaactttacctttggattcttgccttctttggccaataatgcccgaagtctttcttgtgaagggggtgcaatgaagataatatatggtttcaaatctgaattccggagagtcttcaatgactgtaaagagacattttgatttttaaaataatttgcatcatttaattacttcctaa

SEQ ID NO: 76144 - DNA, 4144 bp, Homo sapiens
actctggtaggatacttttaactctctgcagcagatagtatagggcaagggctctttactagagccaaaagtaaatggcattttaggtccttgctccaaccagaaaggttcactccatattacagatgttactattaggaagaggttatagtgtctagaatgtttgaaaacaaatgtttgtagggaaacagtgtgtgttcttgaagcttgtagttttgttggtgagataagacaaaatatgtgaaaacctaaatagtggtataaaacaggatatattgagtcccagatggttcataatatgagtcgtgaagatgccaaagcaaaggtaaccattgtggccgtgacagggttggaaaggagctcctgaggttgggagagacagaaggaaagctatgaaggtcgctccttgttctttggccatctctgactcatcctatattatttggttaggaaaggaattatctcacagtttttatcttctgtttgcagcctgaagagttgagagaaatcattgagaagacaagagagatggagcagaacaatggccactactttgatacggcaattgtgaattccgatcttgataaagcctatcaggaattgcttaggttaattaacaaacttgatactgaacctcagtgggtaccatccacttggctgaggtgaaagaaacatccattctgtggcatgttggacttgatctggcaaaaactgccaataggaggactgcccgacactgcagcaagattgaggataagatggaaggcagcagtataagctgtagatctgttcttagatctcttgaattagtgagacgacagttcccttaggcagtttgtgcatggcatcctttattctctatacatggctttagcggttcttgcctcattttgggattctaaatggaagctttcaacagagcattccattttgtcctgttaaaaccttttgttttcacctaaaccctttctgcttagttgtatctctgtgaaaaacttgtatacacaagcgtccatgtctcacacaaatattgatgtgattattcttaagtgttaaatcattaacacttaaatgacttcattgggaatattgagcagagggactgtgcttctatgcactgggcaaggcagtatttgcttaggaaactaatttagtcatcagagatactttcctaaaaaggaaaaataaaaaacaaaatggtgccactttgggttgaagctactttgttaggcttgaattcatttatatgtcttttgattcttaaaaaaacaaaaaacattccattagaagcaccagtttttttgctcagactttgtggatcagactctacactcaacacactctaatctacttaaaggtatacaaaatatgctgatcttttttaaattatgatttcctgaatttttttcttaagtcgtctcaactgatttactcacttagcttcccttccctcatcagcatagtataatagaatgtatgttacatttttatgaatggcaggtgttcattataatctgtattgacttaaaaagtttcttcctcatgatgctaatagttttttgtatacatgggaggatagcacatttgacagtttttgcatttttatgtatgagcacagtatcctatgactgtgctacgtatatataggtaataaactggaattctgttgatgaatatagctgctgtactgtatattaatatttaatagatcaacaaatggtcattgaaaacacttgtttagcattagaataaaattatatatgtccttgggaaatattatgacagttgactttaagatcaaaaggaagggaagacctgaaagtcatttgaacattttaggaaaagaatattggagagaaaaaggtattaaatatatagaaataggtttttaacctaacaaggtctgcctcttatgacgagaatgcaacagcttggtaaatcataaaagaaacatttaagctaataggattttcgtactgtctctatagctgtagctttaaaattcaacgtatataattggcatggaaacttaatttgcagtcttttcaagcctttaggatagtgtgatgtgtaacaaacaacctcaaatgtgaatgccttgattttatttttatggtgactttagctacagcatttcctatacccagagctaaacactggaataatactgacatcatttaatttaacataagcaattatgtttaaggagtaatttgtgtcatgtacatatttgattgattttttttcttctacataattttatttgaacaaatgtagacagtttatatgtcgcctttttctgttcaaatttgcatggcctattaagttggctggagagtgttttatgtggaaatattttcaagataatgttccttaggaagaaaataacattcttgggttgagggaaggaatgccatacactactgtctcttcagatctgaaatactccagtttagagccaggaaatttcacaggtcacaccgatttttagcattaaaaactaaggaatatacttagcacttacttaatcttttcagttttccagtttacgtctcaggaatgaagtgtagtctatggttgacaatggagttttgtgatcctgcttattgtaactgacaactgttttcaactccaagagctaaactattggcagttcatgttaagttagagtgagggtgtaggtagtgtcagtgagtggctcttgtgcctgctgtagacattaggcctgcactagggccatgtgctgtcaagattcaggaacatggctttaacaagcagatcttgtatcaaggcagaggtgatgccatgccatacttttaggaagtctgagatgataaatatttcaaggtcagtgaagtctatcaatcattctccccttcctcatcagcaatggtagatagaaatgtcctaaacttttctaaatcctagtgatgaggatgtgctgatattcaacatagtccttaaagtgaaaactgagttgttgctgacctccacaaaagaatatggaaaaaagccttgctgtacacctagttgtacagccactctggccaattccatttcctgtccctctgtggttctgactggagaccccagtgtgggggaggtcttaccatttaatatagaaatgatatcaataactaatgctatgtacttggaaaatccaaataaggaagttttaggttggtgcataactttgtttctcaaattttcgttgtcagaacaaatggaaggagaatattatttagactaatccagatttgctttctatgaaaatctaatgtctggattatcttccttttctcatggcctaagaaataaggatcaataaggaatgatttgaatgtaattttgtgaatgtgtggaaaatataaagcagggatttagccttaataaaggtaaccttctgacatctgttgttaatccccctttgtactcttttcctgtatctgcactgttattttgagatgtcatactgtacactgtattgtaaaaataaaaagtaaaattatatttcaaattttaaaagccactaagcaatttctcttgctatttgctcggccactcaaggtttccacacatgtaaagaccaccctcctcttcaagtttttgccaaaagcaagaccattggatcctccagctacaacacaaaatactttttgatttgttctttacagagggatagtgccccctgttggcacaggtataggtaggtcctgtttccttaattattaaaaccaacaactaagtgtattaaagatggacaacgcaaggctgtgaacttgaaagttttctggagaaggaggtatgtaataatactcaggcaaatggaccttatgtgcagcctgggatctgaggacactgaggcagcatgtgaattattggcaaatatataacatattttgtttctccagtcttcatttctcctttttttctgctgtacatctcccaaaggtcataaatcatacaccaacaaacaaaaagtttcttacatatatacacctgtcaccacagttcagctttccattcctattcctgatctatattcttctcctatgtttcagataactgactccacacaacaaattatgtgtccattgttttcttgatttctttttaacaaatgctaaactataaagtcatctgc

SEQ ID NO: 76145 - DNA, 1041 bp, Homo sapiens
cacttaagaataatcacatcaatatttgtgtgagacatggacgcttgtgtatacaagtttttcacagagatacaactaagcagaaagggtttaggtgaaaacaaaaggttttaacaggacaaaatggaatgctctgttgaaagcttccatttagaatcccaaaatgaggcaagaaccgctaaagccatgtatagagaataaaggatgccatgcacaaactgcctaagggaactgtcgtctcactaattcaagagatctaagaacagatctacagcttatactgctgccttccatcttatcctcaatcttgctgcagtgtcgggcagtcctcctattggcagtttttgccagatcaagtccaacatgccacagaatggatgtttctttcacctcagccaagtggatggtacccactgaggttcagtatcaagtttgttaattaacctaagcaattcctgataggctttatcaagatcggaattcacaattgccgtatcaaagtagtggccattgttctgctccatctctcttgtcttctcaatgatttctctcaactcttcaggctgcaaacagaagataaaaactgtgagataattcctttcctaaccaaataatataggatgagtcagagatggccaaagaacaaggagcgaccttcatagctttccttctgtctctcccaacctcaggagctcctttccaaccctgtcacggccacaatggttacctttgctttggcatcttcacgactcatattatgaaccatctgggactcaatatatcctgttttataccactatttaggttttcacatattttgtcttatctcaccaacaaaactacaagcttcaagaacacacactgtttccctacaaacatttgttttcaaacattctagacactataacctcttcctaatagtaacatctgtaatatggagtgaacctttctggttggagcaaggacctaaaatgccatttacttttggctctagtaaagagcccttgccctatactatctgctgcagagagttaaaagtat

SEQ ID NO: 76146 - DNA, 1018 bp, Homo sapiens
cttgcttttggcaaaaacttgaagaggagggtggtctttacatgtgtggaaaccttgagtggccgagcaaatagcaagagaaattgcttagtggcttttaaaatttgaaatataattttactttttatttttacaatacagtgtacagtatgacatctcaaaataacagtgcagatacaggaaaagagtacaaagggggattaacaacagatgtcagaaggttacctttattaaggctaaatccctgctttatattttccacacattcacaaaattacattcaaatcattccttattgatccttatttcttaggccatgagaaaaggaagataatccagacattagattttcatagaaagcaaatctggattagtctaaataatattctccttccatttgttctgacaacgaaaatttgagaaacaaagttatgcaccaacctaaaacttccttatttggattttccaagtacatagcattagttattgatatcatttctatattaaatggtaagacctcccccacactggggtctccagtcagaaccacagagggacaggaaatggaattggccagagtggctgtacaactaggtgtacagcaaggcttttttccatattcttttgtggaggtcagcaacaactcagttttcactttaaggactatgttgaatatcagcacatcctcatcactaggatttagaaaagtttaggacatttctatctaccattgctgatgaggaaggggagaatgattgatagacttcactgaccttgaaatatttatcatctcagacttcctaaaagtatggcatggcatcacctctgccttgatacaagatctgcttgttaaagccatgttcctgaatcttgacagcacatggccctagtgcaggcctaatgtctacagcaggcacaagagccactcactgacactacctacaccctcactctaacttaacatgaactgccaatagtttagctcttggagttgaaaacagttgtcagttacaataag

SEQ ID NO: 76147 - DNA, 1054 bp, Homo sapiens
agtgagccaagattgcgtgcgccactgcactccaccctgggcgacagagcaagactccatctcaaaaaaaaaaaaaaaaaaaggcttctgtctcaggttaaatcagttattagcttaaaattatgtatttttagcttaaaattatgttttttaaaaaggattataaataaattactgaaaatgaaattaataaaagtaccaggtttttttctaggtatgtgtttattatccttgttacaaaactcaaagaaatcaaatctacttaatattgaaacagtgtttaaaaaatccacccccacctgtattttacaggttaaagaaaatacaagagaagaaaaagattctaaaggaaaaatctgagaaggacttggagcaaaggagagcagctggagaggtgttggagcctgctaatcttctggctgaagagaaggacgaggatcttctatttgaataatctttcctgttctggttctttgagaaaccctaacactggcttcattttaattcacagtgtgtaggtttgatttgtgtggctatttattttttggcctaagaatttcactggttgtaaaatttacctagatgtctatttatgggattacttttgcagaatcataatttagcaaccatttatcatggatgaaagagatctgtaaaacctgcccaggaacttacagaatttactttgcagaagcgttatcatactccatttacatctgtgttacacgtgatctgcttaccaagcatattaggaaatacctcttaggaagcattagcggtctcaggccaattactgtggagcagctttcattcctacccacttgcaaaccttggcgctgttgtctgagattgctgcagccattcttgttaccatggtacttctcaaactttgtgaaaacctgcacttttccttgcatgacaggttcctgtcttgtctgtcatgggagccattctgccaatttaaatgcgactgtggtataaacagtaaaatgatttaaaagtaagtcattccgtttttattaatttactgttaagtcatgttctcatgctcaga

SEQ ID NO: 76148 - DNA, 1041 bp, Homo sapiens
gaaaccccgtctccaccaaaaaaatacgaaaaccagtcaggcgtggcggcacgcgcctgcaatcgcaggcactcggcaggctgaggcaggagaatcaggcagggaggttgcagtgagctgagatggcagcagtacagtccagcttcggctcggcatcagagggagaccgtggggagagggagagggggagggggagaggaagagcttctttgtgtttttattttccaagttctctgcattaaatgcacattaattttacaattaggaaaaaataactgttatacaaatgagcactgataatttgaaaaaaggggtttgaagttctcacacatattatttttttttttattctagtcatcattccccggattgaacgtactcttgcttatatcatcacagagctggatgagagagagcgagaagagttctataggtttgttgaaattggcagttattgatcatcttttgttttccatattccaaaggctgtatttgctgaatgacttgttggtttatgttctttagaattagcacagcttatgttttattctgataaataagcagcaagaaatattattaccagaagttgtggaaacaaatctgtcaaattttacatgtacctataacatggcatttccaaaaacttaggcctttcagagaaactgtttaggtttgattttttttttaaatatatgttttaagatagtcaaatgcagtagtgaaaagtggggaaagagtagaacaaggagtttgatctgtaactgattgtgcgtaatagagagaactcattacctttggacaagccaagactgaattattcttttttttttttttttttttgtgagacagagtcttgctctgtcacccaggctggagtgcaatggttcgatcttggctcatgtgtcaccatgcctggataatttttttgtacttttagtagagatggtgtttcaccatgttggccaggctggtctcaaaactcctgacctcaagcaatccacctgccttggcctgccaaagtgctgggattacacgcatgag

SEQ ID NO: 76149 - DNA, 1026 bp, Homo sapiens
tgatgcaactttttgagtacattaaatatttaactttaaatcagtataagccattctccttgatttctaaaaaatttcccatttgatgcacttattttccatctcttttatttcactatttaaaaaatatgactgcttagtgttgatggtactttttgctcaataaacttagtttttattaaagaaacactcaattttaggtaagaaagcaaaatttgaagtaaagaaattcctttgcttgggaatttctatattaatgctagtgagaaatatattaactattatattaactatgtataatatgatatattaactatattgttagaaatatattaactgttatattaactatatattaactatattaatgttagtgagaaagttacctcattttttaaaaaacctttttgactgcttgctagtgccaggccttgtacatgaaagtggaagcaaagaaaaaaaaaaaaaaaaggataattcgtagttcttaccctcagagttcacattctagaagctgaacaggtaaactatgtaaagtcgagcctaatgacgtaaactcaatcgagcattctctctgctcgattttttaacagttgattgctactatatttaaaataacatctgtgcttcaatgttatatattcatagaattcagcacattcagtgttgtatttgttatggtccaataggttatctatgcatagaaaagacactagaagggtatacaccaccatgtttacagtagttactcttttggatggttggattatactctattttactttttttctttgtgtttttttttattttattttatttatttatttatttatttatttatttattttattgatcattcttgggtgtttctcacagagggggatttggcaggtcataggacaatagtggagggaaggtcagcagataaacaagtgaacaaaggtctctggttttcctaggcagaggaccctgcagacttccgcagtgtttgtgtccgtgggtacttgagattagggagtggtgatg

SEQ ID NO: 76150 - DNA, 1011 bp, Homo sapiens
aataaataaacaaataatattctttcttttggcacttgtatttccttgcttcatgtgatatttaattaaatcatatagaatattaagtacatttcatacgaagaagtagagcattctagagagagtcacctgttcacagagtgtcatcgtactctgggcatcaggcagtatgattttcaaagggaataaggggcatcaagctagtgaagtgaaggttggttaaaagcttcctttgtagttatatttagaatagtattcttgtgggaaactgtatttagtagcatgctcctatagtgtttggggagtgagataggcacttcatgtttacattcaatgaagattagtgaattcatctttccatatttgttattattctgaattatctccttttggggaattttatagggaagatattttactctaattaaaaatgttgtctgactggtcctttcaggttatgaactgactggtttagccagaggtggggaacagttggctaaattaaagaggaattatgccaaagcagtggaactactggtggaactagcttctctgcaggtaagtagcaaaagacctggagaactcctgtagtttgatttgtaacagtcaagtggaggagagtcaggtcttgagtcagcatatactgtgctttgtacttttaactgttcccatgatcctatgtaaagcaaacataatattttgatttctgaagtgatggcttttgtaccattgtccctactttttaaaatttatgtattttttatttttttgagatggagttttactcttgttgcccaggctggagtgcaatggcgcgacctcggctcactgcaacctctgcctcctgggttcaagtgattcttctgcctcagcctcccaagtagctgattacagacatgtgccaccatgcctggctaacttttgtattttttgtagagacagggttttgccatgtttgtcaggctggtctcgaactcctgacttcaggtgatccacccgcctcggcctccc

SEQ ID NO: 76151 - DNA, 1043 bp, Homo sapiens
aacattgttgcattggagattgtttccaacacatgaagattagggacatattcaaaccatagcatcagttaaacctgtcagctacaaattctctatatagtctcactttcatcacatcaaaggataaaggataattttaacactggtggggagggttttttttgtcttttaaacaatgagaatagatgtcttaactttgtttatgtttatatagggcacagaccatcatgaaggctcgtttaaagggagcacagacaggtcgaaacctcctgaagaaaaaatctgatgccttaactcttcgatttcgacagatcctaaagaagataatagaggtagaatgaacttttcttagaatagtatttattttagaaaaatccagcatggcccttggcatttttttttttgttgttgttattttaattaatttttttctttcaaaagtaaaaataccattataagtttaacaagtgtcaaatatcaaatagttcatttaataaaatccaaactctttaatcttgcctgcaaagctccacttgatctgattggccccccgcctgcctctcttaccttatttagagcattcttcctaaggtcctccaggtacttttcattagctctttctcctgcctgaaatactctttccccagaacttataactggctcctttagctgttctagtctcttaagagaggctgttcctgatcacccaatctaaagtgaacaccatgtttgcttctctcacaattccttattttaattttattgtagcatgtactaccgcatggtatgacattttatttctagtctttttcttttttttttttttttgaggcaaggtcttactctgcagcctcaaactgggctccagtgatcctcccacctcagcctctcgagtagctgtgactacaggtgcatgctaccattctcagctcattttttttatttttagtagagacgaggtctcactatgttgcccaggctagtctttttgactcccgggctcaaacagtctttctatcttggcctccgaaagtgctgagttt

SEQ ID NO: 76152 - DNA, 1032 bp, Homo sapiens
cagttctggagctattgcagcctcggttgcccggccggggacccgagccgaaaagttatcgtcagaatgtcgggcaaagaccgaattgaaatctttccctcgcgaatgtaagtaaaggaatgggataagccgctttcacaggtttaggaacccggagcgcggtcccttcagaccctgggccacagtgagggtccttgtttcctgggaggatcctgagcttttcccaggttcttttcttgagtctagggcgaggcttcctgacggcctcttcgcgcattcctcctgagtgaatcaggctggacgaagcgatcccagccggtaggaaaaggcgcccggccggcgggcttttgtggaggtctgctgtctttattcattaatggattcatccattccacatacccttattgagccgggcactggatttatataactgaaccgtcgccacctctgccctacagagctcacagtttacgtagccagacattcgtctggaaaggccaaggaggttttaataaatgctctgagaagggaagtttactgaggatatagaagaggtccctaagccaaagtggggatggaatcgaatcgccctagcatagccctcggattcgatcttggatccccttactcattttccaagatcccgccaaatgtcacctgctgtgagaggatatccctgtgtttctgaggcactgcttttgctctctcaccgctgcaccttgttcagacctgtgttaataccggtcatcacgctgtaaagtagatatttgtttatgtgtctttctctcccactagactgtgggctctctccaggatgaaagagtgtcttaatccatagaaggtccacaaaaaaatatttcttgaaagaactcatgcttgggaatacgctcagttgtgggctgcctttcttttggggcctgaattctttgtcaggaaaatggcatatcactgtaggtgtttggctagtttgtaaggaaaattttgacgttttctcaaatgtgcctaacaacttgctccctttctcctcctcat

SEQ ID NO: 76153 - DNA, 5516 bp, Homo sapiens
gacgaagggggaggacagaacagaggcgttgcccggatgtcgaggcgcgcgcaccgcggaaccacccctcaattccggttcgcctcccaacccctccccatccagcttccctgcggctgcgcaatacgcggcacgcgccaggccaaagactaggagcgaagcgtgcacgccttgtctttctccacctttcgtctttggtcacagcgccatctcatggttagctgaaactttgaaagaggattcattcttcagaggcaaggaatcggagtcctatgtctttctcgcgccttgaaggttacttagctaaagctaagatagcgagaaacagtacttttcaggtccttccatgatctacattcgtccttgttctcggaggacccagactctatggttaatgatgaagaggggcctctattcgttcagcgcttgcgcatgcgaggaggttccgcatgcgcggtggagtgagcgaagcgcacgctgaggaggatcggcggccggtgagggggaagcaagtctggtctctgtgattgaagaagtcggctctgggctccagtgcgggaatcacacacatacctcaggtgactaatcccaagctcggtttctccaggaactcactttggtttgtgtccagtgacatgggtgttcgagagcgggtaggccccgggctaatacctccctttcccgtccctgcgcgggaagtggctggacagcaccgccaccacccgcgctgtcgtgggcctcctcgccggctccgtgtaggtcatcctgtgttccagaggcatcgttgttcgagcagaggaatctcgtgaaggaaagtgggccgagtggattgtacagcctctacaatatgccgaaagtgagaatgccatgacgatggggcggtctcaggagaacgctgtgacaccgtaactcttaaccccggctcaggacgctgagcactttgctttttccaggcttgagaattccatcttttcttccgccccaacagctctaccaaaaatttcccctgcgtctcagtggaaaccaaactggcctcttacctgagaaacctgtgggacgggcaccgtgttggaaagagcggggtccgagtagtttttcatctgataattgaatgagtcaccccttgaaccaaaactaaatgagacttgagtttattactgttactatcagtttgtcgtattttggcgacaatgagaatagaactgtgttaagcatatgttaggttaactatgttagttaagcataactaaaacctaagataaggatatattttcgggttaaatacacagtcatgctgaggtctctttatcctcaaaacttaggctttttaaatttttattaagcaaaaaacatggtttcttcgagaaaaagtatagcagagaagtctttatttcccctcaattgagttgttattcaaggaacaatctctgtcaatagtttgggggtgacttgtacagaactttgctacctattcttagttcatctggtgccaaaagatgtagttgtctcatgcacagtaatgtttgtagagattcggtgataactttctttttcaactataatgatgaaataaaagctttacttatgtagcactcctataccaagaactagcattcagagagcattcctaatacgtgttagatccaaattagaattatcacgagagttgtccccatcacataatatattttggaaaggaatgtgaacttctatatccattatagcagtttgaccatgcactgttttgagaaagaagtcctacctaccatttgtcatgcaaaataactgactatgcagggtatttgaaattagcctggagtttggttgatatattttgaaaggtggctgatactttttacatcagaacacataagagtattatagcatgttgtgatattgaggttctgtgggttaaagacattctggatttgatgtcggattacttgagtttagctcctacgctagtacttattaagcatttgttcttaaggaagtattataatttagtatttctgttccacctttcctgttcattgcttcactgtgccctttcatagtactttgtattgtaattatttgcttgctagtttgtttcccactctatacttaattacttaggtaagagtcttttttttttttcttttttcttttttctttttttttttgagacagagtctctgttgcccaggctggagtgtagtggcacgatctcagctcactgtagcctctgcccctgggttcaagggattctcctgcctcagccactatagtagtgggattacaggtgcctgccaccacacccagctaattttggtatttttagtagaaatggggtttcaccatgttgaccaggctggcctcgaactcctggtttcaagtgatccacccgcctcggcctcccaaagtgctgggattacaggtgtgagccactgcgcctggcctggtaagagtctttcttgttgtatcattagtgcttagtacatagtagctactgaaaaaaaaattaacaaattattatattacaaaatggaaataccttctttttctttcaatattttatgtttgactagcacataatggttttcaaaatgtttttacgtatacatgtgataccctcagtaaacctgtgatgtacatggcacagatgagaaactacagttcaaaggatgttatctttcccaagcagccacttctagtaagtagcagagcaaggactggaacacaaggctagagttgttccccgagtttactatgttaattgcctgatttgacacttcttgaggaccaaataaaataagaatgctgtgaaaaagataaagaggtgaagtcacctagtgtgacttcgatattgcggaatgatttttttaagttaaaaaaaaaatttaagttattagcatttcattaggcaatatgttcaaaaattgtcaaccaatatgcaggtttttgtggtatggattctttttgtacttaactactatctatctttactatgaataacataccatcaacagtattcctttacttaccctttatgttgcaaagagacttgtgcctcctgaagaaatagtattcatagtcatatcccttcaggattctcttacatgattgcccatgttttttaaccatcaaattaagccttgcttcccctaaaagcatcacctttactgtttggagaagcttggtaagtaaatgtggttttcactggtcaaatgtcttgcaactgttccatacatttctgtaacatagtttatttttatgcccaatttgaaactttttagctctcaaatttgagagctttacatacacatattcaacaacagtttccccacccccaccctcgaaaagccctgtttaaaaacgaaacaaacagtcagctgtttcttggtgggtaaggccattgaatgtctacttctctttatttgctaaatccctattttgtagggattttgtattccctacaaagaaatacatctctgctactgtcattaatatgctgctctttgttgtcaaacagatgagtactaatagtttgcacttattggtgttatgtactctggcactgaatatatattaatgttgctttttaagtaaaatgtttctaattataatatatttatgaatagttttgagagaatatagtcttactgataagaggacagactctggatccagacttcatggattcaaatcctgactcatcacctgttagcagtatgtgaaagaacaagtaacttaacctgtgcttcagttttttaatctataaaatggggagaactagggagaaagttgtaccacaaggagataggcaatggccagatcatataggattctgtaggtagtggaaagatacataagtcagtgggaagccactgagaagatataggcaggtgccaattaataagttattatatgaattttcacaaggttttcttaggcctttaagttctgttactacctacgttttgagcagtgacaacagtgaaggttaacagaaaaacatgaaaatcatcagccatgattagtttgagagcttccttttttaaatatgcttctacccaggctatgatttcaggcttgtggatcataaaaggagtagtgctgaaagtaggttgggtggatcaaagggaataattgtaaatatctttaatgcttggaggttaagagaaacttgaactttgtagtaatggagattaaagctattctcaagattaggtatacctattcaataaaagaaaggaatatttgggagtattggggataagagaagctagacattgtgaattcaaggaaaaagaattatgagaggaggatgcattttagtttattttgtgattaaaatttttttagtttttgttgttttgacatgtgacactgtaattttggctataataaatgacagaatgtatcatttggtatattggttagggtttaggtagaaaattttttcctttatatagtgagtggtagcgtatacaatgtttgctcacttcggcaaagagtagctttagttttctgattagttataatagtgatgcttcccatcatttgatatgccttaaagtagtattttactcttgaggtattcctttaatccttaggtcttggagtactttatagatggtcattattttttatgattcctctgaaactaaaggcagagaatcacccaagcattacaaaaatgttgagcaaaataaaaattaaagcttggttcctgaacattatctgttttctggtaccacttaagaagtttcaaaggatgagaagactaagactaataactatttttttcttcatcttttctttcagtggcaggatgtggaaattgattttttttttattttcaccttaactgaatacttacttaattcttttgtttaaattgcagaatgccgggtctaagttgtagattttatcaacacaaatttcctgaggtggaagatgtagtgatggtgaatgtcagatccattgctgaaatgggggcttatgtcagcttgctggaatacaacaacattgaaggcatgattcttcttagtgaattatccagaaggcgtatccgttctatcaacaaactcatccgaattggcaggaatgagtgtgtggttgtcattagggtggacaaagaaaaaggtaagtgagaaaaatatctgtaatataaatttcagatttaaaatggtttatttaaaaatacattttttgtaaattgcaagctgcagcttaaaaaaaaaagctccttttatacttaaaccttttacatacaaagttgttagaaaaggatgccaattagctatctaagcaagatctcttaatagtagtttaattagtacatcctaggattttatggatcagataacttgaattttatttctagtgtttatcaggatcttgataattgactcatggtaaccaaacttagagacaggtaagtcagagtactagttcatttacattggtaggcctgaatatgttggatgcctttttcttgatttaaagctaaaatagtaatgagatcactg

SEQ ID NO: 76154 - DNA, 1056 bp, Homo sapiens
tttgggaaagtttggcagataaaattaacatgtacttaatatataacccagctgtgccatttctaggaaaatttatgttcacagagaaacttgtgtccagtttttagtggcttcaggggtgatggaacttgattttggtggtggttaaatgactgttcttttttttaaacacaaagaacttaacactaaaagtggtgaattttactatatgtaagtcatacaatttttaatgaaaaagaatgctcagaatctgaaataaaatcagtgtatatgaacagaatataggaggaaaactacaaccaatttaatagatgtgaaagggcatttgacaaaatttgtcacccattcataataagtcagcaaacaagaactaaaagggaatttcctaatctgataaagagtgtctagaaaaacaccacagacatgctgtcctccagtattgagaacaagacattcactctcaccactgttactcagcattgtactggaagtcattgccaggcacaggtttgtaggtttcagccatttttggctatttgacgttgacaagttacttaacctttcatgggttttagtttcttcaggttaaaaagactggggggcgctgtgggaaagagagtgataatctaccatgcaggattgttgtgagggttcaagaagatgtttaagcacctaacatagttacttgtatatggtagtcatacagtagattagatagttttaatttgttcagtgtgtgtgtgtgtgtgtgtgtgtgtgtgtgtcttctgtgacgatagcctctttccttaaactaaatgaacatcttagtgaattttcctattctggagaaggaaaaggaagaaataggggaaagataggcatttgactacctttcatttggataattgaaaattattagttctctccagtaaggtaatggaatatatataattacctgataataaaaatttatttctgaaaacaattcagaatctctcatcttgtacagattgagtatcccttatccccaaatccaaaatgctccaaaatctgaaacttttgagcaccaacatg

SEQ ID NO: 76155 - DNA, 1414 bp, Homo sapiens
aaaaaaattttttttatcgtgattctctcctcagggagtaataataacaacttgtatttgtatagccgttttccatttatagtgtgtggtttctatatatttgatctatgcgagcactctgtagtaaggagagatgctagtttcttctttttccagaggaggaaacaagttcagagatactgtgttactgtcaagacttgatccaggtcttaggaccctaaattgtatactatctctactttttatacccacttaaagtgagtatttccctatggagatcttttattgttaaggaattattgtagccaaattatgttatttactaaaatgtaaaaacattttttataaatctcttatctttgaattgttgagcttttcattttatttctaggtttatagcattcttcgtcatgttgctgaggtgttagaatacaccaaggatgagcagctggaaagcctattccagaggactgcctgggtctttgatgacaagtacaagagacctggatatggtgcctatgatgcatttaagcatgcagtctcgtaagaataccttcttgactctccttctaccttgatatcacaactcttggcctgatatttaacagcatagcatccatgtataaaatacttgccaaatttagattaaaatattttgtattggccagtaaatgggccaatcctatatggtcaagtctgtgtagttttatgtatcatagttatgtagattcataaaccatatggtttatctcacacattttcctttcctagttattgtcctaagtggctatgggactaaagagcatgtctcaccaaaaactataacctcttgttttctctacctcttttgactctcctttgactttcagcccacaccactttagccagtcttccatgtagccttagcctgggccttactatcaccgggatttgctctgccactaaaatctttaattcacactttctgttcttttgcccctgcctcctattcatctagctcccagttggtcctattatttgtcatcttaattctgtatgttaggatctgattccaaaccttttttctccctgtcttttcgccatttcctgccttttctctcttatccaacataggcacaccatgatacatcattttaacgactttgttgccattattgtgagcttttgccttgtttttccttccatccatccagccttggatcaatgttcctgccttctctgtacttgtagactgctgggtgctactaggaaaaatcagtcttgcaggttggtccactgcatattcatggtctccagcctcagctgttccacattctctctgctcctggtcagttcttcagtagtggctattttagagcttttccacgttcttcctcagaaaaccactctatccctgctccctgcctcttggctg

SEQ ID NO: 76156 - DNA, 2317 bp, Homo sapiens
tcaatatcatttgtttttattgttttactacatatgtgtctattatcattttttatttaaaatgtaacctattgtatctttttgtagcttgcatttttacatataagcctattattaagcaggattcccccacaatgatagatgtatacttgatccatattaatctctatatagtatttcattgtgagaatatgctttatctgttcctctattaagagttgtttaggtaattttcccttctgtgccatttgtcaaacagggctgtgatgaatagtgtatgtgtctctatatgtagttgtttgagagtttctaatatatatgcctaggagtggaattgttgggtcataggattgattatatatctttaaactgacttggtttcaccaaatccttgccacaatttggtatatatctgattttttctcctttttctagtctaatgaattcacagtagtatcttttgatttgcatactcctgattgttggagaggtcaacagtttttcatgtttcttaaccatttgtatttcttctgtgaaacatctgttcacctcatttgcccattttctgtttatcatcttgtttcttatacatttatgttggttgtcttctcgttactttatgttagctgagtaaaagttccctccacccaaattctcttgccttttattcccaataagaccccttgcttattaagcctgatgcttgctcatgctattccttttttacatgacataactttctttttttctttttcttttttttttttttttttgagacggagtctcgctctgtcgcccaggctggagtgcagtggcgggatctcggctcactgcaagctccgcctcccgggttcacaccattctcctgcctcagcctcccaaatagctgggactacaggcgcccgccactacgcccggctaattttttgtatttttagtagagacgaggtttcaccgttttagccgggatggtctcgatctcctgacctcgtgatccgcccgcctcggcctcccaaagtgtctttttttctttttaatagagatggaggtcttgctatgttgcctagactggtctatgaactcctggtctccagtgatccccctgcctcagcctcccaaagtgctgggattacaggcatgagtcactggtgcccagccttatgtatcataacttttttacaatagttctacctttactttttacagtgctactcctcttttagtctttatttcatattttcatttgctcactcattcaacaaacatgccagttaataagaccctggtccctgtcctgtggcacttaggagggtcagatgaaatgctactttttgcatgaagcccttcctgacctcattaactggaagtaatacctttctgtcctgatgcccacagatgtactgttacatttaaaagtttttccatgttttttttttctattcaagatagattataaactccttgaggcagggacagctaattgcatggaagtaatcaattatagtagaatatcagatgtgttaggcattaaattgcttgttttagtcagatcactaaaattttgatttcactaataatcagttggggtgtaagtgcaaagctaagatttgaattctaattgtgacactaaagccttaactattatatgcattaactattatatgcttaactattatatgcattgttccatagtgtttggtttcacatttatcagtaatataaccttgaccttttgttatttatttatgtttttgaccagagacccatctattttggatagtttagatttgaatgaagatgaacgggaagtactcattaataatattaataggcgcttgaccccacaggctgtcaaaattcgagcaggtaaatgattttttaaatgatttttacagtattttgcatgcatcaaaaaagctattaaataatgagacttaccaaagaatatgttgctacatcaacatctataaatttttctaaatggttgttttttataacaaaagcttaagaaattattttggcttctgaatcataaaatttatatattgacacaagtagaaacagtcttgtgagttcagctaacctaaaggtagccctttttttaaaaagaggggtttgattgttttgttttagtgcatactttaaaatattccaaatttttacaaagatgagacataccatgcggaattttctccaactagccttttccacccagtgtatcataggtacccttccattgcagaacataggaatctttctcattcttttttatgctgggtaatgtttcatagaacagataaaccttaacataaacccg

SEQ ID NO: 76157 - DNA, 1040 bp, Homo sapiens
cctccctgctgaaatgctcacctaaaccaaataggatctttgatctttgtttctttttttttttttaatcacatttcataacaaaagtgggttttttactcttaaaattgagcagtggttcttggtaatatttctagatgtttgtgatttatgtttaggctttgttggtttctactgttactatcacagtggatggagattcctattggtagaaagccagcgatgccaaacctcctttacaataaagagttgctgtgcccaaaatactgagagcactttaaaaaagagtaacactttcttctatctgtacacatacaagttttatgaggtttgatcagaatctttcattagtgataaaattaactggatggctgtaactcagaaggattcttccatcagtttagttcagagacaaattatccattatactgatgataattgcagttagtttagccaccaaagatacacggaaatgataattctttctattcagtatcgcagtgaactgtttatactattgcattagatccctgtgttgatttgcttttgctacattaacaaatcaccccaaaacgtaattgccaattctgtaggaccctaaattactgtcctgtagaattggcaattacgttttggggtgatttgttaatacagcagattaataaaatctcaagcatcctaatagttgtgggttctgtaggtacattcataaatgaatttttgtctttctcttttagattaatctaatagctcctcctcggtatgtaatgactacgacaaccctggagagaacagaaggcctttctgtcctcagtcaagctatggctgttatcaaagagaagattgaggaaaagaggggtgtgttcaatgttcaaatggaggtgagatcaatagattcatttttaataatgactcaggaggttcctaaaaggagttcttgtaggtaaataagagctgtcggccttggaatgtcatattgtaggatggtcattcaggcctttgatcactaatggtgttagggtcaccccccgtccccagcc

SEQ ID NO: 76158 - DNA, 1632 bp, Homo sapiens
gttgtctcctgtcttttccttgtccaacaagaaagaagtgtgtgtacgtgcgtgcgtgcgtgtgtgtgtgtgtgtgtgttatggttccttctatggaaaggactagtaagctagtaagtagtagtttgagcctggaagacaggtttttttaacaggatatctatttgtggtcttgaaagatacagccattggggttatttcatgttttcagttttagcttataaaaatgacagaaaataattttccattttaatacatacatcctttttctatactattctcataagtttcacctcttatttatgtaatggaatttattgctgataagtcactcaaaagtgaacagatatgacagagttgttagaaaagtgttaaagagagaaaacattaggcagtaatagtattgaaattaaatttgtatagtatttactacttcagtttgaaattatacctctgcttccacagcccaaagtggtcacagatacagatgagactgaacttgcgaggcagatggagaggcttgaaagagaaaatgccgaagtggatggagatgatgatgcagaagaaatggaagccaaagctgaagattaactttgtgggaaacagagtccaatttaaggaacacagagcagcgcttcctggctgtaaatcctagacttgaaagttttccagtattgaaaacttcaaagctgaatattttttatttctaagtatttaaatgttctaacagatcagaacatgaaatgccctcctaaatgtcagctgttgtcacacagtagctccaacactttgagcatttttaagggagtggcctcatttcactagagacaaatctttaagaatagttctaaaattgggcttgtgatttccatttctgatgtctccagattggcacccctttctagttcaatgcctcacgagatttgccaggggcatccaaggcaaacaatcccaatctttctatataaaatgtattcaagcaaacatcaaataaatttctgggatatttaactataggcttcttccttcttgtcaccagttaaaagcattttaatactaagaccctaattcttttatctttattttagtcttgatgtggaactgtaggagcaggtgaataaaggatctctataacagatcctttcaaaagaagagttttagagaaaataaatttaactttaaccacagtgaaagttgacccttagcgggacaaagccttaaaatgcattgaaagaattagatcggttctgtgccttttatctatttgagattgatgacaacctgtgtgagagaatttatcacaccacgtccttattggaataataagctacttgccttgagtttataattcagggtggtaaagtatgtttttaaattttaaaaagcagctgcattttttatttagttggaatatcacccaattttttatttttattgctattaaaatatccactagatgccacctagagctccagttctttataacaaaacagggatctgtttgaacacttactgttgtttttttttttttacatgtttccatcatttctgtctttaagaactaattcgtacataataagtttcataggtaacacattatttgaagttacagctacagtagtcaggtgtaga

SEQ ID NO: 76159 - DNA, 1885 bp, Homo sapiens
actgaaatttgttatacttcaaaagccataacttgaaaaatactggtggcgtcgatggtgagtgatttttatcccacgtgggccttttgctcagttccatggcaattttgtaaattgaccctagccagagaatagatcagtatttcactgataccacgaggaaaagaacaaacaaaacttaaaagtattcatacaccttgctaacctaaaagacagcagggacaagatacatatgaggacaaggtatacacccagttctgaataacttgaagaacaggcttggcaaagaagtaagtttatccaaatcttgaatttctgccaggcatggtagctcatgcctgtaaccctggcacttaaggggccaaggcaggaggatcacttgaggccagtgagctgtgatcactccagtgcactcgagcctgggtgacagggcaagaccctgtctcaaaaaaaaaaaaaaaaaccaaaaatcttgaatctcccatcaaagccttttcattaaaaatacaatttcatctactccctactgtacctttcactgatgtcaagtggctatcaattcatatagctgaaaattagtgatagtttgggtctcatttatgcataaattaattgaaaatcagtaatggccaggaagaaatatgaatattcaaaccacttttttctttttttttttttttttttggcaaatggtgttatattgcctgggcaggtctcgaaatcctgggctcaagctatcctcctgcctctgcctctgtaagagtgtgagccaccatgccccacccaaaccatttttcatatcagttatagcaaaacaagacaaaccagttcttaataatgttcaaagttggacccatagagacatgctaagcactacatcatgctaagaagaacagttattactcagctgccatacttcagccattctacttttacaccaagaacaaaatggctagagatttttttaaaaatacaaatgccagtaccttgccgagacttgttcactgatttgccccaaccccaaggtaatggtcatctactttgcaacctatggagatcctgatagctcccatacaaagtgaggtacactgttgccaatttggaggcaggaagccatcaaactaaacgtagtttaattcagatgaacacctatcgatattcaaaaggcaaaacaaaaaaactaattccagggacattagaccttggtgaaatgccaaatggaaaatggtgctttaaaaggtagtctcttaccatataaggaataagtaaaacattagcttgtgatttctcattattcaggtcaatgttttagacacgactaacaagggacagttcaaactattaaagagaacaaatttttacttaagcactttgaggtatccactccccttaaatgtaagttatgtattttatctgttgattaaggggaggtccaagcatttgtacttggcaggaatgctggcaatagcttgtgccagattactgtataaacttgaaagtaataaaaatgttctttaaaagtattgtatgatacagacttttcactacagattaaccttccaactggtgaagtttcttggtacctatttgtctcagcttatattcattttaaaaccaaaatttaatgccttgatataaatcttccccatttacatctttttctgtcctttagagcgctcttactctgcattgctaaatgcccatttttcatagaaaagctatgtaatgtatttttcgtatacgtgattatgttctccgacagagtccatgacttctgtaatgtataatatttatgcaggcttgttttctaaagcaaaacaatattctcaatgtacaaagtttggccaccatccccactttaagatgaactatgtcttaatgacag

SEQ ID NO: 76160 - DNA, 1086 bp, Homo sapiens
tatgtttatgttaaaagcaagcatagaatttggagtttgatctcaaattgtttaacttattggaaccccagtttccacagacacaagatgggaataatatcttcttactatggctggctattgtgaaattagtattatgatacatattaaggtatgttgttaaccctaaagcattgtgtaagcctcacctattatttttaggcggaagcttatgggccatcagcacagaaactgaggggaaagattattaacataaggattacttagttgtattcttaaaacgccaagaacataccctttgttcaattctgaaattcacttcaaaactcacaccactctgtctcatggagaaagccctgctcggctcccaaagctgtcatttcattagtgggacattactgaggtgcaggagggaggcccctgagatcttcaggccagggctgaagttgtaccttaccagtgggaacgccattatcttccagagcagacacgagtgaaccacgaagagaaaacccacccactggcctgttctcttcctgtagaggaaaggagacccaattaggaatttgtgaatgaacaaaagggaagagttgcactccccttacaactcaggccagctaaagaagtgagtgcaaatcatttgtaatagaagatgaagctgaacttggacatcacatggccaaagctgcatgcatcagtaaggaagcttgggcctcttcatttcacagccagcagcagtagtgcccatcaatgttgcagttaccaagtctcacagacttgcaaatctgcttttcattcctggagatgtctcaaacagagcctctgatccaatatgctacccggaaaaacattcactggcttccttaacccttgtgtgcatcttacaaagcaatcagaaatatatatttatagtaatcatttctttttttttgagacggagtctcactctgtctttcaggctggagtgcagaggcacgatctcggctcactgcaacctctgcctcccaggttcaagcgattctcctgcctcagtctcccgaggaactgggattacaagcacacgccaccacacctggctaattttgt

SEQ ID NO: 76161 - DNA, 1132 bp, Homo sapiens
ccaagtggctgggattaacaggcatgcgccaccacacctggctaatttttgtatttttagtagagacagggtttcaccatgttggccagtctggttgaactcctgacctcaggtaagccgcctgcctccacctcccaaagtgctgggattacaggcttgagccaccgtgcccagcctcgtgagcacatctttgggccacatctccttttatgttctagatgctattggtttgcctttgtttgctgattacaacaataacagtcatttattgagtacttagtgtgcaccaggcttttgtaatatctcctttaattctcaaaaagccctgcatgatgtgatatatgaaatggccattttgaaggttggaaaatggttaaatgacggtttcatatggttcaaccaaatattattgtcctgattttcaaatattactgccctcaatttcagaatggaactgagtctcaaagaagttaagcaaatggcttaaggccacaggattatttagtgcctgagctcgtattcaaacccaggcctgtcagtgccagagcatgggatcttaggtactaagctgtttctctttgctgtttttgttctcaaggaatgttgtacctggttgtcctgaccacttcttttggtattgaggttcctgcggcctaggacatgctcaccttctctgtctccccggacattgtgtggaatgtcatgtaggcacccagcagtggccaaatggatgttgttagcttgatcagatgacagtgctgagatcagaggaagttgtccctgtgtacactcacacccttctcccagcctcatccccagaaacgggacacaaagctgtttctctcccacaattgacaagtagtcagccacgtctggcagagcacttttagaagatggtggtagcccctcactagcaagtggaagtcatacagatactcacactcagggaatgaaccatactgaggcaatatgagagagcccagtggaaactgtgcatataacagaagccccgttgccttccaatgcctcctgcatcctccacaagatagaggcaatgagctattttgaggcctgtggtgacctctgacctctttcttttagggtcctgtattgattagctacctttgtaggg

SEQ ID NO: 76162 - DNA, 1008 bp, Homo sapiens
ggtcccctcccgttctttccccacagaactcttcctcacacgcttatttatcttttcctctttctgcatgctggttcttagggctccccagaataatccagaagtcgattccatcatggcagaactcaaggtggaggcgccggccagcgtagactggcagaaacgctgcctgaccctggaaactcagcttttccggttccgcctacaggccagcaagataagggagctgctggctgacaaggtgagtccctcagagcagggagctgcctctccacacgcagaggtttatggcagggagggccgtgtgagagagggagagttgcggaaagtcaactttcagtaagatgcttttccccatatgcaaaatgaaacccaaggtagtttaagaccaaagtccgagcagtttactaagctgttatcttgcttgcgtctttgctcgctcattaaggcacaccaaagacatgctgccaatcttctcggtcccccatcacttccggagtcacctgtggctgcagcggagaggttctattattcccttaacgtttctttctcagtgtggggaaggacggtgtttcgggagaaaacagaaatctctacccttcctctcaccctttgttaaataaatgagctacaggaggtgttctgctttcctggtaacaaggacacaggctttggagccagacctaacttggctctgccacttactggctagatgaccctgggcaagtcccttcacctctaaggcaaaaaaacacaaatgtctacttctaagagttattttgagaattatatcagatcacatatgtaaaggtcctgacatagaataggtcttaaatgggaataattattttatttacaggtttgggtgggctggtctgggaaactgaccacctttcctaatgtttctgtgggaagataacattctattttattttattttattttattttatttattcatttattgagatggagtttcgctcttgttgcccaggctggagtgcaatgg

SEQ ID NO: 76163 - DNA, 1049 bp, Homo sapiens
gaggaatatataatcaaaaatgactaaatacttgaggaaataatctacaatgagtgagtatccacagacacaaaaaacaattagactagatccccaacaacttctaataatggaactgttggcaagagactatgaaataaatgagttcaaaagttttgaagacgtaacaaagaaaatgaaagcataagacaagaacaagacactacctaaaaagatcaggtagacttgaaaactaaatagaactttaataagtgaaagtgtttttattgaaattaaaatgtattaatggatagattaaacatcagattaggcaccatggaagatagacttaatggacaggaagacagacctaaggaaatcatccagaatgctgcctacagaaatacaaatacagcagttgagacctggatgttagaatgacaaggtcctgtatctatcaagtaagattccatgaaagatagtggctgaaaatttccaaacttgatgaaagatgtgaagcctcagattcaggaaacagaatgagtctaaccagggtaagtttttaaaaatcacagtttggttagatcattgtttggctgctgtaagaaagaacctcaaataacaatggcttaaaccaggctgatgtttctttctttctcatgtaaccttccagacataagcaatcaagctctagggtgatggtctctggatatttgaagatgggtcatctgatagtcacattccagccccttccctttaagttagtgactcggaggtttcatacctttcttctgctgatatgccactggccagatcttattcacatggttatacccagctacaaagaaggtttgtacatttctacaaacagaaatgtagtctttattctgaataactatgcgctcagctaaaagttgggggttctatttatatgagaaagaaagagaggatagataatagggaaaaaccagcagtctttaagtctagactaataggagggataacaaatagaaacagagtattcatacctcaaatcagtagagagaggaaatgaaaaaaggaaagtctat

SEQ ID NO: 76164 - DNA, 1087 bp, Homo sapiens
gaggaaagcaaccgtctggttcctccagcctcatagtcctcgtctgagtcacaggatcgatctacttcctctatgtgcgcatcccgcacaggcaggcagcccaggggtcgctgtggacagcagtcttccatgaatgggagagccagtgggggatgagggagtctcctctctctgaatacataggctccgtgaagctgggaatcgtggatatggaccgatgacaggatggggaggtggagactatagcatcccagccaggctggcagcagaatgaggcttgcttggagaagcaccagagacccagacaggcagaatctcacactctggagggatccagccaactgattttgtatttattgtggggttacgtggggtagggactttcatcaggacatagagtggcagtcatgtgcttcgggggaagcaggagagtgggtattgtgaggaggctgagaagtaccttgtcctcatggctccgatagtagtagaagattttcccaacaagagcgcaccagaccaccttggagtggccatgctttacctgtaagacagaaatgaactggcattatgagaactaggtaactctagaagtaaatccaggactggcaaatagaagccacagggagacagatttgacctatggtagagatggagatgccatttgggctccctactaatggaaccacccctttcacagtgagggtgccatgacaccctgtggcaccccagccatcatgggctattcagtgacctatgacctgccatgaaacgattagccaggccaatcagatgtcccctccaggcatatgaaaataggaagaacttgctaggtggcagaagccacagttgtcagggtgccgggagggagggagggaaaacagcaggctgaagcccttgggcaaccatgcatcatgaaggaacagaagctgcacacgggcgaaggagaatgacataaacagattgaacgagaagcagagccacacagcgagcctgccagccctgagcttgctgagtgcaagtcgctttggttcctgctggtgttctggtctagctaatgtacttccttgttaacttccattttcttggg

SEQ ID NO: 76165 - DNA, 1924 bp, Homo sapiens
atctgattggcctggctaatcgtttcatggcaggtcataggtcactgaatagcccatgatggctggggtgccacagggtgtcatggcaccctcactgtgaaaggggtggttccattagtagggagcccaaatggcatctccatctctaccataggtcaaatctgtctccctgtggcttctatttgccagtcctggatttacttctagagttacctagttctcataatgccagttcatttctgtcttacaggtaaagcatggccactccaaggtggtctggtgcgctcttgttgggaaaatcttctactactatcggagccatgaggacaaggtacttctcagcctcctcacaatacccactctcctgcttcccccgaagcacatgactgccactctatgtcctgatgaaagtccctaccccacgtaaccccacaataaatacaaaatcagttggctggatccctccagagtgtgagattctgcctgtctgggtctctggtgcttctccaagcaagcctcattctgctgccagcctggctgggatgctatagtctccacctccccatcctgtcatcggtccatatccacgattcccagcttcacggagcctatgtattcagagagaggagactccctcatcccccactggctctcccattcatggaagactgctgtccacagcgacccctgggctgcctgcctgtgcgggatgcgcacatagaggaagtagatcgatcctgtgactcagacgaggactatgaggctggaggaaccagacggttgctttcctcccactgcaccctggtgatccaccccacagagcacagccccacctacctcctcattggcaccaagcatgaaaaggtaaggaagagggctgggcctccagggccaagcttggacctgtgattctgatcttcccttctctctttctcctgagcttcccaaaattcaaatttatttccttttggacactttggcaactaatattctctgaatgggaatattcctttatactgaatttattcccagtgaccaacattgcttcactgaggtcatgtaatagaatcgcaaatttggaaagttgggttcatgttcacctgatcctcagtctttccaggtagccctgactcatgccaaccaaactagctgaaccccacatgggcttggtcccttcaaggagtcctccttggagctcttgcctccactcttcccaccccgtccccatccgatggctttccgccctcttccaggatacgtggctctaccacctcacagtggctgcaggtggcagcagtgccaaggtgggcactgcctatgagcagctcattggaaaactgatggatggtgaaggagatccaggtaaggcaagggtggccaccactgcttgggttggagggtagtggcttggtgactattggtcaagatcccaaagaaagcagtgttgtaccctgaagctgtttttaaaacatctaagccacagaggggaagttcccatccaagctccagggcccctctgtctccggctgagatactaaggtgaccactctgcatctgggggagtttatctgggaagcaggctttccagggacctgggtaaatgttttacttggatcaagctgccccgttgctggctgggcagagggctgaggaaagaaggtagctggttaatctatagttagagtttgtaaatcaacaagtgaagcctaaattgggatcggactaacctgtttggagtctttcttttgctactgattatcagggccctgaggaactaattaatggcatataccacacacacccctttactactgctctgaggcttgtttgtttctgaccaattcatatgcccctccatccagacttgacacagtaagaaagaggcctcccctgcacacatccacctgcactcagacacccacaa

SEQ ID NO: 76166 - DNA, 1416 bp, Homo sapiens
ccctgcctcaaaaaaaagaaaagaatagaaaatagaccaacctcatgggatggctaagtgtgttactttatgagagtgaaattttgtataagcaccagctagttatagctaaagactaagtacttcctataccaattccaggaaatacagaagtagacatcctgactttctatcaatttgagtaagaaaatcccatccctccatctcagtatgtctccaggcaaatagtttccagtagtctcttggactcttacctcatccagtcccctaatctataactccaggtaccagatttcccttactaaatccagtaagcttaatggtatcttcagaatgaaccatgccctcctgttggtatgagatcagcatgaccctgcatctgctctgtgtcatactcggttatatgtttctggaggcaatacaaaataggctcataaatagtgggaaaagagtactttatctttttggaaataaaggtaacagacccagagaaagccccatccctgtttggaatccctgctgagtcctggtttcttattctcttctttgtaggctgtactttcgcagtcaagtcaaaggggagacggaccgagaacggctgctccttgcctctcaaaccagtagagagatagtggcagggaggtttcctatcaacaaggaattggctcttgagatggctgccctgatggcccaggtaaggttctgttcaggaagcaggagggtcgggttgccagcttagaatgaatgcaccatgcagcctgaaacacaggagagattctgcagatcctgtggtgctcaggagagggcagctttgccatctctgggatggaaagcagctgacttctacagatcagagctcctcactcaccgcagatataggatgcgtgcagatggctggacttggaatccagagacctgggtttgagtcctatataccttccaactatgaggtcttagccaagtcacttcacttctctatgctttagtttccttctcagtataccaaaataaaaaatacttggccgggagcagtggctcatgcctgtaatgtcagcactttgcgaggccgaggcgggcagatcacctgaggccaggagttcgtgaccagcctgaccagtgaaaccctgtctctactgaaaaaaaataaaataaaataaaataaaaataaaaattagctgggtgtggtggtgggcgcctgtaatcccagctactcggcaggctgaggcaggagaatcacttgtacctgggaggcagaggttgcagtgagccaagatcatgccattgcactacagcctaggcgacaacagcaaaactctgtctcaaaacaaaacaaaacaaacaaacaaacaaaaacctctgccagcctccacagggttgtactaagtatgatacctggataattgtatcatgtaatgt

SEQ ID NO: 76167 - DNA, 1998 bp, Homo sapiens
tttggagatctccatcttgaatatctacaagcagtgtctagactagaggactggtgcttgggcaggagtgggggtagggcagccatggtcacttggttcaggcttttgagtccacagaggagaagaaaagaccatgttgaggaagaggaggggtcagggagcagcctgcatcctttcataccatagtgttgtggtccaggatgctgacgccatcctcattcacagcaatccacaccagagcgttctccttggaagacagctgggcaggctggggaaacagaaacaacccatcagatatatccatagttagagattttgaactataataactttctgagaaagaaggcacatccagggatctgctaagcagtgatttccagccacctcatcttggaaaacaaagatgatatttgtacagtgtatgcaggaaatagacaaggctgcttgtgacaggagacccttggccttggggctctggccacctactaaccatctcaaaggcagaggcgatcattcttttgatgtccctagaacccatgctgccacagcacactggatggaaagctctgtgctacagaatagaggccagccctagctgctctgttaggggaatggggaacagctggttttctcctagtcttggaaacacggcattccacctatagtctccaagccgaagtgcttctgacttcagccaatctcctaggtgctgtaaaagaaataggaaagcaagaatgcagtcctgtggctttaggccctatcagtaagaaagtgactatttagtggacattcctgtaatgactaattttcactgccaggactacagtatggtaatccagaaaatctctctcttaacccaaagggaggcagatagacattggacatgccacctttttcagaagcttttcctaagctcccagaccaagtgggtccctgttatatgcctttataacacctctgtacatcttcatagcatttgtgatggcttataaatatatattaaatacatagagaaaaaaatgaatacgattatttgatgaatatacatctcctgcactagatgggaagctccaggaaggcaaggactgtgtctgattttctcacttcttataacctcaaacaaccagcactggacatagtaggagctcaactatttgttgaatgaatgaatggccattttccgatctgtggcttcagtaaacaggatcactgcccagctttgagctgtaattatctataaagtttatgcacaacagacacccagtgaagaaaagttccttctgaaattactgttggccacctggccttcatacagaggtgaaattaactgttggctaagtaatttgattcccctgtatgccatgtcaaaccagtggagatgtatttgtttaggttatacattgttctttcaaactttaaaaaaaatgaaagcactcttgagagggctgttatttcaagtctgaatctttgtgtgtgtgaattagttgatcacatcttttcttttggggcagtcaacaaaggacaaatgaagataagcaatcacaattctgctctggactgtggaaagctggactaggccagaaacagtggagggatagtgacctctggtggttactggtatggaggtaggggctgcaaattggtatggctcaaacatgagcagttggggacacacctaagggtgtgggcagctccttccactggcacttacctgagcagcaaaaagtttagcaccaaagaaaggccatttcctggccacggtcaggtagatgcggatgcactcaggaggggagcatccttgcaatgttgcccattttgtggtcaacatatctgccaggtgcctggtgtgggcagatggagagaaatagtgccaatgaagtgccgacgtgtcttcattccaggcctgagacctccccacagtgacttgctgcaagaccttgtagcctacctacctcagctgttcagcgggggccccatgtctatagcgcctggggtgga

SEQ ID NO: 76168 - DNA, 1047 bp, Homo sapiens
gttcacacttttcaccccacaacttggggatctagctgagacatttctacctcgaacaagtcacatgtaccacaggttcctgaataattcctgcagggctggtgacagacataacagctctggttttataatatcttgggtatctctaaggccaataaggataacattatctacccagagagtttagaagaaaagtaggagtccaaaggaagagtaaacaagaatggagctgtgttcacactgaatttggggtcaatctatttcccccaccctctctcctccccaacccttcaggaaccctttagtttattaatcttatacagaagaaactaacttagaaacaaaggattcaatatttgcttatttattctttgttaacatgagagtcccatgtctgaaaaccaaagtccaatttctgtctggccttttgtctcatccttcttggcaaaagtagcttttgaactgatataaaaaaaaatgctgagtaacagaaaagtattaatgtgcttgacaccatgactgaaatactatgatcttgtttgtcaataaaaagcagctatctgtgaaccaggtaactgtgtgttttggaagatctgtttattaacagtaaataaataagccctgtacagaacacaggcactaggttgacagactcgtcttttgtaggacatttcttcctgctaaccagtactgaagggcttgtttttttcgtaactttacacaaggggtactattggaaaatatagctttctcaagacatctgatgtcagtttcccattgttttgcttcacaaacatcaacaaagtaaacctgaacatgcttagcaatttccgaaagtgttctttgctgacattacttttgacatactgtgtcaaaattcttaaggtctcccctcctttggtaaagtaggcaaaaccttacaaggaaaacactataatacacggaaatatactgagttagatttccagtcacctgctctatggctctaagatgcactacatccataatggttcctaggactgtgtccacctgatggtttggagtacg

SEQ ID NO: 76169 - DNA, 1065 bp, Homo sapiens
agtgatggggtttcaccatgttggccaggatggtctcgatctcttgaccttgtgatccacctgccttggcctcccaaagtgctaggagtacaggcgtgagccacctcactcggctgggtcctttcgatttttagagacagtgtcttatgctggtacccaagctagagtgcagttctatgatcatagctcactgcagcctcgaactcctgggctcaaacgatcctcctgcctcagcctccctagtagctggaattacaggtgcaagctactgcgttcagctgatttaggccctaaagttggaattttggaagaaaaatttctgagattgctgtgatggacattttgctgatggaggtttcccctagacctatccatttgttgtctggatctgtttcactgtatactttcatagcaccttagaacccaaataaaagcaatttccttttcctccatgcatgttcccctcattgcctggagttgactggtaccacttggtaatcttactgtctgtgtctggctctctcttcagaacagcatgatcctctctgctgccatcttcatcaccctcttaggtctgcttggttatctccattttgtgaagattgatcaggagactctgttaatcattgattcccttggcattcagatgacttcatcttatgcttcaggcaaagaaagcactaccttcatagaaatgggcaaggtcaaggatattgtcatcaatgaggccatttacatggtaagtatttaaaaggtaagtattacaggcctctctggaggaggtagccagcccatgggatgttcccagatttaaactaaaaccgtaaaagtgagacttatatttaaaaggtaaatctctttatttttaaagagatgcagcaggttttcatggatagggaattagcatttcaactttatcttcaagaccaacttcaaaattatcactggcattttttccttctctttctatcttttttctttttttttttttgagacagggtctcactctgttgcccaggctggagtgcagtggctcgatcacagctcactgcagcctcaacttcc

SEQ ID NO: 76170 - DNA, 1057 bp, Homo sapiens
cattccgtctcaaaacaaaaacaaactgtgggtttgttttgagacagggtcttgctctctcgcacaggctagagagcaggggcatgatctccgctcactgcaacctcgacctcccaggctcaagcgatcctcccgccttggcctcccagtgctggactacaggcctgagtcaacgcgcccggtctaaaaacgattttaatctttccacttaactattgccccgacgaggttttttcgaagacagtcaaggccggcccggaagaacgcacaaccatcagcccccagcagagctctcggcgcgcaactgaggctgcgcaggcttagggcggggcgtggtgacgcggctgccggaagcgggtctggagcgggcgagacggccagggccggcgagcgcagtgcagcgccgcgcggtgcgggcggccgagtgggggcgtcatggaggatgagcggagcttttcggatatctgcggcggccgcctggcgctgcagcgccgctactactccccgtcctgccgggaattctgcctcagctgccctcggctctcgctgcgttcgctcaccgctgtcacctgcacggtgtggctggcggcctacggactcttcaccctctgcgaggtaatggcaagtcggcccctccccgcgctcgaaggagggggttcggctttgggagggtctttggggtctttggtcgagcccggacctctggtcggcccctcctacagtgataggacaggagggcgggaactcacgggttctggggacgatattccgctgctggacagctctttaaatgacgtttagtgaaatgtgtgctcctggatagtacattccccttccgtggctgtgctctgctccgtgggttcactcagcatacatctagttcttgcgcgacggcctaaaactttaactgccatgtgttctatgtagtataggcgcgcagtaatttaattccaagagttcaaggaactactaagtgggtcttcctcgtccatcccttctgctcctcaaagtagtactgctaacaatactttacgtagacttccacaaactgtctttg

SEQ ID NO: 76171 - DNA, 1009 bp, Homo sapiens
tctgcatacctcagacagactaactccaatgtatatttctgccttacactgggtattagaacctcttatactaataactgtcaatagagagatttcttcacttctagatgagattgggctctcatctagagacaatttaattagacaatttaaattagtctaatttaaattggcttgatgtaagttatggttgctcttattctctgaacgtaacagcagctgaagtgaactctaattttaggtctgcagttttaacatcttccatttctaacttcattatagccccagtgtccaaaggctgaagctaacaactaagtttcttaacagcttatgaaatgacatactaccagataacaattctgacattaatcacccagaagtaaagacttggtattgggaaaatgctcttaaaattaccatttgattagtattcatctgccatctttctacactgccaagatttgcttaatataaaactcagatgaaacaatcgtgaggctgggaagaatgggacagttgaaacaataaatgcttgtcatctcagaagataagcattaaagatggagataaagaaaaattcatgagacagaagatctaggcaatgatttagaggaaacctcctcccaaaaaccccagaggaagaatatgacctgtgtttcaaattttgcctttctgaactatttaaaattatgtgtatgtttttgctttgtattttaaaagtaaagctgctgtcctcaagaaacaggctaaaagtgtgttgcccattgggggtttgccctgacatcagttatagttacttacttgccaatcagcagatcaaatgttcgttccatgaccttctggataccaagtcgatcaatatctctcatggaaaaatactggatatcatagttctttaaaataaaactgtgatgagatataaagggaggagtccttagtttaaagagcatttttaacaaatatgtatttgggggagagggtgggtttgttgtagtgacctgcaatagac

SEQ ID NO: 76172 - DNA, 1119 bp, Homo sapiens
aaagggaaaaatagggcagagggaagaagtttacaagggattgaaaggtattacccaggcttctagttacttatcctagggcaggacccatcctgagctggatgtctatttgattactttttctagctaacccttctttctagaaaagctatttttaaaggaagtaactactatttgaacaacatttcagaatccatttttatgctttggtttttattgtctcagtttaacatttctgtgaggtagacagtgttatccctaagtgacagctaaagaaccttatgagtacttcctgctaagtggctgtgtgatcaaacatacagcctcagagtatccagccgtggtcccaggtctaaccccaaaatgtttagaaggaaggttatccaaacttctgactactccccactttgcttctctttgtagagtgacaaccaacaagctgctgctttccattatcatcttactggagctcgccatcctgggaggcctggtttactacaaattctttcgcagccattgaacttctatagggaagggtttgtggaccagaactttgaccttgtgaatgcatgatgttagggatgtggatagaataagcatattgctgctgtgggctgacagttcaaggatgcactgtatagccaggctgtgggaggagggaggaaagatgaaaaaccacttaaatgtgaaggaacaacagcaacaagaccagtatgatataccaaggtaataaatgctgtttatgacttctttaaatttacatagtactgtagcatattaataccctgtgaactgcaaaaaaccaaatacatttacagtagtattggtcaccaaaatagaggggaaactttacaattgtgagaatgtgtaaatgttctcattaaggcagtattgacccagacaaccatttagtattcatctatcccctcaatgcctcataattctggaatgcctgttgtgaaacatgtcagtgcacagtgtctcctaaattctcacacgtgcttgattttctgattcatctggtgaactgggagtaggaagttggtcatagacaatatgccctccttctcttgtctgaccaaagcttgaagcaatcacatctactgccaggttagctgt

SEQ ID NO: 76173 - DNA, 1058 bp, Homo sapiens
atactcgaatgcctgctctgtgcttgctgggcactatgcaaggcattcagaatgaggggaacatgccagacatggtccctgcctcatggagcatatggttatttacttggtgtagtccaaataaataagtagtttgattagtccaaactaggcatatttccaaatgagtgagggaagaaccaggctatctgctcactactttctgccttcccagctggcagagatggaggaggagctacgttatgcacccctgtctttccgaaaccccatgatgtctaagcttcgaaactaccggaaggaccttgctaaactccatcgggaggtgagaagcacacctttgacagccacacctggaggccgaggagacatgaaatatggcatatatgctgtagagaatgagcatatggtaagttttagctgttttgtttgttttttttttcctttaagggcctgtggtacaaaaattaactatattgttggggtatttcatgttatcagtgtatactagactcttgtttcatttttttcacccttatcctcttttctgcatccagttcctgttaccccttggtatctgctctatttaaggcaggcctttcgaactatatgcatatttagatttctttttatccttaatataatacagtcttataataaaaaaaaaacagtgctttgtatgtagtagaatgtaaatgttacctattcttattatctggattctgactcattgatctaatttcttttctccttgatcttttttattctctcatataaattttagaatcactttctcaggtatgcctggaaaattcagttaggtttctaatttatcagaatattgttacaaaatcaatccaagctttcctttaccttaatgtcaagatggcccagcaactgagatacagtagccaatgcagggcgcttctcgagaaggagctttttatcattttattctgtggtaatagaaagtgagcaagactccctctctagctttcaggattctgatttataaaattggactaattgaacatctgtattctgaaaccatctagagcagc

SEQ ID NO: 76174 - DNA, 1334 bp, Homo sapiens
tgacataatatagccttacaaaatgtttcttcttctgccattaaaaataacatacgggggccaggtgtggtggctcgtgcctgtaatcccaacattttgggaggctgaggcaggaggattgcatgaggccaagagttggagaccagccttggcaacatggtgagacctatctctacaaaaaaaaaaaagctgagtagtgtggtgctgctcacttgtaatcccagctgctcaggaggctgaggcaggaggatcacttgagtctagcagtttgaagttttagtgagctgtcatcacatcattgcactccaacctgggtgacagagcaagactccgtctcaaaaaaaaaaaaaaaaattatgaagaagtatgtgaattgagaggccatatagtataatatttaacagcaagaattcaagagccagattgcctgagtttaaattcaccttctagtagcagtgtgaccttggacaggttactttaacccaattagtttttcctgccaaatggggataaatcatagtatctacttcacagggtttttgtgaggagtaaatgagttaatatatgtaaagtccttagaatactgcctgataatagagctactagccattttatttaaatgaaaattaagaataccagccctgtatacaactattcttacctttttttttccagagtacttattttctgacatattagacactttccacatttatgatatttacagtatattgtttgtcttcctttcactaggacagtggtttcattgtggtccatgaaccagctgcatcagcatcatttgggaacttgttagaaatgcaaattctcaggccccaccccagacctattgaatcagaaagttttaacaagcagtgtgttttcacagccctccagggggtttctgatgaaggctaagtgtgaaagccactgagctagaatataagctcaatgttgtctttttttcactgtgtttcctaagtaccagaacagtgcctagcacagactaggtgcttcatagatacctattggatgatggaatgtgtgaattgttggaaagaaaatattgatatatgattgtgatttatttctattctgttgtccacattttcattactttaaaaatgggtatattccacctattaaaacaacaaaaactgtatttctccaaagtacagtctccattcactttctgcctttgaatgatactagagacaatgtgtcctgttttaggaagtttttgtgtaactgtccattaccacttacaataattattaatccatttaatatttcattaaatacctatggccataatttctactcttggttttacaacc

SEQ ID NO: 76175 - DNA, 1054 bp, Homo sapiens
ctcccacctcggcctcccaaagtactgggattacaggcgcgagccactcgcccggccgggttccacttctgaaagcttggggagccgctgggccttccaagaaaagtgctccacctcccgacggcaggcagagcccctggcccggctatctttccagggccgaaagctaacagtcaagacgcgaaacgaggaattcgggtcagggtggcaaagcaaagcgcgatgacagtgaggacgacgtctagacgcaaacatacatcaaatcgggccgaagcccgctgtcgccgcgcgggctgaacctggcacccggagcaacgcgcgaccccgggacgagacgctctcgtccgagccaaactacatcccccggcgtgcactgcagcgcccgcccctcgccggccggcggggcccgggaggaaggcggccgcgctgccagtcccgcaggtcccctaggcccctttcgctgcggcctttccccaacccggacccggcacttctcgggttccgcgactgccgatcgccccggcgcggcaccgctccctcaggagtcgcctaggccgcgcagtctcccgacttctcgtcaggctttcgcgccggcgctccagcaatcactggctggagaaggtgggcgttccggctcgagaggaccctgccgcggctccggaagagcctcgtcctgggcggcggtggtgcggcggtcgccgttatggccactgggctgggcggctgaccgccgggctaggaaagggcccagggccccgaatctcggtggccgctgctccagcgcggcctgcgccatggcctcctccgccgcctcctcggagcatttcgagaagctgcacgagatcttccgcggcctccatgaagacctacaaggggtgcccgagcggctgctggggacggcggggaccggtgaggcgggggtgggccacgccgtggggagcgcagccctgcgcgctttggaaggaagattctcccaccttcctcccagacccgggcccgcgtctcctccctccgcgtcctcagacacgccccctagggctggcttgtcccagcc

SEQ ID NO: 76176 - DNA, 1031 bp, Homo sapiens
ctaatttgtatctcctgggccctcatttttattagatcaagttcattggctgttgattcaacacactttggttaagctcttaatatgcactgagcatagacatgaccaagtctgaggatagtcagtatactgtgtaagtcccacagcacaatgctgggacttgtcacagtacagaaataaggggcaggtgcaaaaaaaggatcaatagcctggggccgggtgctgcggctcacacctgtaccccagcactttgggaggccaaggtgggaggatcgcttgagcccagagtttgaggccagcctgggcaacaaagcaagacgctgtctctaattaaaaagaaaggaaaaaaaaatggcccgggatgatcaagaaatgtggaaaaagtgtctgtgaagagtgtcaaaaaaggttaagtaggaaatggtgaatgaacaattagattatcacacaacctaaattaatagcatgtggattgagattacactgtagctagactctggaacaaattattctttagaatgagaaatcattgcacaaccataataatgaacagtgttttcttcttttgactgtaatcaaacttttaattcttagtttttattctggtaaatgaaaacaaaaaataatcaaaaagaatttttatttgtcattgacagttcaatataaattaagtaaaacattaattcatttattctgcactattatcagaatttttctaatttttccgtaaaatgaccatttctaaacatatagcttaatggtcaaaacaagtgcaataaaagattaatttacaagtatcagaagtgaagactgtggtcctataactctttcccccaccaaagttaaaatataattgtcattccaggaaatcaaaatcttttagaatagcacactccaaacaagtgatgggaacactactaattccttagacttcctttggcagcattacttttgataagaagtctccaaataaaatacaaaattttggcacagacattttaatcttgtcaagacaatgtaaggaaatgccc

SEQ ID NO: 76177 - DNA, 2292 bp, Homo sapiens
gcatttcttttttttttttactactccaggcatctctgaccaatgtgaatagcaggatctcagctatatgacattgtccaaggctctgtagaatgggccttatggacttacttgaagaagatggatatacatgggtgtcaggcaggcactaatattaaattatataaataggggaatataaagaccaaatgtatgcattatatatcaaacaaagcattctgatgagaggtggtctagcgaggagatctaaaatggtaattacattttctctggctaaggactggagaatgaagagataaggacaaacactggccctgtgaagtacatggagaacatgtgatccctagttgtttttatgtcatattccttatccctggcagatggcagacttcattcttaacactgtgcttcatacctttctctttaccttccagtgactgtcatgtggcatgggtctctgcccaagctcgtaatgagactatagcaaggcggctgtgggacgtcagttgtgacctgctgggcctcccaatagactaacaggcagtgccagttggacccaagagaagactgcagcagactacacagtacttcttgtcaaaatgattctccttcaaggttttcaaaacctttagcacaaagagagcaaaaccttccagccttgcctgcttggtgtccagttaaaactcagtgtactgccagattcgtctaaatgtctgtcatgtccagatttactttgcttctgttactgccagagttactagagatatcataataggataagaagaccctcatatgacctgcacagctcattttccttctgaaagaaactactacctaggagaatctaagctatagcagggatgatttatgcaaatttgaactagcttctttgttcacaattcagttcctcccaaccaaccagtcttcacttcaagagggccacactgcaacctcagcttaacatgaataacaaagactggctcaggagcagggcttgcccaggcatggtggatcaccggaggtcagtagttcaagaccagcctggccaacatggtgaaaccccacctctactaaaaattgtgtatatctttgtgtgtcttcctgtttatgtgtgccaagggagtattttcacaaagttcaaaacagccacaataatcagagatggagcaaaccagtgccatccagtctttatgcaaatgaaatgctgcaaagggaagcagattctgtatatgttggtaactacccaccaagagcacatgggtagcagggaagaagtaaaaaaagagaaggagaatactggaagataatgcacaaaatgaagggactagttaaggattaactagccctttaaggattaactagttaaggattaatagcaaaagatattaaatatgctaacatagctatggaggaattgagggcaagcacccaggactgatgaggtcttaacaaaaaccagtgtggcaaaaaaaaaaaaaaaaaaaaaaaaaaaaatcctaaaaacaaacaaacaaaaaaaacaattcttcattcagaaaaattatcttagggactgatattggtaattatggtcaatttaataatattttggggcatttccttacattgtcttgacaagattaaaatgtctgtgccaaaattttgtattttatttggagacttcttatcaaaagtaatgctgccaaaggaagtctaaggaattagtagtgttcccatcacttgtttggagtgtgctattctaaaagattttgatttcctggaatgacaattatattttaactttggtgggggaaagagttataggaccacagtcttcacttctgatacttgtaaattaatcttttattgcacttgttttgaccattaagctatatgtttagaaatggtcattttacggaaaaattagaaaaattctgataatagtgcagaataaatgaattaatgttttacttaatttatattgaactgtcaatgacaaataaaaattctttttgattattttttgttttcatttaccagaataaaaactaagaattaaaagtttgattacagtcaaaagaagaaaacactgttcattattatggttgtgcaatgatttctcattctaaagaataatttgttccagagtctagctacagtgtaatctcaatccacatgctattaatttaggttgtgtgataatctaattgttcattcaccatttcctacttaaccttttttgacactcttcacagacactttttccacatttcttgatcatcccgggccatttttttttcctttctttttaat

SEQ ID NO: 76178 - DNA, 1654 bp, Homo sapiens
ggaacttagggttcttggattccaaagcagttgaaagggactttgtctagcttaagcaagaaggaaatttattaaaatattagtagggagaggagggacccctaggttgaaagggaagactgaagagccaggctaagaagtgtcagagtggcagtcagccagccggggcattgctgctagagtgagcgaatgccagctatctttagtgtttaggttgtattgcttatcatccattctctagggaggaagcattggatctccttcctcctatcccttcatttttactcttttgattagaggcaaacagggactttattaatgctctcttcaaactatattgaggggaaaaggtgattctgcagaaggaaatcaggttgctattgccgaaacaaagtagaatgttcagccaaagagtaacagttgtccactgtgtaacaaacctggctctgtacatgttgcatgtgtgttatctataaggcatgcaagtagaaatgtatagcagatagttggaaatgtggttctgaagtataagaagatagatttatatagtatactggattgattttccaagagtgactggattcttcttccctagagattttaagaaaaaaaaaaataaccctttatcttggttttgactgagtggtttaaagaaagtcagctctaaatccataacttactattggattgacttttgaagagcctttcctgtgctatggattcttaattcattttgaagatccaacagcagccgtgtagaccaccatcaagaaatgaacataaaagtcttttgattgaagccttaagatttttgcactggctcttctttctgcctgcaaccactagtctgctttatgtctctaagaatttgcctttactggacatttcatataaatggaatcatatggtatgtggccttttgtgactgacttcttttactcagcttaatgttatcaagggtcatccatgctaaagcatgtgtcagtacttcatttctttttattgctggataacatttcattgtatagatttgccacatcttatttattcattcatcaggtgatgggcatttgggtttgcactttttagctatttgaataatactgctgtgaccatttgtgtagaaatttttgtgtggacatttctcttgggtacatggaagtggaatttctgggttatatggtaactgtgtttaactgctgaggaactgccaaacttttccaaaatgactgccccattttacattcccaccagcagtctatgagtattctaatttcttcacatcctcagcaacacttgttattgtctctccttttgagtttagccatcctagtgagtatgaaggaatatcttgtttttattttcatttcattttcctactaatgatgttgaacattctttcatgcgctttttggttcatttgtttctttgttggggaaatgtctatcaagtcctttgcccatttttaagttggataattgtctttttattgttgagttacaagagttcttaatagtctagatgcgagttccttgtcagatatataatttgcaaatattctctcattctgtgggttgtcttttaactttcttaatggtatcttttgaaatgtaaaacttaaattttgatgaagtccagtttatctattttttgt

SEQ ID NO: 76179 - DNA, 1147 bp, Homo sapiens
agaaggaagatcatgccactgcactccagcctgggcaacacagcaagcctgtctcaaaaaaatgaaggggatggggtgggtgtggtggctcatgcctgtaatcctaatactttgggaggccaaggtgggaagattgtttgatgccaggagttcaagaccagcctggtcaacatagggagaccccatctctaaaaaagaagggggtggtcaacgatgttaagtgctgctgagaggatgagtcttggctctgctgattcctgacttgagtttccagtcagaaatacacagaggtccttagcactgtctactctagagccttcttagatctgtgagatggaagtataaattactgtgagcagtacttctgatgtcaccatgggcaaaagagtccatatgtgaaggtcacatgcttatttacatccttttctgttttgggctattctgcaaaatcaagtcctgtcttaccctctcttcatgccacccccaaccaggctctggcgttacgacgtattctgtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcaggtatgaatgttatctctttttgcagatgagatttattgctcaaaggagataatttgggtttgtctgggtatacccttttttaaaagtacattgtctcatatagcttttgtcttttaactctagagtttttaccttttagtaggggaatttgactctcttttgtaataactgctacatttgattttatgccatcttttatactgataattatgcattctgtttgttttcttcctgtctttgttatgtcagtccagttttctttattcttttttggattcctaattctattgttttacattaaaaagaatttaaaaagaatttgaggccaggcgcagtggcttacgcctgtaatctcagcactttgggaggccaaggtgggcagatcacctaaggtcaggtgaaactccgcctcaaaaaaaaaaaaaaagaatttgaatctgcatttctctattgtcctcaggattga

SEQ ID NO: 76180 - DNA, 1562 bp, Homo sapiens
gtgtatgtgcatgcgtgtgggtgtgttttttttttcttgtttattttgtcccagagtcacaagctttcataattttaactttttgtattggattagccatttctcaaggccataaaatgccagttgtggacagattgacctacagaaactagttatttcttcttctgggctgaatcttgtgatttcctaagtcacaagtgccttagagagctcaaaccaaagccaggtgcctggctaagcaggtattcatccagttcttgtgctgcagagaacagctgtaagctttgcccttgtaatagaatcacttttgtctttgagcaaaagcagaaaacttttgtcatctttcctccaactttccttaaatggacactgtttccttaaaaggacaacagtggaaagaactaaagcaaacctcagccagaagacacagggagttgcaggaacctactggctgagacagtagaatgaagaattgatgagctctccttctctgtctgcaggaaaatgctgtccagtggggtgtgtacatcaactgttcagcttcctgggaaagtagttgtggtcacaggagctaatacaggtatcgggaaggagacagccaaagagctggctcagagaggcaagttcacctcctttcaattccctcctattactgctgttttacccctcacagtaatgatgattcattctcattgtttcttcccagttttggaattcaagaacacctaaggattccactgatttgctgatctgaaactagtactatgctctacatataatggacccttaatgaatattattaatttatttttctttacctatttgctaatcagatacctctgttgtgaagaaagggtaaaaatgtgtgttttttaaaaaaatgttggaaataacattagatttataatgccagctcaaaaacagagctgaccatttctctttcatatgttggctgacaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctggtaagtgtagaactagagagactatgttgtgggtcttgaggtcaacatggcagattcaactaaaaggaaaaggtccctcttcctcatagaagtggtggataaaatatagccaaaaacttctgtagctgaactcatagtcactgggacacaatttatgtcaaagggatatcttccagaggcagaaacaaaaaatgaattcaaaacgtcatagcagtgagtaagagctgaagccagaaatctcatgggagtctcagcactcagtacaggctttttagggtctggggtctaaatacttacacagggataggagatgaggccacaggcctttgagagctggagctgtatttgaggttctacacaaagttgagattcacaaagggccatctggtccatagtatagaagctaataaaaatcctggccaccagctcagagacatgacaaagaag

SEQ ID NO: 76181 - DNA, 1073 bp, Homo sapiens
ctagtacactataggaataagtgtactattcctatagtgtatacttttttttttccagaaaaatccctctggggtatgagcactattttcagttctggttcaacttttcattgagattctatgtggataagaggatcttgtagtgaaaaaaagataaaaagcagtgttttcatctgagtgtgagaaaccatgtgtgcctagaggtgggagaactgagtattcagaaggcagaaaaaataactgagagctgggtgaatgatcccacaggccctaagccctagatggttggggattagcgatgtataattcaacttctgccagcgttggcggcagcgctcccacgtagccagcctgaggctgtcaagctctggactacatttcccagaaggtctgctccccgggctgtcgcaatttgaattggggcgtgtctagaaagagaagccatagtcggcgagcaacgctggagcatcccgctctggtgccgctgcagccggcagagatggttgagctcatgttcccgctgttgctcctccttctgcccttccttctgtatatggctgcgccccaaatcaggtctgtgcaaatgtattgccttctcttgagaattcttgttgcggggcgggagggaaacatagaatccccaccaaagctttcttggaaaactcccctgggggggctccaagatggcggagcccagagttcggtgggttggaggcgaggtccagctgtcctgggtgccaggaggacacccgagaccccaggcggtgagaaagggcggcagtccggggcacactgcttttccctggcctgtttttcttttgtctaagcaccccctgattctggctccagggaatcccgagggtaaggctacctcaaacgcttgagtttcggactcttcaatgggatatggcccgacgctgttttccccttattccccacgccttaaaccagccttcgaggtacaaaggagcgattccacatttcgccctctgaaactgatagcaatcgtaacatctgcggccccatccttgctctctcgttgctgttacaatcgcttgttctgtgggcggatg

SEQ ID NO: 76182 - DNA, 1041 bp, Homo sapiens
gtgcagtggagtgatctcggcttactgcagcctccgcctcccaggttcaagtgattctcctgcctcagcctcctgagtggctgggattacaggcacccaccaacatgatcagctaattttttgtatttttagtagagatggggttacaccacgttggccaggctggtctcaactcctgacctcaagtgatccacccacctcagcctcccaaagtgctgggattacatgcatgagccactgcacctggcaaaatttttaaataataaaaaaacacctagaataaaaagataaaaatcatccttcacactctgcttggctctccctaaaactccctggaagtaaccactactgcccagtggctggttatccctccagactgttctctatgtataaaaaatcatatagttttgtattccagttttttccttacaacattatatcactaacatttttatattaattacatattatattaaaatatgatatttaatgactgtatattttattacatatttaaggcagcaatgttaaacactcagactctagagtagcaactgtccaatagaaatatgatgggaagaccaggcgcagtggctcacgcctgcaatcccagcactttgggaggctgaggtgggcggatcacttgaggtcaggagttcaagaccagcctggtcaacatggcaaaactccatctctactagaaatacaaaaactagctgggcgtcgtggcatgcacctgtaatcccagctactcgggaggctgaggcaggaggatcccttgaacccaggaggtggaggttgcagtgagccaagatcatgccattgcactccagcctgggcaacagagtgagactatgtctccaaaaaaaaaaaaaaaaaaaaaaaagaaagaaagaaatatgatgagaaacacaattgtgagccacatatgtcattttgaattttctagcagctacatttaaaatgtaaaaagaaattggtgaaatttatttagtaacatttaattacacattcatttattgagttaataaatatgtactt

SEQ ID NO: 76183 - DNA, 2133 bp, Homo sapiens
gactgccaggttcgggcctacctgatatgttgcaaactgcgttctgcctacttgattgctgtgaagcaagaacactcacgggccacagcccttgtccagcaggtgcagcaggccgccaagagcagcggggatgcagtagtgcaagacatctgtgcccagtggcttctgacaagccacccccggggtgcccatggcccaggctccaggaagtgaccttgggcagtggggccaggaacacgtggcctgagagctgggcaacagcagtgatggcgatgccctccacctctttcctccagtggagtgggacttctctggctctgccctaggttggaaagagttggattggaccctacttgccttcccgggcaaggataggacctttcacgcaagtgccatgtttctctaaaattgtggaatctatgtgtgtttgtctggagatggccagttctttctacctcagagtgagtgagtgagtatgtgtgcacacacgtgtgcatgttcctgtgcgctgatgtttacgcccaagcatttctgaacaaatgaaactcttctccatttaaaagaggcactttactttagacttgccactctgaaaaccttccctgcgttttggttcttgacccgggttgtcctgtttgtatagtcccccctctgtggacgtgctttagtagctcctcttacctagagggcttttacagagaattagagcaacaccaaaaggattgcctcttttccttccttcccattccaaaattcagagatggctttggggcaagtgctacctgtggaataaacctgttttccaggtgtctcttctcccaagcacaagaagtcctggagtctttggaaggtagtctgaatagaagggttttcaggtgcaggcatctgaaagctgtgggtatgtgtataaatgatcaggtctgtgaggctaacacgggcaagagggaaagaaaggctaaccatccaaacagggatacaggggaggcggtggggggtggtggggggagcgggtgctcacaagcacagagctgcctgttgtgaatgtccctgctgcaaagttggtgggtgagagaatgggacttcctctttgagagtctggggagagaaaaggtggccaggatcctaggactgaatgactcgattttacctatttgagctgcagtcctgtttgcgctccttgaattggttaggaagctgcttccttttccctcctgcttcccttcagtctcttcaggaccacaggatggatatgcagacatgtggggtcattgggaagggagtgcgcttcttttctctgtcttagaaaagggagtcaagggttggctttggaattgggcctctggacagagtcagaatgagggaataatgaataggtcacatctggttggtggaaaactaggtgaagtgcttctttaatatgcactgtcttgtcttcccacgcaagatgtgacaatgtttgagaaaaggtgtgtcatactcagtgacttcaatttgcaaatgtggggcctaaagaaagctctgcagctctgaacctctcactggccagagctcagcctattggtcccatccatgatgctgagacaaacagaaactggaagctgaagtcagtgtctctggtgctcagaaaccctgtggatttccctctgaaccaagatttttagtagtaaaataaacaactcatggacatctgtcagatgagaagttttggtcctgttagagaggagaaagactgtaatgaaactactagacccatttgggctaaagtttggcttttccttccttgagtcatagaacgtatccatctcccaggaaatgtccttctctggcgtctgcttgcccttctgagtctgccttttttgcactgaacataagcactttatactaatgggtcacaaatcttgcagcccttaatttgggataagaccagattttcctgacattttcctctaactcattgaactatcaaattataggcaaccactgactagactgatatgagatgaggctaaaagcctttgaacaccacgctgtagtctccaacagaaaaacaccaccaaaacagatacccatgttgaggggttgaatgttttactacaaacaagccacaataaagtgtctatcaacatgtttctt

SEQ ID NO: 76184 - DNA, 1050 bp, Homo sapiens
actattggtgtggggcagaaagggtgggagcagttgtctgtaggtgatgaagctactcttgtccattccttgaatcctgaaaaaaaatctaaagggaatcatccctggatgacagtgtgtagtacaagcctagaaagcctacagaggagctggtagtgggagtgggagtggagggaggattagcatcacaggctacaatcagactacactccatactccttacagtaggccaaaaggctcctgcacgttctggcccctactgatgtcaccatctttatctcctgctactctcttcttgctaagcatcgatccctggcctcctcagggctcctcaacacaccaagtccttaattcctctcagcttttatacttgccagtccctctacatagaacacaacatctggagtaaatgctctaccactaccatttattgcctccagaggcttaattgctaactattttatgtgtttgtttactattcatttctcttccagcctataaactctgagggcagggctcatctctcttgacctctgttattgtacctggcacataggtgctcaataaatgcttatcgattcaatgactggaccctatctggttccacagtgcaccataatattgtgagtctgtgcaggacacgagatcaccatttttttggtcttgtcataactgctcacaaggtacttgaggtctcttttcccactatatcatttgttttccctttttcattgccatattattcgacttctcagtctcctggcctcagtcacctggggcccctcatgaggctggactgtgcatattctgtcaccacaggcacatgaacacacttcagctgcagatggaagtgaccaggttcttgcatcggtgcgaaagtgctgggacctctcaaatcaccactttgcctctgccaaccctgtttggaaataaccacatgaaaatggatgttgcctgcaaggtacatgcagcgtttcagacctctggcagactattgtcatcttttagaacacttatcataattgcagttgtctagtgattatttcagtt

SEQ ID NO: 76185 - DNA, 1159 bp, Homo sapiens
tgcactgcacccagctacattcctttttttatctgaatgttccataataacttggagaaattggctgagatgtaccaaattttgtaggaaattgaaggagctcaaggcagactttaatttcactctgccaccctaattcaaaacagcagccaatgcaaatgtacagatagacatattttctaagattgatccaagtgaaatcagcagttcacaaagttattatgactatacccctacaggacactgaaggggggtgtttttaccagtgcttagctactgactattcttagctactaaccaggtcttaagaataatgtagaagtcatgttatatggagttgagttgctaacttttttccttttcctcagtttccagatgagtttagcagtaaagatgcttttcccaggcacaaattgggaatggaaatcacctagttccgttccctctgacagctgtaatccagagagctaagctgcttacttcattagcttggtataagctgacgacagcagtgcccttgctttatatttgtcagagctaggaaataagccttctttttttctgctgtaatcatagttacccttgaactgaaatatcttacatttattctcaagcaggtagggagaggagaaaagacattgtgaaaattacacctgaatgcctggagcatggaagacattctgtccctagccttttccctgtgtattttgtccctttgcccactctgcccaaagactgagctttctaaaacataaatagattcatgttattcccctccctaaaaggctttcagaggatctccatggccataggaagaacttcagattccttagcatgctacagaactaaccaggatcaggcctccttatttctctaatttattttcaccacaaatcctatgtgtaccttacattccagactcattaaattacttaaattttcctgatataccatgcactttttttttttttttttgagccagagtcttgctctgttgccaggctggagcgcggtggtgagatctcagctcactacaacctctgcttcccaggttcaaacgattctcctgcctcagactcctgattagctgggattacaggcacatgccaccacgcctggctaatttttgtatttttagtagagacagggtttcaccatg

SEQ ID NO: 76186 - DNA, 1096 bp, Homo sapiens
ctcctagagcatctaggaatatgggccaaagcaaccatccaaaaccagttactttgaattctgcatgttttatttacaaacttaaatagattttctattctcctccatagcattattgtgtttgtcctgatgtgaacatttttggtcattatttaccataatgattactgatcgcataggaaggaagacacaccatacttactctacagtttccgtgaccctagcataccactgcctccctccctcctggaggaattacccacacaccatactgctgagatttgaaatgggcagttagtattgatgggggactctttcattcaacaattctaccctcaaagagccctccattgtaccagggagacactgtaagttgatgctgtctacgaagctcaaaacaaagaagtgactcaggcatttatttaataatttttctttctctgttttcagtgtaccagaggagccttcagaaaaaccagaaggtaaggccaaatcccgttctctgtgactcttcatttgtgtacttaagttgactctatcttcagcatatcagctgtgactgatatacttgtccaacttatgcactccatccaacttgtttgccaaagcaaattcttggcatttgtatcagcctgtttcctctgaagttcatcatattaacctattacactggcctattagcttccagcattgagaaggccagcaaccaaataatttggttcttaactttttagtaggtgattttattttagtttttcttaagtttccctttaccatcctacctccccatgctccctccttacccctaggtaatccctgttaacagtttggcctgtatctgtccacaacaggttagtttttagagtgtccagtggctcagccatctatttgagaaacacgcccctttgaaggtttcttgtgtgaagcaagaaggttacgtgacaaatactgtaacactcgcctcaggtctatgcctggggaagatggtttgaggtgcttagtggggtgtcctaaagcaaacaaaaggaaccaaggagagagaaaggggccctgagatagcaggcaagtgtctacctgcaactcatgccagctcact

SEQ ID NO: 76187 - DNA, 1240 bp, Homo sapiens
ttcccctagtctaagggaaaggagtttcccaccaacccagccctcacaggaatttgtgcccccagcgacaccccctgccaggcaccagtgggtaccggatgagactgagagtatctgcatggtctgctgcagggagcacttcaccatggtaagcagcatcggtctccactgtcaccctcaggagaaggtaaaggagaattctagttcatgagcctgagtttacaatcaccgcctgtccccaggagaatatcggtattttcagaactgccaaatctaagactttgggttcatttttgacctgaccagaatgtattttctggattcagacaggtagtagacaccctcaaacagccataaattctaaaatctttgccattgtcatgagataataaaaaagaggcaggaggagtcaacaggtgtcagtggatcttgtttctggctcccatgtctttgacagtaagactggtgacccagcagtggttatatgcactgactcaggagacagagggcctgggttctaatcctggctctgcctcttaatgacagtgtgactatacactattttggtctcatgtgcctacttgtaaactaaggatgatatattcttaggctcatggagctgttaggattaaatatgataatatgtgtcaccatacttaacgcagtacctgcccagtatgccacatcagctcaacgctgatgaaaacgatggtgatgtaattgctctgtgtctgtttcctcctcatctataaaagaggtgtaatatttctattagaatgaaatgaagcagtactttaaagtcactttgatgcccatccactgtagactggataaagaaaagtggtacatatacaccatggaataccatgcagccataaaaaagaacaagatcatatcttttgcaggaacatggatggaaccagaggtcattatccaaagcaaactaacacaggaatggaaaaccaaataccacatgttctcaattttaagtgagagctaaatactgagaacacatggacagaaaaaggggaacaacagacacggagtgtacttgagacagaggagggtggaaggagggagaagttcagggaagaaaaactgctaggtaccatgcttactacccaggtgacaaaataatctgtacactaaacccctgagtcacgagtttacctatgtaacaaacctgcacatgtgcccctgaacctaaaataaaagttgatttaaaaaaaaaaaaagatat

SEQ ID NO: 76188 - DNA, 1002 bp, Homo sapiens
agcaagtgttattggaacacacgtgcaactatcattttacctatggctgctttcaaggtacatgtgcagagctgaatgtttgagacagacattatggaccatgaagcctgaaatagttactctctgatcctttataggaaaagtttactaacccctcatctggtgaaggtacttggagtacttctcaattaccatctgcagaatttagtggggagctcagccttcctaaaagactgcgagtctgtttcagtagctggctatgcaccttttgttctcatgcacccttccccttcccagtgagaatcttgagttttttctgaaatttgtgtactattttctttactctatggatctaccccacaaacagattctgctgaccctgcctgagcagcaccgggccagctattcccacttgtcctctaaccccctgttcatgctggagcagctgcttatgaacatgaaggtggattgggccactgtggctgtgcagactctccagcagctgctggttggacaggagattggcttcactatggacgaggtggactcactgctttccagatacgcagagaaagccctggactttccataccctcagagggagaaacgatcaggtaactgctagcatcctagaaggggattctacatggaggaagaaatgccatgctgcattcttagttttaatttgctccccttttaatattttgggttgatctagagtgaatgaatacacttcagaagagctatctctttattatataggagagatcttggtcttggaggaagtagaataatgaccagaattaaaaggtggtagataaccactgcatgcacataataacataaaggtttggaaagcaaaatatgctggaaatggtctctgtctggccttgatatagcgggctcttcagtgccatcatttggtattgagagtatgccttattcccaggatcacatcggatatcacttgtatgtgagctgactcagcctcttctacattga

SEQ ID NO: 76189 - DNA, 1021 bp, Homo sapiens
aggtaaggatacaccgtgaaatccaggcgctgtatgtgggatccaaggtaaggaggaaaaggaggtgttgggaaggcatacctgagggagagactgcgagcctagctcttcttcagaacttgccttttcaatggctcttttgccaggcacctgccatccctggcctgtgctatatgaaatctttaccctagaagccctctgtatcctagttgagtctcctaggacttgtcattctcttcctgtcctgcctccatagggaattctacctggtcctcttaagttgcctttatggtttccatggtatctgctgtatcaatgcttctcaatgctgacaatatattagaatcacctggacttaagaaaaaaataccaggttattcacctctaccccagatcaagtaaaactggtcttgggatagggactggacatcttccaaagggcttctgatgtaaggatttaaaacgactgcttgataaacttgtctgtgctagtggaagagggttagttgtctatgtaattaggtgagataagttcttacctttgatgtataactttggagacattaatagaagaaacctccagctagaaaaagtaatccagtgaagcagagtttgaagagagctagggccctctggcattcttctaattattctgcctgacagtcctatatactaccccacaaatagaacgagtgctaagagagccataaatataaccactggcccacttactaagagttgaactacataacatgttccttaagaagatacacccaatgtgctgtagctgagtaggggaacccttgaaaactggcagtgaacagggtcagtgaacatatttcaagcctagtgatcgtgacttctaaggagaacttagattcatcgtttacctgtaggacataggaggtgccaggtttcattagactactgacactaccttgtatttctcattctgagtaaagcctcaaataaacagaatggtggcattaagggtcagggagacctcaatcatacctggagg

SEQ ID NO: 76190 - DNA, 1027 bp, Homo sapiens
aaaaaaggtttctttttattcttccttggcagttttcatgcagagctaaaatgttgtatgaaaggtgatcccacagagcattcaagccagaagaatatcttgggtggagtttggggtagaggagcatgggacaggtgaccccagaacaatctgggaagcatgagagcactgtcttcactagtgaaaggccccagtcctggcctccatattcagccttcactccctgcttgttcttcctggataggttcactctgctctctaaataatctttgcccaatttgctctcttttctggcaagttctgacagcctgactttggggcagagatctagggatggcccatctgtggacatgcccagtgacttgttcatggagggagaagctgcagtgtggtttgacggattttcttgtctttccttagattctgggtttgcagtctcccccagtgtggtgtgactggcagaccttgaggagctgttgtgttgaggacccatcaactgtcatgaacatgattctagaagcacaggtaccgttttcctgggtggtgttccccttcatcctcctttcagagttacaaccccttagctggctgtataagcccctttctgcatatcaatgttcactttttaaaaaaataactataccacattctggccgaggcgggcggctcacaaggtcaggagatcgagaccacggtgaaaccccgtctctactaaaaatacaaaaaattagctaggcgtggtggcgggtacctgtagtcccagctactccagaggctgaggtaggagaatggcgtgaacccaggaggcggagcttgcagtgagccgagatcgcaccactgcactctagcctggacgacagagcgagactctgtctcaaaaaataaaataaaataactataccacattcttttttattgtgaaatttgccaaaatccagataagtatagagactaatacaattgactcttttgtattatcatcctgtgttcatacctgagattttctacattgtgtacgttaggtaca

SEQ ID NO: 76191 - DNA, 1012 bp, Homo sapiens
cccgaggttaaaggtcagcaaacccagcttgtcatggaaggaacttcgtggccgcagggaggtgcctctggctgcagagcaggtagcccgggagtgtgagcgccttctggaacaattccctctgtttgaggccttcctcctggctgcctgggagcccctgcgagggtctttgcagcaggggcagagtctggcagtgaatctctgtggttgggccagtctttctaccgttctcctgggcctacattctcccattgccctagatgtactgagtgaggcttttgaggaatccttggtggccagagattggtcccgggcccttcagctcactgaagtgtacgggcgagatgtggacgatttgagcagcataaaggatgcagtcctgagctgtgctgtggcatgtggtgagcagaatgctatgcctccctttttcactagtggtaatatttggtattcactgggtatattatcacatttaatcctcacggtaactctagagagaagccccactataatctcatgttattaagaggagaccaggtctcagaggggttaggaaacttgcccagggtggtaagtggtagagtagagcttagaacccaagtccatctgactttaaacagccacgcataaccagtattctcaatactgtatatcacaattcttgtgaaattctacagactacaaatgtttgggtcccttccccagaggcccaggatagagctcaggcaagtgtttactttaaaatagggatcagcacattttttctataaaggactttgtaagccacagtctcgctcgtaactacccagcccctccagtacagcatgaaagcagccagagtcaatatataaagaaatgagcatggctacagtctaataaaactgtattataaaagcagattgtgggtctgtttgatgaccactgctttgaaagctccccaggaaattctgacgtgtaaccagagtggaaagccaatgagctgtaacactactaggatttcctagcagtgttg

SEQ ID NO: 76192 - DNA, 1032 bp, Homo sapiens
aagtgttcagggcaaggaagagaaaagatgcacaattgaaaggctctggatacagcagtagccaagaacactagatttataaggttgtcctctcttattcatctctggctattttactcatctttgtgctagtatagctgtatagcacatgggagtactcaattaattttcttggaattagcgactcaaaaatatctctgtcagacctgtggtccattgtgaatttgagcacccagcagaggaatcaagtctctgatatgagtaccagattcttaagtccacagagtgagtactacatgcacttcagtcgggttgaagagagcaggagttggctgtccgtggctagatctgcccactgaagttcgtctggggttggaagtctttagagcagtggtaagatatagataaaacttgtggtcaggttcatgttgagaataccctttacctagaatgaattaacagaaggctctccatattgtcttcatcttgacactgtacttttttctcaattctgggaaacagggctctgaactcttgcagtcagtggtgcaaacaaagatcatgttctttacctttgcagatcatgtggaggtcaaggtaggaaatccctttgttctgctgcaacagagctcttcccaactggtgtcacatctcctgtttgagagacaagttcccccagagaggtaggagccacctccatgcaagtcagccatgggccttcggatgatttcatcaatatagccaagggctcagtgcggtggtgcttggggttagcacagagagtggggatttcttcctgactgaattttttattcttatataactgaaaatttaatgtgccttgtttcctgctttctctctcgatacctttagcatgtatattgttaagtatgaaatcagtgggtgactctgcactttataaataggcaaaaatctaaaaattcaataacatgatagttgattagactgtaggaaaacagcattctcagagaatgcaagtgggacataaatttgtacagcctctgtcggaag

SEQ ID NO: 76193 - DNA, 1007 bp, Homo sapiens
tccataaagttgttcatagtctagttggagtgtcaagataccacttaaagcaattaaagaagacatatgatctccgctcaagttgagtacaactgaaggcagtaccaaggcaaatctatttggcttgggacaacaattccataggagtgccagagattctgaatctgctgatgttgttgacagctgaggcatcttgccagagtcagtcctagaatctcaggcatgaaataagccaagtatactggttgtcacccaaaatggcacagcatgtatttcctccttaatattggagaggataaaatttcacaggtaaatacaggactgagtgtcaatctctgaaaacacttcaattttttttttttgcattccctcttccttcatctatttccaggtcgacggatagaccacgtactcctaaatgctgatggcattcgaggttttccagttgttcttcagcaaatcagtaagagtctcaattatctgcttatgtcagccagtcaaaccaaatcaggtgagttgcttttttctcttttcttctcctggacttggaacattaggtcagcaacagactttactttttctttctcatttgctttccatagagagtgtggaagaaaagggaggaggccctccacggtgcagcatcactgaactgcttcagatgtgctggcccagcctaagcgaggactgtgttgccagccacaccaccctctcccagcagctagatcaggtccttcagtcactgagagaggcactagagctgccaggtataaggctgtctgcttgggaacaaataaaagctgaactggggagaggaaacagctgagagtaacgaagcactttggagcagaggcttgggactccagaactgggatctatcagccctttagttagccagggcatgtctcaatgtctcgtaacttaacttcacctgttttcccacctctcaattgaaagaatggtgaacactccatcagctgatacattttctcatgatgaataagaaa

SEQ ID NO: 76194 - DNA, 1059 bp, Homo sapiens
gtactcctgggctggacacactgccagagcctagagtcagccaagaggctgctccagaccctgcacaggacccaggtaactctcactcagcatcccaggctgctctggaagtgagagacgtggggcttcgggcttaggctgaatgcagagccctaaaatcagtcataatctgtaaccccaggtgcctgagtcagcatctctttcttctcccatatcaacatagggcccaggctgtgatgagctcctcagggatgcctgtgatgggttgtgggctcacctggaggtcctggagtggtgcatacagcagagcaggtatggccctgtgcagtcagcgcctgcccaccacagggcacagctgaccctgtgctccgcatgtgtggccatttcaaggcgttttccacataaatgttttgagttggcaatgttgaccagctactaaaaattgttccaacaattaaaccaagaaagaaacacaagtaattattaccttcaccatgacaatcaggtcataactggaggataattttaggatgacagtaacaaaaagaacaatagctcgcatttccagtgcacttaccataagctaggcattgttctaagccctttacatggatgatttcaattaagcctcacaataatcctatgggtagataccaatattatcttcattataaaagtcaggcaactgaagcccacaggtataaaataacttgtccaaagtcacacagctcacaatgtcatccacattcttagtcttacgttatcctggatcacacttttattcaacaaatgcttactgaactgtgcatgaggccctgtgtttctctggtaacttagcctggacttaggtttctatcttgttcttcactcacttcaccagcactttctgaagtagagtaggcagagggggaagtagcaaggggctcttactcaaagtacagccagagaaacttgtgttcatttgaagctggagagggtgtagaaattagaaaattcagtctgtaggacctttctagaccctactgatctgaaaggccctttctaggacctttctagaca

SEQ ID NO: 76195 - DNA, 1104 bp, Homo sapiens
tatgctctgaggcccaatacttatttttttaatgaccctgacaccagttaattaaagacatatttacagtaggatttaagagagggactttcacttgtattaggtaaaggactcatggtcttgcagtccatctctgaggcagttaatgaagtggcatcatcgagtaccatctataggcatgatgcttaagtatgggaaataacctacttctcacccccttctctccctgtaccctcaccctgcaaacagaggataggctctagaggttcttgcttttaggtgactgaggaagaaggactaaaacacacactattatgtattaaatcatatggtactaattttaagtacattgaagttgtatgggttggaggtattggagaaggtttttgtagtaggataaagaatggactgaaagcatggctgggatttagatcaagggttaaaaactgacattcttttaaaaattgaatgtaaatgcctttagatgggcataatgtcttacctggtctgtgagttggcagaccttgattcacatcaccagtacacattttggaggcagtgaggtgggactagctggagcatggaggccctgggcaattgagttcatctcttccagcctccaactcctcatttataaaataggagtaatagtagtgtcttcctctgaagactattgtaaggattaatttgatttttctgtgtaaagggccttagaacaatgtctaacacatagtaactacgacataagtatttgttaccgccactattatataagtaaactgaaaaagaggaaagcatgaaggcacacaagtgataccattccaggcatgcccaccacccatccttttcttcatcctctatttaggagctgtatgagaccttaacacagggtgcagtaggccacgtgcctgacggaaatccaaggagggagagctggactcctcgtctcagctccgaagctgtctctgtgctctgggatctcctgaggcagtctccccagccagcacaggccctgctggagctcctgcttgaggaggatgacggtactggcctctgtcactggcctctgcagaatgcactggtggacctcattcgaaaggcatt

SEQ ID NO: 76196 - DNA, 1489 bp, Homo sapiens
tccttttagaagtatgttaattatcagaaatttatatcttataaaagaattactctgagacattttcatattgaacttcagactttgagatttaagtgaagaacctctaacttagaaatgactggcccaaggacacaccgtaaagttatttgacagagctggtgctgaaaccaagatcttctgacctcaatcctctgctttttccaccttaacactacttttttagcccagatggactttaagaaaccacaaattctacttttaaaatgtctgtaatttcgccagttttttaaatttttgctcctctcggtcaccagaattaattttgtctttggttccacttttgcatgatatttatcgttcctcacagagctgtcaaaaagtaacagaaattgctaatctgaatgtatctcttatccaggatttagccagttgtttaggaaagaaaaatgacagaaagactagtaggagcgagaagaaagaaaaacaagattgaaacataatgaaacccagcatcattaagagttggctatggtttcagatttaaaagagaaaacttgaactaaaatagtaacctatagttactatagtatcttcaaagagaaaaagaactattgttactgattaagggatctctctagtacaaacatggaatttgtcaaatcaaattaactttcccctcagtagagactatttgcttactttatatctgaatggttgcttattttctagacagttgctcaactatgtcaggagatggattccacttcccgttcttgtttttcccaggttcacaaatagattatttggtctttaaagcttcaatgacttgcttatttaaacagttgtgggactattttagttcctcatagaattttaaaactatataagcaccatggcgtccagtgaattcttggggtagttttccaagtccagtcattatcctgaaggtgccttcatcatctaggaatttactggctgcctgtccttttccaggttcccaccttttgccaaaagcttcccttttaattattagatgaaatagtgattctattttccctttcctccattcatttttgccttctgccttttaatcttgcagagatgtatctctccatgtgtaagcaattatacaaagatttagctgcagaaatgttcacgtctatgctacttctattagaagaaaactgaaacaactcccatgtccatagtataggacaggttaataaatggaaatatatctatatgtaaaatactataccactattcaaaagtatttggcaaatgagttttcactaacatagagtgttcatggtctgctgtatgggaaaaaaggcagtttagaaaaaagtacatttggtatacatgcatagagatgtgcatagcaaatggtctgaatgaatggccttagaccacagttttcataattgttctccttcagtgagaatatatataaaatatatatttcatatataatatgttatatgta

SEQ ID NO: 76197 - DNA, 1032 bp, Homo sapiens
cttttttaagactgtctgattcactttctgtattaaaaatatgcttcagatagtattagctattatggttttctcgaatattattttattttaaactaagataaggaggtggaggtgagattaaggctttttatgaaagctgctagctctgttctggttctgatttgtttgtttgtttgtttgtttgtttgtttgttttggagacagagtcttgctctgtcacccaggctggagtgcagtggcatgatctaggctcactgcaacctccgcctcccaggttcaagcgattctcctgcctcagcctcccgagtagctgggactacaggcgcctgccaccgcacttggctaatttttgtatttttagtagagatggggtttcattatgttggccaggttggtctcgaactcgtgaccacaggtgatccacccacctcagcctcccaaagtgctgagattaccggtgtgagccaccttgcctggcctggttccaatgttttactgaactgtcatatacatttaaaaatatctcattagggcagtgtcttgcctgttcaggtttaaaacagaataagcaatgaaatctgtcttggatgacaaaagatgaaagatcagtagaaactcttttttacaagtctttctttttacctttttcagatgtgggcaggacatcaaccctcaaagagtagcctgggtctggcttcttgtactggagaaatggttggcccgggaaaaggtaagtaggtttatattaaattttcctccgaggccaggactgagaagaacttgaaagtagttgtgggatttcccttctgtctgttacttcctttatcattaaattcatcatactcattctcaaagaatggcttaaatttttattgctgtctccttacctaaattcattcattaatgcactaatatacattggcatatattactgtttgttaaataccaccatgagtcttgtgcctaaagagaacttttggaaactcagtgaaggtaacaaaatagcaaataaaatatgaatctgtaaca

SEQ ID NO: 76198 - DNA, 1231 bp, Homo sapiens
aggtgagtgtaagacacccctgagagggaggggcccctctccacgacccccgcagagagcgtccctgcggcccacccccacactgctttccacttatgacacagattcgtctcctggtcgtcaatcctctgccttaacagagggctcaaactagggaggttcctgctgaatttctcattcttgaggaggcgaccacctggggatttggagtcaagactgggcataacgttcagtagggaatacggacgtagagttatgggtctgcgcccggagcaaatatgactattaatattattaaatataggaatccgcgtgaagagatgggatccaccccttgaagaaagtgttttcaaaaagtaacgtgggaaattaaactgaaaacgatacttaggcaagcaagtcccgcctttcccaggcggaccagtagttgctgctttgtcttaatacagtgccttctgtttcttctcactggcgttgtgttgtttctaggaggtactccgcgaatgagaacattgagaatgtgttcggcataactcatttctttgtatctccctgcactctgtgctgggaaaatgaatcatccatttggaaaagaggaagctgcttcgcagaagcagctttttggatttttctgcgaatgcctgcggaggggagaatgggagctggcacaggcatgtgtacctcagctacaggagggacaaggggatatcccaaagagggtagaagacatacttcaggcattggtggtgtgtccaaatctgctgaggtaagggatctcttttcctaccagacggtcccagggtgagagacatgtggttcaatatttgggcattggtcaatgtgcccccactcaactaccctctgaagaataagcagaggcacagtgtatttcacgtgctctgaaattttacctctatagtatacatccattacttagtcaatattggcttttgattatcatctgcaactgaatgtaagcctggctgccaaagtgtgcctgaaactgccatttcttgtttatcctcgttaatatagatggtggaactgcattgaaaactattttctttgcctccaaaaaagcaaaccctgctctcttcttgcttatgagattgaaaatattgttgtcgctttacttaaaactttttatttcgaaataattgcagtctcacaagaagctgcaaaaataatggagtccagcgtatccttttcccagtctgccccaattgcgacg

SEQ ID NO: 76199 - DNA, 1006 bp, Homo sapiens
agaatggcgtgaacccaggaggcggagcttgcagtgagccgagatcgcgccactgcactccagcctgggcgacagagcgagaccccgtctcaaaaaaaaaaaaaaagaaagaaaaaagaaaaatttccaaacagggtgttcccttgtttcacattctctttggtgatggtcctgcaacagattttgataatcactatattgagaaactgcttcagattcgatctgttaggctgatcatagtattaactacaattcccagcaagccgcggagccaacctgggcctctgccggcctctgattggatacagtagccagaatgacgactcaatcagtgcttcggttgttgctttgcggcgttttccgcggggaaactgtgtaaagggtggggaaacttgaaagttggatgctgcagacccggtactggaaagtttcatgtggggtgccgttgtggggaagtggggttcgctcattatttcctgctccttccctaggctcgtgggtttcgatattgggggagcggagattttctcttgggtgctggtcacgcccccttaagactcgggatcgtcactaagaaccccgctgtgaattgggggagcttcgggccttcttttggtggggaatgcttggaagctgctcattgttggaaaaagctctttttaggggattctgggtgatgtttccgcctgttgctgcccatcttcctccccagccccttcccgcttcgggcagcctgtcattaggggaagttgagggactctcccacttcaggtggtgttggagagcgtggaatctggagtccggtccctggattcgaatgcgagcttcacaccaattgtcagctgtttaactttgcccaagtttctcaactagttacctcagtatccttatctgtaaagtgaggtaaaatatccgaagcctttggaacagtgtggcacgtaataagggctcaataaatattagctaatattgttcctaaacagttgttgaacatctaacatgaaga

SEQ ID NO: 76200 - DNA, 1048 bp, Homo sapiens
cttacttctctagcctcattgcttgctgtgctacacccacactccatctttcaaccattctaaatgaactgtatatttacagtttgtgttagtccctgtttcctctcttgcttcttgacctttctttgtacattctgtcctctttggcaggaatagtcaaatttcctttgcttacctaacagctctttcagattttagcacgggcatccagcaattccattaagtttccaaaatctgtatcagttatactttccctattacaatatctcttattaattgtgttgtaattgcctggtttctagtcctaatttcatagtccctggttgacttcataagactgtgagggcaacgtctctctctttctgttatgtcatatccccataatctagcacagtccctggcacagagtaaatatttgttgaacaaataaataatagaagggaaaaggatggattagggttaaaattgctaaaatttagagaattaaagttggtttatgtttttgaatatatatagaggttgaaaaaaaacttaatcattttcttgtttaggcttatgggataaaagcacaaaggtctgctgatttctcaccagcattcttatctactaccctttctgctttggacgaagccctgcatggtggtgtggcttgtggatccctcacagaggtaaaggaaaaatttttcgtaccttcttccattgacctataaccttcagagctagggaaaaagtttagttaaaaaacataaattatttctggaacggtaatctgaattaaattataagtacttcaaggatatggttctccactcagtacttagtgtggttgttctgcaaacagaggtgttaaaaacaaaatccttgctgactgattaaaatctacttaggttgctgtttcattgagttaacttagaaagtgataaatattgctgggtgtgtttatatatgtgttatatatataatgcatacatatatgttatatatacatacatgcatacatacatttatatgtacacacgtcacatatatgtaatatatacacatatgt

SEQ ID NO: 76201 - DNA, 1088 bp, Homo sapiens
ctggctaattttttgtatttttactagagatggggtttcaccatgttgtccaggctggtctcaaactcctggcctcaggtgatccacccacctgggcctcccaaagtgctgggattacaggtgtgagccactacacctggccaaccttttggaggaagaagtgtcaggaatttgaggacattttaaaaccactgcagttattttccttgaaaactgcttacaatgtggtgacttcatagacaatgtttatcaatacactcctgaggacttcttgcttgaaagttctaggggcataaatactttcaggaaacttctaaacaagaacagattattttcttacattctgatagtcataatttaactgtggattttttttccttggagatagggaccctgttttagatactatattttatttcctgtcttccaagagagatttaaagatttatatgagcaacacctagcagatgcctattaaatagttggtaaataaatgcgtgaattagttattaataaaaatgcacacacacacatacacacacacacacgcacacacacacacatcctcttcttttggaatatactgccaccaggtggtgccagaatcacatgattttacataaactttttgggctgaagttccacttgcttaaacaaggtttattacagtgtgatccacagtcataaacttacttatttaaatagcaaaaacattgaacttaaggaagattaactgggaaattctttttactttttaagttttagaataatttttaatactttttcacttagcttttattaattattttttaaaatccaaacagaagttacaagccttttaggtgttttgttgttatctaattggctgacttggaataggaatataaatactttgactccttagtaggggcaaattctctcctttctgttctagctacaggtagcttcttcaatcttttttgttttttgtttttcaactgagtacagggagtatatcaaattatcctcaaacagagttttttttgcttttattacaatttttaattgatacaataattgtatatatttatggggtacagtgtgatatt

SEQ ID NO: 76202 - DNA, 1018 bp, Homo sapiens
agaaagtgtatttttctggaatgagacatgaagacttactgatatctattataatacaatataccatatttgttcaaatatacttatttcattcaagaaaatgaaagcattcttatttagtaaacatatcttatagctgctactctaaatatcacttacaaaaaacatatttaatcccagaaagataaatctcaagagacattgttgtttgctcaagattagatgagatccaacagcccttgctggttgcatgctctgactgctaacctctgttagtgcttacaaaagagagcttaattctaaatctgtatattaagccattttgcttatacctgctctattgataaggcttaggagtttctcaagtaaaattaattagagattcagcaatgtggctttaagtagaattgactgttttcgtttgtgctatttttttcacccacagactggttgaaatagcagaatcccgttttcccagatattttaacactgaagaaaagttacttttgacaagtagtaaagttcatctttatcgggaactcacctgtgatgaagttctacaaaggtatgctgctttagattttgattttttagtaatgcgttgaaggtttatgttttatcttttatgtttcagcttctaagtgaaaaaagtctttataggttagaattatgtggagtaactttttcagtgttcttctttgttatagccttttggttgaagtctttcttgaaaaacaaaaaaaattaaatgaataaaatgttctgtatttaattaattaagtggtgtattatttatctattgtttcattaacaaattgtctcacagtttagtagcttaaaacagcaaatacatattatttcacatagtttctgagggttaagtgtctgggagtagcttagctgggtgtttctggctcaatgtcgctcaagaggttatagtcaagctggtggccagggctgcagttatcttaaggcttgactggagctggagtacctgcttccaagctccctaatatag

SEQ ID NO: 76203 - DNA, 1723 bp, Homo sapiens
ggcaagtgaaagagtacccaagatggaagctgtagtcttttataacccacactcagaaataaggtaccatgatcttgtcatatgcttgtggtcatacagatcaagtctggcacactgtgggagggacctatacaaggatgcaaaataccaagaggagggagtaagtgtgggccattttgcagactggctaccacaagtagttttaccccagaattggagcgttaacattatcttaggagaatcaaggaattctgaaactacacagaaacagtttgctctgtttccagaaaagtatgatatgtctacaagttaggtttactgaattcttgcaaatcattactgtaacttaggaaagaatagtttattgtttttaagttgcttagcctttgcaatacctttatttatttattttatcttaaatttattgactattttataaattcttcttttataggattgaatctttggaagaagaaattatctcaaaaggaattaaacttgtgattcttgactctgttgcttctgtggtcagaaaggagtttgatgcacaacttcaaggcaatctcaaagaaagaaacaagttcttggcaagagaggcatcctccttgaagtatttggctgaggagttttcaatcccagtaagtttttctttttttctcttttttcttttcctttcttttgtttcttttatattacattcactgacttatggtatcaaataataaaattagaggaaaatgtaaaacagatgactttttaaaggtagtacagtctaattgctatagcaaacatcgccatcatcttaaattagctcatctgctgagattattttattattttaataatttgagtctggagtagatttaaacgatgtttttaaaagttcctatagtccctccttttcttccttctcattgtttactctttgtgtgtgctttgtatcacatttctcacactgcagtaaatataaagtagtaaaacttcatgaaattgcctagatctatttctatataattaaaaaaaatactgcagttgttgttagttttgttttaagtattttaggtttagatactgtgttattgtgttcagcgctgttttgtgtacaataggatttggtttgcttcaaatggtcagaggtcaaccattaagagatgttggaatgatagtaatgaaagtgtcagtaagaaaaccttgaaagattatttgtggcatggctttttgtagcgggcattgtgatcagaaatctgaagatgacaggctattacaagggcttgtgatgtgtaacctgcaagacgtaagtgtgtactaagttacactcccatctgcagtgtgtcagggagttttagtcgttgttccacagcctcatcaacattcaggcttctcaattttagtcatgcttcatctcaagaaaagatagttccttaaactgagataaaatttggttatgattttataatttttagatttgtttttggaaaattaaaatcttggatctttgcaacataaagaatatgtataaataatataaactatcacacagcctttgaggtttataaaaccaaggaagaagtcaagggagaaaatatgacattcaaaaagttctgcatactttaatggctttttagtttatattttgaattaaagtcaagtgctgttaagtttgtcttgggtgatgttcatcttttacattttattgtagttggttaaaatgataaattcaaat

SEQ ID NO: 76204 - DNA, 7474 bp, Homo sapiens
ttgtttttaatagaaccctctgaaaaaataggtactgaatatcccatttctatgcctttggctttgtttctctatttagaaataaatgcagattatactatgtacttatataactgtgatatctgttttttgtgacaattaagattgtaagattggttttaaaaggattttgaaaaatatttcctttagaaaatgttggaattttcctagctaaattgatacatttaaatggaaaatctctcacacaggtccgagatttaattaaaaaaaaaaaaaggaaatcatgaacttttacacatttatactgtactttgaacaggcaccatagtactgttcaaattaattatgtcaatttaatatgttatatatgataatttgctaaattaaattattgcttgctatatatataagcttacctcacagattgtcttgaaatatgtatataaatataaatatataaaaataaaaaatatatataataaaaatatataaatatataaaatgtgattattcagcttttccccccctttctctatttgaactagtactagaaaacctcgtcttttgggaagggtgacatcatttggcccttatgtgcgcatgaatgcatttaagttttaagtatgctgttgcttttttctacgttagtccctgagaattaaagaggaattaatcgatatcacttgattgaaaacagatgtattaatatctttcagaagttttcaattataagatggctttactaatattttgaggctatcactgaaatgaaaacataaaattaaaaaattttcacagagaattttatagacctttgagtatgttcagactgcagttttgagaaacagttgtagaagtctggtagaatcttttctcctgaagtttatggaggaggtgtaagtgatactctgccattgggatggaagatgcggaacctttgtctttttaaagtgttcacactagtattgaaaaaacagtaggctctgaagctgtttagagatactggataaaagtaaccgaaaaaaatttaaatactgctttataaaataaattgtggttatggctatttatgttgactttatcattgacttctaattaccacgtacagaatagttattatacgtattgtaaattatgtatcagattaaaataataggatgtttttgccagaaaggaccttaaagaaaatttagtttggccccttcattttacagatgacaatgaatccgaaaagtgacctgatttgctccaggacactcaacataggaaaggacaaacagtgggtagaatgagagatcttttagctgccagtttggggatttttttttttccacagcagaattttctttttttctgagacatacagaattacggtggactgtaaacttctttttatttatttattattattattatactttaagttttagggtacatgtgcacaatgtgcaggttagttacatatgtatacatgtgccatgctggtgcgctgcacccactaactcgtcatctagcattaggtatatctcccagtgctatccctcccccctccccccaccccacaacagtccccagagtgtaaacttcttaatgacaggattatattttctgtttctctgatttccaggacctagcactgtggataactaatatttaggaggtaacagctaatgaaagtacaattaaggtttatgaaaatagtcttaccatatgtatgtcatatttacattcattggaatatttttctttatcttttaaaacataatttgaatttttttatgcttgctgctgaaattcttatgtttttgtttttaaattgacctttgtagtatgccatcttagttgtattctttttatttattttccattccagagttttataagttgttggaataaaagaaaatgaaaatgcattgcttagataacaggactttcaccttttgaaaattctttggaaatgctttttactggtatttccaaggtctacatttttactttttcagagaattcaacaaatcaatttcagttgttatatgaataatattgaacttttttgtctccccttaatcttcttctacttccttcatttcttgatattgtacaaatgttttctggtgtaaggggaggagtaccagttaacactatttacaaaagaggtttatggagataaatttggatatattattaaatattctaagagggaaatgccttattttcattgaaagttgttgttaaaatccaaattattttactaagatgtgcttataatccgtttttctgtggccatctgtgttcttgattacatgccttttgagaatatccattgctctaatttattgcttatcaaggtttttggaatattagtgattatttttatgtttaaagctgcttagacaaatgaatcaaaatatgtgcattttaaattttgctattttaaagacagttttaaatcattaacaaatggaaagaatttgttctggttttaaagtggacatataacaaggttaaattttttattattatttgagacaagcacaaatttttttttcctctttttaatggtgaacttcatgtgggcctggatttatttatttatttatttattttacaccatgagctgttccattatgccaagtgggtttaatttatgcaggattataccttgtcttagatactaataaatattcaaaatagaaaaataagaaactaggccacttcatttaaaataattaaggttttattaattataaattgggaatattgtgtttataactggtgagataagaggaaaaagaatgtatgtacccaaattcgacatttatttttatcttaaacataaatattcagaactgtcacttttgtgaaagcctgatgaagtcactctgattgtaaagtaggaatcctagacccttgatgtagacatagatatgccattaaaactgcagtcctgttttgctgtgtgtaacattgttgtatcacttttctagaaatgtaatttttggtttactcttattactttcatatttttactgaaaacaagcaccacaggacttctgaggtaagaaaagtcctttacaggatttttcttttccataaatgcttactgttggctcactcacatttgaaatcagattgttcttaaacctatcctatgttcattcaggtccctgaaactcacagtctagactaaacctttatcagttagtgaaaataattctagaaaaagtgtatctttcttttatgtagctctttatgacttctgaaactttgtttttattgtttctagcaaaaacctagaaacaacttaaaagttagtaagtaggtgattggctaaattaatgttgacatatccatacaatattatattgtgccactgttacaatgaatggtttagcccagaaatggattcataggttatgcaggcaagggttaattcagctagcatgggttactcatatccagccattcccaaaaaaggcctcttttcaggactgcccttgcctggctcctgggagatgagtgctgggccctgggaatactctgcctagtaagggtgttatatgcctgaggacttgagccacaggtactggtttgatcagattgtttatgcaaacagtgtgatttatggtgaagcctatttttctctggggatctggggactacaatctaaatagctgaggtcatctgcatgcaggcattgcatgcctagtgactgaccctcaatagaaatgctggacattaaggcttgagtgaactttcctggttgacattactttgcatgtgttgtcacacattgttgctaggacaattaagcacatgcatgcgactccactgggagaggacacctggaatcttgcacctggtttctcctggactttgcttatgctccttttctgtttgctcattttgatctgtatcctttttctgtaataagccataactgtgaatataacagcttttgagtcctgtgagtccttctagtaaatcattgagccagaaggtaatcatggggaaccttgacatgcaggggtgctaatagatatgtacaagagtatctatggcagcttaatttgtaattgctcaaaactggcaagatgtattgtagttaatagtattggcatcagtcttaatacattggctttgataattatggtttgtaagatggtgatattaggagaagctgggtgaagggcatttgggaactctaccctttctgcaactttttggtaaatctaaaattgtttcaaaataaaaagttaaaaaaagaaaaggaggtcaggtgtgctggatcacacctgaaatcccagcatttgggaagctaaggcaggaggatcacttggccaggagctagagaccagactgtgcaacatagcaagacctcatcttctcacacacacagacacagacacacacacacacacacacacacacacacacacacacacacaaaaaaaaacaattagctgggtgtggtgctacacacctgtagtcacagctacttgggaggctggggcgggaggatggcttgaacccaggagttcaaggctgcaatgagctatgaacatgccactgcattccagcctgggcgacagagcaagaccctgtctcaaaataaataaataaatagaaataaataaataaatgaaaaggagagtagggcgggttttatgagtagaagttggctctgggtagtcataaagaaatggcactggctgtatttggagaaggggacttgattttgatgcactggttctcttctatttagtcatctggtcccatacatattatctaatacctcttcaatttaaaccctgctcttcatctttcagcacatcctcttggctccgctttcgaaatacattcagtatctgattactttctaccaccttcattgccatcatcttggttcctggaggctaaaagtactggctttggagttagacgttggtttgaatcttagctccactatttgctaattttatgaccttgaataagtatttatcccagctctaacctttcgtttccatgtttgaaaaatgaggataacaatatctgactcatagggctgtgagtattaaatgagataatgtctgtaatgttcttcacaatgtttggcatattcagtaaaaagtagcctttaattattaattttactagttacctcgttccagatgcctggtgtattttatctctttcctcctaaaatattttttaacaaggctgcaagtgcctcagaaggaagaatcatgtcttattcactattgtatccccctctgtctgtcttactggtggatgctgttactgcctgaaccctcctttatctggttaacttacacttattttttggatctcagactctttttgtctttccttttcgattccacctacagcacttgtgtccaaaactccatgctaggaacaatgggataataaagatgaataaaacatagtatttgcccttaaggcttctacaaataaggtaattgtagaggcaaatcgctctctgtgatataatggagaataaaataagtatcttgtctactgttcctttcctgtttcttaaaatatgtaagtagcttgtaagtaacttctctgtctgtcctttgtttgggactatagattacacagagggaattaaagggaggtagtagagaccttcatagtctctcgggtaaaccctttatcatgtctagctttggtccttaaatgtcccattctttttttctttttattttttgagacaaggtctctctctttcccaggcaggagtgcaatggcgtggtcatagcttactgcagctatgccgagttctagtgatcctcctgcctcaacctcccaaatatctgggactagaggcatgtaccaccatgcctagctaatttttttgatttttagtagagacaggtcttgctatgttgcccaggctggtcttgaactcctgggctgaagcagtctgcccactgtggcctcctaaagttctaggattataggcatgagccactgtgcctggccagggttccattcttatttagaaagtcagtgctcttttggagactgataggtagtggttaaattcataaagcacatgcataattctaaagttgtatgctaagaaaacattggaaatgaaggccagttgtagctcttagtctttagcgttactttacgtatgttacacagtaccttgatttgttgtagaattttctaactgaagatcttaaggttgtagctgagtggcaatcttgttttccagtgagtacagggatgcagagaatgaggtgatttatgtaagattgcttaaggagtcatttggataattgaataatatcacttgccgcttccatcctgggttgttattgtagtatcttaatgggtctgcttctctcttttctgtatcggtaatagtacatatgggtacataccattgctacatcattttcccaaagtgtatttctgatcacatccctcctatgctcagaagcattgtatggtaccatgatgcttatagaattaagccactagactataagcagtatgggggcagagaaactatttgttttgtccacagttgtatcctttgaagctaggacaatgtatggcacataatatatgctctaattaatatttattgaatgattaagtcttagtttaggatatgatataatatttaaagttctcttccttctggctccaacctactcctcccatgttgtcatttctcttctgtgcaggctgctggtatactaccccgagacctctctatggctttttagctgtggatgtcctcttctttcatctcttcctttctaaatttttttctttcctatctgagctctcaagttctgtctctcctctgagatttttgtatcactgttttagccccagttaattctaccttcttttgtagtacacatggtcttaacttctaattggaactttaattatgtatttgccttgcagtgtcacttaaatatttgcatgtatatatctgagctcctcagttatattataaagccccctgaaaacagaattatgttcttatgcatcctccatagctgcctatattgaatagtgtcatatattgagtaggtgtccaatatatatttgtagaatgatgtatcacactttttctagttaggcaatttttgaaatgcatgtctaattagatgcctacttcaattcttacactacttaaagggaaaacattctaacattcattctaaaaattgaaaagatactgggaaactaaaacttaagtgtctcccctgcacccctttaaaactgaatgtagaagatttgttgataatttgacagctctgtacctttaatttagtatgatgcatgaacttctgtgagacatcaaccaagattttatacgaagagctgtgatcatcaaggtgggaatttaacatcagtgctctgtacacatagtattactgtaatgccttctttagaagtttaacaacgtcaggtg

SEQ ID NO: 76205 - DNA, 1077 bp, Homo sapiens
ttcaaaatacttgcactttagacctctcttggggaacacatgaagtaaggctgcttcctaagattctgctttgaggttttatgaagacacaatacatgctgttactggacagaagacattttagtttcatgacattgccaaatgtatctcgtaaaattcactgttcatgaatttaattaaaagttcttaggagcttaaaacttaaagtaggtattttagactcatgactcaaaggatcttctttcagtttgtgtgtgtgtgtgtgtgtgtgtgtgtcatacacacacacacacacacataaatatatatatttgaaggagttacagttctaaactaaactggaataaagtaatgcccatagttattaagtactaaagtacagtattttaaagaaatgttgaaattgttataatatgaagtttcttagtgcccctagcttacagccactaaagttagttttatatctgataccatattgtaatgaatttacttttttgttctgtatgatctttagcttagtttactgggttgcccaataacatgggattgacctgcctgctaaccttgtgttggagtctgcttagtccctagttcagctaggtccaagtttttgtctcatgaccaagaagaataaggcttgcagccactggagagtaaatagagtagaatttattaagcgaaaggaaagctcttagcaaagagaggggacctgaaagcaggttgccagaaataggactgagttctgggtcttttatgtggcaagagcaaggaagccttctgtgggttctgcccaaaatgggagggctaaagttccctcctaaggatgttgcatctgtgcatgcctggggttgactccatcttagttattacccgtgagtgcctaagcgaaagccacaggggtactaaaaccacaatgcgaatgtcatgttaatggcattataatgagttgggccaagttaaggacatttaggttgacttattgcgcctgtgcctaagttgggatggtcccttctgagcaacatcctggcatgagggtaagttcttaatcatatttcttctcattagctacagggacag

SEQ ID NO: 76206 - DNA, 1018 bp, Homo sapiens
attacttaattggtacaatgtatgttattccagtgatggatacctggaaagtcctgacttcatcactatgcaatatatccatgtaacaaaattacactgtatcccatacatttatataaatgaaatgaaaaatgaaagaaaataggagtttaagtaccatatgtgttacaactagctgtgcaatcctggacgagtcagttctcatttctgagcctcagtatccctatctgtagaaagtggctaaaagttgctacctcataaggcttaatattattactaataatattaatagatgaatagtaatatatttccgattactaaactttatagaggtttttataatttataagcactttcatatataataattttatagggatgtatatttatctatatttctgaaaggactttgtaaattctgaagcactacgtaacttgttagttgatagttccataaccagctaaatctgatttagtgactgtttttatccttagttatttgaacaatgaatcagaattttctaagctcagataatgcacttaactcaatttgttcagctaaaataaaagttttggaatgttttttaactagtgttaagatttgttttaaaattagattgtaacgacatctggcttttatattattatttaaagatgtagaaatggtgatgtagtaaaaatcatgagtggttagtagttgggggctagtgtcatttttaggagttgcagtgatgaactctatccactaaatttagtgatggatcagtgtagttcttttaaaataaatatttagtactttatgtttacagaggaccctgcaattattagttagcttataccaatatttattgctatataaagggctgggcaagtgcctataatggccacctttggagaggatttacaggcacctttgagaaaacttcttttttttttgaagatggagtcttgctctgtcacccaggctggagtgcagtggtgtgatctcggctcactgtgacctccacctcctggattc

SEQ ID NO: 76207 - DNA, 1843 bp, Homo sapiens
ctttacaacgttagggctgaataaaagatagaatccttatgaaatagtgagcccaatgtcattttttttttttttgagtcagagtcttgctctgttgcccagactgtagtgcagtggcacaatcttggctcactgcaacctccgcctcccaggttcaagcatttctcttgcctcagcctcctgagtagctgggaccacaggcatgctccaccacacccggctaatttttgtatatgtatttttagtaaagacgaggtgtcactgtgttggccaggctggtctcaaactcctggcctcaagtgatccacccatctgtgcctcccaaagttctaggattacagatgtgagccaccgtgcccagccccagtctcattttggaaatagagcagagacagatggaaaactgttagcccttggtgatgttattgagcagtgttatctgtgggtttccagatgtgttaatatatgtattttcttattaagtcctttgcattgaaatggtggtgcatggactggcagcattagcattacctatgagtttgttggaaatgaggaattttagactgtaccctagttcaattgaatcaaaatccattttaataggatccccagataagtcatatgcacacaaaagctggagaagtattattttacaccactttgagttggatttttatttactcgcaactggatgcatcctgatatgacattctggagttgttgtttgttttcttgtttgtttttcctgaagaggtacaaccttctccaggcatgctattgtgaatattggaggggtgccatttctgattataatagaaacagcatttgttgagtcatgatacagtttaaatagttctcattatactttgatatgatttttttcatttttttaaatggttatttttagatgaaacctaaaactgtactctttactacttgtggtaaaaaagaccctaccgttatttttggcaagtcaggagatgtaaccttagctgtgctggttaaaagccagctttgagagttgcattttacctcccttagaattactccttcccattctttcctcagctccattcctatttcaactagatagttttgtactggacctgtgttccagaaccattactgtctggggagcgactcttataaactactgccttttagaccagatgtgtgtttcagttacatgaatagagaaaagaatgtcatccccctgctatagctgtgtatatgatagcatgaagaaattaaatccaccagcaatctaggaattttcagaaaatttattttcttctactctttatacaaagccaggtgccacattccataaaaagcaaagcatattttaaaattgtacttcttgtttgtccatttatttagagggcttaattagtctgtagccagatattttggatgattcaattcacaaattagattatcgttctgtaattaactgagaatgatctctctgtggtgtgctttatagtgagaattaccaaaggtctgtattcactcggaaaggtcttagttttaaaagcagtctttttaaaggaaatgtagctatgctcattgattttgttattgttgtcctttgagtttttatggtacactaggcattatgctaggtatatgaaaatatgtctctaatccctgttttagacatgataacattgaggctagagagattatgtaacatgcagaaaattgtatagttatatgaacccacggctggtgctcccaaaactcattcatccccttgaggagttcagattctactgattgggagagaaagagctcactgtaatagaatgcaaaatgtagtaaaaattttaaatgaagtaaa

SEQ ID NO: 76208 - DNA, 1497 bp, Homo sapiens
agtaaaatatggagtcaccaatgtgcatgttcccatctgaagctgaataaggtgatatctaccttcttgtttcagctgtcatattgtaaacaagtgttctttttgtcggggatgccacctcttccaaaacacatggtctgagagtgtggaggaatagttttccaaaagaaatagggtatatcaaatactacatgttctcacttctaagtgagagctaaacatcgggtattcatggacataaagatgggagcagtagacactggggaccattacagggggaagttagagggtgggcaagggttgaaaaactaactactgggtgccatgctcactatctgcatgatgggattatttgtattctaaacctcagcatcacgcaatatacccttgtaacaaacctgtgcatttatacccccaaatctaaaacaaaagttgaaattatgttttataaaagaaatggggtatgtttatcagaagaagggggggattaggtgtcagtcagaaacaactgtctactgtaatacctgagtaagcttttattggatagatttgaattggtgaatgaataaattgggtcttggagaaaggaaagggcttgaatgagttctttcagaataggccttttcttttctcaaaagtaccagcaatagcttcccattttttcagaactgatacctctagctttattggcttttatcatctttgctggagggaaatgacgttgggttaagtattgagtgtgaaggaagatagcatgaggatcttgtttgcctgcagctttattcctgcctgctagacctactgccctttaaagacacttgaaagggcttgccccagctttcctcttgactttagggggcaaaagtatgtcattcttatataagagttggatttataagattgtatatcaaattacatactcaagagttggattttgtttgttagtattgtctaaagttacaacatgtaaatagtctgtgtccttactttctaagcctgccattacaaaaagaaaataatatttcctattagagcctgaagcttttttcctccctagctcttatttagggagaatatataatttaagtgtttgaataggaatagaggaagtagccaaacacttttcaatagtccagctaaaatacacaatagcacatgtttaaagtacatctttggaagaaagatttgaagatccttgataagataatatatcatgtaccacaaaggcatgccctgctaagtaaaagtgggaagaagcagtacatattctattagggggtcagaaatctttaaatagaagtttctctggcaatctggttcccagatagatagttgaaggctcaaagaaatttccaagcttgctagaaatttccatctgctggcttttgtgttgagttaaatgccatcatattttattgcctcatacatttgcattaacactttccctttaaatttacttaaagtattttttgttttgtttcatttttgttttttttt

SEQ ID NO: 76209 - DNA, 1147 bp, Homo sapiens
cccaactggtgccactctctctgtggaatttgcacattctccccatgtttgcatgggttttctcctggtacttcagtttcctcccctgtcccaaagatgtgtgcattgggtgaattagcgtggcccctgtttgagtgtttatgggtgtgtgtgtgttagtgtgctctgcgatgggatggcatcccctccgtggtcagttcctgccgtgtgctctgactaccaggataggctttgctttcagaaatctccagataattagcttcatatatttctgtgttcaggtgctttcagtttctgcagctcagcaagcgtccagctttggatcaagttgccagtgtgtccttcttgcagatatcttcaccttgcaatctgtatgaccaattattttgaagtgccaacttaatgaatgacccttcgtggtgccagactcctaagctctcccttgccttctcttagttctctctttggtagagttggttgaatgcaccagtgagtttgttacttctcagcaaaccttgggggagatatctgaacctaattgttggtgttctcccttagatttgggctttattgcctcttgctgtcagctttgggccctagttactgattctggaaaaagtggaaaaataccccttaacatcttgttagattatgaataggtaagtttaggaaatattattgcaggtagaagaaaacctaacaggtttttattttctaatgtttaaagagacatttaagtaaaagatctcaatggaattatacctttctttttgttgttgttgttgcagatagtatgtacttaatttttttttttttttaaatttcaataggtttttcaggaagaggtggtgtttggttacatggataagttccttagtggttatttctgagattttggtgcacccatcacccaagcagtgtacactgtacccaatatgtagtcttttttttttttttttctttttgagatagagtcttgctctgtcgcgcggcctggagtgcagtggcatgatctgggctcactacaacctccacctcccgggttcaagcgattctcctgcctcagcctcccaagtagctgggattataggcgcctgccaccacgcctggctaatttttgtatttttagtagagacgaggtttcgcc

SEQ ID NO: 76210 - DNA, 1529 bp, Homo sapiens
ctacttagcaaagcaattgcctgtgagagcagctggtggcagtctttaagatgcagatttcaaataggagagaaaggaagagataaagataaaaagagaggaaagaagtgggagggcaagagaagagaaaaggagaaagtaaacaggcgtactgtgaaggaagtagtaaaatgccatcagtaattagctcaggaaagtggtatttatggcatttgttgcttaccattgtttcatttctttatttatttgacacgtatttaatgggaattaggaattctggctgaggatacgagatgctgtttctaccctcagagagttgatagctaaagggagtttaaaatatctcaacttaaaatcttgacccccttcctgtagagtatgttaaataatacatgaaataataccttttatttttagttttatttgtttcgtattctctatttcattcccctatcagagaaaagagtttctggagtactctagttgacatactttgaaaattagccccttgagggcagggagtgtatattattgaggaatctggagcatgttgttccatccctgactcttattgatgggggggaatgtccatacgttgaacgaatggtaggatcagatgagaaacctcagcaaggtgtctcctggttatagtctacagccttcctggctctttgtagaatttaggcttctgactttgaatgctttcctgacagcaccatactctcctctgctatatagcacactatcatattgcctgtttacgaggcatttgtgtttctccacagtgatgaattcttttatggtagggtctgtttctaatttaatttatttatgtagtttcagtgtttagcaggtggtgagtgctcaataaattttggttaaatgaatgaataaatctgactaattatagtgtacttggtataagataaatttgtataggaatccttttggagagagttaatttttggatatgccagaaagaccatcctttaagattttttttacatatgtgaggatgattaggcaattactttgagtgtaagatatggtgcactttcaaagataaccagaagatataccagttgtatgctagagatggatttgtagtgccaattctacaaatacaactcttaaaaaagtttttttttcagagacagtcttgctctcttgcccaaatgggagttcaatggctcgattatagctcactgcagctttcacctcctggggttgggtgattttcctgcctcagcatcccatgtagctaggactacaggcacataccatcaggccatgctgattttaaaatttttttgtagagatggggatcttgctgtgttgcccaggctagttataaatccctggcctcaagggatcctcctgctttggcctcccaaagtgttgggattagaagtgtgagccactgcccctggccaactcttttaaattttaaagtggattctgttgcgttgtcttagataagtagcccagctgcagtcttcttgtttcttttttctaaaataataggcact

SEQ ID NO: 76211 - DNA, 4248 bp, Homo sapiens
agatataatttacataccatacaattcacccttttaaggtacacaatatagggttctttttttagcatattgacagattgtgcaacgatcaccacagtctaattccaaaacatttcaccaccccaagaagaaaccctgtacccagtagcagccactctctcactctgcatttccaccttccccaagcccttggaaatctctatttgctatctctatagatttgcctgttatggacatttcatgaaagtggagtcatataatgtgtgttcttttgtgactggcttctttcatatagcataaagttttcaaaattagtgttgcagcatgttatcagtattcttcattccttttcattgccaaataatatactgttgtatagatagaactcattttgtttatccatttatcagttgatggacatttggtttattttcacattttgggtattatgaataatgcagtaataagcatccatgtacaagcttttgtttggacatatgtttttatttctcttggttatatccccaggagtagaattgctggatcatatggcagctctgtgtttaataatttgaggaactgtgaagccacttttccaaagtcctaccagcagcgagctagggttccagtttctccacatcctcactaatacttgtcatctttttcttaaaaattacaataatccttgtagtgcttgtgaagtggttatgtcattgtggtttttgtttgcattttctaatggctgatgatgttgagaattttcaagtgtttattgaccatttgtatatctcttttggagaaagtctatttaaatctcttgcccagttgtaattgggttgtctttttattattgtattttaaagtgctcattttatatgttggatacaagacccttaatagatatttgattttcaaatattttctcccattctgtccttttactttcttgatggtcttacttgtagcagaaatatgttatatacacatatatgtaaatgtaatatttatagcataatgaaataaagtagtttagaaggatttgcagtagggtgccatgaaggggataacagttgtcttttattgaaattcaaagctgagccctaaatccatatgtaatacaattatgggaagccaaaaaagaacagaagctgctcagagtgaaacataatgtcctacagcacatgacacaccttcttcctgtctttgtgatatcccagttacaagctagttagagaaatgatagggattggggtagtgagaaaagaatagttgtttcctttggtgtctcaggtaagatatactgttagagatatagctagaaataaaaccaaccggttctagcagagatgacgataattctacttttgtcaaatcaccaccagagaaatctcctctcagttgattaacatcatgtgccgcaggctgtttctttcttttactctaggtatagtgggagtaacccattggcaagaaaaactcatatttaggtggtaaggggaaggcaggtagagaaaatgaagtgtgtctttgacacagtatgaatggaggtgctccccattaggaattgagcaggtagactgtgttgatgaacatagagtaacacgctgggatggttgtggccacttgtctgtctcattggtccatctctcccagtattccatttgaaatccttcttcagccccttaccacagcttcaggttgatattgaaatacaatggtaatagtgagggtattttaaaagtggactttaaagctgagttacattaagaaatgggcatatctggcaagttacaggcacaggtaagtaacttttttttttctttttttgcattaggggtttgaaatagtgcaccgatggccttctgagaaaggtgtctaccttctcaaggtttttctatagaatgacttatcaaaatccatatggattcttgaccgaggcttttcagctggattatgtgaaaagctgtggattttgtaaagaagcctggcatgtgctccagtgtgtttcagtttttaaattttcattttttacagtgtgagaactaattccagactaataacatttatgtgaatagttctctaagctttgcttcctaaagtgtaactgttaagccttctggaataacaatgcagttctcccttcagaaagattctttatgttgatgtcttgtgactggcttaaattcttcaggcactttctctcctggttcctctccacacccagagagagattttagataatcttgtgcattgagcagaatcaagagatgagtcaggaaagttttctaacaaataatacttttgacggagccatacaacttaatttcgattttgaagtgacagtaattgtcagtattgctccttcaagtggagggactaatttgtaatcatgagcatattgcataatggcgacataattgagggcgtaggcctatcctttagaacatagcccccaagagaattgtgttccatacataatataaagatatgttaaggtggttgtgaaactccttgctgtgaaatagtaggggcttctcagtcattttgtgtatagtttgctttgtagatgatgctgtatttcagtagaaaacagttgatgtctcaatgtcatattggcatctgtggttgagaatagctcaaatactattgaattaaacttgtgtgcgtgacagtgtgcttgcccagacggactccttagcactgtatgactcttgagaaaatggtctcacttgacaatttcattgctacctaagatttttatttagtggctgaggaagtgaagtagtgacttatactgatttgccatctagggagataattggtaaacttgggcctgagaaaggaagagatctgttatgtaagaaaaatactgatcaaaagaacaatatttgttgttgttgttgaccagctctgactgtgaaacatttaaagtgtctgggctctaatttgagagactagttgaaaaataatcatttgacatttagcactctgctaggtaccgggaaattagagcaagtaagaaataatttcatatcttgaggtacttatattagggggaagacagacatacaggcagatatttttttctgatatattagataaaggctttactcttccccgcccctgcccccctccatgtggaaacacatacaaacaggagcaaaaaagggaataccaaattcattttaaatacatgtagatacccaatatgtaatatgtgtcatcttactctaggatgtgagctttaaaaaggtggaagccaaattgtgcatgcttttgtatagatccttgcataaactagatagtatatagaaaattgacagtagtaagtgaaatgcttgattccttttaagaaagaaaattccaagagttatgttaagaacttctttaaaaaaaggcaagagtgaaaaaaatgcacaattcagaatagtgatgatcattgcagggaggcaggtagatggctttcggtaggggcccatgtatagcttcactgggattgtgtttttagttagcttgggctgctgtagcaaattaccatagattaggtagctcaaataacaaacatttatttctcacagttctgaaggctggaagtctgagatcagggtggaagcatggttgggtgccctcttcctaattatgtcttcacatggctgttcccatcacagggactccagcttcaagacttaatcgaaccctaattacctccctaaaggccctaggtctaaataccattacattggggattagggttttaatacattaattttgggaggacacaaacatttagtccatagcagattggaaatattttaattcataaattaggtgctgggttcattaggtatatattctgtaattatgcctcataacatacattatatatatataaaaaaataaaaagtatatatataaaactgtaacatttgatagatgcatatatatatatatatatatatatatatatatttttttttttttttttttttttttttttttttttttgagatggaatctcactctgttgcccagcctggagtgcaatggcgtgatctcagctcactgcaacctctgcctcccaggttcaagctattctcgtgtctcagcctcccaagtagctgggatcacaggtgcctgccactgcacctggctaatttttgtatttttagtagagatggggtttcgccatgttggtcaggttggtcttgaactcctgacctcaggtgatccaccacctgccttggcctc

SEQ ID NO: 76212 - DNA, 1021 bp, Homo sapiens
cagccttcccagtctgaatttcttaaaagcttttgcttaggttaagttgtgggagaaaaactgaactcacccagctagccaaactatctctctgttgtctttccactttatccatctattttttactttttttggaaacacaataacaatagtgtagaagtcttttcacattgcctgactctcctgtttgtgtcccataaggttccatgtactctgtccagaactcagcttattatgtcaaaggattctgtctggactggtcagtcagagatataagttctcattacctcagtgtgtgtgtttgtatctgtatttaatgatgtttgtgcttggcttaggctggggattttgaaatctttgcagagtttcccaatttgttgggcagttttagaaatgatagtatcagtaggaaaaaaaaaacacagaaaaatacaatttcttctttcatctatgtcccatattatacaaatgttcgctgaaagcaccaattttctgggaaaggttttgactcagacttttttcaccctttacctctactctccaattcatgtttccttcttacaacgtggtcatatgcttgcccaggcctggcttatgaaccgtgcagaatatttgtggggtttgttttttaagccctaaactgtgcacatgatgcagtatttaatttggaatgagctcttagtttagtcacatgtgcttcttgtggtgtttatcttggaatccacaagtaggagggaagtatttttgcattttatacatctggacattgttcatggtccttctgtaacttgggaattctgtgtgaggcaaaatccaaaaaaacagcattaaaaataacacggagttatgatgacatctgagtcaaaacccttgagaatacccttctgatcccagcagagtttgtttttgaggtggtgaactttttcaattgtgtgtggttcactgctggcctgaggagaatgctgggattataaggttacctgacacccttgcatgtagactaatgggtttccagacattc

SEQ ID NO: 76213 - DNA, 2487 bp, Homo sapiens
agtctattgcagatttggcatagggggaagattttgctttttggcttagggggaggattttgctctaattttgcatggggtaaaataggtaaagtgaattctgctcactgttgctatgcctctgccacaagcattctaagagacctgtgagactgtccctatttctctcttaaacttgcctaattacagccagcttagagctaaagttgactctgagaatgcctcgggctctgtgtcaggactgggggtttagtaaccttatccttcccctgatttcacatgagaagttgttttaaacaggattggacatagagatatagcacagtacctcctccttttggctaggggtctgctaaagtggaaaaagtgggaaaggatgtacagaaactcctgctctttgagtgagtttgcatatggacagtattgctttttggccccagcctagttttctttcattcccatgtctcatcttttatgcagctgcagagagcaggctgggaaagcagaatgaaagcttcaaacagatttgcacttgaataaaagaaagagtgatttctcttgttcagagtacagaccagtttgggtagaaaactgtttgcttttttactttctgggtaaggactgtttgcttttctctctttaaatgtagtaaagagaggaaaagctaataaagtagttggacctgctggttataattcatagagaattttcaagtgtgtttaataaagtctctcatataattataacagaaataagtaattggaggggaaaggttaaaatcctgtagaggtttaagaatcagttaaatatgaggcagtgtgcttggatgagacaactaactaggagctgcttctctttgctgatttctctgaactttccttttgagattttttcctctttactttcgtaatgcattttgcaactttcattaaaaaaatccatcaatgtttaaacttctaacaaataaacatatcctagtcctattatggaaatcacaatgtagcagagaatagcttgacttcagctagagagaggttaatgataggaaccctaaggattgataccaagatcatgcttgtttagtgttttaatgactccagaaggaaatggtgaaatctgctgatgacaccaaattgtttttgctgatccaaacaaggatttctgggaagcttcttcagagtatttggaatagtagaagaattgagaaatatggtggcagacacactgaacttaaagtgaaggtttacgtgaagtagcaggagtaacgtcaatacgttgaagttacaaagcctgccaaatcttccaaaaggaagattacggagtctatagtttcatgaaaggaagacttaagacaaagaacatttatacatatagcaaatgaaaactattatgggaatagttgcaattataaagttcagtgacttaaaaatatgatgtctgaatttctttttaaatgtcagcagtagtatatctaaataggtgttgtttctctcgaaatggtcatagaagattatatacccattttatgcatgctcctttcttggtacgttcttttgtcagttttctgtggtggcaggtctttattttgcaggctgttttgaattttgaaacagtcaactgtcacttaaagccaagtgtgataaataagatgggtggtcaaactaagtaatagatttaaatatattaaatatattaaatgaaatataaagtagtaaaacttattttcttttattgctttcaaaagtgattctaaaggacattaccaatgagaaattgcaaaaatgtttgtgtactaatagtgttagattaagttcttggttgatagatttcacaaacatcacttatttagatatgtaagttacagggcttgtactaatacacattttattatattggagacaaaccatgtttataagtgacctttttaaaatgttttctttatgctccctaaatatacacttagggaggaagaaggaggttttgaattaactggagatttccctaatgtgttgaatttttctgactaaagcctacatttttgtaaagaaaaagaccctgtgggataaaaaatacgataggcactatcacaggagctgtgggctggccatctatatccatccatctatctattattccacccatccctccatccatccatccatttatttaattaagttatttttaacggttggctctggagttgacattcatttattttaaaagaacagtgaatcatagctcttttcctcaagatgcttgcttttatttgcatggtggcatattgattaagtactcagaacactatttgacatatggtaagccctcaataaaagtttgttattattatgactgtacttctcccctctaatgtatagaggtaaacattttggttcctattgtgacacgtgggttataatgagttagggcctacttaagaagaaagtggaaagaaagcgggtaaaattgttgctcagatactagcatgtg

SEQ ID NO: 76214 - DNA, 1041 bp, Homo sapiens
agagtacgtgcctctaagaagtaaagatttttttttttttttttttttgacagagctggagaataattttaggaaaactaaatctccctgttgctatgtttgtgccagctttgtcacttggaaagtattagttgttttaagccacaaatatataaggaagttattttctttcaaaacattgccttatttatgagggttttgtttgtttgttttagctgtctttgtctctgtattttaatatttttgctcctagcttttttggccctttgttgtttcataaaaacgtggttgtaaagttaatttgaaccatatcaatatgactataatgtcatattttaaaattcagctatattttaataggccttaaaaatacaggtttacattaaagagtaacatagtgtttttgatactaccgtagtgtgtttatgtacttgatcttatttaatcttagtactaattgtatgaattttattattcacttttctaggtaaataaactatatcagagatacttagtaacttgccaagctcacatacctagtggttgaactagtagttgctgcaagagtttcgccagcatattaaagttgtattttttgagcacttactgtgtgccaggcaagctaaccactggaaatactatagtgtccaaagctgacctggaccctgcccttatggaccttacagttattagataccccacagacattttttgaaatctgctggattgagagtgggtcatgaagatgaatttgaatcattgtgattgttggataagccagagagccctttcaccaaaaagaaagtaagaatcatacctaccttgaatatattactgtattaaaatatttgttttagttgtactccctgtagccaagggaaaggcaagacctcctttggctacaatgagtaactaaactgtcttctagataagaatcaggaagagtaaggaaaatctggctatactataatgtcaaaattttccactgattaaatggtattaaaatatctaaagcaagaaggtgttagttagcagtggaag

SEQ ID NO: 76215 - DNA, 1410 bp, Homo sapiens
ttagtgataccccaaattgccaagtacccctttcatcttgggacattaattgtcaaaaatctttgaattgatttttcttcagaaagcttcactttattattttcacacaataccaagttctcatgatatttatgggtatgtgattggtgagaaaacagaccaagagttgttttttgtttgtttgttttttgtgacgaagtgttgctttgtcgcccagactggagtgcagtggcgcaatctctcctcccgggttcaagcgattctcgtgcctcagcctcccgagtagctgggattacaggcacacgccaccacgcccagctaatttttgtatttttagtagagatggggtttcgtcatgttggccaggctggtttcgaactcctgacctcagttgatccacccgcctcagcctcccaaagtgctgggattacaggcatgagctaccatgcccagcccagaccaagagttttaaattgaggtccatgattgggtttcagtaagtgtatggaatgtctaaaattatataaaattttatgtgtatgtacttagaattattctgggaagaaagtccatagtctgcacaaatttctcagtgagtttcataacccttaaaaggttaaaagtggttgtaactagactttatcaaaaggggtgttcaaaagtcactccagttcaggattgtggaaagataactgtcttctcaaataggcatcttagaggaagggctgtttgggttccttttaagaactgtaatcttgagatgtggagtgaatttgggatttgaaaatcccaaaatagagttttggaactctcagctcttagtgatatattctgttttgaaatgagggatacctttcggggaatttgaaaatacttttttctaattcaacttttaatcagataaatgattatttttgaaaaatgaaatagaaagtaataggaaagggggaaaagttgttatgtctcttcgtggaataaatagctaaagaaattaatttctaaattttaaatttcatccctggttaaaatagttcctcttttttgttgttgttgttgttgttgttttttgttttgagatggagtctcactgttacctaggctggagtgcagtggtgcaatctcggctcactgcaacctccgcctccccagttcaagcagttctctgcttcagcctctcaagtagctggggctacaggcactcgccaccatgcccagctgatttttgtatttttagtagagacatggtttcaccatcttggccaggctggtcttgaactcctgacctcgtgatccacccgcctcggcctcccaaagtgttgggattacaggtgtgagccactgcacttggccaaaagagttcttttagagaaaacaaaagtctttgatataagcaatatgatcatacaaatg

SEQ ID NO: 76216 - DNA, 2307 bp, Homo sapiens
gacatcgtacaggagtgtggttggtggtaccttaatagtaatatcaaagattgctgatcacagatcatcataacaggtatgacaataatgaaaaagtttgaaatattgtgagaataagcaaaatgtgacacggacatgaaatgagcacatgctattggaaaaatggcagttatagacttgctcagtgcatggttgccacaaaccctgaatgtgtaaaagaccacaatatatgtgaagtacaggtgaggtatgcctgtacgtagttggtgcctgtagttttgtatccattgaaatatactgtcactcattgggtctgcaattgggtgtaataataatatcattttattgttaatgggctttgagtcttcctctttcttctgtgatagtttgccattgtcaagttaaatttttatgagctttttcagagcagaaattaaacattaaatggtttattaaccaaaataaggcaactgcctttagactttaatgtagtacccattttttcctacagcttatcgtcttcccagtttaaaaggcttaagcagaagagtaacagtatagttaaaagtttttaagttacaaagttggaacttgcctttttttgattatatgatcccaagagtcacaagagagtaggcagaaagattactgctttatcaataggtgaaagttcaggtttatctgaatttagaatattaaattgtactttaaccataccacatgtttttataacatataaatcataactgacttcatactattctgttattttatgaggtgatctgatgtggctgcaaagttgttaaagttaaccttgaagaaacctcctatggcttagtgtttatttgcaaaatcaatcacattttttcttctgccttattagactgatgaaatcattttctagcatatggaaacattcctggacctcctgttattttgcgtaaataaccccatgtgactcacaaatgttgaaaaagcagtagatatttccaaatgctattagaaccatcaaactaatacaaaaaattcttcggtgggacaaatgaagaccagaatgaagtctaagtcactgtttccagtgaagattagtcactttttccactctaattccagaatttctttaatttttcttgcttatgttagcaacagtattgtcacaaaagattcaacagtcatctcctcaggtaaccaattgttacacaaaccatatgtagaaaatgctcactggcttcatttatagaaaaaaaaaaagataactggaagttagaaacagttgtccaaacttttgaactataataagctattttgaagtgtcattgtcaatacaaagtacataccagtgtgagattttaagcagtaataaaatctatgtgtggaagagtaaatgaagcgtttctgcaatattaatgaacggacagatatatgggaagaagtgatattaaaccttgccatacactctgacaatgtacatgaacagagccagtttgcttgtaaagattagtaacatatcattgcaatagatgtgcatcctgtggtctaaacttattcctaaatgacatcttgaagtttggcctgtccaaaaacatcttttgaggaaggacagatgctatagctgctttcttcaaggaaaaaaaaaaaagtaagtgacatcacaccttgttttaaacttaatgaagtgaagtaaggatgtcctctgaaaaactggccggaagtaggagtagtaggagggggaggaaaaggagaaggaagagggaaagaagctctttaagaaatagaactagttgaaaatattagtatctaatattgtcaggaacatgacatataagagattattggcagagtgcaacttcagaactcttagaggattctaaaagcaaaggaaaaaagttttttagtttagtttagtttagtttttttgttttttttttaataaatgcttactacttctgaatcagacattctttggcatcttaaactgaatgcctgtaattacattagctgttttgtgagacttacatatattctagtcctgtctagtacagaacactatgctaagcattgcagaaagagcaaaatggatattacttctgtcctcagagaacttatctaggaagaggtagaatataaatattcaaacatctatagaaaaagcagaatcaaccatctaagaggactgtgtagacaagacagatctaatccttttattaacataagtgcttcatgaaggaagtagatgtgaactggacattatggtgtgtgttgaatttggacagattaagatgggattggggtaggagttaggctttt

SEQ ID NO: 76217 - DNA, 1122 bp, Homo sapiens
taagagtcagtattccctttcagtttaactgaatgttaaatgttttaaaatgttaagtatctggccgggtgtggtggctcacgcctgtaatcccagtagtttgggaggctgaggtgggtgaatcacttgaggtcaggagtttgaggccagcctggccaacatccctactaaaaatacaaaaattagccaagtatggtggcggccacctgtaatcccagcttcttgagtggctcaggcaggagaatcgcttgaacctgggaggtagagattgcagtgagccagatcatgccaatgtaccccagcctgggcgacagagcgactccgtctaaaatgaaatgaaatgaaataaaataaaataaaataaaatgttatgtgtctactatctataagatgatgatgagcaagataaaattccttttctcgaaaagtatgtaatctgttaagagacatttcacgtaggaaatttgaattatttcagtaaactatactttaaagggcaatcaatatattaaacaatataatcaaaccaagtcatgcataatatcttatattcctattgtaactaagagttgcactgtccaatatgttaaccactaactgtatgtggctattaaaatgaatgaaaaataaaattgaaaatttagtttcactagttacatttcaagcattcagtagctacatgtgattagtggctagtgtagtggacagcatagatagtgagcatttccattattgtagaaacttctgttgggtagtgcagctctagagctatagaacatattttaattgttttggacaggcttgtccttcatctcttcaacaaaccttcattaaatgcctaccatatgccaggtgttgtgatagagtgagatgataaagtcctagttcctccttacacaaacctttcaatcttgtgggacatcaagtcagtgaatgggtgaataagatagaatgtgataagcatcactataagaggagagatacaagaggatgtgaaaatacacaaggaaaagtacagaagcaacacttaaggtttccttttgtagaaaggtgagtaggtgttggcatggttaagttggagataaagcagaatccaactgcaggaaatgcttggatgtgaaa

SEQ ID NO: 76218 - DNA, 1143 bp, Homo sapiens
atagcaacaattcaatcagaactgtctcaaatgtaaagtagtttaaaagtaatgttaatctattctttgtggttttgatcatttttcttaaagttagagggactttttcacaattaatgtttcttgagtgaagaaacatttgtctaagatttaaaatttcttcagtttcatttcggcttctgttaattgcaggtaaaattagaattgatattttttatttttaactgtgaatataatctcatcccagaaagaatacatttatttctgtccatccattatctatgtgtatatgtgtatccatgtgtatagaattgatattttttatttttaactgtgactataatctcatcccagaaagaatacatttatttctgtgcattcattatctatgtgtatattccagttgtctggaataatgtcactaattgctaatctaatacctaatatttctcaatggtgagattttggatgatttaatgcatcttttctgtgtattttttgtagtatttgaatttatataatgagaatattttaaagaaagtgatacaatgaatttattgctctgaaaaatgaataaatacttacgcagttttatagcctcatttcttttttaacttatcttgaccccttttctcttaccatcattttaaatagttgcacagtattttatggatgtgttaatatatttcttctttcattcctgatctcagtttcttcatctgtaatgacagagctgaactagattagccggttgcaatctttctctttaaactatgaaatccttccaagaaataaacagtttataactcttggcttaggcatttcccatagaatgtagtttcaaagctgtacagattagataatttctgaggcttatttcattttaccaccaaaaattagggtttttcttttttttaggatttttttgagtgactttttcatgtgtttaaaaaaaatcggtaacagacataatcttatgaatcagaattttaaagtgaaagggactttgaaaaccatctagtatatttgcctaacttttatacatagggaaaccaaatttaagtttttaaactaacgtcatacagccaactgaaatgaatgagacttgagtgcacatctcctgactttctatgctgttctttt

SEQ ID NO: 76219 - DNA, 2471 bp, Homo sapiens
cacataaatatatatacatatatatttatacaatgatgggcaaacaagatgacaattttattgtactcatgtcacatttaaaccatcatgtaaatgtcaggaaatatgcttaatttatagtgtatttattttcttgttcatgaaaagagatcagtactgcagccattattgaactcctagagttagaaaggaaagtgagtgggattctggcgagaaagaaagcatttacttgtcaaagatttggaatttactgtggttaccaaaattaaaataaaactaaaacttgacttggcagaagattaaaaacaaagcagctccaaagtgtgtgcacatcatggagaagatgccattattccttcaggcagccaaaggggaagggaatattgtttctttgcgttgctggagctgatttatttagttatgatttcaacatgcctacagggcacaccccagaaaacattacacaacaacattaaccagaacaaatggtgctttctttttctgtatctcctcctaaggttttttaacagcagtgaggttttttctttttctttttttttcccccatattgttaaaatggctctgattatgtttgactattgggtgtggcaggttttagaatgttaagtggtagtacaggttcctgaacaagaaagagaattagagttgatgtgacttgattattggaatgtgtagaatgtaaagttgtgagacatacgacggtctaccgcaggttgctcttagtaatggaccttcttgttaaaagccctgttattattgggaatttattttggaaactactaaagaagaaatttgacagaaaagtaaaacaaaccaccttgtctcatatttcctttctacacaggcactttgaagagatatcttaaatattgtcaagtctcaattatcctggcacacgttagcattatcaccattctcacaaacttgaattaaatgcacatggtattgcagcaggtgcagcacagagaaaattggcaaacaagatccttatccttttggagctcagtaagggttgctatcctagtaagtagttcaaccaatcccaaactaatttttccggatactctccaaacaccctccctcccttcctatatcctctgtcttcattagtggcctctccatcctctcagctggaaacctcacattcatcttgagtctttatgttcccttggtcttcacaaccaatctgtcaacaagtcctgtttcttctatcactaaaattgctttttgactttgtttgtactcttccctccattctcctagccattgccctgtttaggcccttttcatcttccatttcagttcttggagagctgcttatctacttttaacctttccattttctaatccatcctccatactcttgtcaaatctctttctttaaagacagttctaatcatatcactctctggtttaaaaacctttgatgggtccccattaacacataagggataaagtctaaactccttagcttgtcatgccagggtttcagagtctggctctgatctacttattctcatctcattacctgccataatttcccccttaccgtatttcccattgccagacgcacacacacatgtacatttactccattcccacaagcttcctcataattccctgagcttgctatgtaattgtgcttttgatcatgcctttccttgccccatatacacagaacactcttccctgacaaactcttgcttgtatagaggaactgaggaagccaagattttacaaagagtactcttgacaaaagaaataaaccacgtgcatagaccaagcagtagggccaccgttagagcagagttcagactagtggctgccgactagtttctcttgggcaaaccaggaagaaggactcaatcccagaaggtactggcattatagcagtgattaaattggtttgcaatagtattaaatgaatgcctccttcctatttatacagccaagagttagcatttacttttatagctaaaggatagagggaaatagctacagtaggtttctggcatagtagttaatttcaagaattaaaagaaaactcattacccttatctacctactactcctaccttatctcatgttccaaaggtgtaaagaatgattaggaactcacaggaccacgagccttcacactcacattggtgctttttaaaaatcaccaggatagagccagagatgatgggtttaaggggtaaattgaaagagggaaatagcagctctttacctcaagttactgaggaagcagaggcctttttcatgctctgcctagtcatgcttctccctaaccattgcatctttctgctcaacctttgtcctttttatccacatatgattcttttaaaaaattagttcttactatataagtattgtattaacatagtatcttcaaaacatgtggaatgtttgtaaaggcttctctgacattctctcaccaccatcatccc

SEQ ID NO: 76220 - DNA, 3069 bp, Homo sapiens
gcttccacattttcaggtatctttaaagcaacgccctactccaatggtaccaatttactgtattagtctgttttcatgcagctgataaagacatacctgagactgggaagaaaaagaggtttaattggacttacagttccacttgactggggaggcctgagaatcatggtgggaggtgaaaggcacttcttacaaggtggtggcaagagaaaaaaatgagaggatgcaaaagtggaagcccctgataaaaccatcagatctcatgagacttattcactatcacgagaacagtatgggggaaactgcccccatgattcaaaccatctcccactgggtctctcccacaacgtgtaggaattatgggagtacaattcaagatgagatttgggtggggacacagaaccaaaccatatcagtaagcaagtactggttctgattaaatgcaaaaaatgttgcaattgttggtttcaggaggagtgttatccttaaaaattagactgtcttagaaacacttgttggacccagttcaaaggacttcactagcattaacactctctctcctttctttctccttaacccacttctacccaattactgacattgatgggagttaaatgtaaccaggactctttgtttatatatacatctggttttccctgttccgtatgcctaaatcctccctccattgcttctgtttagcatttaatgtaaatttccaaattaattcaagaagaaaatttgaaatatataagatgagggcattaggtgatctctgagggcttttacagctctaggattctattaggttattaataatttatttccagaggatacattctgataaactaagaagttttctgtgcttgatttagcttttacttaattaggaatataaataactaaatatttaaatagataaaacttatgctatttgtcactttttcttgaagcatatttataatgatcatttaatgttcaaagtaaacctccaaaaggacttggtaactgccaaatattaccaccaaactgtagactaatcaattagaccactagtatttgaatttttttcttttactatataaaactaagaaacgtggactgaatcaaagtgaatgggagctttggataaaatattggtaagatgtttgcacttactgtctgcttttgaatgttcagatatttaagaggtaccatcatataccacgaacaaaaggttgggagtcaggaatcagggaattagtcctagctcatcactgtctcattttgtgattgcaggtcatgctttgctcttaaattttcccatctttagcatgtagtagattatttctgacccttaacttacccagggatgttttgtgaaataataaagataaccactgccagttattttttgctgctcagtaaagattctacacaaattaatggtagcagtagggtggttatttcattatttaagaaagttcttcaaagtgagagaactacccagcataggtcatttggaattgctgtttatttgttcttttaggccagcaaaagtgttctatgttaggtagaacagtgctaaaaacttacataaaagcaaaggttttgtaagttgtaggagccagtccttggtggatctagttctttccaactcttgtttttagtcatctgcttttataaaagtgagtggtcttaccttttagttgttttttttttcctaaggtagatttttatttttatgtttattcatatattctgtatgagttctgtcatcttgataaaccttggaatagaaagtcatatgtaaaatttgccactttacttgaattctaacactttttgtgatgttaacctgttagattctcattctaaattccacttctcaccttcttgtgattggttgctgtttgttaggaaaacatgtaacagattcttaccctctttgaaaaatcactgttgttctttttgttgatgcagaacagcagtaattttttctctttaaaggaaaaataatttagacaaaggagatacttgagaaaagagtttaaagaaatttactgttttctcagtgtacttcttttcaaaatgatgtcaccccaagtgttataattctttcaaagcttagtgtccaactggtgaacaaaactaacagttgattgcctcaagttcagcagtgtttgctgtatattttctacatctgtggactattctgttatgacataaaagctattaaagattataatttttaaactatatatttcactaagtatttataaacacgtatgaaactcgttctaagtataacctgtactgaaatgaactgttcatgtttatgactcagtaggtaaattgctctggagtgcttcagaccaggctcagctgaagcaaagcattttgaattgatattgttaggaaaggttttttttccttattcaacggttacatgcgaattttaaaagatttcttgtgtttggttagttctaaatttaaatttgttatacttcttatactagtagaatgtttcctttctatctgcagatttgagagttggtcttggaatatggctttgcagattaaaaaaaggttacttttaaaattcctcttaaactttataattcaaatcagtcaagtaaccaagaagagaaattagagaggataccattgacttgctttgtatctgttgttcttcctttccttctctgcaaaggtaaactgaattgcagctttgtacttagaagtaaattactattaaaataaagacagtttaatagtattttagaaaatgtggaaaatggaaagatgggaatgaactataaaagatagaatttgagctgagtcttgaagaatacattgttcttgatgtattccagacttccccttagacgttttttattctttgtgactgttgtgtgttatgtgactacttaggtcatcctccctcagggggaatagttggacgtttattctccaactactatgtaagcaccatcttaatatttgcccttggatgagtcacatcactctgctttgccttaatttctccatctgtaaaatgataatggctatataattttagatttattgagt

SEQ ID NO: 76221 - DNA, 1909 bp, Homo sapiens
atagcaggcagaagacagatgagtagctagttctctttatttagaaaaaaattctgtctccttgacaccaatattgttaaataagatatgatttctaaaaagccattttccctgtttatttgacatgattggcagctctactatctgaacacctaagaagtttaagtttcttaggtgtggttttagagtcttaggaaagctgggaagggcctagactttagaggcgacaggcttatggtgtgtcctggagtgttacacaaggaagaattattagggccaggtgcctttcatgtctatgtctgccaaagtaaaaaatgcagaggcaagagtttgtctcagcaatagtttcatacattatctacacagagaaaagtgactatttaatactggcaagaattcaaatactttctatgtaatcaatatcaaaagagggtaagtttgttttttgattggttatcaagttgatatacagtcctattgctgtggtctgcttaacctgtaattatcagagaaatcttgtcaaacaagattttctgaaatgaagcctgttaattatatcagatcctttggttttatgtggaactattatcatgtcatgaattgggaaccgtttgaacaaaatactgatttggaaaactctttatctcaaattttgcttgaaacccatgacatctaatggaaagggcatggtgagaggcaacactaaatttctaagctgaactcttttcctaaacatccctcagtgatcattctcttgtatgagtagatcccaacaagggtagggattggttagtttcagggcatcttatctaaacattcgtctaggggcaggtctatgctggttagacacatagaaatcaaaattatcaacacagtgatgacaatgtaattggccatatctatcagcaacttataatcaaccatatctaaggctgctgaaaggtacaccctggtaaaaattctggctctacctttgactttcattactgaccctaaggattttggactgaagtctgtaagtgagcttgaattcaacctggaatctgctttgaccttgtaggtaaatagtgtgcaaagttaggaaattagaacaaaataaaatttactttacagctaggataaattgtgataaaatgagaaattggcagcaagaagttttagtgaataggaccctcaaaggaaacttaaacaatgttgaagtgatgtttgctgccatcagacagcacacacacacaaaaaactatgtctaaactgttaaagtggattttatgtaaattgttcatgataaacatttgcattatatattcctattcctttgtacttcccatttgatgaagttttcaaactgtggtttgctggaggggaaaaagaaaacccaaatccaaaccacataggacaaattgaattacaaacctggtgtggtcccttaactcaattacatctaatttgtgttattttagtcatcctgggtggcagctgttctgagtaaatgcccacaaacattttcaatgtaagaatttgtcctgattacagctctttaagatcagtagtagcctatttatattttaagtggcaaagttttagattaatttggtgtatcaggaccattttaaaaattcaaaatttagttgtttcacaaatagacatttaaaaagcaagcatccaatgtttattttaaatgttaatttttgtaacttcacctcattttcttatttcttatgtttctacttatgtttcttctaaacatagccacttaattactttattcaggcatttatcaacttgcatatacaagggaatatggaattttagattcagataaatgctttgacattccaagtcaaaatttgagatgatctgggaagaaaaacatgaaataatatgggttcaggattgttcagttcaatat

SEQ ID NO: 76222 - DNA, 1062 bp, Homo sapiens
tactacagtacatgagacttatacttcactagatatttaatcagttaatggtcgacccatagacttaggaatataaattgtttaaatttgaggtgtttatcagttgtgtacactttttccctactcattctctttttatggaaaaaacaatttggtaatcaattatgatatgtattttcttgtatatctcttataatttttaattagttgtgaactgtatcaactttaataacattttaaaagatgttcatcatcctatattcctcttttatatgtgatactgactactaatctactatttatttttgaaattatttttggtcttcagtggtagtgtgctttttttggtttctctcccacttttggagagttgatatctgctttgctggcttcacatctgtattagttatcaattgccataacaaattaccctaaaacttagccgctttaaacaatgaacatttattacctaatggtttctgtgggctagtaatatcgtatctgtcttattcacatgtgaatgatgaacattcagacatccgataaatattattgaatggtgcacaaatgaatgctgttattcaagttgaggttcttatcacttagcacctaatgggctccaccatcttctttgctggcttccaatccttacccccatgctgtttgtaaaaccaccctttcaaaagaaatttatgctgctgcttcccttattaataaccagttgtgactctcattggcctaatcaaatttctgttggtctccttggcattcaaagccttccataaaccagccttatcatatttattcaaccataaaccttaacagatatacctattttacttaaactggttgtttatactttagacctgttaaaagacaatccttaaccaaattaaatataactcagtttaattgagcaaatctggcggcttcttgaacccgagtagtctgagagagactccattgcagccacgtgctggaagatttatggacagaaaaaggaaagtgacgtacagaaaacaaaatagaggtacagaaacagctggattggttacagctccg

SEQ ID NO: 76223 - DNA, 1907 bp, Homo sapiens
attgacaaatgggatctaattaaactaaagagcttctgcacagcaaaagaaactaccatcagagtgaacaggcatcgtacagaatgggagaaaatttttgcaacctactcatctgacagagggctaatatccagaatctacaatgaactcaaacaaatttacaagaaaaaaacaaacaacctcatcaacaagtgggcgaaggatatgaacagacacttctcaaaagaagacatttatggagccaaaaaacacatgaaaaaatgctcatcatcactggccatcagagaaatgcaaatcaaaaccacaatgagataccatctcacaccagttagaatggcaatcattaaaaagtcaggaatcaactctagtttttaatctttgaattctcgttgcattaacactcagtaccaaacagtgcctttctttatttttaattagtttaagtgggtgaatatgtctttccaactagaattccaattttctgacagcaaaatccttttacttctcgcatctttattgtagtgtgctgtgagtgtatcctggttgattgaaaaactagaaatgttgattcacctgtatgtaaaaaatcctttttgagtgaattttaactgctagagacattcatgaggatgagctgggactgcaggacagtttggaactacattttattattttcctgaagaaacattgctgtatgaagagattaactttaaaaagttccctccggccaactatcagaattggcttttagccttgaactatcaaagcaaaactttcagtgttgcctagagcagaacaggtattaagtagcaagcaattcaaggtctctgatccctagcctgcttcagctatgggcctggccaagccctttggcaaagataagttgaataaggaatttacttttatcttctccctcttggaagttttatggatttgattcacaaagaaagggcaataattgaaattttgtgttagcttcttcttgttattcaccaagaaaagttaaagtcaggtaatgatatcaatcaaaatgtaagtacacctactgcctaaaaataacattgtggttaattgtgttccataatattcttggcatactttgcacaagccctggagaacaaagcctgagagcccatgggaaataaagctccagttctttcggccactttaaatttagttctgtgatcttgataagatatcattgtatttacattgttagtttctaccagcattcccttgtatcttcttttatggctttttctatttctgtgcctttttgttcctcttccttattttccccctaaagccataggtagaatgtttggttttagagttttataagaggagtatttgacttttccttatagcgatctcagatttcattaagtttgtgttttaggatgatttataatatcagtctatgatttgggctattatttgcacatttttggctttcctgtggctaaactactggtgtttatataaaaaagatttttttttatttatttatgcatgtaggggtttcagccaagattcctgtctttagtactggaatatttgaattagagaaattaagaaagtgaaaaaggctaaagttcttgattcttaccttttatccttatagttaatgacttataaatatatttctttgggaaaataaagaatatcaattgactgtcacctcagttaatccctccagcctctgcgttttttcctctaggtgacctgtaagggcctgctcaataaagccagtgtgatgatgttagctttgttgcatcttttagttttcttctttactcatcccacacttcccatacatatcccgcttcccttccctggtgtgtttaaaggtaaaagaagtaaagaagtgggagaagagacagtgtgaaggaggtgcagaggcagac

SEQ ID NO: 76224 - DNA, 1181 bp, Homo sapiens
atgagcatttccttctgaaaaaaggaaaagacttattgactaacttttgccacatgaaactgtataatcaacctcatttgaaagtgcacatttcatttgatggcatttgcaaattgttccttccccccaccaccagaacttgcaatgtgaaaatgcttccatatgctaaaagctagtctactaattttactgaaggagaagaaaagaaagtatggctagccattttctaaacatgaagctacagtgtgggcagatttggcaatgggagcccctcagagttcactgtaaacaactctgcaacccccaggcctcactactgttcaagatgagtgtagaaagttgtttttgccccacaaaagtaaatttttaaaaatgcaattgtaatgtgtatatagttttaaaatatctaaatgcagttaaaatatagtattaaactctgatttctaatagatttgaacattttaagtgaagaaatacttttgctttcagattctttgtgtatctcaagacattttaatagttttcaagacatttaaactgagtcttcactctgggtggtgggcccccaacccctaatgcgtggcttatagcaatagttttctccctgattttcctaatattagtcattctcccttttaacactgcgctacttggtgctactaggataatctttcataaataacattatgccttttcctgttgactgatctcatttaccctaatctcaccaatatttctcccaaatctgatttataattttctttaaggagtcttcgtagtaatcccatctggccccatttttcaacagtacttttgaaccaagcttctactattattattttcatgttgatttattaaagttttttaaaaaattgtattatgtctgttctttttttcccaagtagatatcagtgtgatggaaacactatcttctatatcttttgactggagtcttttatacttctgagtacatgatagatgttaaatatatactctgttaatacatattagcaagtttaaaatggtggctgtttgtttaagtcacataaattatcaaacaaaagagctgagtgatggtacctgcacaatgcttaatatatagtagagatgataaaataaattctactgaagtctgtacttcatctttttaaaaggtttattgcttagcttttagaattaat

SEQ ID NO: 76225 - DNA, 1565 bp, Homo sapiens
tgttttactgatggggtatagaacaaaaagttaagaaaccaccgatctaattgtcaggtctgtttccgcatttgtaaagttaggtcaaggattggactagataatttccaaggtcttttttaagcttaaatgttcatggagttaaaaaaattattttgaaatctttaagtatacagaagagttgccagtgtagtacagtcagctcccataagccattcatgtggttttatccactgttaacattttgccatatctcctccttgtcttctaatacatatatatacatattactatacttttgttctggaccatttgctagtaaattgcagaggttgcaaccctttaagctatgtagtttagtatgtgtcccttaagaacaaagacattccattataagatgttatgtaagagactcagcacaaaagaggcatatgtaacatgtaggaagagaataacagtaattgatcaagttcaatataccataatctaacatagagtccacattcaaattttgcctattgtccctttatgacctttatagcagttttttcactaatctaaggattgagggaataggaattttcttgccatgtctatttagtttcctttaatacagcagctttttagcttttccttgacttttgtgacacggacagctttgaaaagtaaaggcccaaccagaaacagtggctcatgcttgtagtcctagcactttgggaaaccaaggcggggtagatcgcttgcgttccagaccagcctgtgcaacatgatgaaaccacatctctacaaaaaaaaaaaaaattcaaaaattagcttggtgtggtggtgcgtccctgtagtcccagctacttgggaggctgaggcggcaggatggctggagctcaggaggcggaggttgtggtgagctgaggtcgtgccactgcactccagcctgggcagtagagccagaacttgtcttaaataaataaataataagaaagaaataaagaaaagtaaaggcccttaattttgtataatggctcatttgggtttgcataagtgtttccactgtaccttgatttgtgtgtgtgtgtgtgtgtgtagtttaattctgtgtgtgtatgtgcatttgggtgcacacaatgtgcacgtacgtgctatggtgctgtgtgcgcaagttgagtcctcttttccaaaatagattgtaaattccttatagacagagatgatttatcttggtaatttttattccccacacttctatgcacgtatgatacttagcctatgattcaaattaaaaatattcataagtcaaaagttcttacatatcccatgggttaaggagatgatttaaaacatacagggaagaacatatcagattaattaactctcagtgattaaggatgccagagaataccatggtaacaatagaagcattatgttttattttattgaatcttgaaggaaattggatactccaaagtataatataatatggaacatgcactgtgaatactgtactagttgacatgtgtaatttcttttcatcatttctctgtggaaaccctttgcaataacgtttgacc

SEQ ID NO: 76226 - DNA, 2407 bp, Homo sapiens
caggcatacagtgtgtaataatcacgtcatggagaatggggtatctatcccctcaagcatttatcctttgtattacaaacaatacaattacaatcttagttattttgaaatgtacaattaagttattattgagtatcgttaccctattttgctatcaagtagtaggtcttattcatttctaattattattatttttgtacccattaaccatttccacctcccgctaagtccccactacccttcccagcctctggtaaccaccattctactctctatgtccatgagttcaattgttttgattttaatggttagtacaagtaagaagtttttcattttaaagtcagcatctgaaaagatacattgtagcctttagaggctctgatttccttgaagcctgttacttatttgtaaaggtccatagtaagattgaacttactatttggaattttaaattggtagcttcaagaactcttagaagatctttttttttcctattttaatgaagaacatttaatatacaggttttcttagtattgactttcataagtattttctggggcaattactatctcagttgattatctctgaaggcctattttaactctacatttatctgaacttaactgaataactcctcattactcagcacatattttagtgaagagattcttaggagtaacggctgacattcaccatattgtggtttgtctgtgtgtatgttcctgtggataacttggcaatcgcttcctcagcgaaataacagccagtgtggttcagccaaagtttagaggaataaagtaactgaagtgggaggtttttctgtaatgccgagtgattttattcttggttctttctttttgaattgctcaggtagtgtttgccgtggtaggtattaaaaccaaaccaagcaaacaaacaaacagtaaaaacccaataacaaccaacaaacaggaaataccaggtaattcagattatctagttatgtgccatagtatgaacccaagaactcttcctgtaactccaaaataaatgtatgcttaggtcagaatctgagttagaaatgaaaaacaaggctaggtgcggtcgttcacgcctgtaatcccagcactttcggaggtcaaggcgagcggatcatgaggtcaggagttcgagaccagcctggccaacatagtgaaagcctgtctctactaaaaatacaaaaattagccgggtgtggtggcaggcgcctgtcatcccagctacttgggaggctgaggcaggagaattgcttgaacatggtaagcggaagttgcaatgagccaagattgcaccactgcactgcagcctaggcaacagaacaacactccatctcaaaaaataaagaaataaagaaataaataaataataataaaaaagaaatgaaaaacaacatcttgtctattttttccaggatcaggtgtaataggaaactggtgatgcactaagtttttcacagacatggcttgagaatattttctattttatatgcttgttaattttttaaaaataggattgtttgggagcttatttccactgcagcaggaagaggcactgtgattcactgaattgtgtgaattaaaggcatgatcaaggaacaggccattgaaaatgatggccctgcagtattaaaagtgctttgatcttctgttttgacacattgaatttatctttaattatatgtgatgacatttgattactatacacttagactattataatgtggtttgtaaaatatagtttgtaatgtataataacttcaacaccgatttttctgtagatatgaatttacagagtcatgttttagttttgtttaagagaaaactattagacttctgaattaacagacatttaaaaggtaaatatttagtagtcaggcaaagtatgattcctatacaataagtattaggactgtaccctgtgggactcagtgccttattttaatagaggtaatagaattctatgtggtggtttcctgatctatccactactggctgctttactacaggtaaatcacttagttctctgagcctttgaaaaatgaaagccttagactacatgatattcaagattttaattctgaaattctttgaatctattattctgtgacgtctttgatggacataatatagaattccatagaaattactgacacattttctaaaagaaagatatttttaaaatattgtgtgaattaatgggttttgaccttgcatttaaatatgaaaatgaggccgggcgcagtggctcatgcctgtaatcccagcactttgggaggccaaggcaggtggatcacctgaggtcgggagttcaagaccagctgaccaacatggagaaaccccatctctactaaaaatacaaaaaaattagctgggcgtggtggcacatgcca

SEQ ID NO: 76227 - DNA, 1976 bp, Homo sapiens
agccttcaggcaggaagatggaggagagaaagcagatcacagaccctaaacatctgtaggttctctctctttcttgttccctacagctggtgaatctgaattgaatccttagtaaagtttcatattaggtgatttagtagatgctagttaaggaaaaatgatgatctctaagaattagcctgattttattaaaaaaactttgtggagattaacctaatttccttcttcttaggaaggctattagactgttgatcacagcagacaggggtctgaatttcatgaagttttttgacatggtccatcatgatatcactgtgggcagaatggatgagagggatatgatataaaaatacggttatgttgttatgcagctggctgaacagccatctgaaagagtgatatttaatggtctgtgttaacctggaaggagaactctgggataccataggaatctgtcttcaccttcattatatatatcaacaaagagttaaaagaaatatagctggcctactaattaaatttgtagataatatacagttgaggaaggatggcttaaattattgggtgatatagacaggagtcaaaattattgggtgatatagacagtctcaataaacataggagtgcagatatctctttgatatagacaggagtcaaaaaagctctaaaaatatcaggatgataggcttaaccagcaagataaaatttactgagaacaagtttataatataatatataatgctatgtattacagaatagaggagaaatggcttagatgtaggggtaggaaaaaaggcttaacgttcctaagttaacagaaaacttaatatgggcaactttgtcatgtttctttcaaaaaaatgcattgtgatcttaggaatgtctagaacattaatagaatgtctagaataagattagtagtagtcccgctttattctatgcatcggactattttgttctgattatcgcagtctgagagtgataagcttcaagcacatccagaagaaaatggctaaagtttttcacataacaaagctacaaaaagaagcctataaggagtcataatagctgtctcctgatatttgatgggcaaccctttggaaggaaggttagaatgagactgtgaagctccagaaggtaaagtgacaaccaattgttacatgaagatggattttgactccatataaagaatatttgtctggtccttaaagctgtctaaaaaatgaaatagactgtgctgggagttaagtagtgaattttccagggtgttgccaaactaccttaagggtatgtggtaatagaagaaatttattcatcagaaagggggtaaaactagttgatgtttagattcagtctactctttttggtggtgtgtttcctacttgtttataccaatttactctctgtcgtttggctaagaggcagagaatgtctttgaccataaattgataaacaggattcatctgtatatgttattatcaaaacatgcctgttacttttccaagaagctttattcttatctactcctaaaatatctttatgaagttaaaaggacttaacataagtatttagaaggaaaaatgttttttttttctaggaagcattatttatatttggcacttttttattagtgtcaaaaacaaggtgatcacactgcagctataagaagatagtgctatgaaatgaatatgtgcagatacatcagagtaaccaggttcattggtttgttcactcatttgttttttactcattcattaatttataaatattttttcggatacctggtaagtgctggtcgctctgctaggtactaggaagttgatatatactatagtttctctgaccatttacctaaaaatctgttaataggctccatttcttctaatcatccaagaaacatttttttaatttttaatttttgttggtacatagtagttctgtatatttatagagtacatgagatattttgatacaga

SEQ ID NO: 76228 - DNA, 3063 bp, Homo sapiens
ctaacatcagaatcacctgaatcatcagaatcgtctatttcggaaaaattagattcagccaataactgtttgagaactgtgttaacatcatgtgtaggaatgctatgttttctaggatttgacatttttggtgattgagaattactacattttgtaaatggatatatcactaccaaaaacagaatggtacaaatagaatgatgtattttgtttccaaagttgatatactagagcaatgtgaaagtaataattaaaatgagatattacatggcaaagttatctcagggtaaacgctgcagccgcaagtgccactggtgagtattctctgggcagatgggaaaaggatcaagaaccactactctggagctagttcagccttactactaggatgtaacccttctggagtctctgtgcagtgctctagatattcaatgaggtctctctcctttaccttgtcaaaatgtctcacagtcttatatgagtactgggaattatttagattaacattcatggtactttgtttgttcttatggaatttactctatgtatgtgcagcttaattttcagtcatagtctcaaggggaaccctgtgtagatttcctgagctcttctctgcatagctcttcctctttagcactctgccctgaagagtccatctctttcctcctctttaaactctgaactctgtcaccctaacttagtaagacctctgtactctgcttggggttatcattccttgtggtgcattccagaaagtgcttccagacagacatcagggcgaccttgttcattttccttttctcagggatcacagtcttaacactaacttttgtctgaggtgtgacagtaacttttttgtatatttttccagttttttcagtgtttacagtaggacagatctggtactagttattctgttatagctggaagtccaggtacttattttttatggtcatgaggctacatagaagctcattatatgaggaaaataaatgctgtactaatttcttcacatgatttcaggcagcactagagtgctatatgatacatattaggcactgtgctagcataggaggattaaaacccaaatgggatagtgcctttgtcttcaaagatctcatgacctacaagagtggactggtatataaacaacacattccaagtcagtttgtgataaaggcagcatgaaattatataaaggccatagactttgaaatcagataggctttggttaaatcccaactccatgacttactattgtattatgcaacctctcacatctttagttttccaactgcagaatggagataatagtacgttataggacttctgagaaggttaaattaaaattcttttataaagcacttgacttggcatatcatagaggttcattaagtattaggtttatttcccgttagaatacacataggatagaggagcagttaatttttattattactatagaaatcttcagggaggaaatgatatttaaattgtgccttgaaggtggagtagggttttgatatgtgttagatgggttccaaggacattctacttttaaggaactaaatgagcaagggctcaaaggtgtaaaacgtggggaaggctgtaaatacacttatgaatgtcagcatagtccagaaccttaggaaaagcaatttaggtcttaaaaacaaacaaacaaacaaaaagacaacaaaaaactagtagtaggaatgtaaaaatgaagaaaaaaagaacaaacagaaagtctaaccccatagtaaaagtatacttccttaggccattcctatttattgccatgactaataaatttgggaatgcctgtggaaaattcctgtgggctgatcttttcttaaccactattcaagactgctttacgttgatagtctaagccgatcatttcattaatattaaactccagagctcattcccgagtttccaagaatttgctgaattgcttttctctgttatctgcttctttgggtaacttccatatttttctttcttgccctgtaaaaattgatttcctaggttttccaagtgattgataatgtgacagtactataaagacttttcttagactctggtatgttcgcatttagtacaaatactgtcaagggttttataaagtgtataactaatatactttctacatatcttttactagggaattctaaacttaagtattttatttcattgaggttaaaatatgtcctgttaagattttttttctcttttaaattattagtgttttgcattgttaaaaatcagctggcttcttggattgagtttacttcacttttccagtgggtaacttttatctgacctttaggtctgtaattgtttggtttgttttctgaagctatggaatgttttggaaaaaataagcctcatggagaagggctattatccctgaaaatgatgagaccggaaatgagaaaagcaaaaatcagatatcacccttgaccatgtggatttcagtttttaaaaagtctttatcctctgtctctgagaaccattatttggaagtctgtttctctgcctctctgtgataagttctcaccaaagatcctcttgtgtttttattagaattacatcgaattcataaattggggagaatttatgtatttataatattgaatcttttcatttatgaaaatggtttatttctctatttaggtattctataatattatagacttttgtcctcaaagatcttacaaatcataatttggttagatttattcatgggtttttaatagtttttaaaaaatgggatctgtttttattatgtaatccaatcagttcttggatcagaaaattgatttttatatttaaagtccagcaaaactgctttgcatgcttattaaaatggcttgcaaactatcgtatattttctatggaatcatatatgcagtagcagtttttcttctattccaaacctcatacttctttattcttgaatagaagtgtcatagtgggattttttcttattcctgatttccggagactccaatatatcatttttcattttagaaagtttatttttcttgctatatt

SEQ ID NO: 76229 - DNA, 2011 bp, Homo sapiens
atgtggtagattatgttaatggcttttgtagtgttaaatcatccttgcattgccaaataaactatacttagttatttaaaaagaatatattgctgtaatcccagcactttgggaggccgaggtgggcggatcacaaggtctggagatcaagaccatcctggctgacacggtgaaaccctgtctctactaaaaatacaaaaagaaattagccaggtgtggtggcgggtgcctgtagtcccagctactcgggacgctgaggcaggagaacggcgtgaacccgggaggtggaggttgcagtgagctgagatcgcgccactgcactccagcctgggcaacacagcaagactccgtctcaaaaaaaaaaaaaaaaaaaaaaagaatatattggtggatttttttgttactattttgtttaagaattccttgtagtttttgtttgtagtaccgatttttctttctagattatagaagaagctcagcagctttcttcattttctattctctggaaaaatttttataacataggattttctcatcatgaagatatggtaaaacttatttccacatcctccatacttgatggagtttctaagtaggagggcttttaaaaataatttataaattgaaatataatgtatttatgggaaaattgcacaaatgataaatgtagctgtagctcaatgaattttcacaaactgaacaatctcatgtaaccagaatccagatgaagaaacaaaaaattaccaatgtcccagaagcccccactgtgtgccctttcagccactgccttttctgagggtgaccacctactccagtttctaaactgtgtattttaggggggtttggttcgtttttgaactgtatacagatgaaattatacagaatgctttttttttggtatatggcctttttcactctgtagtgtatttgtgagattcatcatgttgtattgtgtagttgtggttcattctgtttgctgtgcagtatactattttgtgattattcatacaatagaacatattacatatttatgtatccattctaccattctactgtgtgtgtgtgtgtttttttttttttttttttttttttttgagacagtgtctctctctgttgcccaggctggagtgcaatggcagatctcagctcactgcaacctccgcatcccacgttcaaacaattctcctgcctcaggctcctgggcagctgggattacaggtgcatgccaccacgcccagctaatttttgtatttttaattgaggtggggtttcaccatgttagtcaggctgatctcgaactcctgacttcatgatctgcctgcctcgacctcccaaagtgctgggattacaggcgtgagccaccatgcctggcccattctactgataatggagttttgcatgccttctagttttagcctagtgtaaatagggctgctatggacattttggtggacttatttgcacatttctttcaacctaggagttgaattattgggtcatcagttatgcatgtatttagcttagtgatgttgccaaacagttaagttgttgaactaatttatattcttaccagcagtgttggagtactggttgctgcacattcttgttgggcttcgtatttaactactatattttagctactctagtgggtatattgaataacatgtagtatgctgttaacttgcctttctttgatgattaagcacattaaacacttttttcatatacttattggttatttgtataattttggtgaagtgatgtattgcttctcgacatgctataaagaaatacctaatactgggtaatttataaagaaaagaagtttaactggcttatggttccataggctgtacaggaagcataacggcttctggggaggcctcaagaaactttgaatcatggcaaaagacaaaggggaagcaggtgcatcttacatggcaggtggaagagagagaggagggatgtgctctacacttttagcaggaggaagagagagaggaaggaggtg

SEQ ID NO: 76230 - DNA, 1146 bp, Homo sapiens
cccattggccctgggattttcttcctttggtttatgagtttaaagtgttgacagttgtgaactagtttgctaagtgataggaagcagtgttgaaatgaaatactttaaatcctgaagatttatgaggaagaaaatacttgggcaaatagtgtcaatgagtcctgatacgtattgctaacttgtcactagttcactttacatctgtgtagtgataactttgttttttcctccctcattgattatagtctctcatcccaccatttgccaaggccgtgtaaatagtttgctgtcgtagagatacgcagcaggcccatttgagtagttctctttcactctgatctccttagaaacctatcacttttacctttaaatgatacatttttaaaaaactattgttgttgttgaatgggatttccctaaataagaagagccatctccctagtttcaggattgtggcttctttaattgtaatggagttttaatattatatctacggtggaaatcagagtcaattcaatcttattttgcatcccctgtatgctatcatactgattaggggtgtaacaaagaatggactgtgatttttgccattttgtggttttcactggagattttatagtacagagggagagaatggcatagtaaataaaagaatgagcttagaagtgagactttgtgggtttaaatacctgctctctaatttatcagtttgtatttaacttctcaatatccttatctgtaaagtagaaataacagcactatcattcatcactttctatttccttatctttttgccttttcttcatggaagttttcacttccaagacattatgtttttcttcatttatttacagtaatgtaaaatcctggaatacatgtacctttttggttcactcatgtatttttagtgtctagtgtagggtttgctacataatagctcctaatattcgttccttctactgggaacttcttccaacatgaatatccatatagcttatccccatgctttatttagttccctgctcaagcatcacctcactagagagaacttgctagacgacctcttctataaaatagcaccctttagttttctctattttttcctgctttatttttcttcataatactttactgactgctaagtag

SEQ ID NO: 76231 - DNA, 1046 bp, Homo sapiens
atgatattcaaatctctttatatctaattggaacctacctttccatagcactaaggagagttgtaaggaggtgagtacttggtgtaaaaattgcttatagatgtagttagcttgctatgagattaaaatgatttttaaagtacagagaaaaataagaaataactttaatgcaagtcaatatataatcaactgattatacgtgatttagtccacagatttatagaaattcagataaaaagatcattgaaaccttggctcatcagagagagcttcattagaaaaactgatagttgtttggggtcctgtatcatttattcattttatttattcagacccaatttctccctgtttttctaatacaaatatataagattttagagtaatggattctgttttgttaatataaaaatatttcttgtgtcagaagaattcagatgcttatagatattcttgtaaaatgttattatttttaatgagattgggtcttattccattactttgaaaatgtatacaactgagctgtttcttctgatcagcttatactatggacacttagtttgaagtcatattggaataatttggagaaaggtagaatttagtagatattacagaatttaggtatctattgtaaaatttaggttttatatagggcatgacattttttaagcgaatttataataaatagggctttttcaattatacagtaatgtaggttccaaagtgctattttgtgggttttctgtgtgtttagctgttttgtctgtacttatatttgtatttgtattgtacaaaggatataagtttctttgtagtttggataatcttttggatgaaagaaaggtagtgagtcatacaaaatagtgaaaaaaatcagatattttgaaataatacttctaattttccaaggatttaccaaaatagaggatgttaatttttagtatgaatttttaatgattggattggttttctgatgactgttttaattagttctgcagggcatcccatttctatcaacatagtgtgtgcaacaccttatttaccagtaa

SEQ ID NO: 76232 - DNA, 1013 bp, Homo sapiens
agtttaaacaactggactctgaacctgtttttgttctgattaagaagtttatttatatgttcaggaatacagcggcacaacctgttaacagctgtaaatttgcttgattaagctgtgtgtagacaaatttactagagggaactgttccctaaaaattccagttcacttacatatgaagttagtctggctgtttctcaccagtttccatcatttcctgccaagaataataaacattttcttgcaaagcatcgacactaaaggttagaagtgttcagtgttttatcaatcacactgggctgtcatgaatctcaataaacaaacacagagatatctatgtggatgcctggagaagccgttagaccctagaaaaataatttctttcagacagtatcctagaccttttcaaagtagataaatgtcaattatgaagagacatttattgtaatggaaataatggattcttcggtctagattttcatttactgacctagttcagggaagcttgtacttttagtggataataataagctagagcaagaaagtgtgttttcttaatttcatataactgtagatgctattatgagtattataataaagatgggtttattaatttaaacttatagtattaacatttctctaccatggtctgtcaggcaaactgtggctcacgactggtgcacagcgtgttattgtagcactcacaagttaagaatgggtttatagttttaagtgattgtaacaaacataaaacaaagaattttatatatatatatctagagagagcgagagaggagagagagccctcaaagtctaaaatatttattatctggccctttaagataaagtttgccaaaccctggtctatattagtagtaatagtttactaccagcattcaaaacgtgccagcaacaaagcaggatgaaattatagtcttagtgttagggtattttatttcttatttagtgttaggatattttatttcttatttgcatgtggtatataaaataaaaat

SEQ ID NO: 76233 - DNA, 1121 bp, Homo sapiens
tcttaaataagtacaaaggtcaggcatccaggagctcatccttccatattcttagaattgggatgtgataaataagtcagaattttttcatgaagcagtgcccagatgagtacatgttatcaaatattttatttgataataatgcaggactgactgaccaaacttgatttataaattagttccatgtccttttatgagaataaatacaatatcttggtcttgttgtgataatattacctaatggctatgttttccttcattggcattgaaatcagaactgatttttggtaaggttagtaatttgcgttatttttaaatctccattattatgaagatattttatcagggacaaagattgccttttctctctccctctccttttcttttctttctttttttttttttttcccattaacagttgatggaggaaggtaactttgtatgagttattgttggacatgcaagccctgtttttttacatttgttgattctgctttggagatttatcagtctctgagcaagttgctttgaagcatttcagtcttctttgtctctcagaacccattagtgctatcttcaggatgtgccagagtgacttttaccctggtacatttgtgacacagttacaccatatctcctactctctactcatcactgtatagcaagtacaagttaccagatagaagcatattcttgttggattatcaaaactcaggtggagtgtttaacatcttttttgaatatttaaatagtgtttttctttctaattggcaaattttgggtattctttaaaaacaatatttgattaggagatcatggagaaatttgtatggtcaaaacttgccaaatttgagactcacttatttgtttaaatttaaggatcagtaaaaataaataaataaataaataaataaatgtaggaatctaagatagagacctgtactattctgaatgtgaatgaactgattacattgattggaatacgtaatttaggagcattcattattactttttgacttggaaacaatataagaatgaatgcaaaaaaaaaaaaaaaaggagcatgtggattcattgctatcttgtttactgctcagtcacttatttgagagtgccaaacc

SEQ ID NO: 76234 - DNA, 1843 bp, Homo sapiens
cgatggtgtattagtctgttctcatgttgctaataaagacatacctaagactgggtaatttataaaggaaagaggtttaatggattcacagttccacatggctgggaggcttcataatcatggtggaaggcgaaggaggagcaaagtcatgtcttacatggccgcagagaagagggcgcgtacagaagaactgccctttataaaaccatcagatttcgggagacttattcactatcatgagaacagcatgggaaaaaacctgtccccgtgattcaattacctcccactgggtccctcccatgacacgtggggattatgggagctgcaattcaagatgagatttgggtggggacacagccaaaccatatcaggtggagagtgatataggttataaaacaaatatgtcaaagtgccatgaaaagaagaggacaaaatttttgatagccttaaacaatcgtttcacttttctctgacaccatttattcatttataaatgccttaccttttatggaacttttacagttcttcagcaggaaataatctctcctttattggcatccctatatcattttgccttatggcaattattattttctatctttcttttggcagctgttgatagtaatcattttgtatcttgttaaatcattatttgttcctatcttgtccattttacttgaagacagttcacagtcactcaacacagtacttatcaaaaatgcttcaaaaatatttactgagtgagtcaggtaacaaaacgattaaaatgcttagccatcagcgtatgcctctattttttaagggctttttataagcaaatacgggtagaaaaacattggcagtttgagagtaaaataaacatatataactcaccaactgactgatcaggataattatctgggagtctctgggggtaaaaagcccccagtttgttccattttacaactcccaccatggcctcagtcaggccaccaacatgatacaactagatgtggagtttggaagggtgtgcactggaacaccatcatatagtaatcctgccaactggatacaatagtgtaagcaaccccaagagcacagataatagtaaaatgtccaacatatttaacaaatgaggtgttttgagtatttattatctttgttttaatataatttttatttattggtacatttataacatttagctttaaatgatggctgtgtttaacaactggcttagaaaattcctgaaaatttagtagtcagctcttgtgaaagagtacaagccaactcacatacacttttacccaggctctgctgactgtgtaacttttgctagtaatttcactcctagaatctgtgctaaggaaattatctgtgaattggaaaaagcacaaagatgtttatcatagcattagtagtaacagcaaaaagttggaagcaacctaattgtttaaagtgagctgtggttaagtaaattcactggaatgttttctggaattaagtgacttctttgaagactttataacaacaagggaaaatgccataaagttaaatgaaaaagaaaaaagaaagaatgctaaatatctaatttatatagaatgatcaaaatttaaaaatatagacatatgctaatggaagaaggaaatgtcagtgtttggagctaataaggacatggctttttttctttaaccctttcttcattttccaaatttctaataatgagtatattttataattataatgaaaagatatatcatttttgtcacaaaaccaaattctaatttatagctctagttttttgttgaattacaaggcattatcaaaataaatcttttttattttattttttttgagatggaat

SEQ ID NO: 76235 - DNA, 1050 bp, Homo sapiens
tatctgttaccactctatttacttggtgtgggcgagtttcaacaaggattagattttttaaattaattctctatatttttatgggggagaaattgaagcattccattatattgtaggaattcccggaacttcttagtattccttttctaccttgttaaaccattaatttgtttctatcttattcattttacttgaagacttaaacatttctgtatcactgacagccactcaaacagtactcataaaaaatgtgtcataaacatgtactgagtcaagtagcaaaaccttttaaattattcagctttttatgtgtctggattttgagtcatagacttgtgtgtgccatggggtataatgaatgggtaatggactttggagtaaataagcctaagttcaaagtctgattcttccatttaccagctgtgaaaacttgggtaattattctttgggcctcagacgcatctctgaaatgaatataataatccctagcttgtggagttgctgagaggattagagataaaatatgtaatgttccttgcatatagtaagcattcaatacatggttagttattaggcattcagtaataattgagtggatgactgcttcagggaaaatttggtggctgatttactgaaacacccagtaaacatatatgaaaaaaaaaaacacaccaaaactgacttttagttagaacagtttagagaaactgagagtcagtttataaaggagccttgcaaggaaactgaaaaggtgaaatagacgggaacaaaacctacagagtaccgctgcagtggagaaaagaagtttcagaatgctagaatggtggcagtggcaaattctatagtgaattcaaacaagaaggtcaataattggtcatctctggatttggtcacctttgttatttcccaatttctgtatattctttttatgatcatggttgacaaaagtatagcgctgaacataagacatgctaggaaggaaaatgatttaggaggtacagttgattcttgaaaatcatgggtttaactgcatgggtccaattatatgta

SEQ ID NO: 76236 - DNA, 2134 bp, Homo sapiens
tctctcagcctcagttttcttgtgtgttgaagataataatacctaggtcatggagttgtcgtgaagatcaaaagtgatatctttaaagtgctaagcatagcaggtacacagtaagcatgcaaaataaaggtccttgcattatttttacctccctttctagtggctcctaaccttattaagagtctcttgtcttaagaaattgttctactacttcagtatttagcactctctctctctcttcaccatcacagctattctccactttttatctcctatttattttggctctcacatcagcctggcttcccaagcatttcaaattttatttttaatcttatttcttttccacccctttctctccaaatttgctctgcttccaataagttcatctatcatggctcaaatcagaaaaatagcagatgcccttgttcttttgccctctctacatttaatcatcaaacagagttctgataattctgctgcctaaatagttcctaaatttttctacatctcttctttgggtgctaccatttcagtccaaggcactatcatctcacacagtattgtgacaatagccttctactattctcccctttgccacactattccatactccacactatagatagagtgataacaagaaatgttatttccctttataaacattctaatgagttttcttgctcttagggcagagctcttcttgatcaggtcttatttatctcttctttcagctctatcttataccactattaccctgtgcatgccctagctctgatgagtttctttcagtttcattcagatctcttatttcagcttttccacatagtgttcctctgctgccttcctgatccttcttggggatcattgctacttggcctctggtttcaacctaaactttacttccttgagtgaccttcgcttaggctaggtacttctgtggtctgttctttattaccgtatcatcatggtgctcatgacattttacagttccttatctccccccaagattccagaaggcaggagccatgtctttttcattctctaccacaatgcctggcctatagtagacacccattaaaattttgttaaatgttgttaaataattaaagcaagagaaaaatcatcctatataacatgttagggtttagaactacatatggtattcctgtatttaactttgaatatttctttaaacataagtaaatgtggaaaataataatgctgcttttcagcacatgctcttatttttctatcttcacacattccctaattttaaaatctctttatgtttgtttttattccagactacaaacatcaaatcttttttttttctatttggatgcttttaagtataaagtgtcacttaatatcagcacttctgccaactcttattcatttttccagctgtatttggacaacatttacatagataattttgtgaaattttcaactagaagttgagttgagataaatcatgcagttttcaattcagtgtatcctgaaagataacgaaactcactgagctgcctggttttccaacaagctacatagaaagcatgaggagggcagaaggctatggcttccactgttttgaccacttcacagcccttcccgcagactgcttggagatggctcaagtggaacctgttgataaattaatgatcctctttttcccagtcaccattgagccaaagtaggctatggggctgaatcatcccagacagggatgaatgaatgttctgaaaagctgaaacataaactgtcagttaagatgcattttcttcaagtttatttgtgacagatgatggaaggtagttgatattgactgagtttgattgtttcttaggaacaatcacagtcatttgattgttgttcctaagaaagtagtctttttaaaaaaacaaaatctgagatacaaatgaatcactatatgttaattttccttgcccttcttaggtgaccactgactatattttaccagttgttaatgtagctttgggggggattttgttcatttttttggtgcaccttggataaaaaataattggaaatatttctcattttgcaattactgacttttcatactactggaatacaggatttgtcagagttcttatctgacccagaatag

SEQ ID NO: 76237 - DNA, 1137 bp, Homo sapiens
ttcctatctttataaagtgaagaattgtttttttttaacaaattaacatatcctgagttacattcttgagtgagatatgagaatttaaacatataacatgaatacccccagttttgagtgctaatatgcaaggaaaggctttcctcattactgttttacaacttttatgctccataaggttgattctcagtgctagttctctttcagagagaagattcagtaaaaaacactgtataccagtccttaataacttaaatgcaaatactggcatatatccagaagctaaggttcaattaggtgtagttgtttcatcttacaaaattattttaccagcaagaaatcttggcagttatattgatgatttctcatgaaagaggcaaatgggacgataaagaggcctgaagactattttttaatactaattttctaattcctcatttttttaaatgtcagaagccaggccttagaaatcaagcacctgagttttcctctgattttctaatcattactgtggttattctagttgtctcttatctgttcggaagtcataatgtgtaatgatggcataagtgaatgttaaagaagtggaaatttgatatgatctagatggcagtttattggtttagtttcaaagacaattttacctggaaaataaataagaaagcttatcaagcttttccctgttatccgtggtttatctgttccttgtgtttcatcttgaccaccactggtcttccagaaatcgctaaaatctctcctgcctatgtcatttctttttccttacaagatcaaagcttttatgagcattatttattgtagcctcacaatattctagagagcaaagtagaggttatgtgtctccatctttatttttaaagccaagtgaggaacagataaatctcttcgctaacgttacaaaatgaagcagtggtagaggcagaaataaactcctgaggcagaaacatctcctaattctggcccttacgtctaagatgcagtagactgtttggcctttctctaaacaggcctttgacatttagggtatgtggaaagtatgtgctcccgtcagagtttcgctgtttagttattctttgcctgttaaagtaatgactagaagactggagaaagcagaaagaa

SEQ ID NO: 76238 - DNA, 2039 bp, Homo sapiens
ctgtcaccaggttggggtgcagtggcacgctctcgctcactgcaacctccgcctcctgggttcaagcaattcttgtgcctcagcctcccgagtagctgggattacaggcacgtgccgccacacccagctaatttttatatttttagtagagacagggttttaccacgttggccaggatggtctcaatcttctgacctcgtgatctgcctgccttggcctcccaaagtgctggaattacaggtgtgagccaccgtgcctggctgcctctttctttttttaaagggctgcttttcatattgacctacatgactaaacctgagttataattcagaagaaacagttgaactattgtgtgccatcttgtcataaagcgcaggttagcacaaatgtcttgccaatgtcttaaatgttgcaatttttgtaaaatcttccgtgtgcctccaacatctccagttggtgaacagatctcactgtatttatccctgttgtgttcttccacatgtttgttttgcagcataataacacttgacagttgtaaatttttccgtatgttctgttttgtagagataaacaatgtactttctgtgtatttccctgagctttgaagacttaacttttgaaataaacaattccataggattttataggaggctttggtacgttattcacacaaactattctccttgaaagggaaggtagttgaatgttcatccttttgatataaactggttaactgaacttttccaagggatcaagcacaacttaactgcttttagctttgcaaccagggcaatgcagaccagaccagtgtttgaaagtctttaaaagtattatttgacatcataaatgaccattctgtggaataagctctctaattctctgagtggtttacttcagttagagggattagtgaattagctttggatttgcttataatttcctcttttatcttttacaaattaaaaagttggtatcggcatgtaatgatagcatctaaaacatttatgttgtggtggttgtatcatagaaaacattctttaggattcaattataagcagcctccttccattagcatgtcaagtttttctgagcagttttatttgtgaaaaatcagtacagatatttttattcatagcttgatatcctttttttttttcttactcaaatgaatatctgtttcctacctttctccctcaagatgcagtggtgcttttattatttgattttgtaaagcctgaagggcagaaatatttcttaagttttccattgttaactacaaacttggctatataaaatatacaaatcataatatctgtatggttatttttattgtcatttctttaacacacaaaatttatcacatttatgcaagaattttttaacttagaaaactcaaaattgatatgtaaattgggtggtagcaacaatgtgtgggatgtggtacgtggccaatgatgtgttggaggcagcccccaccagctcccaagatctagtgattaaattttcagaaattttgtgagccagttatcagtaaaaattaaactatataaacttacaattaaataaattatttaaaaacaaagataatactcaaaactcagtaattatgttttactacattttattatctatgctcttgaggttatttgtgtctcttgtatctgtattggaaatactatataatggtgtatactattgtatatctcttcacaacttcatgttcattaacatcatgttgatagcttcaaattagccatggtagaagtattaacaccatgaaaatcagcaaacacaaccaatcaggggctgatttattgttttgctgattgtctagacttaagaaagtgatggaaaaaatgttaataacacatattaaaaagtgtgttatatctggccgggtgcggtggctcatgctgtaatcccagcactttgggaggctgaggcaggcagatcacaaggtcaggagatcgagaaccatcctggccaacatggtgaaaccccatctgtactaaaaataaaaaatttgctgggtgtggtgg

SEQ ID NO: 76239 - DNA, 1997 bp, Homo sapiens
tattctcaatccttttgattattttttctctcctaaagtcataatttgtccactttccttccttccttaattggagtaccaggactagcctgagggtcaacatttatactctcttttttttttttaatccttgttttcttccccagcagccacaggtcaagttcttgccccttctaatggtctggtcatttcttttcctgtctgcctgaaactggcagaccctgagaactgtctacaggcctatagctaattctcagtttttcctggatagttttaatagtatggatgtcatcctgactcttagcttcttttccttctcccaccagttctctgccattcagctattttaccgctgcttttctttttactaagatgtgcctatctctgcatccatgaggcctctgtttccattctaccttgcagccatctgcttctcacttttgctgttgttgctcgtaattgtaagtttaatataagcagcagcctcaggagaccccatgaaagcaatcttctggaaacagtcaaagtgctgggaatttgatggttggatctgggaatatcaataatgtctacaactgatgaatgtagctggctatagattctgaagtactccagtgcgtcatcagcatttcatgagtatactgtctgtgtgattttttcacagagtttccctttgaattttatgtctgcagagtttctaaacactgcacctggctcatacagttacaagccttctttctcagtatttatatagttgtttattcagtctccaagatgattagttatttgagatgagtagaagttgcatctattcatgtaatcagagcttgttttcttgctcactggtggccagatacaggtcataatagtattttattttcttaactttgaatagcgttaaaggggagtggactcatttgaattacaggaggtactgaaagaaaactatattattcattacattttgtaaagcaaggaacaaagaggaatagttgtttcctaccatggtaatttcagactctgaaagatctgtttataagccaaatgtagacatacctatccctaacccagatttttttatggtcttcaattttgtaattatttagaattgaagggttttttttcctttctgccacatatttttgtacacaccctttctccctcccctttcccatgcttttgtttccttgagaaaaggagcgtccctcttagagcatagaataaacattctttgtgaagtgtgacttatttatgcttcaggggttgtcagtgtatacacaatagagaaggtgatggaggctccgaggcatgccaagtcagcactttgtgcatgttgaggccaaagagcatgttaagcaggcttaaaaaattttaacaagtcagaacattttacaatttccatatttatcaaacatgtcaggggatgggatcacaaagccttccagggattaactgcctctctgacttgaactgttttattaagatggaagaagccaagttctcaacaccctgtgatttgctctaataaccacaagaatcagaatgtaggtgatccttgctgaatgaaagcaatcctaaggctaaatgctctttgaatggggaaaaaaaaaaactctctcaacagatgaactatgtgtgaaactttctaacagagcttaggagtttgaagtttatttacctagagcttcagttttattaattctctggttggtggttcttgacctttgacacccaaggacttagactgtgaagcctaaatagaaggcattcagaaacctgaagacattctcaaagaggggtggccattggcttttttggggttggcaaaacatcctagagttattatttgtttttacatgtttggggtttggcagatcctaagatgcattttgccaagcactttcctttgaattttagtacaggaatatcttgggtggaatttaattcgtgattcatttgcattatactgatcagaatgccattttggaaaagatatc

SEQ ID NO: 76240 - DNA, 1048 bp, Homo sapiens
aatgagtaccaaaccataaactttttaaagaacagggaaagcacatagctaaatatggtacccaacattattgcccatcaggctgcaacaaagcatgatgacaaaaacaggttttttcttgtctactgtcagcttcctattgtttgtaactggcccaggaaaagcagtgccagcaactcaaatgactgctctcactgtcttcttgagaaaacagcagtgcaagcaagcgtccatcaggaaaagaaagaagcattttaaacaaatttacatggatatctttaggttcaaattattttgaaaccaaaggatatgaagtgttgggaattctagttctgaattctataaatcagtgtaaggagaaggacagtgtgatagagactcttttatttgcttcaaatagtggggtgaataagttataagagtatcactgggccagtgttgatgattttcttttctctcttgttccccatgttcttcaaactgcttaaaagtcaaaacacaagatgtattttgagttcttgaccttatcctggccctgacttagtttgtcagaatattaggttgtctacagagatccaccctggtttccatctaaatttttttagattttggtcaactttctatatctttatttaaataactgtaagtattcctttcagtataataaaaatttatgtttttcttcttcttaaactttggtccttgtccttgttactttaaaacagagaacttagtaaagataactttttcttttatttctcatttttctctttctctctctatacccctctttgcttgcccccgcccccaaccttgtctctttcttactggctataatctaattagtgaatgcttatcaatgaccaatgagaacattgtcacattttacattttgcttgttactgaactgtaatctctgttgcagaaagcaggatttttgtgaggttgaaaggaaagtgtggcatcccatgagtctgatgctattacgttttagaaaattgaaatgactggccaggcgtggtggctcacgcctgtaatcccagcactt

SEQ ID NO: 76241 - DNA, 1254 bp, Homo sapiens
gagaccagcctcatcatggagaaacctcgtctctactaaaaatacaaaattagccaggtgtggtggtgcatgcctgtaatcccagctactcgggaggctgaggcaggagtattgcttgaacctgggaggcagaggttgtagtgagccaagatcgcgccattgcactccagcctgggcaacaagagcgaaactctgtctcaaaaaaaaaaaaaaaaaaaaaaaaaaagaaaagaaaattgaaatgacttactacattattgagagcatatcttagctttggataataaagaatatagataaacattttaagagcagctcttgtttcatacttcttatctcacacacagtgccttttacacaataagggctgaataaaattgttacccattttagttcagttaatttttgaatgtgagggcagatcatttaattccgtatcttaatatataatccaggactggtgaataatacttcctgccaaaaatccattaaccttacaggaaacaaaacccagtgaggatcatagaagtaaaaataacttaatttagatttcataagttgttatttttttagagaaaagcataaaatgttctgtacctgcacatttgaaaataaaatcaagaagcaaaacattctcatgagtaagaatatgaaacaataatttgaaaataccaaaactcagtatttattactgttctacagtagatattagtgactagggaaaggacaaggtggctatggggtagtagaaaagggagccagatatgcaaacctttggggatgatgatttaactgcttcatgacagttaagaaaagatttattttttttagggtttaaaattactatatttaaaaatatataaatatttgagttttttcctcaagtctggaagcagaagcattcctcagtctttctctccttcgacatggcagcaacagcaacagcagcagcagccaccgctgctgccacggccctggctccacctagggaaattgcagaagaccctatctcattctagtgaggaaggttctatgaagtagatagttcatcttgtagactttttagaccattgctgtaaaagacttttatattttttattttttgagacaaggtctcactctgtcacccaggctggagtgcagtggcacaatcatggctcactgcagccttgacctttcgggctcaagcaatcctctcacttcagcctcccaagtagctgggactacatgcacatgccactctgtcagctaatt

SEQ ID NO: 76242 - DNA, 2258 bp, Homo sapiens
taatgtgccaggcactgtgttaaacattttacaaatattaatattatctcttctcagcactatgagggtgggtatagttataccttgagcttatatttcagggaatgtctacaaatgagtctactgctttaagtaggcttcactgtatgaagaaaatgcagacagcagaaaagaaagctagacgtttttcatggatgcttctttctttctttttcttttttttaggttttattttggagggaaggaagaagaacctgtcttctttaaaaaatgaaatatttttaaccgaaatgttatctagtgtttagtgtgtcaacaagttctaaattgtggaaaagtcttatcagaagaaaggctgctttgaaaacgatatggaaatatttgttgggtgttcactccttcaacgtctaaatgaaatacactggggagtaactgaattttacagtatttagatagctacatagtgagcaatcaaaacattctttaagtatttaataagaggttaagatcggcccgcctaaagcttatataatagaactgagtcagtgatgatgagcattttttcatgtgtctgttggctgcataaatgtcttcttttgagaaatgtctgttcatatccttcgcccactttttgatggggttgtttgttttttccttgtaaatttgtttgagttctttgtagattgtggatattagccctttgtcagatgagtagattgcaaaaattttctcccgttctctaggttgcctgttcactctgatagtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtgtaaggcaatcagagaaatgcaaatcaaaaccacagtgaaatatcatctcacaccagttagaatggcaatcattaaaaagtcaggaaacaacaggtgctggagaggatgtggagaaataggaacacttttacactgttgatgtgattgtaaactagttcaaccattgtggaagttggtgtggtgattcctcagggatctagaactagaaataccatttgacccagccatcccattactgggtatatacccaaaggaatataaatcattctgctataaagacacatgcacagatatgtttattgcggtactattcacaatagcaaagacttggaaccaacccaaatgtccaacaatgatagactggattgagaaaatgtggcacatttacatcatggaatactatgcagccataaaaaatgatgagttcatgtcctttgtagggacatggatgaagctggaaaccatcattctcagcagactaccgcaaggacaaaaaaccaaacactgcatgttctcactcacaggtgggaattgaacaatgagaacacttggaccaggaaggggaacatcacacactggggcctgttgtggggtggggggagcggggagggatagcattaagagatatacctaatgtaaatgacgagttaatgggtgtagcacaccaacatggcacatgtatacatatgtaacaaacctgcacattgtgcacatgtaccctagaacttaaagtataataaaatatatatacatatgtataaagtaatagaaatgagtccaggaatcagtaacttggatactttgttagctgttcgagaccctgggccaggccaacacttcctaaaggtgccagagcacacagagagcatagagattgcactgattgcaaacctatccaagggccccagctcctctgctaacacccaaggcctctccacctgtttttctccgagttgctcgtcaccctgtcctttaccttctagattccccagggctcctggtctccttggaattaagactttgagattttgttgtaagagtttccaaacaattcttcacaatatctcttgggtttgtccttgtttatccaggcctttgttactcccacagcctccttgccagcctttttgatgcatcctttgctgctcactgccttaatacccatgccatctccaggtctgtatttctaaaacatttctcttgtgtcattcctctgctccaagaaggccttgaatgtcaagcctgtttttcagcttgtcttttgaggtcttctgtaatctggctg

SEQ ID NO: 76243 - DNA, 1175 bp, Homo sapiens
taatcccagctactcaggaagctgaggcaggagaattgcttgaacctgggaggcagaggttgcagtgagctgaggttgtgccattgcactccagcctggacaacaagagtgaaactccgtctcaaaaaaaaaaaaaacaaaggaagaaggaaatatttattgggttgggtggagtaggctcagagccatgaatgttccaaatgatagtaaaattggatctcagcttcctattttatggcaaacgaggtgattactggtaaaataaatgaataaataaaaaataataaaaataaagcctttaaagagaaaatgtaatagttctttccaatgatctttagattttttaccataatcatcagaattatctttgatggtttctaaaatgtgttgtattaatgtataatgtaaactttaataaatgtgcttttaaatgccagttgctgacattaaaatatatctataatgaagttcaaagataaatggaactttctgaaaactcctttgcaagttaatttagatataggaggtaggatttgaaaacaggatcacattataaactcaatagtcctagaattattatttaatatataaaagatatcaaaatgcatttgtaaacatttgaaagataacagaattggaaaattattgttcatttaatacaaaaatgctttcagaatctcttagctttttttgtcatttactagaaaaattgctggtttctgtattttttctttttcttcttctaactttttaatttattatacatcattgtactaacagtaaaggaaatttaaatgatgaaaataaaatctgccatcttatcaagttcaatgtgactgtaaccttttagttctttgtgtgtgtgtgtgtgtgtgtgtgtgtgtgtgtgtgtttggttggcttttattgatgtatataaaaagattacagacagcaagagaagataatcagaggccttttcgttcttatcaaattaagttgctttatagttgtatttttcttttatattttaatatgcatttgtaattgatagaggaaagaatttgtctttcctctgtctcctctaattttgtgccaaggaaaatctggcacagaattaatcaaatttttgcctaatttttatcatgatataattaaaaaattgagtatatgatactcaattttatctttattgt

SEQ ID NO: 76244 - DNA, 1473 bp, Homo sapiens
gtattctaggcatgtcatatatgtaacatgcatatgatatgcagatagtgtatgcactattataataatataatccaattatagtctttattttcattatcttaaggatatttatatagttcaattgagtcgctaggaaataaaaaaaagttttttaagggtggggccttgctatgttgtcctggctgttcttgaactctgggcctcaagtcatccttttgcctcagcctcccaagtagctgggactacaggtatgcaccactgtgcctggccaagaatatttctttgtttcctgtttctgtgtttaagctgcatttagtttggcagtgtttgaaaggtatcatttctggtttacattcagctcttgtcctttctaccagctgagtgacttatgaacagaaaattatagagtaaaaataatatgacatatatgttaggctctaagcccttcaccttttttttttccttccaaataaagatgaagcagcttgtctaggtgcaatgccatgttaatatcctgtaaagataattagtagctgacttagcatattgcttggaggtttcctgagagaccaactttagctataatgcaagagatatttgatttctattaatacttgaataagtcattggttttatcaagatcctatatttaattataacttggggctggacacggtggctcatgcccgtagtcccagcactttgggaggccaaagtggaaggactgcttgagcccaagggttccagaccagcctgcgcaaaagagggagcccctgtctctacaaaaaaataaaaaattagttgggtgtgatagcttgtgcctgtagtcccagctattcaggaggttgtggtgggggaattgcttgagcctgggaggttgaggtttcagtgagccatgatggcaccactgcactcccgcctgggcaatagagccaagaccctatctctaaataaataaataaatcctggtctatttaaaaccctggatttgttttaaatagccatctaatttttatgctacaaaagagttaacatactttcttgtttttggaatctctctgaccttagaaccatactaactttgccatggatatttcttggggcctatttttccaaaataatcattctctttttttagagtctactgttcattttaattaaattgtttcccactatgctggtatgatttcaggaaaggagcatttaagtcatatgttcaatcaaaacttctgcaggtaaattataacccacttttcttttttatttcatgtggtcttggcaaatcatgttttaattgtggtcaaaatctgcatagaaacatattgtttcattgatttgcataatattttggggcattttaaaaatatacatcaatccccagagatcttaagctctacttgacagtatttagcatttacttctgcttaaactctgatatatttgagaaagcagaaggtaccacagtataat

SEQ ID NO: 76245 - DNA, 2193 bp, Homo sapiens
tatctgaatatttaaagtatattaaaaacattaaagacaaaaagacaaaagttttttaaagtatatattttttctcactgcataggatattagactacatatgtgccatctattttaaaactaatttcattcatcaccatctgttttcaagaaagatttaaggtggcgtatgtgcgctcttgtacttggtctcacaggctctgtctctctaacatacaaatctcctggaagtcaaaggtcatgtcttttcttctttctcctccatcttttacatctggctaaaattatattctgtatgcatgaaaatgataattacatattacctggtagttatcagatagttcacaaatttcctggagaagacataggaacaaaacagggccttctgtgatgaagaaagatgagaaaaatggagtatgacatcaggacacttagccttagtgttcttactcattacttttgtaaacctgtaacattttttcccatgctgttcccttttctgcttcatgtcttgattttcccatttgcaaaataaggatggaaacagttgcttcctgtttatttgatggggaatttaaggatgaatgggctagtgtttccttccccagatgtatcaacttaatcttatttattttctgtccatacttctgattccataatgtccaattgtatatgtgttttcaattcttttatttacattcttttccttttctgggattcttcaaaatcaaagcatgttaatcacatttcatagtgcacttgagtacccaagatactcttcagatatgggctaatgtttgaatagctctatttgcttttgagtgtctatcaaaacccaggccccagaccatcaaagcatgtaatatgagaggtgtccccagcctgaaatgcagatcagtttccaaggtgttaaagctttttctgaaagcctcactttggtctgctcagatgccttcttttcttttaacctagttgagcagttatgaaccaatgccatgatgaacagttgggtttgatcagtgcaggggtctattcaggagcattaactgaaaagtctactttctcatctgaaaaacagatgttttaccgtgatcctcaacatgtatgtgcctggcctctctgatactgattgagaaaaagaaaaacagtttagtagtcaatatctggggtcttcatcagctccaaataaactattaacagttaaatttcaacataagaaaaaatagagggccttgggactctgaaacaaaccactcattgatagaatttcactgaagatcagagccaaagtaatgcctaacaatttataaggttgtgcaggggaagaaaactggtcctgatctgatgtagggagtccagtgagagcaagcacttagttggagactcaaagttctgtagcatggcctggaagaaattagcttgtcctagaagattttgaagttaggcgctaacaattataagcatctatcactttgatatggctctcaaataattaaagaaattttgtcctataatgaggtgcctaaaggatataattgtttagtaatatttgagtactatagaatgtcttccagagagcataggttttgggttgccataactgatactgagttgttttttgtttttctgtctgaagtggccagagattcaaatgcctcttgagcctcctcctcgcatgtgcaagtaggactgtggtcctggcccacaggagcctcttcagctttcctccagctgtggcacaggacatgtgttcggttcactcgatcacattattaagtaacataggtattatttaaaaggagaagagtgagggcggagtcctattttatggcatttaagtttggaaccacttatgtcaaaactcatttctgtgtttatatgtacttcctaatttatttataataagcatgttgaattatgaaggagaatgttatttcaaaattctattggaggctacttagaggctgtggtgacactgaatgagagctctgaaggaaatcatagtgaaacaggaaaagttcccttgtccccgtcgcagggcatgcgacaagggggagtggcttgcttcttcagtgccccactgctcaaacctctaggggagaacacagatgggcaggctgtggggctctgaccccacggcagtgtctaggggtaaatgtttacagctgaagccccagtgaatgttgaagaata

SEQ ID NO: 76246 - DNA, 1394 bp, Homo sapiens
ctttgtggttttattagagatggggtttcaccatgttagccaggatggtctcgatctcctgacctcgtgatctgcctgcctcggcctcccaaagtgctgggattatagatgtgagccactgcgcccggccgcaaataatatttcttaatttcagttgcatttatttttaaataggaaatacattcacctggttcagaatttcagaggttacagagctgtacgtaggaagaagttttgttttctcccaattccgcaagccatctgattagcccccttgaaggtagctcaagttactagtttcttttatttccttccataaatatttgatatgcataggagaaagatatatatatatatatgtatttatgtatgtatgtatgtatgtatatgtatgtgagaatgaatggataaataagcattcctctttcatacagttacttgcttaccatacctgctgttctataccttgcttaatttcacttaacactatgtcttggaattcattccatgttagtacataaaatgctgcttttttctttcttgtggttttgtggtatctattgtatagctgtattataatttttttttaactaggtccttactgatggacatttatgttgttgccagtcttttcattacaatgactaatgttgttttcttagttttcacttttcaattcatttcctaatttagtctgagcctacatattagtgccaagaactgaggtatttattgtgttctgacacatctgaggtatttgcatatagacatctgggtacatatgcacactgctgaactgtctaataatagtctctttccccaggacactctcctaaggtaaaacctatatattggaattcttatgctgtacatatatgctggatcacaactcttactgtcagactagagagtttcaacttttaacctgtgatttcagttattgtgacatatcctatgtttcaattagaagagacaaactttatttggtgagattcaaatagcgttcatgaaaacggtatcttttaataaagtgaggttaaaaaaatgggaaccacctaagatcttagagtgagaggagtagagattatgaaagcagttttactttttgattttagggtctttctatataatttcagcctgtatcagataattccgtttaggacacagctggtacatttaatgatcacaaactctgaaggtagtaactggatgcaataatcacacaacaaagtcattgagtaggtttgttgacttatgtcagattactctaaatcttgatgatattgcctggagcacaaaaaaggaatattgtcacagcaagcaatggaggttttgatactcgatcactggagtattcttttcccctaaattttgcgctcgttgtatcataactg

SEQ ID NO: 76247 - DNA, 1068 bp, Homo sapiens
agaaaattagtagaaaaaagccattagaactgatatatattagcattggtttggtggttacttattaaagataaaaatggagaatatttcatatttcttgatagaaaaaaagtaagttgccattcatgcaagtaaatcatattaatttaggtttttggcattttttttgttttctgagagaaacatgaagagttctgcttatttattttttatcttgagaatgggaacacattaacaagtacaagcgacaataaaacttactccataactacattatgaactatattaacttactctacaactcgataaccaacattatggttggttaaataaagagagtgaaaaagacagagagggaacgtgagaaagaaacaatctttttgtttcccaaagctgtaagaagcaatgataagacattgagtgtgtacgtgtgtgcatgttggggtattttagtattgtgtttatttttgttgggagtgagcagaaaatgaagccttcagtaaagaaattaataaatcttattagaacttgttgtaaatattttttaaattcctaaagttggaacactaaggcattatttaaactttatctctgttttttaaaatctgagaaacccattaacttttaccctagaaaatggaaagtgtcatatctcattttacagaggaagttaacaggtttattgtcttgttgtaacatcctaatcctgtgacattttgaaatagtgcttttggtagtgccttgtttttgaaactatagacctctggggcactatggacattttgtactagataattccttgtcactgggggctgttctgtacattgtaggatatttagcagcatctctgacttctacccactagatgccagtagcagcactcccttgggggacaaaattgtccccagttcagaacaactgctgtggacatacatggtggtcctacacaactggagtttaaatatggatcctgaacagctttcatcagtctgatgcacttccccaatatttgtaatcatgaggagcagagcaaaacaaaggcataaatgttggggtaatattttgttt

SEQ ID NO: 76248 - DNA, 1678 bp, Homo sapiens
gtgtgtgtgtgtgcgcgtgtgtgtgagacagagagagagagagagacagagagagagaggtgggggggagattgagatggaaagagtggcgggggatgaaggaagtgggggagagaaataaatggtgtctggggtaattgtgctggtgttttttcctgcatgagagaagcttcagatgtctgtctggctttggctcagttgctgtatgggcgtaactgaagaaggaggttggggtagaggagaaggcaattaaaactttgaacaccttaaatgcccttcctaattaagtggtgaggatggaaaatgaaataccttcttatgcttcatttctgttctccgtttaaaagtctgtggagggatcagagctcatgtccttagaaaggacagaactttcaaaataacaactctgaaaaacaagtttaaaaaaaatttctcatcattttctgcttttcatgaacttttaatataaagccatcattatttttttttcctgggcccccttacctatatcctctccccactctcattagtcactccaactttgaagcacccaattctctggagtattaatggagacagttcaagtatctaactgctgtttcctttgttcaagttgcttttggtccttgctgggaaatgctctgaaaactgaaccagctactgaacacaaaggctgacggtgttgtccctcctggtaatgtactgtgtgatttgttcccctctcctgttcatgactcattagtctctaagtacagaaaaggttgctcctctggaataaaaggaacggacccagctcggagtcctttttcgccttttcctgtgttttatatgggtgcactcacagttctccatcttcattagtgacccagcagggggctggcacagggttgagactagcttttgctggttccctggggtgtatcagagacctcagaactcaataccctactataaaaataaaatactgtgcttcaaacgaccttttgatggaacaaagccatacatcccaatctgcctgggcctctcaaattgagaccatgccaagtgccagatttgcattttgcacatgccctcccaccatcccctttcccccttcctctaaatgtggttcttttggtagcctcagtgtcaggtaaatgtttatgtgtgtgtgaaaacgcagactttggcaaaagaccttttgtatttaaattacacttcaagatagtagtttcttgtaagagatgtaggcagcagatatttgtgggcttttatgccctaaatgatatcattttagatttatatatgtgggcttttatgccctaaattatattattttagatttatatatgtgagcttttatgccctaaattatattattttagatttatatataaagtttaggaaagtaagcggaaactagaagtgctataaaaaactgagttacatattaaaaattcaagttattttttctggttttccagagtggccaaattattttcttatttaaaacctaggcaccctagagccatgtgtgtgcatgtgaactctactaaagtgagacactgacatgaacatagagtccatcagacctttatatcaagagcttggagtactcagagcatcgtatctcgttaatcttccagcattgatgtgctttagctcttgggaacagattactatacttattttaaagcaa

SEQ ID NO: 76249 - DNA, 1253 bp, Homo sapiens
tagaattcggctgtgaatccatctggtcctggactctttttggttggtaagctattaattattgcctcaatttcagagcctgttattggactattcagagattcaacttcttcctggtttagttttgggagggtgtatgtgtccaggaatttatccatttcttctagattttctagtttatttgcatagaggtgtttatagtattctctgatgttagtttgtatttctatgggatcggtggtgatatcccctttatcattttttattgtgtctatttgattcatctcttttttcttctttattagtcttgctagcggtctatcaattttgttgatcttttcaaaaaaccagctcctggattcattgattttttgaagggtgttttgtgtctctatttccttcagttctgctccgatcttagttatttcttgccttctgctagcttttgaatgtgtttgctcttgcctctatattgcatttacaaaaaagtagattgtctcttcctccttgctactgcaaacaatgatgtgaggaacatcctggtactctccagggtatgtactgaggggtaggattgtagggtcatcaagcatacacaccctgatggtcactaaatcctgccagatttcttcctggaatggctgcaccagtctgcagcccaccagttgtgtaagaacactcctgctgccctacttctttgccaacattttatatgtttagactttctcttttttccaaactaatgggtgtaaagtggtatttaattttaagttgcatttctctgattactaatgaaattgagtacctctttatattactagttagttatttggctttttattgttgtgacgatttaagatttcatgttgatgtagatcttaattttgagttggtcaaacatatcactttttaaaatcttatactttataattttagggcccagggccacagagttattttctgacgttttgttttctgttagtcacatttacattcaggccttgattcatcttgtggtcacctttggttatatcagcatcgtttgaggtagcacattcacactctcaaatacagtgtgatagtttggtatgcactagagggccatgctgtatcatggattcattttgaaagagtatttaatgaaaaatataaaagaaggctattcatagcatattgccatttatgaaaatttaaaacacacacacatatatgtaaaacaacacttaatatttttcaaagaaacactccatatc

SEQ ID NO: 76250 - DNA, 1454 bp, Homo sapiens
aaaatttgatgatatacagaagcaatatgtgagtggttacttagaaattagatgaatgagttatttcattggcatttatcatttgatgtgtaggtttttcctatttataacaaacattgaacactgactaattacctgcaactgaaagagggttaaaaaaaaaaagtcttagttgagaactgtattctcaacttattttcaacccaccagtgctcttgaagagtatgatgcactccgattaatagaagttgtgctctcttgggatcatgcttaattgtgttacaatataaagaagtcttcctccatggtatttatgggtatgaaaaaaaaagaagtctttctttgccagatatggattttgtacttccctcccttcaatttcatgtatactgttttttgtttttatttttctgattagttcccttggtatctgccctgccccatccccattcattttggtattcacatacccaataccatagtagcactttatatttactttgtttacgcctaattacagcctgcatattctagataaaacaaacagactcagccaggcacggtggctcatgcctgtaatcccagcactttgggagcccgaggtgggcggatcacgaggtcaggagatggagaccatcctggctaacaaggtgaaacaccatctctactaaaaatacaaaaaaattagccaggcgtggtggcgggcgcctggagtcccagctactcgggaggctgaggcaggagaatggcgtgaaccagggaggcagagcttgcatgagccaagatcgtgcctctctccagcctgggtgacagagtgagactccgtctcaaaaaaaaaaaaaaaaaaaaaaaaagaaacagactcagaaaggttaagtgatttttcgagggccatagagtaataagtagcagaaccagaatgtgaagccaagtctaactctaaagcccatctttttcatacttgactatcctatatttttcatggatattctacaaaatccatatttttatagagtatgatgtcttcattacgctcctcaatctttgaagaggattttaaccctgctctttggttcagctattgctgaatattgacacctttaagctgcaccatagaaaatttgtattcaggctccttttagagatgagtacttcgaactctctgctatccagttgctcaaaagtctgtttccaaatgtatttatagaatattgtgtgaatgacttattctccatccatttttctggattgtctgcattttagtttcaggccaagtcgtaccgtccaagagctatgtgcttaactcagctgcttttacctcttgcagaggtactttcttccttcctcctactccttttcgatattaaatcactggccttcaatgatggatgttatagcaaacagctgaataaaattcagtattctttctgtggttgagctttcattgaggagcc

SEQ ID NO: 76251 - DNA, 1013 bp, Homo sapiens
tcaatataaaaagctattttttctgaaaattagtctccttataatttgtatttttcttaagttcatattttttagtaaaagtgtaaatttcataatttttattaaaacatttgcctccctaaagaaatttaactattttggttttttttttaatctgagaataggagtagggaaatttggagtctctaaggcatgccatgtagaagtttttgaacatttatatagaatggattgactttttctgcttgttcttctgtctgttgcctagtagatgtctctaactggatattcaaatgacacttcagaccatctgaaacttcacgtattatttccctcccaagtaaactagtcacccaaaccatatacacaacagtcagactcatttgctcacagctttaaagcaggttcttttccatttccactgctattacctattccaagtgccttgcacaactttgcctaaggagacactaagaattcttcattgaagagatgaagaaatgaatgaatacagggatgagttttcttcatttcattgcttctgtctagaccactggaaaaacgtatcttcctttattctgacctcttctaattcatgttctacaaagttatcaaaatgttattcttaaaatgcaaatcattcttaaaatgatatacaaacacacatcattccaggattcatttagtttagtgccaaggcctttcatgctaagttccctgcatctttctggtcttacctcccaccatgtctctttactgactttgttgcatcatcacgtggctgcatactccatttcctcccatgtgctgttcattctgcagaacatctcactgaagctttacctggagaactctactcactttgcctgtcggattcagatgtctttcctacttgttctcatagacatttatgtacagtctcgtgactcttttcatattaaactgttatcatgactgacttacttatctaggggctttctcttaatcaacacaggttctttattcctggatgg

SEQ ID NO: 76252 - DNA, 2740 bp, Homo sapiens
taattggacttacagttctgcatggctcgggaggcctaagaaccatggtgggagatgaaaggcacttcttacatggcagtggcaagaggaaaaacgaggatgatgcaaaagtggaaacccctgataaacccatcagatctcgtgagacttattcactaccatgagaacagtatgggggaaactgccccaatggattcagattatctcccaccaggtccctcccacaacacatgggaattatgggagtacaattcaagatgagatttgggtggggatacagagctaaaccatatcacagtgttaggaagaaaataaagagggataaggaaattctagagcatatgctcaagcaaggcatatctaaagagggagcctttgagcagagacctgaatgcaatgagagacaagttgtgtccatggcggtgttgctggggaggtggttctgggcagagagaacagcatttctgtgctcctattatgtaccaggctctgttctaggggttctggagacagcaatggagaaggttgttaaacatcagcattgtttattatttaaccatgcagtctgttctttttcaatattatgtcatagttcaaaactcctcctttctttaattgctaggtttaacgaagttgaaaaaccctaacttgggaaagtctctttgttctccccagctgctaatcacttcctactctttgttgtggaagagaacacataaagtcttattatttagaggcccctaacagaataggatactggtcctggggacagatccccaactatctgaatttaatcatgatgctcagggatgtgtgaaagtgtcttaggtgttcatgtctttgacgtttgacctaggttatagatgtctgtgaaattctgtcaccataattagatatagatactactgatttccttttcccagtcttccaacccagcctatgaccctgagtaaaaccttcttaaattcttttacttcagtagcacacaaaaaatcataattttggatcctgttccttgctctgtcacctgcttgctgcagttaagtctgctctgtggcagttttccatttgcaagcagggcacccttccagttaagttgtaaaattttatgtttaagtaagcccctgtgcccttgaagaataggagctacaggaatgtagagtccaaagagaaaaaaaaagaaagagcattcctaagaaaactgtgtaaatttgcaaattcgttttcttctggtggcagctgacaggtggaatgacaacccaaccaagtaacactaggcccttgtgataggagggaacttaatgctgcggttgttctgcttagatggaattgtgtggggctgtgccaatgcctgtattgagaaagcccagtcgagcagaagagtttttggtttctgcatttagaactgccgaacaactgaggaaaaccgattaaatctggaaggtggcagctcacttgacaggcttctccaggcacctttgaggagaatcaaagataaataaacacattttatgagaggagtatggggtgagagggagtgtttggacaagagttaaaatttcaaagggagggggaagttctttttgacttttctcctgattagactcttgcctcatgtctttgttaatgtacaaattagagtttgtccctgtctacatgggtaagcttgatgggaaaggaagaagatagaagtatattttcaaagacctcaactatagaaggtagaaggaaactgatcaaatatgaatttctttattagaaaaaagtggctttaaaaactattttataagtcatattggatactcatgtgcctgtggaacatgcaaaaactctggcctgttgcacagaggtttgattttgaaactgtctaattttatttatttaaatttttttagagacagggtctcactgtgttgcccaggctcttgaactcctgatctcaagcaatcctcctgtctcagcctcccaaagtgctgagattacaagcatgagccactgcacgtggcccaaagtctgtaatttttttcagtaaagattgatggactttcattacggcctggtctagtgtgcagtgagttgccttgaggtcaggtagtacttgacaccccttatttactgggtatggaccctgttctctcatccttccattgtgctttactctttttttctccgtgaacaatttttacttgagcttgacttacctcaaaggggctatgaatattgaattggctaaaaataattcataacattctagatatatggagccttagagatcattgccctcttccccattttgcaaagagtaaataaagtgaagcccaaaagtgttaaattgctgctggcctaggggcattcagctaccaaatatgtatgcaggaactccacccagatcctgaccacactattagtctgttctcacctgctaatgaagacatacctgagactggtaatttataaaggaaagaggtttaattgactcacagttctgcagggctgtggaggcctcaggaaacttacagtcatggcagaaggggaagcaaatatgtccttcttcacatggtggcaggagagagaagaatgagctaaatggggaaaagccccttataaaaccatcagatctcgtgacaactcactcagtatcacaagaacagcagcatgttgtaaccacctccaagattcaattacctcccaccaggtccctctcatgacacatggggataaggggaactgtaattcaagg

SEQ ID NO: 76253 - DNA, 2416 bp, Homo sapiens
agtatgatgataaaaaaacataaaatgaagtggcccagaggcaggcaaccagaaggtgaggaacaaaaccaaaagtaatagattattagatgccagtaactaagattctaaattattactcttacgaatatagtgtgggttgctttaactatttcgttataatgtttatgtctgcacccatttctcatttctttttcctagtgtgcaaagttaatttaaagtgttagtacaaattgaggaagggaagtctctccagatttcattagaggatagactgaataagaacatgtcctacccgcaaggacaaaggagaagaaaatatattcttgactgtttcagaccacttcagataaggaggagacaatttaaaaaattaatttaaaaaaacacattaggatcaaataacccctccaaagaaaggtgttctatggatgagaaatgtaattactgctgtaaaaatgtagggaattttgcacgtttaatatagtttgtctcctattagaagcactagttggcatttttcagtattagggttgtggcttgccaggcccaccctcctgctgtgtttgtttcagggaatagaacttacccagtcgcaggtttcagaagagctgaggtaacctccttcaatgtgacacaagtactgtttatgttggagacaaatcccagaaactcaaggtaacaacgtacacagagtgagagagtatatgcaagagatttttatttggcatttttactgctaacagtctacagaagttttagtatttagtgccagttcaggcttaaggggtagtttctatttctgtgtgattttgaaaggtttaaagaatcagcaaattattatataatagataataaagaataaagattctggcttctatggaagcttgcaaagatatgagggagggcaaacaactgcttctacgtgttttgttttgttttaagaactcaaaaaagcatggtaggttctttgagcaaggccttagttgtcaaaagtttctgaagccctcaaaccaataaatagtattattactaattaaaagagcagataaactgagaaacaaagcacttagacctagggtgacatggtgagaccaaaactgaattctgtgtcttaaaattcagttatctaatctccccacttcattgcatattctactagcagtcattcagtaaagtacctttcatcactgcaggagtctctctgaacacagtggctttggaatagggttatctccagacattgttgacatcatgtctctgctcacataccaattgagtgaatattggcccacatgattcttgtaagtggattacaagaaatccacgatagacttcattcacttttgatgaaaccaagaactttccctcttgagctacctaatgagatactgttatttgtttattatgcagggtacaggttggggcttgttagctctctgaattcttaagcactcaactgaggaaatcaaatgcatgattttactatgcctgcacaggagttggagaaattcataaagtttatactttactagttttcttaagaatacagatgtaaataggctgttaagtctgcccaggcagaactgttgtttcagatgaaacttaatgaccacaccctcccaccccaatggagattgaaacagttggagaaactttagtttgaaaaatatttactttaaactaaactccaggaatcttttttttttttttccccttggtgagaaagatattctcaggtctattcggagatagcaatatctttaaaatcatgcaagaaacaaaatttcggagcttctcagtggttaggaatagcttcggacaatttacctaattgggcttcagtttcctgacctgtataaaacaagaggattggtaaatgctctccaacattgcttgaagctcctaggttctctggttactttgttatcgtcataaaatgataatttaaaaattgatgtatatgcatgattttatgtatgtatgttatatatgtatgattgattatacttgcctatgtatggaaaatttcaggttgttaataagaaactcgtttcttttggagaggaggactatgggcctgggggtcaggatgggagaattttgcattattttatactttctgtttgcttgttttttactaagtatgcattgtttaaagattttaaaaatagattggttttgttattattttaaaaggatgaaaggaagactttcaaattattgtaaaatctatacccaggataataataattggaatttcatttcagactccaagtttaaagtatttgtaattataagtagacttttgcttttattatagtaagaaaagtcttttaaattctcttcttcaatgaaagcaaccacttttgtttggtgaaacaagcagcatttacaagcacagaaacaaggttta

SEQ ID NO: 76254 - DNA, 1633 bp, Homo sapiens
aaaatgaacttcagtgtttgtgtcacattggagttgttaaagttctcctttgttctttccaggtttgcattgcctctggctaaatttatttgtatttccattccatgcagggtatggtagcactgtgattcagcttacttagtacttcattggaacgttgggttatttatgctaaagtcaataatctcatagtgatgatgatgatgataaccattgctgtcacttattgagtccttacttttggtagatactacattagacttttaaaaaactcatttaatgggtattcattgaacaccttttatgccccaggcattgatttaggagccaaatacataatagttaacaagacaaagtcctggcccataaatatattgtttctaatccacataaaaccttgcaaggcaggtattgtcttaattttatagatgagaaaactgaggctacagaaggagaacaaagttttcagcattttatagcctgtgagtgaccagtctatttaattccagtctgtactttgctctgttctcctgcctcaagatagatcagtattatttccctcttcattaagatgtttataaacattcaggactggtataaacatgcttggctatgacacagttaagctgacagggatataggatgtgaagtctataaacaattattccttttttaccttagtgctccatgagagctagaagagacgctaaaacctagtacttttcacatcaaaaaacgtaaaatactaaggaataaattgaacccccaaaagtataagatttgcacactgaaaattataaaacattgttgaaagaaattaaagaagcctaaataaatggaaagatgtcatatattcatgaatcaggagacttaatattgttaagatggaaatactatctacgtggatctacatagtcaacaaaattcctatcaaaaccttaaccaatactaaaattcactgggatccagaatagccataacaatcttcaaacaatcttttaaagaagaagaaagttggaagactcatattttccagttttaatactcagtataaaactatagtaatccaaacagtgtggtcctagcataggataaaaatacagatccatgaattataaatgagagttgggaagtaaactttttcatttttgattaattgaatttttacaagggtgccaagacaattcactggagagtagtctcttcaacacataatactgggacaatttacagccacatacaaaagaacgaagttgaattggtactttacagaacacatcaaatggatcagacacctaaatgtatgatctaaaactataaaactcttagaaagaggccatagagcacaatctttgtgaccttgaaagacagtccacagaaaagaagaaagtaattgcaaatcttacatatgataagggtctagtatccagaaaatatggagaacccttataatataccaatagaaagacaaataattaaaagtagattaataattttaatagattttttccaaagatgatgtgcaaatggccaataagcacatgaaaatatgctcaacagcatcagtcattgatggaatacaagtcaaaaccataataagataccactttttaccactaggatggctatgata

SEQ ID NO: 76255 - DNA, 2104 bp, Homo sapiens
ttgtctattgccttactttataccagctagacttattatatacaggcaaaaactgatacagagcaatatgatatattttcttcttgattccttttttaaaaacttaatgttatattacttttcaaaccaagagtggcatattgttgtaattatatcattaaaaaatgtgtttattttcaagagtatggatttgatttagaaactgcttttcctgcattctctattattcatggcatttgatgaccacacacttgaagtgctccctggccagagcgtaagagtcttgggggtggggtcagtatagaaatgattaatggtttgttaaaatgcaggcaagttgaatatgacttttataatgtggctgtgagaccagcttatggtatgaattcatacatgtctctctcttttgtaaacatgttatcgaagtaggttttatttcttgaatgctctggcctggtgctaatgagatgtgtgagtgtcctacccaaagcattatgtaacaggaagcaaagttttctgagggaaataagaagcttactagaaagagaagataaaatctttgctggggaatggttcttttccattagcattcccagtgcatttctccagaagtgtgcctaggaatcctctgctgtagttgctagataatattccctctttttcagggtgattggagaaagaaagcagttatttggggcctggagtatatagatagcaaggagccatggttctgaatgtggtgattggcccaggcattcttgctagtgatggaaatagagggctgaacaggaaagagtgggcagcagtacttgataacatgaggcactggtaataccaacttcatgtctggtcttcccatttaaaatggattatattttagcctctcgtcagattgaatgctaagtatccctacagtcaatgcctgcaaaatctttggcgtacttacttcaaccaaaacttaaactcaaagaggaatatagtgtaaactttggtttaactgaacatagaaagatcacacagagagccctggttttattgcttggaaacatgatgagatgtaagtactgtcaatagattggagactctaggcccaaatttcactgaagttcataaatgtctgctaatttcagggaccatcatacttaggagctagtatactaagaaattggaaagtaagtttaacatgtcttttgtgaaaggtggaaatttaagatagggacacagctgtctgcaagggacagtaggcttgttttttgaggcactctgtggcattcaagatcctaggggatttgaaactcagagaatggtacagtgaacataagaggggtggaaaaaagtggaggatgaagtggttatctgtgtcaaaaggaactgaaaggtgttcatactgttccacaatcccctcttcttaccattattagttaggtaaagagacaaaactgaatggcttccctttctccatctgtctcaagattgtttcctgccttggttgaaaggaaaagagggagggagcaaagtggcattacttactttggtctctctttttagatctttgggtcccaaaagtcttattggtgagaatatctggtttcataagcagaagtgggaaaaataattattactacttattgaacataagaactgtgctaaacaccctaataacattatttaatccgtacaacttttttgtataagcatttatctataagttaatacatgtgaagcacttagaacttagaatgagagcccattaaatgttaatacccattttggagataagagaactataccttagcattggtagaattttaatacatgattgttaaactcaaaagcccatgatctattatgcgatactgtggctctcttccttaagaactcagcttcctttacaaaaatcttccctgatattctcctctatatgcatttagaatcatacctgtttttcaattctatattttgactaattccaggttgtcagtcctaaatcctcttactctccctgcacttatccctgaggaagttcattcttcagattatcaaggtctggaccaaatttatttagtgagaatgtggaatttttcttacaagattttaaaatgac

SEQ ID NO: 76256 - DNA, 1733 bp, Homo sapiens
aagaatagaggccaggaataagttttcagaaacaggatatcagtggttttaaaagcaagcaaatttatacacacaaaagctctcatgtggttgtgctgttacatgtcttttcagttcatccatcttaaattatttgcttttggtgagtaggtgtctgctttcaaggctttctttcacatattgaatgtgtgacagttctctcttttctgagaagtaaatacaacacaaccccactacaataccatcctacgtactttggttttgggtaaactgaaaatccagtaatgttcaccaaactacttcctttgtccagtacctctctgttcctgccaaaatacaaagggaaaggaccatcttgggcaggttgccagaagtgccacctgggtctcctgaaatggctgtcagcaagaagggagcaattacatcccataacagactcaaagcagatggtcacctgcggtgataagtattacattattaagcctttgatttgtgattgtactttgtgctttccaggcactgaagttatgttacttgtgcgatgttcctctctgttcccctagacctcattgctcgttgtttggccatgtgttcccatggcttatcctccaaaaagctttattctgcaatcttctaactctcctgcaagaggctagctcataataggatctctgccaggccctccagcagtaggtatggtgttattacatggagttacctttaaaggaatttttaaaagcctttggggctttactgtggaagcataacttagtcacagtataacctcatataggaaattcagttagtgttcagagttaggagtcctagtataacattgcactcattgagatttagtctctggagtctcttcttccattgaatttttatgttttcagccctatttaacaatggtcttccataatgcattgaggctcaatctcaactgtcctcctttgagatctcgcttgccatcccctccacaccttctttattttctgaagatttagaatacaaatttatagtctctcctatagctgaagttaggagtcacttgattcatagggtgcctagctccctggactaagatagatggcagaatgtgcgtagagatacatgatgacacagtcacaaatctaattcttcatgcagatagtctttcaaaattcttagcaaattttaatttttaatattgtgagcctcagctgtagtaattcagatttaattatcatgtgatcatgctggggtgattgtttttagtgcagacataggaaatcaaagttggcagctgggctgcagctgtgccccagctggttttatctgagttgaattcagagggagaagtggcagcatgctcaccagctccagaagatagtcttctttggtcatacaaagcaatacctgctagatgctttttgagctagtgcaattaacacccaattagtgagacttcactataaaggtattaagaacatagtccatgtgtagtggacatgtcatcattgtttctttacaaattaaataaacttgctacgtagaaaatttactttatataattagacagtgttttccctaaattacaaaaacatgctcttaaatttggctgtcttaaagttctctgaacttgtaagattttgacctaccatatctaatttttgcctgaaaatattttatagatgctgagtacaatagcatatttatgtttaaaaatacgaaattggtttattgatttttta

SEQ ID NO: 76257 - DNA, 1042 bp, Homo sapiens
gatgatatcagctgggcacggtggctcacacctgtaatcccagcactttgggaggccgagatgggtggatcacttgaggtcaggagatcaagagcagtctggccaacgtggtgaaaccccatctctactaaaaatacaaaaattagctcggcatggtggcgcacacctgtagtcccagctactcgggaggctgaggtgggagaattgcttcaacccgggaggtggaggttgcagtgagccgagattgcgccactgcactccagtctgggcaacagagtgagactccgtctcaaaaaaacaaaaccaaccaaccaaacaaacaaaaaactgttggttgcatttcaaaaatctaactgaaaagactttgtgcacaagcaactgcatggaatttcatttatccatcttggataaaaagcctagttggtcctgctatgatttgactctgtgtttcttcaggctctaagtattccaaaatgatgcattagctccctggactctctgtgcatcagagacctaggatgtgctatttaaatcatctggcaaattgatgtgtgggggaatggaactctttcccccattttttaaaaaaaattaaattttgtaatggtggcacattgtataataagcacatatgaagattggagctatcattttggaaatgaccttaaatagaaggaggaaatgatagactcatagtaccatccaacagtgtgggttcagcctattttccattcctaccacagagctgctgggtgactctgagtaagcagtttcatccaattttactgtaagcctttgcattcctaatagaggcacaatagtattggtacctgtcttattcagagagtggcagattaagaagactttgggtgatttctaacttctagcagccgtacacacgaaaaagtctgtacaatatagtgtgtttttgtactcagatatttcatgtgatggctctattttttgaagccatagaataattcttccttaagtaaaacagcaaactagctccttgatgtcactgagtttgtgaattattttc

SEQ ID NO: 76258 - DNA, 3450 bp, Homo sapiens
atttaaaatgttacatcagggagtcatatgctttatggtgcactcatgccagcagtaacattgttgagctccatatgagacacacagcaaagtggtttaaaaattgcatagggctgtagcattcatttacacaacattcaaaacaaaacaattactgaatcaagcaagtggaaatgcagaatctaagggggtgaaaaaagattgtcttgtgtttacttcttttttaattctctcattgtcttcagttgatattcctctcagatgccagatacctgtcattgttgccagatgactggactctgctggctcatcaaggggctgtggcagtgcttgtttccatgagagctggaagaaaaactgcaatggaaaagcacacgcagtcgttcataagtagctggctgtgtaattctcagtgccctgtgttcatctgaatgtgaacttaatctgatattgcttagaactggggcttcatcaatgcaaatgactgtgcttgcaagctgaacttcaatatttgtgagcagtggcagagcactttggttaatgtgtacatattcaggtttgtagaaaaaaaatctgtgcaatttgactgtggtcagtttagttgccaggagaattggatattcctgggaaaagaaaaaaagtgtctcacttctggagccattgtaaccatgtaggtatttaagaggtttttgttttgttttgttttgttttttcaaagataaatccctttttggatgattagtcagttgatcttaaatatcatgtaattggccatgaaaattgatggaaggctctgttcttagaactgtagctccattgaaactcattctcatggtgtcatttagaaagcaccaacgtcccataggatcacatgaaaacagagtctaaaggagttatcaaaatgatacttaagaagttgaagtaagtcatcccatatctgatcttcatgatgactatcaacacttatgttagatgggcactctcattaatcctggtgttttcccatgatttctctggtgctagatctgatatgaataacttggttgcaataattataatagaagggagattgaattatatacatctttgttttatagctatacctttttttgtgctaataattttttactgtagtaacaacaaaaatcattcttttatcagcttttaaatattcgtattcataatagcacttcccttagtttatgtagccttgtttcctgagcatgtttgctgccttgattctattgttgtgcatgctcttgttctgggggagccatttaggttttgtgtatgccaaaaaaaagtctcatactcagcagttacaaaattactttccttctttatggattactttatattcaagtcctccagtcctaagtcgttgtcagcaaagattggaagcagcagtcagaagtgttctactcctttgaataactgcataaaactatagcccctcaccaaagaaaatgggttttcatgtatgacacgttgatcagcatgagattgctgctgagctggagaagagactgtgcagtgacttacttgacagcagaggtgctttttacttccttagtactcaaactgcagcatctgttccataccagaagtgagcagcttgttttccaatcaaaatggattcttctgcaattgtaccttttttggaaattaggtacactttctaacatatatgttttgaggcccttgagtatttgaaacatttcctagtctactttcccagacttaaaagatatcatgtgtgaaatatgtggaatgagaatctcaaggtgtttgggtggattcgttctacggagaatatatttgcttattgcagtttctcaataaagactttaaagtagctgagggaaaatctaaaagcacctcttcagaactgaaataatttatgtctgctggtatacatagaaccttccagagtataagctaatgagccacctcagataccacctcctttgtgaaaccttctccagcacccttaaaagaaagtagttatcctctgctctgcttttccaaagccctttgaccctctgtaaaagggcttatctcatatatgtgcctcaaattatattttttcatctctctccctatttatcatggaaatcagaaaggagattttgtcttatttatttttgtatttcccaaactactccacccagaccattgaatgtagctatagatcaggcaacaaccccaacccacctggtttcctcctgagtggtctgttcactccctgtgctctgctaggattatatgctcttaaaagcactattcacatactgtttcaacgatttgtttatatagctgtctcttctattagactgcaaattccatggggataggactaagtcctccatctgtattaacccagggcctagcataatgctgcaacacagagtactcattaatttgtattgaatgaatgttggatttattcagtgaatggtggccttgagtatatgaatgggaaatataggggctcatattccagttagcggtactgtatagtgataattcataaataacaattgtacattgtaacacacacacacacacacacacacacacacacacacacacacacacacacatacacacagtaatgctttttgtccctggaaaaccacaagtaacaatgaagtattctgctttattatgttgatatcatcatgataggaaggatatgttgcttattcactcttactttaaaacccagagatggtattctgtcatttcttagaaggttaagtagaattgatctgttatcagatagaattaaattttagagttttcattgtatctcatgatggaattgcctgttagtttgtgtcccctaggaatgtaagttccctgtgagtaggtgctataccttctatgctgaggttcctagcatagggcttggagagcatggtagatgatcaacaaatatctattgaatggaacataaaaatgaatgtatgatacaattagaaaaacccataaaaattcgttagctttaaagtgaaaattctttttaccgcttgggaagtatcactgggaccaaatggcttttaagagaaatgtagaaaccttctgaacatggcagtatttagaagctggaatatgagtttggttttgattgttccaagttcttcctttggaagatcaaacttcattcctttagaagcttaatcctttttgtgtctctatctttagcttagattctcacccagagaaatagaccttcaataaagttaatgtgaagagaagtcaattagatcgcaagaggagtttctttgcaatcaaattacctggaattttcaggtcaaacctgacagagtgtaggtttcattaaaaaggggcttataggccaggcaccagtggctcactcgtataatcccagcacttaggccaaggtggatggatcacttgaggtcaggagttcgagactagcctggc

SEQ ID NO: 76259 - DNA, 1047 bp, Homo sapiens
ggcaacagcagtgaggtgcctgtcacttaaaaggggaaattagattttcccctaaactagaaatcgataagcacagggtcacagtggaaatttacacaattttcttaaatactatgatcttgaaagaataaaagacttgactgcaaaactaaatagcagatattagtcagaaaagatgttggtcatctatagaagcatggacaagatcaaatcgcaaggtaaaggttgcctgtgcctacaagcagagtgtactccagtggttctcaaactttagtatatactttagaattaactggaggccttgttaaagtaccaattcctaggccctatccccagatgcttatggcccaagaatttgcatttctaacaggttcctagatgatagtgatgctggttggggaacaacattttgaggatcattggtctataggtgtgttagttttctactgcggtgtaaccacaaacttaacagcttaaaacaacagccatttattagctcacatttctgtagatagaaatccaggacagtatggctgagttttctattcaggctgaaatgaaatcaaggtattggttggcagtgttcttacctggagctcatagtcctcttccaagatcattccttttattggcagatttcattcctctgcagctttagaactgaagtcttgttttcttggtatcagccagggactgctctcaactcctagaggttgttctctggtccatagagggtgccttcagaggagaaaatacagtagtgtggctgactcaagtgttcctggtctatgtagcaattgattttctctgaggagattaataaatcaacattcttattatatacatcagcctctgtgaatctgcttaatgtgggtctcctcttgctgtgtttaaagattgggttttgaaactgattagctgagatttagatcctggaatgaagataaattcaccaagatgaaaaccaatgttggggaacaaactgggcagccagccctcccttttaggaatcatctctctattgctttacaactgtatttgttcttc

SEQ ID NO: 76260 - DNA, 2397 bp, Homo sapiens
tgtgttgcccaggctggagtgcagtggcgtgatcttggcttactgcaacctccacttcccgggttcaagcgattctcctgcctcggcctcctgagtagctgggactacaggcgcacaccaccacgcctggctaatttttgtatttttttagtagagacggagtttcaccatattggccaggctggtctcgaactcctgacctcgtgatcctcccgccttagcctcccaaagtgctgggattacaggcatgagccaccatgcctggccaaatctgaatgatttttttaagattattttggcttgttaagaaaacttttttttttaaataattatatattcatagcaaggtacaaagaaatgtacagcgaggtcatatatatccttcacccagccttccccagtgttgacatattccatggctcaagtacagtatcaaaacctggaaaccaatatgggtacaacccataaaacttatttcaccagtaatgcatgcattcatttttgtgtgtcatcatgcgtagctttgaataaccactagcatccatcaaaatgcctcactgtattatcagaagcctctcgtgccacatcctgctagccacacccaccccatctcatattccctaacctctggtaaccgtgaatctgttctccatctctgtaatcatgttatttcacaaatattacataaatgaaattatacagtatgtagccttttgtaattggctttttccacttttcttatggttcatccaagtggttatgtgtatatagaattcatttatttttattgctgagtagtattttgttgtatggatgtaccatagtttgtttaactattcacccttttaaggatatttggatagttttcagtttgggactattatgaataaagctgctctgaaccttcatgtacaaatttctatgagaaaagttttcatttctctgggatatgtatcaaagagtacaatcctgggttgtatagtaaatctatttttagttttaaaaggaactatcagactgttttccagaatggcgattccattttacatttccaccagcagtgtatgagtgatccaaaatcatttagcgttatcattaatttttaaatgccatttttgataggtgatagtaatattgtgattttaatttacatttttctaatgactaattgatgttaaacatattttcatgtgtttacttgccatctatatatcccgcttgagtgaaaggatgtctgtgtatattttttgctaattttctaattgggttatttgatttttttaatgttgaattttgggaatcctcttcgcattctagatacaagttctttgtctgatatatggtttacaaatattttctcccattctgtaaactaccttttcatcctgttaacagggtttttgcagagcaaaggttttacattttgatgaagatgattttatgttatttttatgattaatattttaaggaatgaagtatacattttgcatactttttattgatcttaagaattttaaattgccaaattacctgctctaccttctttttcagctcagacgtgttaccaatgcagatgcagttaaattttaagatgagtaaaaccattgagtacatagtgtttaagtgtagtggaatgtctgtgtgttctactctattctaatacctgcttttctctagtgttttaattaatgtagcaaaggaagatctcactttctgaggtagtttcattttgagtttcagcaagatttaataacaccggaaagaggacatgtgattctacttgtacaatggattattgtaaataaacacctcatattactaatatttttctttctacacaatcccaaccatattagacagtgcagcaacgtcccatgttgctttgtttatataaatttagcctttagcttttccttttggcagcccatttgttcattccagaaatactgcacacctaccagctttgtcaagattgtgctgggttcagggttataatggggaatagtatacacatagacataggttctgccctcatggagcttacaatttggttctcatttcttattatggtaagcttgtattgcctgtcagtatttcactgatttgattgaatatccttacttcccatcttctgtcacagaatcttcctcattcatccaaaacgcaacatgtccaaatcttagtgaatgctttcagtgctttgggagtggttacattccattaagattaaatccaagccaagcaagtaatacttacaagcatgcacaggagaatatgagatgaggagagaaatcctcatacttagttaatttcttgccaagtagagaaattttcagtagagccttaagttacctcagggatggctgaagattctaaatatgagattccaaagtccac

SEQ ID NO: 76261 - DNA, 1570 bp, Homo sapiens
gccgagaccacgccactgcactcctgatagaaggaaaactggacctaaggatttgagttttgacattactagtacaagctgtgtgtaactttggggaaggctgctacattagtttcagtttcctattgctatggtaagaaattactacagatttaagttacataaaacaacccaaatttattattttatagttcttgagaattttaaaatcaaagtgttctttaatgactacaaaagctaatacactgttaacctctttccaattctattaataccatcattatctttaatagttgcatggaatccacatggaatgcaccataaatgaatcgaaatcttatgttgaacatttgtttactgtcttttgccattataaacaatattatgatgaacatccctaaatatatgcctttgaatacttgttcaattttattcattggggcaaaaaggtatgcacattttaaagaactacagtccacaggtgttcatgcaattgctgagggttttctgagaaggtgaacaagagcagtctatttcaaaactactgaagccctttttgcatgactgactggcattccctaactgggccttcttcgttgccctgacactgcctgttgctgctcctctgagaaggaatgtgtattcacagatgaggcgctccattagtcatggtgcatttcctgggccctggagacatgggcatgacatcaccaagggccaatgagaaaggattctctgtagcaagctctcaaaactctttagaggattgtagactgtgtgttctgttcctagccctcagggtgtgatttgagcttgccttgctcatccagccatagtctgggcacaaaagtctagcttacagacccaagaagccaggacaagcttgaaaatctgcagagctgcaggcagattcccatttagtattttttttttccagggctcaggttgttattcccagagttttccactcctaatgatgttgttacttcatgtggtaatgggtgggtggtgaaagatgaagtctgcattaaataaaagacatttggcagttaaaatttctgggtaagtataggttggtagcataacaaaatcagaagtacattttaccgttttgttacattgcttttgtgtgtagtttcacataataaaacaacatcttttaacagcaaaggctcctagcaaaatgagtgtggcttaaaatagggcaattaccaaagaactttactgaggggattagtaactcattaaatcttttctcttcaaggagaaaagaaacttaaaaaaaaattctcttttcttgggttttaagcattttggataaaaacttttctgtctttctctgtatctgtctctctctctgctccctaatttatgtatttatttatgaaaatgatttgtggaatttagtcagggataactttgttaattctgcacaccaggaagtctattgaaagacttatttcctaattggcccaatcttttgctaacaaggtataattgtaaaattatctttttaaaaaatagtcaaggaaattaaggctcaaaactcaatgtgagcttacactgaaca

SEQ ID NO: 76262 - DNA, 1047 bp, Homo sapiens
tactgaaagtcactgacacacacttcccttggaatgctgctgatgtcatggaaaaccaggaccttagcaataacccctaacaaccacagctacagtaaacagtaaatgttacctccaccaaggcattggtttttaaagagttttaacaggccagggcttgccagccacaactcataaaaatgttcttataattttaccctactctctaaaagtgctggataactgctgaggtttctctgccacttgggatgcaaagccaaattcacgtcactttcaaggttcactaatcagaatttacagcatttcttttgcagtcctcttcataccccctgccatgctcacagagttaggtctggtagatttcatactttttcaaagaagtctcttgtcttactgagttgtctcaatttctggtgatggtgtgaattaatgtgccaggttttgactagtgttttattagtctagaggttaggcaaatctggttaattgatagcactcaatctataggttatattccaatcaatttgaaacaaccgggcaaagtggcattctatagttcaaactctgaactgggtattgtcaaggtgaccatataatttatcatcaaaactaggatatttttgaaagtaaaggggctctattaataattactctgagataacagcaataaaccgggactgtcgaagcaagttgagcatagggtcacccttgttactgtgccaagagtcaccatctagctgtcatttattaagtcagacattgaagaaacttgcaggaatgcagaacagtgccactcttctcatgaacattttttgttttagaaaatctagtcattctcataaaaatgttatttatgataagatgttatgagtttattagtgttagttttaaatgaattaaataaatgctttaaaattcatctattttaatttctaatatggtaaatataatcctcccaagtaaaagctctataggtcttcaataatttttatattcttaaagggaacccaagactaaaagttttgagaattgctgctttttctctgc

SEQ ID NO: 76263 - DNA, 1424 bp, Homo sapiens
cttgttcttgaagtccctagttgacagataatggtgtggaaggaaatgatacatggcagagtcctgaatgaccaaaatggactttgtccacacttatgtgctaatctccaaagaagaagaaaatacaaatgggccagcggccaaacatgaaaatggtgacagtgagcaaaacattgaagcagacagctgaaagcttcatttcctggcccggctgccatgagaaatgctgtgcttgccaaacccttcaggctgtcaaggccagaactttggctagctcttattttgagctccccccataccacacacacaaaccacacaggaaaattgtctctctccctttatatttgtgccttttggctacacttctatttatgccaagtccttgcctaatctccttccttccagctgtcactatactctgcctgttgctttctgggggctttgaaaagcagctgcaaccttcagaggaagcgcagggtggttggcattggtggaagggtattgtaagtgtgtgtggactctatcagaaccaaccgtcacttttacctggtttatggacagtccaaacagtgttctcactctctttccttggcaaatgttagaactgatggctttatttttttctccctcccttcatcttcagggattttttttttctcttctacattactcagcctttttgtctgtgaacatcctgtggaagatttcatttatcttaggttctttggccaggctgctcatcatcttttttttccacataaaacatatttacctaatgagagaacttaagatggataaccagagcctctgtactctctcacaagcctagaaatttgacactttctcaattctgacagttcatcccaaaccattggcctcctaaggcccagagagctcttggtcatttgctgtctgtctagccccagctgttggagaactagcttaggtgtactttcacccctggcctgtgttgtttccccacagagcttgtctgcatatgtctcatattggctcttagtgagggcggctgagcaaagaggcacttggttgtcatcattttagaaaatcaaggaagaatctcaggaagcctgattgaagaatcttggctcaatataggggaacaccatgtactatgaaggttttaagttattgcgcttgcacagactgactttgtggccttaatatggaaagcaaaacaagattaaaatctcacacagtcattgtcttttgtagtagagcattgtcttttgttgatgagtagagctttttgagatacaatgagttgttctctgctgctctttctggaaacttcgttaactatcttgccctatacctggcagtgccaacccacatttctgtttatataaaaggaactccatatcctcttcagaagctagtaaacaaaaaaacctcaaagcatatct

SEQ ID NO: 76264 - DNA, 1741 bp, Homo sapiens
ttttttgatgggatcttgtttacctttttgtatactatataaagtcttttttattcatattgggaagataacactacaaagccatttttttccatttctgcctgtataatttcctcaatctttgacttgcttggctatattgtttcaaatacccagttaacctttttattactcatttccttattacatgcttttgcattgtctacaattcatagaatcagtatggtaaaacattagagctggaaaagccattaaatattaactatccaaactccctattttatattaatagatgagaaaaagcctgcagaaggaacatgattagaccaaggtcacacacatgccacagccaggctgacaagtcttctgacccattgtctagtggttttccattataacacctgtgctccatgtgtcaggaattttccaaagcactagtgagaactccatcagagactgcatcctactggaaagggcacaggctttggagctggatagatctgggtttgaatatcttgttctgccacctacgggcggggtacattaggcaaggaaccaaagcttttggggacttgttttttcctctgttatatggcaaaagtaacaagaatactttatggttattgtgggtattaaattatataacctacattaaagtacctgttacacatattatgtttaataagttattataaaaatctgctgttcacagaaaaatgtgatatgtgtaaataataacttaaaataggtatttcattattgggtattctgagcctctcttgttcagtagtattttcttgaagtcagtattaatatgtgaattgagtgaattgtctggaaatgaattactgaaagttatttatatcttgattgtgattcatacatttcccttttctttatggctttcctctgtacttagctgcagtgcatctgcatcctatccaagaacttttgtacaagttgaactcacccaaagaagacatttggagagtacttgggtttggcccctgcttttcatctggctaaacactattagataaatctagaatatatagtctatgtagaatattatgtttacatttttagaaactttggatttttagtgtttttctgaaacttactgaactatgtgatgaacagcttcagtgtgaaattatacgtacttggtctgagtataggtagaagttatgttcaatataaaggggcccaggactgttgttaaaaggaataaggactacattatttaactagtagtgtggggaggtggaatgagttaggaaacaaaagctaagatggatttagcaaaggccagagcaagaaaagaaagtttaggctgggcgtggtggcacatgcctataatcctagcgctttgggaggccttggtgggcggaatgcctgagctcaggagtttgagaccagcttgggcaacgtggtgaaaccccatctctactaaaaatacaaaaaattagtggatatgatgacgtgcacctgtagtcccagctactcaggaggctgaggcaggagaattgctcgaaccaagatggcgccactgcactccagcctgggcaacagactgagactctgtttcccccccacggccccctcccccacaaaaaagtttagaatcgtcgcaggaggtgactcaggggaatttcatttaagggcctctcaaattgcttgggtgttgttggcttactggaatgccttgagtttgaattagagggaaggaccttaaggaact

SEQ ID NO: 76265 - DNA, 1051 bp, Homo sapiens
tgtcttatttcagaagcagcaatccagatgagctctacatcctgaataaaaacaataataatggcaataacaaactattatttttttaagaaatatgacttaaacctatttgtttttatttatttggtttgtttgtttatttatatgtagtttgtcagaaaaccataggagtcaggcattgggtagctcgtggccattagtattattttcaaagtcagaaatcattggagaagaatccccttctaatataaatttttaaactattcatctgagtgtttaggaagctgtgatctctgctgtgataatcctagaagacattgctcaagccacagctggctattattgagactatggaaagagaaagagcttttgccctgatttatcccataaaatgaataataggccacattcagggagacctagcttgtggcagactattctcaccacacccttcacacagcctttttttttcttctcccatcccaagccaccatcccaacctgccttgactaaactcaatgaacaggaaccattgtatgaatcggaaggaaaatgtcttaaatatatgaagttataatgagttggtaagtgctgtaaaaatactctgtaacttagttggaagttgcatcatccatgcctgtggcactatggactggacccaaatggtataattcttcagtgtaacactgaagtaatttttgcatctgccaagtaaatggtttagatttcaaacctatgaaatgccgaactgtaattgttcaattctagtgaaccacagatgtgtttaatttccttcctttactttttgctgtcttctttaggtaagctgaaccaactaaagagtggccttatgtgaatctacaaagtgaactttaacgtcagtcagttaatatactttaacacctaaatgttgtataacactgctctatatagcacttttaaatgtataaaatttttgatagaggataagtccatttcatttagggaaaacagttgtttcaaccacatgtattataataggagtaaaagtggcatatcgtaatgaaagaac

SEQ ID NO: 76266 - DNA, 1225 bp, Homo sapiens
cattttcatttgcaaggttcttttaaaaatgctattgaggctggtcacggtggctcacgcctgtaatcccagcactttgggaggctgcggtgggcggatcatgaggtcaggagttcgagacaagcctgaccaacatggtgaaaccctgtctctactaaaaatacaaaaattagccagccacgatggcgtgtgcctgtaatcccagctactcgggaggctgaggcagaagaatcacttgaacctgggaggtggaggttgcagtgagctgagatcgcaccactgtgctccagcctgggtgacagagcaaaactccatctcaaaaaaaaaaaaaaaagacaaagtatatgcttggaccctgaacacagacattttagtttttcatactcagtttttacattctatttccaatgctttctaaccatttactacttttaacatattatgccatttctttagcgttaatatattacacttttttcttactcccgttccagatgtttgtcatgtgctttgttgtcaattttagattttcattttcctatttttgggaattataagcagtcacttattaacccaattactttatgcttcaatgggcttgtcattgggtagccatgtgaattatttcaatttttagagacacagatcaacctgctaccctatacccacaacagaaaactgccgacttccccattgtaggaacttacaatcaaacggcatttgaaacatgtgagaacactcctattattaaaaaaaaaaatcaccctcaacctgggttattttcactgacagacttcatggttaaagcttgctatttcatgagctcccagatgacgcaaatgctgggaaatgtaacatactcactgtgatttgtttttagacatcaaaagaaatccattttacaaaggaatcatataactttagagctaagaaagatcttaataatcatctggtatagatctttccatttatttatgccagaacctaaaattagaaaggccaggtaatttgctcagtgttacataccttagtatggcagagctggaacttgaacctgagttccctagctttcaattcagagttcttaataggttgccactcaagtgcagtcaggtctttgatgctatttgtgaacaccaaatatgtctctgcttcttacaacttagaaatcttactctgttttgcaatgccctgccaagtcatattggagcctgaggcaaaatga

SEQ ID NO: 76267 - DNA, 1968 bp, Homo sapiens
aaaattctgatattttcttcactatggatttgtgggattaattttgattttttaaaatattgcattaaatattatatcttgactactgagttttttagtagctcctaaaattttgcatttgaagtgggtgccttgcttgattcaccctagtcccaatcctattatttttgctttaatctactaaatccctttttcagccttctggcaataaaataaaatcaacctatggaacctttataagcaaacccatactattggccacttacaaacaatggtggcaaacaaaccagaatctgcaagtgcttttcattggcttgattgttggtaacattgcatggtaattacatagtcatttttggctccatgaattgaaactctcttggaatgtctagcagtttattgaaaagagctcaaagccaagacgtgagttcttttgtttgatccttcacagtattgtgttttaggctcttatatcgttgtgtttgttttgatttctataaattgggactcaagggaaggaagctctttataggcctattattttcattttacttggtcctctcaacacctgtttgagataggcactttataggctaaaaccaactcacactgacttaagttaaaagagaattcactagctaacacaattgaaaaatctaaggagtagatctgacttcaggtattacacatcattttgtcagggctttctctctcgtgttttctactgggttggctttattattattcaggtttttcctgtgtagtagcaccaggtgtatactctactagcttagcaaccttagtagaaagggaatgaatctttcctgattgcttgagccagagtctcagaattgagtataattggcccagcataggtcacatgcacatccctgcactaggcattaaggcctggcgaatgcaattaaatcactggctgaacctggttcatgtgttcaaccctgggtcagggactggattgagagtagaagagatctgtttcctctaaaggaagagacgactttttaagtcttttccccccaaaagggattctggacagggaaagacaaatgtcaactaaaatgttactattctcacttcatttatgaggaagttgaggattaattaagtgaattttcacgaggctgcatagctaatgagtgataggatcttaactttgacccaaatctgcctaaatctaaagcccatctcttttctccacaccttgtatccctagaacatcatgcttcttcctccttctccttaatgtgaaaccatgatggttgccatcactttacagcagtattcttcaaaaaggagggattttgcccccagaggaaatttggtaatttctggagacatttttttattgtcacaactgtgcacagaggtgagtgtggtgctactgtatagaggctaggatgcctatacctcctgtagtgcacagaacaattcctcacaacaaagaattacccagcctaaaatgtcagtagtggtaaggttaagaaaccctgctttttaggttcaatttctcggctgttactattaacatcagttttgagagaaataagtaatagagagcaggattgaaataattcatacatgtaggtataattaagttgtctcttaattcagggaaacttcctttaatttccatagaagctaactttagaatattgaattatcttggttagtgagtaaattgcaatagaacgtaaattcctttttaaaatatttgttttatgcaagtttaagctaacttcccagacataatttttcattctaaaataagtcctataatttttttcttaaaatagaaatctagggatattttaaattgaatactgaatgcttttaaaggaaatatataagtttatctcaaaagccttttaatatttcatatagaagtttctataccaggggaaataattattttttaaaatccgagctgccgggcgtagtggctcacgc

SEQ ID NO: 76268 - DNA, 1074 bp, Homo sapiens
ctttggatgataataagggatttaatgtactaaaaagcatacagaaattttcttcctgtaagcatgtgctttgtgaaagaataatgaaagcagaagaatgcgttaaatgtattatagctgcagttattgggtttgacacttcagagaaatcaaccttcttgttaaatgacatgaaaatagtttatactgtctgactccttgagacttgcaagtcgtttctgaattgtgcatatctgaatgaatccagggaaagctgtgcttctgtagtcaaaccacagataatattctagtagaagagctgaatgagtagagtgatactacagatggatttcatataagaaatcttttacaatccagcaagtcaaatttattgttggagtcggaagatttgaggcttagcattttctcgttttgccagttttatacaaataattcttcttgttttccaaattctcatgactgtatgcagcatggaattacaagtccattcctttctctggttctttttaaccttatcagacccaacccagatcaatgaacattcctctgatttcaactgaataattctgacttgctttgatatctcacatggatgactttcttcccatctctcctatcccccgatggtccttcagctcatgcctgtcgtgcccatttttttggcctcacttctttacctaatctcaggaatactcattgctttttctatttcttctatttttctttggcctctctttccgctcccatattaaatttcctccttggctataacgcctgccttcttctgtttcccaagtcctatttactggctctgtatccttagactcacttgtttcttaattcatatcctcatctactaaggtgcctaatggccacccacctagcatattttagtaaggcatgtgtgtacagacaggtcacctattcattgttaatagaattcaatttgcagtttccctggaaataaggcagtttctgatcttcaaatcacccaagttcttactcgttagaatgcaagttcctttgtcacattaggaaggacagtaatatttatttatgaaaaagttgaaaaaa

SEQ ID NO: 76269 - DNA, 4871 bp, Homo sapiens
tgacaggtcacttgactaaacaagtgacttatttagaatttcacaggaaagtaattacagagcccttaaatttcctgtctcttacttctatgatataaaacaatttactttgcattccttatttatataaatgccttagagcatttcctttcctttaataaaatcatgaagactatcacctggtaatgaaattgttaggatggaagagaaatgaactaggcacagtgtacgtgaatttgattattgccttttcaactgtctaataatgggagctgtgggctcataggctctccttttgaattgtgaaaactatacttattttatactacattggtgaagttccctgaagtccttaaaaaacaaacaagatttaaagtgcaaaatgttattgttaagttaaaatgacccttgtgtgtttgcaaagctccgcgggctttctggggctagtgatccccttggtgagcattgtggagtgtggtgggaaccagccatgttttggtgatttcttttagatttctaaaactgtttttctgttgggttgaagtgggaaaacagctttggaactgcttttggtgttgctctgagtgtgtttgggagtgcattccaatagtttgtgaggggatgttagctgttcaggaaaaataacccttaccaaaggtaatggttcccactagcattttcagtaacatgtaccagatgtgggtagttaattattctcagatctgataaatacctgccagccaagcctaattttattttcagtaaacagtggccaaaggtcctagctgttcatttgataggatgggcctgtttgcacttatctattaataaaagcacaacactcctttagttttcctttcccagggccagataaaacattttagacactcacgtatttgtcttagtaaatcagacaaagtaaacaaatctggtagattaacttggtaaatagagtgtggttaagtgttacctttggagttgaactcagtgccatataaatagcattaatcgcatggtattttcaataatctttatggagtaaaacggagggttgtttttttctttcaaccaacagggacttaagtatatttcttaagtactttcagatgttcttctgtatggagattttaaaatcactttaaaatgaaatttattcttttgtcccattagtaacttgttgggaactttgtactagttaacattatgtttaaaaacctggaaacctctatagttcatctcagaagaaaaataggactacatagtggcatgcaagctttgccagacagagataatggccatctagaggttactgatttgggtggaacagtgaaaatggggccgcttttatggggaagacagtggctggtaggcagaaattcactttattcatatgcattttttttcctcttgggtaaagagttttattagggtcagaagtactatttatttttgtgaggtaaattcttgtcttgtgagaactggcatgaaacagactcattatttcacactagccaacaaaacagtattttatcaaagtaacttctagtcagtccaagactggactggatttgtactggtaacctggtggtgcagggctctaagtctcatgccagctcttgtctccctcattaaacttccttttttagtaatgattaaaaacaactctctttactacaatatattttctcattggctttatactcgaagttgcaagtactttataaaattatttttagttttgcatgctgtataataatccatctaatttggtaagcatagtacataaaagaaatagctgaaaggctttagagaaagttccctactcatacctccccctttacaatgatctcggcattaatatcttatgctgtaagagggtggcctggcacagtaccatgaatattgtgcccgatacccagtggtaacctaccaatgattgttatgaaaatgatggtgatgatagtataggggagagagtgtaaaccaaaagttgagatctgtattctgttttcagcttcattttaatggcctactggaagaccaggtacattatttctgctcttttttttttttttttttagtttctccagctatacatgaagaaaaaagtcctagtccactagccaacctgacaggcatgttgtgaaaactaatgaaagtataaagttctcatagtccgaagcataaaaggtgctgtaaccaataggtacaaaatactaattattatttttacagttcagcatagtaaatctttggagtaaatttttttcattatatttactagtctttcctttaagaattatttgccaaatttaactctttttctcttttaattagacccagagtatagtaaaaaaattgatggtttggctttcagaaagagttattttgttatctgtaccaaattttcaattaaatatttttagctgtgaatcaagtttcatcttcaaaagtgtcttcaattttaaataatttgagaatacttacctggttagtaggctaaactaacgtagtagggaagagagtgtaagaaaagtgctgttgaattcatcattcccattagcaccagtctgcggattcccaaacatgtatttctaggctcagatatttttcctgatccccagacttattaatccaggaactagtcaacttctttacctggatgccctgtaatgatttgtagcacaacatacataaaacttaatattctgttcctgaatttgctctctctgtgaatggaatatctatccaccccatctctcaagctgaaaaaccctcaccccatttcctcaacatctgtagatttaactgtcttaatactttatgccccttatctccatcccacaattactaccttaattcggcttttgctcttctgtcaccgggcagctgcaattgtcttcctgccaccagtctggtctcattacagtctactctcgataccatttccagattaacctttacaaaatgcaaatcatagaatattactgtctcattttaaaaatatttagtggtttcttgtgtgctataagacaaagtttacactctttatattggttattgaaatcttaataatctttaccttgtttctagtcttgaatcctcttatgacctctgttctagtcacactgaaagtttgtgggttccaaaacatgccatgttgttggacattctacattctctccacccacttctttaattgccaacactgttttatattttaaaacctaattccagtgtgaagtcttttgtaactccctccttgtatcccatcataccctgtatatacttcttacatagttcctataaaacctatagcacgtattttgtgtatatccttcccttcctgctttattgtatgagagattatgtcttgtttatttttgcctttcaacgtccagctcagtggttggtacagaggtagcacttggtagattgattagatagtgggtggagtaaaattctatgaccatattttcctcctcaagttctactcccttttcagtgttgcatggaaatggctttttaaagtactcagattaagatttgatgggtagacgaggtctttacttaattggtatgattgatgggacaacaggaatactcctgtaaccactatacctacccaaagatttcatagacagtctgacatttccccatgaaaagtcatttattagagttctgatattctacttattatactccctgccctctttagcactttataggtacaaagtcctcccataaacattatcttatttaatttttaaaacaagcttatgagatggattttattgtatatactttaactttatctctaaagcatatacaatataatttgcacccttaggcagatctgtgaattgctttgaagaataactcgctattctttttcgtgatttggactactctgatagtgacactgttttgctaagctgtgagagtttggaagtgtctcccataattttgacactagattttattgggtacagcacaaatatcactccttggggtgggccacatagtcacggacccacagatactcagataggaagaggctctaaaggacattttctctttatatatggaattgtatgaaatttaatagaaatggatctctagaattttactccttttaatcaggacagtagtacaaagcaaaacttttgtacactgcctagcatggtgctcagttctgcaaacgtcttttatgtctttgatagtgatggtggtgatgatttagaagcagtttttgcccatatacatataccatggtaaagcagttttctcgtttaccaacgatctatgaggagcattatttttatagatcttagatataaattctctccttcagactgtttgcctgaaccttaaaatgtagcatgattacacaagcactctggaatttagattaaacagcattcaatttgaaaatctaatcatatcatctaaatatcattaagtaataataggctgattgatagggaccaaagctgttttggcctggtgttgcatgcctttcactcagccagccttttcaaaccaagatgttgataaagaggtctataaatcttaatagttggagacagtttaaaagcatagttcactggataaggtcacacccacttaagtgacctattttgtatacttttcaaaaataggttaattaacttaatagaaataagactctcatattgatgtgcaattactactaaaacagctttgtttttttttctttccaagtgaacatgatgttcatgaaattgagggcataatagccatgacaagaaccaggcttagcaaggcaggtcatgttcagcgagtacatttcagacttcccctttaaaatcctcttttattccaggtcctag

SEQ ID NO: 76270 - DNA, 1033 bp, Homo sapiens
actttatatagtttctgatccctgaagactccagcttgcatagtaagctcaatgaattttggtctctttttcttttaatctgaggctttcttcatttttctaacagatggatgattcatttgctaccctgggagaagcatggtttcagaggaggatacagtataaaagggcaagggagtacccagaccagagtcatattctggttatattctcctcatacagcctgctttcatttgttgttgtcgtttagtgcccatttcaaattttctgctcctaaagccttttatctactcttagtcttcttattgatgattataaccttcttagtctattattggtcactaattttgcataatttgattttcccattcatctgttccttaacatataaccccttaatgttttatatcgtaagttgagtacatgggcatttattattctttgaacttttaaatatattttaaataacatatacatttagaaaagttaacctcctcccccagtctgatatcttgtatcacacataactctctgtgtagatgttgctgagtcctgctggctcgaattttcctgtggccagatggtctgagaggcagttagtgatgcacattcatggaagggtgggttcttgcaaggtagccatgatgggtatatttgaattgatggatatatgttgatctgatgggcgtattttgaattagaggttctaatatatatagcagaggttctagatgacctctttgttcaccttacagtagtgtcatttctctgcttgtttgcactgcacttacagcaaagacttttctaaattaaacaagtcttgtttatatgttttgtgtatgtgatcacaaaaaatagcaaagaatactgttctatggactcttagctgtggtggaaagaaccattgaaactctctcagcctttagttcttcattaggaagatgcctttcttactgagggttgtaatgattgtgaagtccagttttctgacttctccattagggaataagagaactctttggttttaaattga

SEQ ID NO: 76271 - DNA, 1041 bp, Homo sapiens
aatattaaatgcagtgttttgtaggcagtgattacctttcatcttgtttgtcatatttctcattctttttttgtgtgtgtgacggagtctcgctctgtcgcccaggctggagtgcaatggggcgatctcggttcactttaacctctgcctccggggttcaagagattctcctgcctcagcctcccaagtaactgggattgcagatgcccaccaccaagccctgctaatttttgtatttttagtagatacaaggtttcaccatgttggccagcctggtttcgaactcctgacctcaagtgatccacccacctcagcctcccaaagtgctgggattacaggtgtgagccaccacacccagccatatttctcattcttattttaggctgatgaaaatactaaatatttcaacacctctgtatcatagccatgtttaaatgtgcatatccaccagtcaattttaatacattcctttctagtaaattctgttaggtcttcagttcaactgtacctccctcagtgtcactttttaccttccctcctcccttaaatcgcctagttctcattttgaaaaggtagagaaatcctttgtcagtagttaggaggttgtagatcctgtatgattttctgtcattacattcttaatctattacatgtgtatttgtcccgtccttactgacttaacctctgaccacattgcaaaatgtaaacagagccagataccgacaggtttgtcccttcattagccagggcccaattcataatttctattttctaatttggagaataagaaggttagctagattaagaggctttcctaagtcacataaccgtttgcaagtagctaagaacaggattgtgaactcttgccaaactcctccataaaattccataagcttgtgggagctcatttatacaatatttaagaggttatataggcaaggagaataattgaatttctatatatttagattgactgatatttcccaaacttcaagtggaaaaaaaaagcccttaaagaaagagcttaagagaattaaaatg

SEQ ID NO: 76272 - DNA, 1088 bp, Homo sapiens
gctagtcaagcctatgttatgaaagagaaataagacacttaatcctgtgaatgattaactagtattggcctcccttcccagtagtttgcccttcctgtattgtagtctgtgtactcatttctgagccaaatctccaaggtctcttattattgagtgtagggacacctggattacagggagttaggcctttgttttagtctgaagatgatgtggctaattatacagctccaggcatttgcattttttcaaggcattttaaagtttattgcttgtgaaaacctagtttgtaaagtatcatttttaaattttacaggtgaagaagtagaactcagagaagttttacttgccaaaagttctgcagcaagtcagtggcaaattcaaataagtgtacactcatgtatacttagctcagtgtttaactcatggaggtattgttttgtttcttatttataatataaagccaagtagggctggctagagccatttgtagttaatacattttggtctttgatctttttccacataaggtcagacttcaagatagaaaaatattctttatattctttgcaaagagctgattgccatctttctatactgcctgtgggaacactctggccttagaatccaagattttattatccaagacagcagccagtaagtacagtgagacctaagtggggaattaacttttgggctgtagattttgaatgagaagtcctactcaggatctgagaggtgacaagaacgagtgactattcattgatttggattcctgggtcttggcaccttctgtgggataagaatcacatgcaatatgagtaattttgtggaaaggtcttggtcctggttcatagactgtctcagttcctcagtagagagaacttagaggagaaatgactcccttgttgtcatattgaagcagcagcagactattagggagtacccatgttcctggcttctttccttgggctggaaccattcaactgcacagataaatgtttactcaaggaagaatgcatagctttgaaacagtcttaagatgagtaaaagtcttaagatcagtaaaatatacaaactactcctatgta

SEQ ID NO: 76273 - DNA, 1916 bp, Homo sapiens
gactctagtggaggtgctaggaagttccactttctggtagattatttagagtacaggatagtcaagggaataaggatggtgctaaggcaggctgtggtggtttaagcctatagtgccagctactcaggtgggaggatccctggagcccaggagttccagggtgtagtggagctatgattgtatcactgcactctagcttgggcaaaaaaagtgagaccctgtctccaaaaaaaaaagaaaaaaaaagtggttataagaaccataggaaagagaacaacatcattttgactaagacaaaggcataaccttgacagatctcagtgtctccaggctaagagaagagcaacttagatatagtaccttgagcctttcaatgattgctgtttaaaaagtatatgactgtaggataggatacattggaaatactgaacaatgctggaggaaagccaacagcatgtggataagaccatccaatggggccaagatgagggggcactggattggatcaacgttaatgactaaaattctctgcttctaatatacacatgactaactcccttactcacttcaagcctttgctgaaatgttatcttctcaacgggtctgcaaacctattctgacctacctatttaaacttggaattaattgaatgaattaatggaagcctcatgttgattaatcctcttttcaaggactgaactgcattacataagaaaatttaattctattaatggtgagctcagtggcacaatccacatctaagtttttagctttatcctccttgcaaataatgatattaagttagtgtaaatattaataatatttgcccatgagaaaggaacagaatgttctctacctttctccagccatactttgaatcctggggaatcagcatttcccagaaagatcaaactatcaatgacataaagcaacagattgattccattgatgatctttttataatactgacgtaccacattcttccccatggcttttgcatttctatctttccatctgagacttacaacttcaaactccattttccatgcttttgctggcatgaagaaggaaaaaagaaatcatggtgcatttactggccttaaagaaagttggtatgtttataaaagaaataaagcatactgaagaggaacagtatttgagtttcatcagttaagcagagcaatttaagtactgaatgcttcatactgaccatttccattttattcattgtaggcaggtttataaagatggctaggtgcacttgtccatggttctcccacccgtgtttgggatgtgctacctcacaagcatagctggctggggatagtctttaggtggaaaatagctacgaaatacctatttttggttgtattaaatgagctatggctgacatattctgtgattcatttctttctaaatgagtgctggggcatgatactaagtgtgcccatgtctcactggtcttgggttcttttatggttccccagccaaattcaagttgaattatggtgtccgtttaacttacaggtgtctgagataagttgtcagttaacatttatacatgagatcaccatctcctagtaagtacagagtactggtagaaaatgtgtggctcagtctgacttgggttcaaatcactctaccgccttttattacatgaattccatcaagtgaacctctctcagcctccatttcctcatcagtaaagtctgacagttccaagccaatggcttaatgatttctctactatatatgcacttcctagaatagttgcattcaaatttgcaatatctttcatcaagatgttgcctctctttccttctttttctcttccatcacagtaagtgatagaaacctgcttgctgcactcataaataaatggccagacatgtgctataataggcaggatcctcctg

SEQ ID NO: 76274 - DNA, 2472 bp, Homo sapiens
catgtgtgtatgtttacacaggtaggcacctaggtgttttgttctccatttttagaatgatctttgttgctggccagtaccagagtgatctaattatacatgctttactgatttccatctaccaaaattcatgtttcaagtttaactagatatccttagtggatgtttccttaaaaacatgcgatcacatgtgcttatcttttctctcactaggctggagcttaagtccacttatgaggagaaaatatataaaagcaactctaaattggtgagggcgatggagggggccagtggggaatgagagaaagggaaaaatgaaaataagaagcaattaagttttttttttttaaattagcctaagctcctggaaacagatataaataaatttgagaaagccttccaaaagtcagaagaatttaactctccagccgagatgttcaagctttctggcatttgactaacgttttatgctctcttgtctattgatcattgagccactgttgagatgaccagatgaccaggtgctaagcatactttaaagaaagttaccttgcctgaagacattttcctactcagatatctttaacagctcaatgcacatgaccttggcattgcttcaaaggtggcagctcatccaagtaggcagaatacctggtctctcagcactgcttttataatgccctttttctaacgttgagctggtgaccatgctgccctcttcattttgcagtaatcagggttgtcttcttttttcatatccctttcctgcctgaggctgcttcaacaaacagcaagtataaactgaaaccctatctctttgcggatcaaacacacagcttgaatacattgataagtaactttaaaaaaaaattgtttagcctgtggacctatttatcagaatgctatataaaattattgttttccagtgacccaattagttgaaatattctttctgaagctataggaaaaagacttaatattgtttgatatgattttatcatttgtttagttatgtatcacttcccactttacagtgtgttatgcatactttctttttttctgtcatccttcccccatgtctctactcttcagtctcatgcataaagaaacagggttccctacttgacagtaaccacatgaggagttgacattggcaactggtttaagacttcgatcataagtcatctaagtaattgggctatgcgtatcctgttgaatcacattccttctcaaatccttctttgttaaaagtttgaagcccaggcctttcaattttctcttatccctttaagtccacaaaggaatttttaggctgtttctggagggttataacttctccccagtgctgtccaatagctggcatattggaaattggcagaatgtgggtgcaagagagaagggagttctcagtaaagcaccattagaattctcccacagtttgacacattcatttcattgcccctgttttgtgtggctagcaactgatgttgtttggctgtgacatgcgtaaacagatgttgtaaaaaacctgaaaaacaaaaaatcatctttccctactttttcaggcatactgaagacagaatccttttttggttatcttgaagagtctgaaataggaaacactttgaagtgtagataaaatttctgctctggtcacaatggatgccaagtgttataaaatgattgtgggagtgtgtttctatattggcattttgatatagaggcaggtaagagcaatgccaccttcctgcagagtactctaaaaccctttcttccttcattaatagttttcctttgaagataaaggaactgctttcattatgtgtgaagcattccttttacagttaaattactgtttattggtgagtggtttccttgctgcgctagtatgcggcagatgtttctcatgtatccctaggttttcaggctttttcttttcaggatgaggctctgttgtcttttctttttttctttcttggcaagaatctgattgggataaaacacattttatgcagcaaattaaaaatacgtatttaaatttaccttttattttttacctaaaaagttcgcaaactacttgtagctattattactctgaggtcattcctctgatacaaatgtatttgttgttttatttcggagctacagatagaaaatctaaatacagaatattaaaagtatgtagtgtaacatgacttgtacttagtaggtactccgtaaatgtttggaacttatgaattgaaggtttctttctgatcttagtctagaacagtgcttcacagcctttcttatgtcataatacacatagaaattgataatatttatatgtcatatggaatttttttcaaagaacatctctagtaataacataatacagagagggatacaagttgaaaaatgctcttctatgttgttattgtaacttttaggagtaagactaccatagaaagcatgcattagaatgctaggcta

SEQ ID NO: 76275 - DNA, 1743 bp, Homo sapiens
agtagtgaaattttaagcctgtggctttgattatgcaaagcagtgatttctctgcagtgtccctcagatgtaaaaggagaatgactgaaatactagaaaggaagttacgggaaatcaccaaacaaccattttccatgtctacagatcctttcatctgagggcaaaagaagctggagagggtgcctccaaaggtgggggtttggaggagcacaatttaaaattctctgggttgtaggctaaggatcaaagggttatgtcctcagaattacacggtgagtcactggaaaaactctgagtaaaagtcaggcatcctgttttccaatcttatatgcctaataatttcaactggctttaagacagtacatttatgtatatttttcatttagatccattgccacctaaagaatataatgatgtatgcattatatagattatggtttccatgccctagagcatcatgaggtgttttgccatgagaatacagtgggttaggtgaagaggtgcttgagaagccttggtgtctaatgtgtggtctcagtactctgtggaatctcctcctcccttacaaaccactgcctctattcaagccatcttgtgcttcaatttagaagttctcctttaagagagagttttccaaagctaaattaacagctatgcagtgtactgagtaactctgtgatttactttttccaattttgactgctgtaagcatttcagtttgtttcccactagtttggatcaacatgttggttttaactttatctccaaatgtaatgattttacatattatagacaaatgtgtttgcacagttaagggcagcaggatttgcttgaacagagaatatgtgagttctgtaacttttaatattcaattcaatttaaattctttttcatatgtcctttttatatattccagtttctgattatgggtaacctgacttgaaggtcagaccatctgaagtgaagatggttaaattgtatgtgtttgcacatgcatacacgtgtgtgtgtgtgtgcatgcatccacatacacatgggtgttcatgtggtaaaggagagccagagagatgtttaatttcctcaccacattgtagaaactgaaagagacatgtactgcagaaacaaattctgagatacgtttgctaaccacttttttaggtttcaccttccggggaaaatgttaaggcatttgcaaacatgcctagtttcttagcgatttaaggcgcatagactctctgtgactacacctagagaggtaagacatggaaaagaacataagctttgagccacctagattaggggcttaatctggccacaccactttttagatgtataacttcaggttgattactggacctgtattccttttctttccttggttgacacttgttccaacttatgatgttggtttatgattttgattttagtttggttaacttcttatttgggggattttgactgacttaatttgttctcatcttgtgttagggttctctagaggggtagaactaacaggatagatgaatatatgaagggaaatttattaagtagtattgactcacacgatcacaaggtgaggtcccacaataggctctctgcaagctgaggagcaaggaagccagtccaagtcccaagacctcaaaagtagggaaaccaacagtgcagctttcagtctgtgtccaaaggcccaagagcccctggcaaatcactggtgtaagtcaagagtctaaaagctaaggaatt

SEQ ID NO: 76276 - DNA, 1313 bp, Homo sapiens
gaaagagttttttggaatgatctttcagaagcagttgctataggcaacaatattaggtttgtctatggctctacttttgtattagccaatccattacttgtgattgttgtgttgataatgggaatcgtgaattgattacttcatcaaagcaattttttccacactgacattctttctagcaatgaacttgtgaaatcaaatggaatttagaggtgatgctcctctgttttggaaaggtggaatgagttatccacctagaaacaaatctgatctagtcactctcctatttagagacttcttttgacttcttctctaaagaatagaatccaaatttattctcttagtttgtaagattttcttgggtcacctctctagccatgtatgtgcttcagacacactgatttcttgctgttcctcatccttgtgttttgcatcgacttttcttccactaggatgctttttgccagcttctctgcttggtgaaactcgtatgtttatagctctttgataaggctttgctcctccccctaggcacaactcctcctccttgttctctacttctattgtagtggttctgctgctatagtttaacttaccttaccagtcctaatctttcttttaattttttattgtgtaatttattgctgcatatgtattatattttacaataattaatattatatatttgttactatataatttacatatcgtaaagtacacaaatcataagtatacagttgatgtatttgccaggtctgaatttgtacctgggctgtgagccttcagagggtaggaacaatattttagtcattcttatatcaccagaggtactcaataagtacttgaatatgagcgaccactacataatttcctcagttcatctagtgtctatttctttatggaaaggggacattaacaagtatttttttgtagatgtttcaaaccaagtaatatttgtttactgtcttgctactaatctcaaaagttgagagattcaacctaaaatattgatttcctagtggcaattatagatcagtgactaaaaacaaatttcatccatttttctactcacttgataatgttttattagaaactataaatcttaagacttgaggtattaaacagcagagagatatggttaggatcaaacttccttttcctcactatttattccttatagaaaaaaagcaactaccccttcccttaaatttattattattattattatttgtgatggagtttcactctgtcacccaggctggaatgttgtggcatgatctcggctcactacaacctctgcctcagggttcaag

SEQ ID NO: 76277 - DNA, 1444 bp, Homo sapiens
gattagatttcacgatgttgatcaggctggccttgaactcctggcctcagatgatccacctgccttagcctcccaaagtgctgggattacaggcatgagccactgcacctggcctcccttaaatttaaattcccttaaatattccttttgaaagatgctttttaccattgctaaagaagtggaatgatttcaaattaatttcaaaataatttcaaattaatttcaaaattctcccactaaaagttgctgacatattaaaggaaatgatatttatgcatgttttctaaaagctagatgtagaaaacttgctcggagtaatttgattcaacaaaagagtttagtagtttccttgaaagataatcctgaaatcaatacctttaatttacattaggcactcaaagaaaataaacacatttccctacttaaaaggctggtccaggtactttttttgtgctagaaaatcaaggctgaaatatctttactttgtattgattcagattttaaattgttctttgaaaagtatatatggaaacagatttttaaaaatgtataaatagataaacatgtataagcagagttttaaatgtatagaaaaacagatttaaaaaacatgtccaccaaatggacatcttttcctactatattcagtaacctaaatgaccctatcccttctcagcttatcttaattttagtatacagttgcccttcttccattaattaatcaataagctcattcattcacataatcagtcattgttgatgcctgttatatccaaggcactctatattctatatgctttatattctatgtactctatattctggagacatcaagatgaaaagttcagattaaaattttcctgactccatttttaaaaagttagtttttacttttatggttaattgtcttaatttaacaagtgtccatttaggatgtaatctgtgctcagtactgttgtacatcatgatctatattctctctagaagctagcattttatcccattgatttaaataatgtctaatgaattttaagttcttcatgtggttagtgttttacattttatgagtaataatgaaatggaagattcaagcaaactccattttcctgagaaatatgcatctctttatttcccaatgttaattatctaaatgctgttagttaatgctatattactacaagcttttttttaaaaaaagagacaatatcctttcttaaaagaatgttataaatataaaaaagtacttgtgttaaataaatgttattgttcatttttagagaaatcgagtgttttcttggcagagatgggagaagaaatgtaattgcttaaataattaagtattcatgcttggaaacccaacttctgttgcagggttaacatatgaactggtgattaactgacaaaaattaagcatatgtgtttggatcatggtttctgtggaggc

SEQ ID NO: 76278 - DNA, 1130 bp, Homo sapiens
gggtgtttcctgaaattgcaacattactgacttcccagccatgtgacatagcttttcagactctaagttaaattttaacccagacatctctcttcaattcaggtcacctacaggccagacaaagccaaggtcatgtattgagtgaatataaggagttttgttggttctaataactgtaatgttattcactggttgaaatactataccatggttaatcataagttgcagctgttgtgtccttttatttatgagcccttaatcaagaggacacagcaagagccactgtttgaaaggagcctttcatgaggtcttctctttgggtgctccttcttgtttcattgtgaaaagaagagaagtttatattgccttgcaaaagttattaaatagtatatgttggcttctctgaaaacagatttttctattccaaatttgaaagatcaaattataatctttatatttcagctgatgataatagaaacactaagcctgtgctctccaaacaatgtcttttaattggtgccaagtttgattgaatctcaatatcagccatcagaagttatatgttggctctctgaaaacagactttcctatccagaattcaggttttctatttgtgacaatatgtctctgctgatgttaaggtaaacagaccagagctctttgtgcagccctttttactggtcctgaacctgatgaatgagattttaaatgtaagtcaatctctctctccttttttaactttttggttttaaatcctcccttattttatgagaattcatcttatgagttacccttgttaaaatattggcatatccaggagtttgaatagggtcattttctgaatggattttggaataattacgtaaattgatttttctgatcaaggaatttagtgataggttatattttcaaatgtgttgattgtcagcttcatcctaaattgcaatgtaacacaaaagctggtacacagctcttttctttgagacactcaaaatgtttccaaactttaaattcatactttttactgataacatttttgtggatctcattcaggtaaacttttcttcttcacttgttgatcccgcgtgacccctccagccacacaggtttcatgtgcttccctgaataca

SEQ ID NO: 76279 - DNA, 1923 bp, Homo sapiens
tcaccagtctgttttgaccaagtcaagttgaggcaagaatgctgggaacaagcttttctgattgaatgtgttaatttagcccgccttcaaacttcttaaccaatggcttccactctaccacctttcaacgcttttttttctgtaagatggcatgttatctgttagaaataatggggatcacattcattataccagcagtagtctctctgtgatcacactcattagactgtttactaccacgaattctgggagaaatggcctgggacattaaaagaaacaaacaagctaagagggctgtctaggaccaatgacagttattggatttgttttaagaattaagcttatgagttacacttttttcctttgcagcatagatgaaaatcatcacttgaggaacatttcaacatcatagttgcaagtataacttacacaatggaaaatgtttttcattttgagaagaggcaattgctattttgtaatggaacgcaaggactactggagataaaacttgcatgcaagaccagtacagcttgatgaagggagcagagtctagtttaacctctaaattaggagatgtttgttttaattttactgctattccaggcaagaaatattaagtgtctgctgtgttcaggactgctaaacattatggacaatacagtaatagtagaagacatggtgtctgcccttgagggagtgaaaattgaatagacaactcttaactatcaggatcaacaaaaaaatggtgttagttagggagtaataaaagtgccacacggctaactacaaaccagaaggccagggacggattactgtgaactcagctgctgtgtagctttgagtttcttgaatattgtccatgacccatttattttgttttaaatagagaattatatctgccctctaccaaatacacaggaataatctgagtaatgtttataactgtgatctgagaactttttgagtcttttgcaaatctgtaaacacagagtgagaatgagatatgacagtgtggtaaaagaggacttttgagatttattaatatttagaagtacaagggggaagaatacttttatagtatgattataatgttaaagatattcttcctttagttttataaaatgtggcttttgatcagtaagtggcaacttagaagaaaagtctatcctaagttgatttgctattccttgaccttaagaactatagaacactttattttctcctaagaccacttttttgtttttattttactccattcattaattcattcagcacataataacgaagtatgtacttggtggcaagcactgtggtaggacctggggatatgaagttgaagaagacctgggccatatctctaaaaaccttgtgaggggaaaccaagggggaaaaagtttctactattttaaataattagaatagattttattttatagttaaatttgaagaaaactacaattttagttagatttactatgccatctttactcatttgttcactcccattcgttcatttttcaagttaatgggtgctggaaacctgagtcatccttgacatgtccctttcatttgccctccaaatgcaaacaaccacctgttgtttcagtcctttcaaatgcctgcctccagaatgagcattaaatctgtcaacatatttaccatctcagcttctccagtcacctcctaactgctctcccagtttccactcttacttacctctaattaacagctttcagacttttttgaggatgacctacaattaaaaaatacatccatgatactcccagtacacatacttgtgttgctatgtatctataagtaaatccaaaatcaaagattaacagaataatacgtatcttttctcagtatcatgcattttgatatttttaaaaattatattcctggccgggcatggtagcttac

SEQ ID NO: 76280 - DNA, 1080 bp, Homo sapiens
atggttctcagtgcagaggattgtgatggtattttgaatgactatgaataaatttttggctgatatattaagtcaataatagatacctttgatttttattattatttctatattattatgcagttctcagccttgaagtttgaaagactttaataagacattgacaccagtctcccacttaatgctggaatgctcaattacaaatccctggcaaatgttcattagactttgaactcttccaatgctggagaaataactgttacacaaaacaccctattccatttggggacagtttgaattgttggaaacgttctttttatattgagctagttttctgcctgttgtctgccctttggagtcatggagatgagtttgccctctctcctacagagtaccctccagctattcgtagatagctaatctgcccaatgaattcttttttcttgttgaaacaattctagtttctctacttattcctcgcatgacatgatttttgtatcttttctctttctctgactcttttgacatgctccagttttctgtattttctttaacttttggcatccagaatagaagcaacactccaactgtgtccagaccagtgcagagcacagaaagactattttttttccttactctgaacactatacttctgctaatctggccttaaatatcatcagggttttcagcagccaagtcacactgttggctcatgtaatgttcactgtcagctaaaacccctagatctttttcacatgaactcttattcagactgctcattctttcatcctgaacttaggcctgtaatagttttctttcttgtgttcatgtaatagagtttacatttattcccattcagtctcagaacttcagaccaatcttctagtcagtcttttgtggagtctataggcttgacaaaagaaaaaactcagactccagtgaataccacaaacagttatttgctttaggttcaggaaatgaaaatgtgctggttttaagtttctgaagttgcctccctccttcatctcattccgtcctcccccttcagttctttggtccgagacccaatagaggatgtct

SEQ ID NO: 76281 - DNA, 1050 bp, Homo sapiens
tcctggactcgagcaatcctcccgccttggtctcccaaagtgggattacaggtgtaagctaccatgcccatccacatggttttttctataattgtacaaaggcagcagctggatccccagaagctactggtaatactaagatttccctcccaaagtcgaaagtagtcctgattgctttgcttaagtagtagagtttcattactattttaattcctcatgaattttttaaaaaatacaaatcatattcggagtttcatattgaaattatttaagagaaaatttttttctcaagtactgttacacactttaaaagcgtgtatgtaatttattgattttataaatataaatgatttgcatcttatgagagcaagttctataaagctctttcttggttacaatttttagcatggttttatttttaagtaaacatatctacctgaaagcaatgaaaagaacagttttgaatcttagtgatatttctggaaagagaactcattaacctgaagtactcatgcatataattaatttaaaaaccatttggttttaaccttaagctaatccaatcaacttgtgctttcatcaaacatttaaggcctaacagggacaggtctggtatcacaaaaactttcccagggaatactcttcttatggctcatcttaggacataggctgtagaactatgtcctagaaccagaccattagcaagtaagtcaccttttcataccatgtttctcctacctgtcaagcgaagatgcaggcacttgccacctgtcaatgggagaaaatactgtatatcaatcttttttatatcagtgataaggaggaaggatagtgatgactgtggcctgtagagggtatagggaaggctctgtggaagaggagagatttaaataaggcttacaagaatatgtaggatgttagtcaatgaccgttttttgagaatattgataaaaaggcatttaagatatgttgcctgcttctgatttggattggcatagaaaaggcatgaagacaacatcagaaagggagtaaaagcacaggtgtgtcaaa

SEQ ID NO: 76282 - DNA, 1873 bp, Homo sapiens
agggtgaagcatagtgattaagattaggaagtcatccacacagagttaggagaaaatacatctagagtttgccaaatccaaaggcaagactgtaagaaaaagatactaaaagagaaaagagcagaggatgtctctgcattttgtgatacattaaaaagttatggtaggagaaggagataaattaagaatagcctggggaaagagatgtagagagtgaagtcaaagaagcaggggagccagtactaggtagagtcatggtggtcaggattagaaagaattccagcagtccaatactgcagaatagtcaaggaaaattgaagaccgagactgggcctttggatttgatatttggttaccaaaggtttttaaatctggatttaggaactcatttgagattttttttttgagaatataacttttaaataacaagtcagctcacgttaattaatgtttaatgttttggggacatttacatttagcttttcttaaccttttaaatgtgttcactaaatattattttatttctaactgcaggctaagcaagttatactgtgtgtataaagtgcccaagtctaagaggcattgtagacaggctatttttagggaaactcatgtttttctttaaaagttcagctagcatttggaatcgatatacagtataatatttaaaaaaaaaaacaacatatttcctcatcccccaagaggtttcttaaaatagcatgtaatcttacctacagtgggaaaagcctcaaattttataaattgggttggatctaacccagattacctgaccaagagagtccccaagaaaaacaaggtgtggtaaaggttatagtaatggtaattaagaaagttgtgttgtgcctgctgggcctcactaaaagcaatgacccagcctgtggctactggcatcattttgactgctgagacatgctttcttttggagagaagtccaaaccaaatctttgcccactttgaaagccaagatattctcattcctttcagccacagaaagggctggtttttctaacaggatcatgtccgtgtgaccttctgatgtatcaacttgttttctatgcagtatataaacaataaagggtttaattttagttgcttttcttcacagagtcatggaatattacaaatgttagaagctagagaggatctttgaggttatctgctttaagccccttgctttccacaggaaaacaccaaggctcagagagataaaatgtgtccatgctggacacagctggaaaatgatagagcttgaactcaggttaactgaccctccatgcaggtctgtggctgcaccatacattacagcatctctattcaacagtaaaactcattggggttatatattataccctagtggatattacatctgtgggatgacaagctgcattatgatagagttgcactgtgctcagcagcagttgagtagccagcacccacaggcaacctctatgggcaatctgaaagtgaaatctttactgaattgaatggaatctgtggagatcttcgatagtcttcccttgaggtgaaatcttgttttgttgagtggtttaagatgttttctagggtgtagcactttgcagaagtgctttcctctttcatgataggtgacccagtttggagatcaggaagattttgtcatccttcacattgcaagacttgaagacttgcaactcaaaatggtatatttttttcttttcttccaatagagaacaattccactctagcactcaagtatctaatacttttgggacatgttgaaactgtttccatttcatctgatttcactcagcaattatttatagaactctctgtgaggtaggcaccatgctaagtatcctgaggctgacaaaga

SEQ ID NO: 76283 - DNA, 1054 bp, Homo sapiens
attaatatataaaaccatcagatatcagagcatagttgtggaaagtcacctaaggaaagtcattgtctctaggccaaagactggcctagacgtaagtaatgcaccagtgtgtcagaaagggggttggtcgacatcagaagcacccagaggcaaacactggttgtgccctgtacccacagtaactgtccatagaaatgtgaatgttggtagtcttcaaagtttcagtgtcactggcaagtccttctttgttggaaattcaatttaacattcaagttctatagcaaatgcctcctattatgatgtcttgtgtttacagtttgcctctgtaagtagaaccctctaaagggaaaaatgctctggtcagattgttatggtctgtatgacagatacataactgttgtaaatcaacacattggcattctcgtttgctccaccagtttgttgtgaacttcgtcaggggaaggcatcatgcctaagtctattcaactctgggatactgacaaggtcaaatttctgtgcctgcaaggctgggactggacccaagctgtacagttcatacaatgaaatagtgccatttagtaaaaaagggagataatatggcacttggttggaagtttggctctagaatctgattgaactgggtttgaatactaggtcagccacttacatgctgtatgacctaagaccccgctctaaaaaggatattatctttacactgacctcagagggctgttttgagaattaaattagacaatccatgtaaaatacttgactcagagccttacatagagctgttagcagcagcaacaacagcagcaccagcagcaaggtaaataccaccatgtgtgtcctttgggtggtcagcagtttgctgaacaatttggactggtttagaaccctcctaactcactactggggactttccattggaaccacagcactgggtagtgacagaatttgccagtgtaatcacatcatttatgagaaatgatagcaatagggtttggtgtcatagtaatggaaaatggcactggacactatcctaattttgaag

SEQ ID NO: 76284 - DNA, 2000 bp, Homo sapiens
aagacaaccttcaaatattaacatagttacatgatgagaaagagtagatgccattggtgtctaagagagtaaaaaaatcacttctcattccctgttgagaaatggactctggcatcaggttgatggagaacaaaatgtcagctttattccagtaaaaccatattagagaatgtggcctgatctgtggctacaatcaggccttttatacccttccctagttaaacacactctcagagtcaggtaaggccctggacaactgttgtttgcaggaggagggcagttcctgtgtgaaggagaaggagaaagtgtgcatcctgaagccaggggtgcacctgacttctcgactgtgaatgagagaggaggaaacctagttcatatctgcacaaaaattctttttggtatccttgaagtgggctgaaacaaaaaagatcaaaatgttactctagcaggaggccactcatggaaaccttaggcaggggaattgtgttacccctggtacttaccaactttaacttcagtggggcaaccaagccaatggagcactcttatctctgaaatgtttggcctctgtacagaatgatgtgaaaaagaatcttctagcatggggaggtggaggggagggatgtctagattacttctacggcccccactccctaagattcttttgaaatcagttaagacacgcataaataaaaaaactccaagtaaagcatgtcagtattttaaaggcttatttgtttgagcaatgagagatgatcagtgttctaagtgctatggttcatcatgttctggaggtggctttgttccaactgtttgttcacgagtgttttgagttaaagggaattacagtctacaaatttatgcacatggcacttcacagaatagaagaggccaacttctggcctcttatacccacatgcaacaaatacagctcgtgtccttcccccaggactcaatttgtaagcctctttattgcattgtgctgtagtaaaaaattctcagttttgtgggcaacctgtgaaaccagccttcttttatttcaactttgttgttttgcctttatactgtgaattaaatgaatccttgggggttctaattatattatggaaaaaagaacttgatattctgagaagctgaagaacaatttgttttcctcagctaggtatttaggacttttaggatttagttaccattttcaaaaaacttgaagaagattaattatctccattgcctcaaatgacaaagatagtatgttcaattctctcctgagttatcatcataataaccctatattcttaatatggccttttatattttacaaagtttctcaatagggaatgagaagaaagtgattttttaatctcttagacaccaatggcgtctactctcccttatcatataactatcttaatatttgaaggttgttttcatcttcctcttcagtttttctcttttctcttttaccacaataatcatcacaaataatcctgtttggaaggtggagaagaggaagcaagacagatattattgtacccatttcagaaataaggagaatggaactcagagagtggtggtgggaacaattaacaaatgttttctgagcaccaatctgttccaactacctgcagtagtgcatttaatccttataatagttccgggagttaggtgctattatccccattttgagatgaggaaactgtggctcaaagtgttagttgcccaaggtcatgcagtattaagtagaagaaccaaaattagacccaggctttctggttctgaaatccatactcttaagcactaggttgttaccactggagaggttatgaacgtgcccaaaggcactggctgcctagtagctgaggcagggccagaacctgtctttagactgcttagcacatcttctagatcctgtagctgcttcactggttttcattaactttggggtttttcaatacaaaaagaggaaacaaatgaaagctgagccgaattttgcttttgta

SEQ ID NO: 76285 - DNA, 2761 bp, Homo sapiens
ccatcaacaggggtcaagaggagcctggacagtaatccctgtccgacccccctctcagcctaatcactactatttgcctcaaacaatcttatttcatgaggcctttgatcaatgttgagattagtcactgtaagaagcctgacttgtaggaaaccttttacctcccagactctaattcttctattccgtttctccccaagtcctgtgtcctctggaattcagaatctgtcattggcaagatctcctgtgttctcaaccccttctcagaacagtcctttcaccttcccactctaaactgaactgtggctgtcgcctaaggatgctgcctcccctgctgctctcctaagtggtggtagtgttatcttccccagtctcctatgacaaggcctggaggtgggctaggtgtcctctttcttgttccccactgctgctttcagaccattcttcatctcctcttttctaaatccagccctcctcccccttaaaatcttatgttatcagttatctatagacctctgtgagcttaatcctacgcaatgtaaaggcatatctttctggccaatcaatatggagtttatggcacttttataaagaaagtggataatggcctcctgatcaagaacataactgctattttcattagtcggtactctatgatgcgggtgcatggtccaggggaagtgggttcaggcccatcagactgactgagagttgagttctttacccactcagagtcaagaattgtggtatggggggaagcactgtgtgaagcatcctacaggggtctgttctgaacactgaaaatgtacagtccctgtcccagagtggcattctcaagatttttttcttgatgggacttgtgtggctatgggccaaattaaatttaatataagcctgactctcatagcctttgtagaggaatgaaaccagaagaatttggagcagagagtcgggcactcatagaatatttttctaaaacagaggaagtcatggaagactcagggtctagagtataaagtgtttgttacttaactttgaaaggacaactttgtataatttagcaaagccttcttgtttaagattagtctctaataagtaagagggccttgctggatttcttcataattctcagtagttaccagaagtcagaactattccttatctgtaagtaacaggtctttagattatagacctagtggggatataactttaatgttgtacagttaaatcaacttcacactatttacaagacatgtcatacaacactgaaaacaagaaattagagtatgtggaaactatgctactaaaattaagcagcataaggaaaattaatgtaagcctataagtcacagcttgacttctgtttcagcagctgacccagaggcaatgaagccaaaaacaattttaagacctgttctgttctgacttgtaaagattatttgatgttaaccccatacccttatcccctttccaagtgagtaccaggggttaggaaaaagatataatattgcctggctcatttctaatcaaactttaatgctggcttcagcaaggccagatgcctactttttgtaaatatcattggcagttggcagtacatttcattaacagtttttatggctatcagtagtatttttgatactctgaggatgagcactagagaaatatgtgcttgctgaaaagcctgctaatctctgtgtgataacttaattttgctattacctgaatgtaagtgctattgatgtggcattagcattgatttcatagctatttaataaagagacagaaacttcaaatgcataattatgacatcaatatatgaatctttctttagagatgaaaaacacatagttaaaaactgtgaaaaactgccctgcttatatcagaaaacttatacttctctgttgaaaaaataggcaactaaaatagtttacaatataatctaaaaggatgaattggtggaattttcagtataactggaaggtatgatgtgttagatagtggggagagtgtatatatattatcaagccacaatattacaacctgacactattagatataatagattatgcagccaaaaatgtggtcatggacagtgataggggagcagaatggttcggtaaagtaccaagtctggtgacaggacaatgggaaaatttctgcagcctgatggtctgggtagttggatataagtctgacagcagagatactttcatatttagggaaaacctgcaaaatactgaaaagattaataaagagaaagggaacttctaaatagctaaaactcccggcagagcagcatagctgacagagcaccataatcttgcgtatcagagcttctcaattcctttggaacaggagaatttgataatttttttctcccatgaggatgcactatgaaggaaaccgctaggaaattggaattattttaaagtgattattttaacattaacttggtagacttcatctattccatagcatttcttttcttttatcccattcaattgcatcctctctataggattaatgcactcttgaaagtgtcaccttctagccagtggccaactaacacaaaaccaattcactaaacaaaaacacaacaaaggaccctcagagagtccacttcactccctgctacctccactggagcaggtactggtatcctcggctgcaagacctgaagacagatcacatcacaggacgctttgcagacactcgccagtaccaacccagagcccaagagctccactagatggctagg

SEQ ID NO: 76286 - DNA, 1124 bp, Homo sapiens
atgcatgggactttggggacttgcgggaaaaggttggggtggcgagagataaaagagttcacattaggtacagtgtacactgcttgggtgatgggtgcaccaaaatttcagaaatcaccaccaaggaacttactcatgtaaccaaacacctctgttccccaaaaacctattgaaataaaaaaaataaattaataaattaatgtttgtgttattcaaatacccataggagaagtaatctccttgagactggagctccattttcttcacttttctatgcctggaaatacctcacaaaatgactacagagtagttacccaagaggtatttgttgactcgttatctcttacagaattttagataccatctatacttcttttcttactgtacattttccctgggtgagctctcatttattcctgcggatgcacacataccctgaccagtcacagatctctacctccagctcaggctcttctcctgagctccagccccacgtgtccaagtgtctgctgggaatctcctagatgttgtgggctaactccaactcagaatgcccatgtctgaactgttagtatttctttccagaatggccatttcttacacttcccctaccttggctaacaggaaaatcgttatctactcagttgcctaaatcacaattttgaggcgtagaaactttccctcgtcctttcctcccatttttaatcaaacatgtttacattcttctttttccttctggtttaggatctcctccaagacggtttctgtctcattacttattagccttgcctaggccaaggcttgatttaggatatgtatgtttttaatacatgtctaatgaatgggaattttttgtagcttttagattttctgttgagaaacacacataaacacatactcacaaacacgtgtgtgcctggaagcacatacatgtagtattcacccaagtcgtccaagttcactgagtcctgtccagacctttaattctctcagtttatttgtgagattgttgtgtggcacaagcttacaggcatgtgtaattgttaagggaatatggattgagaactctgccatgataactcatagctccttctgggtagttaagccttacatcccattctgcc

SEQ ID NO: 76287 - DNA, 2382 bp, Homo sapiens
tttgctgagtgggaccaagcaatcttggtgtagaatgaagaaaaaatggtgaaactatggagggtgaaattatttaaactgtaaaaagcaaatgactttgttttccggatcttttataccacctcctttgatgcagcctgcttcctgcatgaagcctgttttgtttgttacttgttttcttatcctgagattgcgctaaaattgcatgactctgttacaattcttggataacttttcaagaaccactttggaaaaattattgtacaatagtatctctctggaatccagttttattctctcccagtcacttactttgccaatggcccattagctgtgtaagtgatgtagctcttccttttttcactcatggattacttctgcttggcatatcttctttcaccttgagcagcagtcaaaattttacttatttcttaatattcaacttaaatatcacctttgtgaaaagcctttcgggttcatattattatgatctattcatatttattcagttctctagtaagtactgtatgcataagtaggcatctgataaatatttattaagttgatattaacatatggcttaagaaattgctaattttataatacagtagttttattttttatgcaaacaacaaaagacatcttaaaaagctattcttttttttttgagaaggagagtctcactgtgttgcccaggctggagtacagtggcgcagtcttggctcactgcaacctctacctcccaggctcaagcaattctctgcctcagcctcccgagtagctgggattacaggtgtccgctgccacgcccagctaatttcatatttttagtagagacggggtttcaccatcttgaccaggctggtcttgaactcctgatctcgtgatccacccacctcggcctcccaaagtgctgggattacagatgtgagccactgcgcccggcccaaaaagctattttctttttaagcctcaacaatacatattaaaaaatacaagagaaagaatgtttgttaagaaaaaaatttagacatacaagtgtgcaatttagagaaactttttttctaaaatattataaatttagaaaaattttgcaaacagaaaacactgtagggacaatatatgataagtaaattgtacttcagcaactcattgctttttagataccactgaattatttgcactaatggaggaacattgttataccaacctatttatatttgatccacattttaagattcctgttcagcttatttactttcttacttatgtcttatctggattcttattaacgttagttctcccttacttgcttggaggagaaatcattagaaacatgctgagaactgggagatggccacttcaagtttaaatttgctatgaagaagctaccaataaccttctttcagtctaaattaaggtggcctgtagttttacaacccaaagcatgattgtgggatgctaatttagggaactattctgcagaaaccatgacacaatcagcttgctggtccgtatttagaaccatacttggaaattgtgctcaggtctgcaatttgtaattcatgggtaggggttgaatctagaggtggctgagagttcagccacaaaggtgataaaaggattgggaaagaactatgaaggaatttaaagaaactgggattagcttggaaagagaggaagataaagagcaatttaatcgcaatctttatgtacatagagaagcttagcggaacacagtgaccagtgttttctgcctcacctgaggacaacacaagaggcttaaactgcaatatgagggatttgggataggcataaggaagtatctactaacaagcaaaattggagtagactactgagaaatatggtagaatttccatctctgaggactgaaaatgtatatattctattcctttcgagtgttttaaggtaaatcttgctcaaagatgttgacctgaacttgatggcttcctggaaatccattcattgtgtgacattactgtttttagaagcttcttcatagatggcagggaggagcaagtacaccaatcaagtcacgggcagtgtgatatggagaaaagggctccaggctgagaggcaagggaacttgattgctgtctctgatgtactgcaattagttgagtgttcttatacttgtcacttaactcctctgtgcttcggttttctaatctataaaatgagggagccaacctaaatggctcaaaaaggagtttaaaagtaagaaagcataatattcagtaaacataagctaaaaccctctcccgggccagccacggagcaagacttcttcacgtattatcttctagagcatctcatctgatatagtttgattgtgtccccacccaaatctcaccttgaatt

SEQ ID NO: 76288 - DNA, 4391 bp, Homo sapiens
aaataatctattctctagatttagcctggcattgacccgctgtgtgacttacgtcaagccactatttcttgactggccctcacatgcaatttatcctttgcaaaatgatgggatttaatctaaatgattgctaaggttccttccaggtctcagcttttgcagcttcctatagactgtgaacatgggaatacagtctgattttctcagtgactcatctgggaccctagaaactggcagattgggaaagaaaactaatattctctaaaactgaatttcttaacttacagattataaaactctactttttaccatgtctaaaaattcagtattcgtggaacagctgatattatcttttgctgatgggcaaaattaacaggcacctttgagacctagcttcatatctatgaaaattcattaagttgaaagttcatttgtaaacaagcttctctagacagctgagaagtgattgttctatcttgcattgtatatattttaatcttttgtattgacctgtagtcatctcactggtcaagctaacatgtttttgatagccaagagttggaaaacctggtcactattggcctaattgtactcttggaccacccatggaactcttggcaattagattttcttataaaactctttcctagagggccctttgtggataagatgagcctcacattgcattttagaatagtacgtgctaagaagcagtgcaagtaaaagtgtgacattatagaagatgcctctggcttactcatcttcattatgacaggaatttgccattgtcaatgtcttatatgttgtagaatgagaaagaaatgactctttggagtagatatctgcaataaaatctggattgatctacttacagtcagtttcagagtaggcagtctccagggcactgggagtaactagactctggtctccaggcctaggttcagctacattccctacaaggcctttggcgtgtacctgttcagttggtcagtcaccctgtttccaaacaaaggacatggccctgaaaactatacacaacagggcaagatcctggctctagtttgggattcgtcatgtctttttagttaggcaagccttcaatttaggggacaggatcagagctgtgtcatagatctcttatatctttgtgccctatcttgccctcaagactgcctcatctctttgattagttcctgatgctgtcatgggctaggccaccttcctcatttcctactaaaattttcactttaactaggttgaagcaactcatatcatttctagcatgtcactgaattctatccctgctcttcagaatcagttacactttttcaactaggtatccagcactgagaaggcacagaggagaccaggcctgtagccagttgagaggttacaaaaagcatcaaattgtaggacagtcttatacaggtgactttctcattcagtgtaatgtggattatataagttgaggctttttgattgcaagcaatataaattactttggctaactgaaaggaaaaaagagtaatttttgaaggtatagagagtgtgtcatagaattgaaggaaaagtagaacagattttcagagtaggacatctgtgggagtagaggaaacagaaactaatggtcacgtcaaggcaccaccactggaatgagttcactccagacattttctgttaaacatctttattgtttgactagtcattcagattcccagcagagaatctgactggctttgattataagcctacctcttagccagggaaggccctgtaccttagatgacagtcctaccagcactgcccataataaaggtcaggggtggttacccaaagccaagcacttttggtgttcctaccaaaaaaaggacattcaaaggcaacagatgtctactacaaaatctgttctatgggatctacagtgagggaatagattcagccttacagctaaagaaacggattgctatgcagagatttctgcttcttaggagttgccaaaaagacccttatccggcttaggagttcttggctgtgattttagtgttcttttgtttcccaagtatttttaaaatgtaaatcagtaactagcaagaggcatctttggtcattgtagttgcttggagtagaataaatttaaaaaattctttgatgtgagaaaaattactatcatcattatcacacatggaaggtcaacattagggccagtcattggagttaaactgtcagaagaacatcccagttactttctcacttttgagttgtgtagactgacaggatttgagtctttgagggctttgactagggtaactgacctcaaaacaaatagctagagggatatttctacttctatccgctgagggatttgtagcaagaagccatattgtggatggtatattttaataacaaaggggattttaaaaggaggatgacacattgatttggaatgttttctcaactgtatttacttattcttaaatattttccttcatgctttctttctcaagtggatgaccagctggttgccacctttttcttctctctttgcctctgttcctaatttctttcttatccttaaccactccactttccttcctccaatcttgttttctctctaaatctttcctccaaccttattgaatctctccccttctttttgttatctggtcatttgatctataatttcgattccttttcctgaaattccctcctttttccttttcccctaaaccatcattctagtcctccccacacccaagcttcttatctctttgctgttaatctccaatgtgtttattgacttgtgtgccaaaaggcaaaatccccagccccctcccaaccatgccagtgcattgaaaagcagcagctgtcattgctcaacaagttccttgtgatctacaaatcaatggataagaattctcacagtgaaggtttacatgtatatatttgtatgtatatatgagacatgtgaccatgtttaatgaatggagaaggacttggatcttttctagtagagaagagaagcagaaagctttgcctaaccctatttctttactaaggtaatgaaaaaattatacagggaaaataaatgatgttaatgagagaaacagggacaggagaccaataaacaatcatcaggcatgagaatatcttgctgaacttattattgatagtagacacaggaatgtaatataaatgcagtgatggaacagaaagcagactcaggaaagaaagagatgataataaatagtaataaaatccaagtgattcatatgctcaagtgaaagaaagaagaaagagggcagtgtacacaaagtaaaagggcaagaaaatggaagtagagtcatcactcgtagagataaatagttgggaaatatgagaagccttcctgacatcagtaaaatattacatgttaaacagcaaacaaaagacaacaacagtgtctgtagtacttttggaatataaaagttagataatactagagtagtatcttcaaaataagcaacttcagaaatcaagtccccagtaaagggaattggaagaatttgaatagatgaaataaggagcagtggcaagtgatacaaaccttaagcaggaaaagtgattttaaatggtactggcaggttaacaactggcaaaaagaaaaaaaaagaaaagaaaagcaagatggtgctatatcccccaggtgctgggaaaccaacctggcctaaaaaaggagcagacccacctaactttttgccaagcactgtgctaggtgcattgcatacacttttaatttaagcctcgctgtacataaaagtgaagccaaggtctgagaatgatatccattgggaggaaaaaacaggaaaattttctgagccagttccaaagtcataaggctcagggggaataactttgactttgtcaagtcagagtgaacagccagagtcagcagacataggatattgtcagaggtaaatcaccagcttggtctggtctgtcttattgcaaggtcagaggaccatagcaagccagccaaatgttttcaaccatggaaatcccctaactttccaactgctgcagtcccacagctctgagcttttactcacaggatggctcccttccagctttcaaatctctccaagttgattaatcattttcttgttctgactcattcaggcctctagaaaaatagctgtaggtactggaagggctatgtagatcaaggaggtcagataaattggcttgatgttggtctatagaaaaatctagaagatattgccaaaagcttttaagcataccgtcttcagatgctgggatgtgggctatatccacaggccattggctcattcatgtgtttgaagcagaatatttttgtgtgcattaggagacttgggtatgttcatttcttaatg

SEQ ID NO: 76289 - DNA, 1317 bp, Homo sapiens
aggactgaaatgtcagttctggttgtctgagccaagggcatatatgctgattacattattttgtctggctaatacactttatcatgaagcttattttagaagaaatgttcatttttagatttctgtttgtatatttaggtcatactataaggtccattctcttgcttttataataatttagtcttctgctttattcattcaattcatgaacattcattaagtacctgagtatgctagtcattggagatgcagttgtaactaaggcatcaccccagacctgaagttttatgttgtgttttgtgcttagtgattggcataagtaaaatacttgaggaaacacagaagcagcagcaaatatttctgcaaaggagaagagaaaatatttgagttgaagcttcaagaatatatcaacattttccagtttgacaagggtgggaggagccccatcaatacagggaacagcatgtggaaatgcaaagaggtgtgaaagagcatagtatattcagggtgaaaaaatacattttttatgaattgtagtagaaaatgagccgaaataggttaagttgaggtaagattgtgatgggtcttacagcatactaaggcattatcctgtaagtaatagaagggcttatggaggttttaaagaaagagagtaacttcatttgatttcttttttcaggaagagaattctgatgatagtgtagggtggaaaaaaggggtaacaaaggaaccagtgggaaagctgctgtatagtctggaagtggtagcagtaagaggagaggtgaagggacagatttgagatgcatatcagaagtcaaatgagcagactactgtgactggttggatacaggggtgggtgtttgagtgggacctccagttaggaactcagatgtctggatgggtcatgctgccttcaacaagaaattcagaggaaaagcagccttggggaatgatgaggtcattttgtaacatgttgagtttaaattaaggcactaatgagaagagacattcaggtggagaagtccaatggacgacaatagtatgggtcaagaaagaaagctgagaagtatctgaattacaattatgcatcacttaatgataggaatgtgttctgagaaatgagttattaggtgatttcaacattatgcaaacatcatcgagtgcacttacaaaaacctagatggtatagcctgctatacaccttggctggatggtacagcctgttattcctgggcagcaaacctgtagagcatgttattgtactgaatactataggcaattggaacacaatggcaagtgtttgtgtatctaaacata

SEQ ID NO: 76290 - DNA, 1042 bp, Homo sapiens
gcagtcactctgcatttcttctccttactccccatcccagccctaggcaaacactgctttctgtctctatggatttgagatttttttctgctttttagctattataaataatgctgctgtgaacatttacatgcagtgttttacatggacatgtgttttcatttctcttttttttttttttttttttttgagacggagtcttgctctgtcaccaggctggagtgcagtggtgcaatctcagctcactgcaacctctgcctcccggttcaagtgattcccctgcctcagcctcccaagtagctgggattacaggcatgcaccaccacgcccagctgatcttttgtattttagtagagatggtgtttcaccgtgttggccaagatggtctcgatctcctgactttgtgagccacccacctcggcctcccaaagtgcctcagcctccgaagcatttatcatatgaatatatctccgagtagaattgctgggttatatgttaactctgttttcttttaacattttgaggagctgccaaatcattttccaaagtgaccacaccattttacattcccaccatcaatatattgagggttctagtttctccacatccttgccaacactttttattgtcagtcttatagccatcctagtagttgtgaagtggtatttcatggtgattttgatcagaaacatttttcacaaaatagaattccttagtttagtttagttttgttttgttgtttttttgttttttaagatgaggtcttgctctgtcgccccagctggagtacagtggcacaatcatagctcactgcagccttgaacttctgggctcaagcagttctctcacctcagcctcccaagtagctagtactacaggtatgtaccactgtgcccagctaaattttaaaaaattttttgtagagacaaagatctcactgtgttgcccaggctgatctcaaattcctgccctcaagcaatcccccttccttggcctcccaaaatgctaggattacaggcatgagccactgtgcccaaccata

SEQ ID NO: 76291 - DNA, 1023 bp, Homo sapiens
tggaggtccaggtagtgtcctaattttgcacacacagccctggtgacatgaaagggcattgttgaaatgaccaagtgagtcatggtaatcagggcaatcctgtaggttagagatatgggggtcttgtttatttgtttgcctgctagagctgcaattctttcataaactacatgacttttgaaaatacctcaaacaacatatataaatcagaccaaggatattaatctcaggccaccgccatagtgaggctttgaagccaggggaaggtggtgagaccttcttgtttgttaaggaagaaatgtcataaaaattccaaagcaggactcaaatttccaggggagagggcctctttattgtttcctctaatagctgctttggcgctttagtgaataaatgtgttgcacaaagtaaccctagatgcatctgaactttagtctggcttggctcccacttttgtatttagcatccattctgaattatttatttaagatatttttgctgttgtttgtcactccttcttcctgtctccctaccagtccccctcattcgtcctgtctttatttttacacttctctaattaattgatatcttctgctcttagcactgcagcaaatgtgcctgcatttttatgtggatcttcactatgcaggctatgcttttaagtttctggaatagaatgatggtaaaaatgagtcatggcttgtttctatatttgtttctgagtcaagaagcttaattttcttactataatgcctgagatatcaagctatacagtttacttttaagggaaacaatcacaatttcatcaattcctttaagtagatgttttcaaatattatagaattctttggatttgtgtttccaaaatgaacaacacaatggtagtgctattattgttttaaggagaaaaagaagcatatccaaaataggtaaaatcttcccctaaatcccctgggaacaggcctatgggtgttgccctggcctgctcacagccccaggacaaccggcattaattcactgagg

SEQ ID NO: 76292 - DNA, 1896 bp, Homo sapiens
agctgtattattatggttaggtttgatgaagcatggacagtcatgtagaagtatagttggacaaaaagcagatatgacctaatgatgataaactagggggatcttagcaaagcctgtttgtttagtttcttcttggcctctgtgtttaacattccatccctccgggtatagtcaagacacctgtctcatgagggtcttcaagagagaaggtcagagagacctttttgcttctgcagttttcttaacttccttcagcttaatactcagtgcgccaagcttccatatttgggggtagcattttctgcactctatcatgctataagctgattttctcacatttagaggaacattcaacagctaacataaacaattacctgatgtcatatttgaagatatacttagataataaggtcttaaaaaacagtaagtacattaagtacattcacaacaattgttaatcttccattagttctgaaatgcctaatctaacctttgttttatctcagacttgggctagaatgctccttttaattcattctgcatgatttcatagaatcaattttttcttaaggtctcatatccttcaaagactttagggcaattggtcacgaagacccttgcacctcctcaaggctgtgtgctgtggatgttgcagcttaaggaagcattttgaaattgggcatctttcacagcctagtgtagaagttattggcccgcagtttttaccggctttctctttcagaaatcttcttttgttcctgccacaaggcaaaaacaggaaaagagatctgtgtgaaagaatgctctcccttttccttttgtggtgattgtgtatcttaagagaaggcctcaaaggttcccggagctgtctgtcttttcatgtaaatggagcccttaagcctatttagaagtgtgcgaaaagactgtgggagttgaggtgaaagatacagaagagtagcatcagcaccccgtttaatgtattcaagttcaactgtgcactctctctttcttgtatataattaaaaatactgcagaattgtattttgcacttgtacttttaattatatgctattcatattactatatacccatatagtgtgcagcgttgcaactacaaaaccatatattttgtattgggaggtttaagggattttccagggtaattttgaccgcgtaaaatttgccttacatgccaactctagaatacaatccccacgtaagatgtaaccctctatattaggtatttttaaatccctgcttatcccaaagtgagcagaactgggactcacattcaccccttgcccccaaaccagtaacaggtatagggttgtcactgaattttgtgagaagaaaagaggtgagacagaaggaacttgtgaggtttgacagaggagcaaggaaatctgtggcaggacacagtaggccggggacgctgggtcaggcagggaagggggctgagagagagttcctgggtgagactgtttgtactagtaaatgcagggctcaaagccatactagccatggggttggtagagtttgtaaataggagtaactcctactggatggataatagccatttttccctagagtaccttcaccttacaggaaagtttactgtgcattgttccatgtgaatgttgcagcatgtgtgtgtgtgcacacacgtgtatttgtgatgttgtagacagagtaggaggaaagagtagcagtgtggaaagaggagaaggcatgaggatttagcatccaaggtttaagaacaaggtctgccttttgttgttttgtggctggggcagtatcattaaatggctgaggggacctgagatattggcatgagagagggaaggtcacccttgtagcccctgtcacctgctaccttgggaggcattcccttcccct

SEQ ID NO: 76293 - DNA, 1048 bp, Homo sapiens
tttggtgcttgtcttctaactgccttacacttttctcttctgggaacggccaaggcccccaaaacacaaaagtgaactatgatcccactttgctagactcttgagatggctctgtaaacataccctctaatctatggtccttccttcctacttcctcagaattcactgaaaacaatagagctctaggaactcctattgcttaaaacaggggtgaggatcgtgtttattcaggactatggctgttaaattagcaggactgttttgactagctggtactcaggggtagggttgtcatgttggtcaacatgcctatcccatttgggactactctaaaggaaataggaatgcctaaaaagtttctagacttctaagaattctatgactggggttagggatgacttataggcaggaacggagccagactcctgacggtatccaaggtttataggcttggtgatagaatttaccagagtagaagagaaagttttctgagtagctagtgttttgaatggcatggggtttgtgacaagatttggggtaagccagtgagagatgctttggagttatctgggacctcatttattctggtggaatgccagaagtacaggaggcatctcctagggtatttagttttttagaggctaggaaaggtagtaaaggtaaagtagatacaaatttgttactatgacttttatggagccttgagatagttatacgaagtaggaggttgagcagggattattttaatcggagaagagattagtagaaactcatttaggaggattagagcatgctgaatgagatgtcagaagcttttaggatccaagaaaagtggatggcagagagagagaggggtcagcactgtgtttaatttccttctttaccgtttctcgtctgcctttcctggatattacctatttcaaactaaagggaaatgtgtggaggctgcatcgggtagcagaaaaacatggaatagggaactctgcctctgaaatagcatataatacttcccacagggtttaatgtgaaataagtggtataatctagg

SEQ ID NO: 76294 - DNA, 1022 bp, Homo sapiens
tgtcggccaggcgcggtggctcacacctgtaatcctagcactttgggaggctgaggcaggtggaacacctgaggtcaggagttcaagaccagcctggccaatatggtaaaaccccatttctactaataaaatacaaaaattagctgggcgtggtggcatgtgcctgtaatcccagctgctcgggaggctgaggcaggagaatcacttgaacccaggaggcggaggttgcaatgagctgagatcacataccactgcactcctgcctgggcaacagagtgagactctgtcttaaaaaataaaaaataaaaataacataactaactgtataatataataatatgataaatgctattctgttggtatgaatcaagtagcacagaggaagaaaacaattcactctagtagatggttggcattttgagagagatataaatataattgtgctcatttataacatgaattataaatgtagcagcattggaaatggacatttaataaggtgtagcactactaaattggattaagtgcatgcactgggtttatagatggatgttcccatcaaatttgttctttatttgtatccctacccctgagcagtccttgcctggcaagtgattggtgtttgcactgttgggggtaggctttaggttcctgtttgggcaccaggagctgtagggttagaagaagtaatgtctttttctcacctattgcaaggttcattactgaaccctatagcaaaggcagagtaacaagcaaaaagcataacaaatttatttaacagagttttatgtgacactgaagcccttagaaatgacccaaagacccagggaaaactgtgtatttatatggatagtcatacagaagtatgattggagcaccacagagtatcatctaatggtaatcaactagggagaactttgcaagccctgtttgttcgaatggcttccaagtatagggtaggacccctctggaatgaagatcttaaggcctacttttagggaagataggtcagaaaattattt

SEQ ID NO: 76295 - DNA, 1060 bp, Homo sapiens
catgtctttggggcccagtgtttctgtctctctgcttctcccaacactcagtggcctgaagaagaagagctttggtatataatttcttttttccccccagccaagaggaattgagcactcatgaatattttaagcgtgttacaaagaacacaaaagctgtgccttcatgggaggattaaatgttggtgtttgactcctcacaatcagcacattttaaaacataaaccagatcatgtcagtctcctgcttcagagccaccagtggtctcccacactcttgcaaccaaacccaaggctgggtgccagcctccaaggcactgcctgactcagccctgcccactgctctgaccacctcttgcagtaattccagccatgctgatctactctgggttcccagggcatcgtaagcatctttctctttaggacctttctacacatctcccctgcctgggaccctgccctgaaccctgtgctaccgcaggatcgtcactcagatctcagcctgaatgtcctgtctcagacaggactcccctgactgtcctatcagtatctacacccgatattttatttcctcacatcactcatcatatctgaaattgcctgctcatttcctggttttcttgtttactgttggaccctgactagggggtctcactctacaagggcagaaagaggttgtcttagtctggttctctgttgttacccagaagctggaacaacgcctgttccccagcggttgctcagtaaacacatgtggactcaatgagggattgaattggaagttatttacctctctcctggcttttgcttccctctcttcctttgtctctcttttgcggaatctgtaccatgaaaagggctgttgtccagtagtggaacacaggccttggattgaggtcctggttgactcacttgatctgaagcttctggtcatgcacaactgccaattggaaacagctactatagaaccaccctctttttccaaagggtcaacaaggaaatcaaaaatagaaatacatttcaggtagtcatgtaatactttactaatactaaccctaaga

SEQ ID NO: 76296 - DNA, 1036 bp, Homo sapiens
tctcggctcactgcaggctctgcccccgggttcacaccattctcctgcctcagcctccccagtagctgggactacaggtgcccaccaccttgcctggctaattttttgtatttttagtagagatggggtttcaccgtgttagccaggatggtctcgatctcttgacctggtgatccgcctgcctcggcctcccaaagtgctgggattacaggcgtgagccactgcgcctggcccaacactttctatattttaaaagttctagaacttcggcttctgcccatgatgtcctgtggggtcctgaaagcaactgttgaagaatatctttgcttgaaaagagccacgagtgaccactgtgtcttcctacaagtggtcagacacaattgtctcttgattatttagtgtaatgtaggggaataactgagattaactggtggttatgattttgcttaaggcagtgtgatgaggacactaaggttagggcagctcctgagcaggaggaggctgctatccagagtcaggaagtctcccaaggtgttttttgcctggtgatcagcttttggccaaaagcctattactctcaggtgaacctggccctgttcttggtcccaaagctcccggaccaggctgagctataaaaatagaatgccaaattattgatcctacagtgtaaaattaagctgttctatccactggataggcttgcctaagttcccctttaaggcaaattaagtgacaaatcaaattattggacagttgcttggtaagtacagaattgatgtgaggggagttaagtgattcaaatgcttatattatcaggccccgttagcctgctgttccacctctacagtgcagatctatctgtcaggtgaccacttgagtgggcacacagggcttcctggcaaccctgattaggttcggaacaagcacttccatcatttttcttttttttcttagagatgtgctctcactctgtcatacagagctggagtatagtggtgcaattatagctcactgcagcctcgaactcctgggctca

SEQ ID NO: 76297 - DNA, 1027 bp, Homo sapiens
cttgcctttactacacctaacaaaattaacaattcattaatatcatccaatacccagcccaaaatcagatttccctgattgtctcaaagatatccttttacagttgattagtttaaataaggacctaaataaggtccataaattgcatttggttgttatatccttttactttcttttattctggagtacttcccagaataaaataataaatgtcacaaataatgtcacaaataattaataattatgtcagaaataattacttccttactctccttttatttgtgacattaattatttggagaaattggatatcaaatgccctatattctagatttggctgatggcttcttcaccacgtccttttaacttgttctgctagatcttatatttcccataaactggtggttgctgctaaggtttgattagattagggtttagagggttttgttttgttttttctttttaggcaaaaacactctataggtggtgctagtacttcctattttatcatgtcacaaggcaataatgtctgactatatcacctttaatggtgattaagttgatcagtggttcgggatagtggcagcctgatcttcttcccatgaccaagatttctgtcaacttttcacctactggttttagcacccattgatgatcattgcctagatccattgtttaatgagacatatattctgtcctttcattctgcagttctgtcctgtgccagtgagtgctgattattatgcagtttaactccagaaggccatcttattttcctcatttccaagtctgtgttagagtcagggagtttctctgtgaccctcatgtgctacctgagaactgactaaatttatatgaaagtaacattcttatagttgtattgattaaaatttttatttgaacctctagttgagctttgctgttggctttgaaaacataatggaaaagtggaaagcattcttgtcagtcatgttgaaaagtaactggcagaaaaagtggacttaaaaaaaaaaagtagtggaacaaa

SEQ ID NO: 76298 - DNA, 1050 bp, Homo sapiens
gacagatgaatccctggtataaatacctgtgctgttattatagaaagagacagattggtcaccttgttaatgacttccagtattccagagttcctcctctgaaatactctgcagatccaaattatcataatataggggcctcttctgccatttagaatgaccttccacataactctcaatgtccaaattgggcccttccttcaaggcccagatcaaatgactcctcccctgagtctcccattgagaagtcataccttcccatctcctagcttcccatccatcctcttttcatggattacttgctacatttcattttagctcatttgcgtactcattttactttttttttaaacagaaaaatatcagtcttatctttgttttaaccacgatttgtatttaataagtattttcataacatttttaattttaataattaattacttgagtaattttgttttctgagatattcagcttttatttcaactatgcttccagtatctacaggggagtctgtcagtcacatgttgagccaggttttctatttcagaagaggaaggaaaagaatgtgtaggggaattagtatggaactggagtgagaagaactagattcaaaacccgtccccaccacttcagagcaactgctttagtgcaattggtatgtcagcaggggccttccctcaaaaatacacagctctgtagcaaaagtcatctgtaagacatatttaagacttagttcatcagaaagagggtagggaagaaaggactgtgtagatttatgagcagtggtggatggcacagggatggggtcttgggccctcaaagccctccgaggtagtactggctactgggaaaaggatgtcggggagcaggtcccacttttagctgcacttgaaaagatgagtgtacaaagcttatggagtactcaggacggagagaacatggtgagtgttagggaaggaagccttaaatataaactttactctttaacctccttgcaatctcactctgaacctccttagtcccaggtatgggtttctctcacttcttact

SEQ ID NO: 76299 - DNA, 1042 bp, Homo sapiens
aaataggcaatactagttgccctagagaagaaatttatctagagaaaaaaatgtacaaggtagacacagctggtgagttacccttatactatttccagtactaccaatttcatttcttccagaaggatttagaatgccacatagtagttttcctggtgccatgcttgaaatggtgaatctatttgaaagaagggattttgtagtcacattgatgttgctgcttgctgcaagccaggcaagtcacttaatatctttatccttaaaagaggaataatgtcacctacctcatggtgttacgatgaggatgaaaggaggtctgtaactaaggcactgaacatggtgtttgatactcactgggtacccagtaaatgttagttttctttgtctagactatgtagtgctcttcagttttcaccctgatcaaattgcatttgttaaaaattccaagtaagacatggcactgggtactttaaataaaggggtgctaagggaaggtcagcatgcggtagagggctgaaagagccagttacatttgtttgtttgtttgttttgttttgtaataaacaacagtggcttctcatctcctttccctggtcctgagcctgctgagtcactgttccagcccttgggccacatgatctcaggctgtgtctatggaatacagcaaaacccacaagaaaccagcactaatagatggcaggtcattttgagggatttttctttgcgttcctgtgcttgctctcctggtgagataggaaacctttaataagacttttcctaaatgatgttgcatgtgaaatgcagatttttttttttctgttctcctaacaaatgaccatttcatgaggtttcttttcattttttcttctttcctgcttctcagtacattccacaaagagcttattcctctgctggttactgattgatggttctactctgtatgccctttaattttgcaataaaccaacaaggagttgagaccacaaacttaaagagaattgacttatttgactggattcactggagccaacaggcagattta

SEQ ID NO: 76300 - DNA, 1016 bp, Homo sapiens
tttggccaggacatccttttttttttttttttcttttgagatggagttttgctcttgttgcctaggctggagtgcaatggcgtgaccttagctcactgtaacctccacctcctgggttcaagcgattctcctgcctcagcctccccagtagctgggattacaggcacgcaccacaacgcctgactaattttttgtagttttagtagagacagggtttcaccatgttggccaggctggtcttgaactcctgatctcaggtggtccacctgcctcggcctcccaaaatgctgggattacaggcatgagccaccatgcccagcctcaggacatcctttttaacgggcttgtaccacatgattgggagtttgaatgttagtaaccatgatagaagatctccactccaagggcatcaccgtgggaggaagcctgcccctacttaccatgtaaatatttagccatttcaatatatttgttctggacttgttcttcttatgtgtgtctcctgtgttgagtctgtttaattgtaggttattattgtgtgtctatattgatgtcatttctttaagtacagacacagacagcattgcttcagctgcccccacccctccttttaaaaataacaccttacacaatatcccttccttgaggacatcaaataaataacttttgttcaagagcatatctgatgaggtggctaacttggaaatttgttcctaggcagaccttgtgacctctgtttcaatacatagtgagtggcctttgctcccattttatgctacagattcactctggagatagaattggttgcacctctccaggcagtgagtttggagagcccttggtggttaggatgccatttgtgctggtggcacagaaatacaagcagtaagcccagagttgcttactctccactggaggtttctcagaggctgggggggacccgagactcctctgcttcaactccgctctactatatgccactggaagtgtagctgaggctgaagggtatcaatgtt

SEQ ID NO: 76301 - DNA, 1036 bp, Homo sapiens
tggcctttctggacctaccctgttctcactctcttccttctgcctcttgccctcattgctttccttattctctttcttcctcttgtctccttctcacctccagctcctaccacagcagacaggttggggcagacaccgtcatggttggggagcaggaggacagcatggggaaaaccactccaggcctttctctcaaaccttagtgatgaaaggactcaatggacctgaacaatttctcacaggaaagttccggtctctgtctccttaaaagcaaggcattcagtaacccttaacagagccaggattaaaacttgaatttctgacttatcccaggcctctgtttggatagaaaggctaggtcactgtcatatatggcaattaggatcacttcagatacaaaagtaacatttttaaagctgtgccttaagcagagagaccatttttagtacaaaaaggaaaaaaagattaactgtgccttcagagctgatgaaaggcagagcctcgtcactttgaaagcattggatttagtgccaggcgggttggtgagtagactcagcacccacattctcttcttgcgtctctctctggccacccagattatccaggggctgctgtttacttgagagctagaagtatcaggacggactatcactgcacctcgccatcctggcccagttaaagtgattttgaaacttcctgatgtgtgttagattgtggcaggtttctgccagggagtgggcgggaggaggaagcaggtgtttttatgggctagaaatgcccctgagatgcctgaggttgcttcgtgaatcctctagcccagcctaccccttcaactctgttgcacagagacatgagttccatgaaaaatttagtttcaaaacttcccgtgggcgccggaaatgataaccacatgttatcaagagccactgaaaaccaccaaaaatttgtcaaaattcatataagattgcctcacatacttgactttcatagaagcggaagccattgacctacttgatttatggtatttattagcaga

SEQ ID NO: 76302 - DNA, 1080 bp, Homo sapiens
tgtgtcttcaggcctggccatttcccactcaggtctccagtgctatccaattttctcttcacctgtacattctagtactcatggaaggctccagtatacaaaatggctactcatggggccccctccccttccaccccaccaaagatatttctaaccttcaatgtagagtaagttagaattgacatatacattgtcccttaaaggccaggaacattaagcttgagcagagggtaggtgtagcctgggtatagtctagtcatagcctagctaaagaaagatgagtcagctgaaggcagagggtctgcattgggcacatagactggcagagagttgggctcagttggctcaatcctctgactaatgaccagttaattctgcttattctctcttaactcaaggtatttgctgccttaagctactttttaaatacttagtggaaataagtcatctattttcattagtgtgtgtgttgtgtgtgtgttggttggattttcctggccaggagcctctgccttctgaccaaaatgacattgattcccagccttctgccttagcagttcatcccatctttaactggttcccctctatctcttttctctagcttatatgccttgctggctgtgaaaggaggacctactgggtggtctatgaatctataccccgtatttcttttttaaagatcttaatttttctccctatttttccttgtgggaaggcattaaaaatgggactcaaggtctatgtgacactatatgaggtgccatttcctatacaggtgcacctctgtaagcagcatacagttaagagggcaatgcaaagaagctttgggagtaagcattctctcatatataaagttgagttgagacagaagttactttatacaaatatagggtttcttgttccttctaataggtggatggtattcttcttcctcgagagaagctgattaagttggattctgtctattcctggcttcagacctaatcatgaccattaaaaatatctatcttttcctttgtccaagaatcccactctggtcttgcattgtaattggtggtgttgggggtgtgttgcgtgttt

SEQ ID NO: 76303 - DNA, 1008 bp, Homo sapiens
taaaaattaaagtctgataaaatgtgtacatgtgcatttaattgtggttagctgcctattatttaaccaatatgataacacccctcagtcccaacttactcagcatttagaatgaattgatagaggttttactctgaaaaaagtcagtctatttcctcagttttctgggttttgaataactgctaggccttgccagataattctggcctaaagataaagctggtgaaagtcagggctggggttttgctacctgtgtatttatcagtcttctcctaaaccatagtctgccttttgatagctctaataattaatttggtcttccctgtctttcttctcccttgccccctaccccttctccctgtctgttcacaggttatcttgacgaatcagattacaacccatctgagtggagccctggcttctcaggcagacctggtgtctccagctgatgatttgtccctgtctgaaggtaaggaatctgtcctggagaggctgaaacttgacactgacatagagccccactgcctctccacctcctgttgagagctgggagatatggctaataggccctggccagtgaacccagccggagcctgttgatttaggtttggccacctttcctggcatctgatctcttatattggggagtcttttgccctgcctctataagggagctccatttggaggccagtcactcctctgtgtgttatttcaagtccttagtatgagggctgatgaattgttaaatgactttgtttttgagactgatactcaaaggttggctttcccagtggtcccctagcaatttagccttttgcttgtgctgagttcttttggactaaaaagcgtacatcagtttcatgtgccagagatatgacattcctgatcagctttacagaagattaagaaaaaaatctccacgctggtaaatctgcaaaattttctccaccctcccctgctagcaaaggtcaggctggctatggtttcgatggcaataagctttacgta

SEQ ID NO: 76304 - DNA, 1070 bp, Homo sapiens
atacaggagacttttaggcctagcaaggctcctggatggctgcccaggtgatcttctgcagatcagctttgctttatggtcttagaaattgcaagaaccacacctctgcttcttagtggtggctttaggagggaaaactagtggctaatttatgaaaactgtacaatgctttgtgtacgctccttccaagttcagggatacatcatcataacccctatcagcgaggctgaaaacctgaatcatcgagcattcctccctcctgaaacttttgtcatcaagtctgcttagtacttctttccgcatgtatctttcctttgtcccctcttttttgtaatgtgtgttgtgatcagcagatttactaaactcccaattgaattattttaataacatccagattggccttcccagctctagcctctacagtttccattctgccactaccaaattgaacttccccgtctggccttgttctgctctgttgctctcctactcagaaatcttagaatagttttttttgtttgtttcttttttgttgtttgttttgtttttgtttttgttttttctgagaatgagctaaaatcagtaagctgattttaacatatttagggatttgggatttgttagcttgaaatcagccatggtgaaagtatttataccatggaaatcagcaaatgctgaaaatcaggtggcttgtttttttatttcctccctttgcgtagactggttttcaaaacaccactagataaagtgaatgatttcaacccttcataatctgtcatttcctttctattcaaatttagttcctgccgatatcttaggtgaagctcctatgccaagtgtgccactcttggcctgcccctccccactcccagctccaggcctgtgcagagacagctcacctagaacagtgcttccccctttcacttcttctgcttctcgtcccacatccactccttcgaggcttatttaaagactgcctctttcacagaacctgcttgcctatggtctcagtctctttttcctctgtggccgctctatctgctcaactgtataaagaaaaagtctagaaa

SEQ ID NO: 76305 - DNA, 1205 bp, Homo sapiens
cagcaggggctgactcagggaaatgaagtcccttctgctctgatgcagaggagggaatacaagtgacctggcccaaccgagagatctcttccaccccaacagatcctgtactattaatatctgccagctgcaggcccagagcatccccctgctgagatcaaaagagctcctatcttagctggaacaaggtcatctgcacagggctgtaaaaagcgagccctggctggctgcagggacgtctatgggggaggagaagtcaggagatgggaggtgctctctcacgctcctttaatctcggctgaccagctgttgccctcccagtgtttgtaaagttgagagttctttgtttttgtgttgctgggtctccccgccccaccacccttattaaatttgtggctgagttgttggcttggattaagtagactcatgttcactgcttgacatcatggtataattcccttcattgaggtttcattccactgttgagttatccagctcccaggtgggagagccaaagaagggagaagtacaccccaagggccaaggactttcccggcattgctcctgcccctgagctttgtgccttgagaaggaatgagagggcaaactgaattttctctatttacttaaaatatctcctcatatttgcagtgtgcttgtcaatttgcagcctgcctttcacaaactatcccattcacaaactattgggagaatggaacttttggaacttatgcaaattgaccagtcaccccatcccagtgtgtttctcattctcactggtttgcacacacttctgattttgtacacctttgtgtggagagaggcagagagagcaagagacagacagacaagaccagaagtgtccccagagtgacaaagagaaaacatacagggaggaaaggctcctgcaggtatgccgaagtatcagtgctaagatttattaaagatcctttttattgtgtttaatctagggcaacatcagcaacacggccattcttcctactctgtaagtcagaattaaaaccccatcagtgggtgaatgctcctgaccttcagacctacctcatgatcttatatgctagagctggaaaacactttagcaatcttgtattcttccaacctgtcatgtaacagaagaaactgagacccaaagtcatcaaaagggcctgcctaacaccacagttaataacacaatggcaaagctg

SEQ ID NO: 76306 - DNA, 1080 bp, Homo sapiens
aagtatttggggattcatattccctaccaaaccatccctgcgaaaagctggagtccatttgaaagattatatgcaagtttgtggcttgtgttctcttttaaaataagttcaacaagcaagacagctcagaatggttgggacaaatcagagactcatggttgtgaaagaagcaaacttcaaagcgcggtatgaattttcaagtcttatttccactcttgctttccagctggatctgctctggatttactgcaggatgtttgaaaatgtggctccctgctaatctcagacagttgctatgatcaatggtttctttcatttccgataaaaaacactggtgtttctacttaaattgtgtgtattttcagctttattattatagttatgatttattgtcctgcattacccaaatttgtaatccattaaccacagactttggggtgggttggtcaagttagcagaaatctctacatgctttagctccaaggcccttcacagcccaatctcagactaaatgttcattggtttgtgtagggccatgtaccaacgggtatgagtggagtagttttaaaaatccactccttgggggtatggtgcaagttggctgtaattagtactttgaaagcctaaggtgtcaccatgtgactacaaagttaatattaacaactatgatcaacattattaacattagcttttccatagtatttttaattgtcttaaaatgatgaatttcttaatctacctcaagcaactgaagcatgaaggagagaagagaattgctgaaaggccacacagtgagagctggtgtgctgggaacagaagtcagagcccctcccgtgaagttttaaatttggttactgctgcctcttaggagtgagttttggataaaaatgtttaagtgtcctggtgacctttcagtttttgtttccaaagccatagactatatcaacacacacgattttacatggttctattcacaagggcacacgccggccagtgctctacttccctggtattcaggagtccatagcacttgactgggcatatgtcttccagcagctgttcagatgccatgaaaggcct

SEQ ID NO: 76307 - DNA, 1033 bp, Homo sapiens
ctgttaaggtctcaatgtcaagaaagctggagggacaaaaacaccaaggcatctttgtcagttgcctcagctagagaggtgacgacagggccaaaagccgagagaatgggatgccaagaggtggtgtgatcccagaggccttcaagttagaaggactctctgagaagagatccttgttttccatcactgcagagaatgctataccaagggcgagaggcctctaggtcagagatcataaagaagaaaagaatggctggattttaggggtggtgcccaacgattagtttgtgttgtaatgtggcatgaagcgtcttcagaatgcatttgcgatgtttactgggatttggaaaaggatcgtaacaaggtctagcaaggcagtctagcccaaggagggtccagttgagttccgaactagtttctgatatctatcccttccaaaactgcatgtttaattaaagaacagccctcctctatcttccccagatagaggagggctgttcttcagtcgaagatatggagtggttgtgtttctctaccaaaacctttattccattttctcaaattttagcatacatcagaatcacctggggggcacattaatacacacattatggaccatatactgtatgcctggcatcgtatgtttattatctcatttagtcctcacaaccaccctctgaggatagtgcagttggccctccttatccatgagttctgcatccatagattcaaccaaccatgaatcaaaaaatagtaggggaaaaatggatgattgcatctgtactgaacacagacctttttccttgtcattattccctaaacagtacagtataacaactatctacatagcatttacactgtattaggtattataaataatctagagattatttaaagtatccaggaggatgtgtgtaggttacatgcaaatacagtgccattttatataaaggacttgagcatccatggattttggtgtctgcagcgggccctggaattattcccctgcagatactgagggacaactgtatta

SEQ ID NO: 76308 - DNA, 1810 bp, Homo sapiens
gtgtattggaaaactcgttgaaaacacatgagttagtaatgttctctttcagaagatgaacttgcatggccgaagtgagattccagtgggaaagacctggtagagaaagagtgggagaatgcgttgacctctggagggcagattatggcatgccaggcaatgggttgtgccatcagggaaggaatctagaaagacgaggagactcaggagaaaggagatgacttctgttgacaggtcattgttgctcagacttagtgcagatgagaaaggaaatccagaaacctacatgacagctcctcttggattggatgaaaatattgattttttttttttttccctatctggaatttgacagggtcagttcatgtctgggttttcagcacttaatacagggcgcttttgtcttgggaggcggctggactggtttttcctccaggcaggtgcacagagggcgtttattgtagcctgaaacacaaacaccaagcccctaggccctgatccacacactctccagtgtggctcaaggaaataaagtgaacaatgtctcttgcaacaggcgagcactgtaaatgccactcctgaatgatatatttcttaaaactttgtatccgtaacctgatcatctcttaaaacttaattatatgtcagagaaaaggaagctattggctcctccagctgtccaggttgaacgagagcacacaatggagcatatccgattcacagccttacttaggtaatcagattaatatctcctgaattgaatttacccttttgatatggagtctttcagctgccttgtttcacatctcaaattctgacaaagctgtgcggcctttgagtaatttccctgaaatctatatgtgggaagcctgtacttcaagcagtttttgggacttgcaccaattaaatctgtctctggcacacttttaatggcatgctttcccctgagtcaacaactgctccaaaatctgaagtcatttgtttaatttaaaagcaaaggttatggaacaaccatttcaagcttcaccagccaaactccagtggctttgaaaagggagatgaggcagaggaaaggctaataaactggatttcttatacacaaaataaattaattactgtgtttctgtaagctagtatcaaatcaagtttgttcacaccctccttgccaacctagctctccctttctcttcaaactcaccctctctgggctttcatattcacgattgaggctcaccctcttactgttgttcttgcaacacaaacatctggactggatttttgtcagctggagttgagagagaactgtaaatgatgcagtgatttttttttcgtccttattaaatttatttatagccagtctgaagccaggaaacatgctagagcctttgattggaggttctcgaggaatgtacggtggatggtattttctcctgttgttttctaaataatatcaaggatagaattacataactcccaacttgagtattttttgccctgaaggaccctttattaggacattttgcacatcagaattcttccattatatttgcttatccaatatgccttcttttctgtcagtgagagaaaaggaaatgtacatgacaggttatttctgaaaaattagaaagatggagagtgagtttctggttgtttgggacatgaaccagtggcatgagtattttcttttgccaaagggacacaacatggatcctatttctacctcttaacaacctctgcaatcttaaagctgccaaatctcaaagaatttcattcatttagtcattatttaagataataaaaggccctacaa

SEQ ID NO: 76309 - DNA, 1048 bp, Homo sapiens
ggcattttcttcttcagaaaagagactgtttagctttctgccacccaagtcagtcatcctcagcctgaacaatggagcttaatgttctccatcttcctaagagttagtgtctgttgttatgaaagtgaattgaaaccaaatgtactttctattggaaaagctgcccttgctctcagctcatggacaaaactgagagagaaggctcttacaaaacagagggaaaaatcctcgctgtcatgtcataacaccagttatttcactgttagacctatgaacatatctttgatgcaacactacactatttgatgatgtttctgtgtcacttaagatgggcgtttcatatttatctcttagaaatgttagcagatttttttcacgagttatcttgcttatggactggaaaagctattcttacagtaagacccttcattaactgagaaggcataaaagatagctcatgttctccaccaagaaaggaagctctgtttctctctgtctgatgggaagcatttgagacagagcagcttcatgaagtgtggatgtctgttacccacttcccagtttttaaagtaaaagccaagtcaatggcactggtacttgtagtgaaatgagccacagaggcatcattactcatcaccatcacgactcaaggatcagcaaatgagagtcctgaaggtaaagaatgtttattttcaggtagagaagaaagaaaaatcacggagaggtagagaaaagtgaagggcaaaggaagaatccagcagacattaagcaacactgtatcttccaagatcataaagccaaatagttcctgctagatttaacttttattattttgggagatgaaaatcactggggcatggagttctcattctgcatttaggaacttccataatattttaataataacaataatgataataatgccaatcactttaattaaatctccctaaataagcatcttttaatgcagtgttgtttgctgtaaaacatcccaactaatggtagaggctggatgtctgccaaagacatggtgagggaaccgccacag

SEQ ID NO: 76310 - DNA, 1691 bp, Homo sapiens
aatcccattcttaaatctgaagttcctcttgattagcggctccttttgtttgttgtttttaacggcatttctgtctttcatgggtagcttacagggatgtgttttagagccccttccagctgggaagccgcccaactcccaccagctgagtcgggggatggcttccctttagttccgctgctgtctgtggactacaaggactccacttccagccccagcaacagtggcccttgtctgctgtgcaaacttggctctcttctctgggttttcattctccagccatctgggcattttgggcacccctcttatcttagtaccttggcactcaggaccacatgtcatcctatcatagagatgcaaacaaaggaatccttcacctctagcttgcagttcccctggaaccatcatagattgagtgacaatcagggagatgggggcttgggcattggtcttgagtgatataaatggtttttctaatagaaggcatttggaatgggctgacaatagctaggattgttcactaccaggattcttagtgcctagcttcctcctttttctctggctatcttgaaatctaggaggaaggagctaaagaccccgtggcctctgattgccatagcctctctaggcctggaagcttcagcttagggactagaatactgctgtgtgccagagcagttcatctagcttcctattaagaattctatgtgcattacccacttttaaaattcctcctcctacttcctcaacttctggcttggggagggtttgatcagagtcattctctcttcagagaagcatctggaaagattgatccaagagtgctgatagcaagttcgctatcatcgccctgcctcgaggaaaataagcattcgataaaaggacacttccactgcccagttcactcctactccactgtgtcttctcctgtccctccccctacccctctgacccctgcactcattctgatccctcttcctgcccgaatgtctctcagtggtcaacaaggcatgagctagccaaagaaaatgcaaccaaatagtgttaatcacttccatttagacctcagtagtcaggtggggctgcaggtctttgaaaggcagacttaaaatgcttgcctcttttcagcgaatctgattttacatttggctgctgatcattcagcccctggcatttgttcatacattggaagcccaaagcttccacacagttgagtctacagagcagagtaatattaacaagacttatcttggttatgatgccaaaaccatggtgccacttcatttcacaccaaagtggatggatcttatttatttattttttaagagttgaggcagcacagagaagctcagagattcattcaggatcatccactgtgtccaagctttgatcctctggcccttatgacaggcaatgatggttcagagtacagacagagctcctgtagagcgtgcgaccaatttaactggaaccatgggttcttaattacgacttcccctccccacccactgccaccaccatccagttgccagaacccagttggttttctgtgaaacggcagctagtgacactttgcatgggttcaccagaaggcctttcagtctttgtctcattttaattgtgtatctcaaccaagaagatcaactctccacatgtaaagttaactccctttagttttcaaagtttctttc

SEQ ID NO: 76311 - DNA, 1847 bp, Homo sapiens
caaggagcctgggagcttttatgattattgaaaatcactgtcaattttaaacctaaacaaaacaatagataaagctttgaaaatagaatcaagtccagtcataccaagtgaaaggagtcctttctcatttttttatcttcttgtagccagctctggagatccaattctattgggaatggctcacctaggtctactgtagctcagagttataccttgtagatcacctggatgcttctgtgttccagctttaactcagaggatcaggtcagaatggaggctccctttgaaatctaaagtgcttagcttctttagggtagctccacaccctttttaattcttctgtaaaatgtctatctagcctagagaagtggagtctcactagacatggttctgagaataatagctatcatttactgagtgcctaatatgtgccagtgccttacctgcattacctgcctgagttcatactgccttctaacaaccctatgagacagatactgttatctccattttacagatgaggaaataaagacccagagaggtttagtaactttctgcaggtcacagagccattgaaaggcagaagtgggataagcattcaaatcaatctgactccaaaaccccttcagtaaccattgtactactgcatgtgatgcccttagattctccacttttcctctccctccccaagcccccagtttggcttgatattggaatcatccctttctctccttgttctttactggctggaattaatagagtactttcggtctgaaactggccttaaagaatctttgtccgtgtgtatcacactgcaatgcaatagacgcagaaatctgggcactagaagatgttaactttggatgcctcctgttttatatgcatatgattaaaccaatggggaaagaaagccctgaaactttattacaacatttttgtagtattaaatttgacatattaaaatgtgttatcattttaatatctttaaagagcctgaggagactctcaagccttagactgtaaatagctaacagctttgagatgagcttacataggagtcaaatgattgttccaagatggctgttctaattctgcagagctaccgtagtattcagcctactgcctgccaaaggcaaggggccttgcccctctcttcctcctccctgctttcctctttgttaagaagtaacaaaaatatactgcccaacacccactttcttttagaaccaacacatattccttctggctcactccctctataaaatgatttgtcagcattttgatctcattaaataaaaagttttacttggtcaaactgggaaagtttatgaagttagcccttccatcccatcatctgctgtggccacagttgttgactgtgaaatagctctgtgggtgtggtctaccaagtatcccaatagcatttcttacactgtgggctatggacccaaaggtctggaagagttgttttcatagggtcacactagaacactggctctttctggttaaaagcttccctagcctttctcctccaactcttaacacatctctcatgtttctttcccccctgcagaagtatagaaacctcctcttttcttttcctctgcactctcctcatctgtctccaagtccccattgtgccatgtttctcctacttcctgtttcctttaaccactaacttctcacgatttttaaaatcaagcctatccaattctaaaaggaaattgaaaccctgcccaccaaaaaagtaaaactagggggaaaaagccatagtaggaggtataatgttatgatcttctctcttagccctacacatctgtaaaaagtaatcttgctccgtactgcaa

SEQ ID NO: 76312 - DNA, 1047 bp, Homo sapiens
ttaattcatgcatgaagaactatgttcgacttctgtatggtatcttgaaggggtccaaaataaatctgactggcagtttgaaggcctataagagagcatattacataatttcactcaaggattttgacaattagtccagcttgatggatctcttctcacctgtattttggccaaactgaccaattatttcccattccaactgccatccaaatttccttccccatcccttccacatgtttcagttgcttttgctgcctttgcttcatattgactgtcaggatgtatggccctgtaatactaggtttttatttaaaaagcctttctctcattcataagcttcttttgaggagtgaggcctgcatttctgatggttgtgtatcattcccatgccttgtgcataagtggtactctatccatgtgttttgattggctgatttgagcttttgcagattaggaaatagttggcctagagctaagtggcacctgagagaatcttcccctccaggcctcacagatgcactctgtggaaaggccattgtctccttgctttgtgttggactattaggaacctaaaagctaggacaggcctgggtagagatagccacctttaagttaggggaatgttggggagtctactgggatttgactgtgaggtgaaaggagggctgcctacaagcagaaagcttaaggcattggctttgtgtaattaccaggaatgcttttagctagcaccttgaacggttggttaaaaagggacagttagatgtttgttagatgtgtggtgttaataaccttgaccagtagattcgtgactatgagaatttcaaaaggcgaagcaagaacacacacagagggaaaacatctcttgtttctaggggcagccttcccagcagcactcagcccagagctgtttttcccccaaggagaacacagggacaaaataaatatgccttcctgacccaaagacaggagcgcccagggagaccatgggatctgggagtgagagcagattgtagggaggaagtatccaggatgagactggtatta

SEQ ID NO: 76313 - DNA, 1063 bp, Homo sapiens
aggatgccatcaggaaagagatggtgcactttagtattccgaggctaattacagtggggctccattagtgcccctagattgagaaggtgagggaacaggctggtttctggaagcaaggagatagagggggctgtgtggaaaagactgcctagcaggatctgagaccttccatcaagaggcacagccagtccatagcccaacatcactctgctccttcaaatctcctaccggtgcaccccagtggcccaacccaggagagtcctgttgatgtgacacacacaggccaggtcccagggcagagagcaggtgaagaatgattgtgagtaaatctagaggggcacacaggaagatatccagcaaacatgtttcacacttgattttagaggtaagggtgtgtatcttaattttatctgttttagaaaactaaaattttaatagatttaaagtatttctgccatagttcttaaactatcaatctgatgatgtcagatatttttctcagtgtcattagtttgacctcccgccacatttttttggtggagaggggtgagggattgtgtataaatttcctccagagcacacagagaataaaaatgctattcttcagtttgtttttttttgttgtttttttttttttaacaaagagttgttccatttcccctttttctgtctactgctttctccttctacgcttaggccaagagtatattacgcttggaggcatctagctagtgtggtgcttcccaaacctttctcagccaaagactcctctgggaatccaactaaatttcctggttcccttttgcttttaatatcaatgaccatattacccaatgaggttatttttatttcttacaaatatttttataattaacttaagattcaacaaggagccaaaggtaaacagactgtaattatttcaagttctaaccattatgagtagatattaatcttcgagaaggtattattaaaaaaaagtatataatattcataaattaaagtcaacttataagtacaaaggaatatctgtgactataaaaggaaaaataaactggaatttaaa

SEQ ID NO: 76314 - DNA, 1034 bp, Homo sapiens
cttatctctcaaaactgtcctatcttcctttgtatttaacttggatgagtcttggttttacaataaagaaagcagaattcaaaaaggtaagatcatttactttcctagaatgatgtcatacatctgtggtaatgattatatttccttttcattatatttcactcaacacttattcatccctattggtatacatgggggctacccatgggagatgtgaagcaatctagttgacaaaagaaataaaggactgagtccctgggggtgttactgtccaatacatagattgctattttgatgcgctctgatcaattacaagcaaattcttcaagtttttaaacaaattacactccaaattcctacattttgacaaaagtgctttgaaccttaatataaaatgatgatagaattctacttgccaccaatgcatctattaaacagtgtaggtttctaggacccaaatcagattttctttctttgtatcagtttcttgaaactaatgctataatcctgatgtggcttttagacaccaacccattcaatggtggagaattcattcccagggtttgaaagacagctaaccatttctttgtttgtccccagtgcttttaaccaaataatgtagttcttaaaagatgcatttatataaggtagaatactctacatttcctttttatggttgtttaaaaatgtttttaacaaacattacagtaatttttctcatctacctcagaaaagttccatgttctaactgagatgaattcctttgtcaaactagtaagagggtgatttcatttgtagtttacttactaatttattccataatttgagtgttaatcttgctgtcagatgaatataatcaacttttggactcaatttcttcctgtggaggggagaatttctgtgtaccaaattcccacataattgcctcttttgcacacacccacatcttatttttgttggtgcctatcctagcccatcgcaacctgtaattgtccagctaaataatttttaaaagatttgatgctttcaggtac

SEQ ID NO: 76315 - DNA, 1063 bp, Homo sapiens
tgccaaaattcttaagccttttctcaaacaggggattcaccacttccttggcctcctgcttctttatgacagcaggagctggagccattttttctccttggctttctttcctttcagcatcttgggtggcgggaggagagacttatggttgccatatttttcatctagcattataccaaataactttgtttctaatttcagttttattgatgatattttcgcctttaaagaaggtgaaaagcaacaattttcatatatcaggggtgatttaacgttacagatgccactaagatgaacattgaatgtactgttctctctctaagcctagttcttcctcttataaatagggatcagtctaaatgttgagaaaattagagaattgggaaatctgcctctcctaagtagtaaaagttgaaaagtagtacagtaagatagcaatctaatagcacagtcattttctacaatgtatataattttaatcatcacaataaagaatgtttaaagaaattgaggtagtttaatcataggcagtgctgagatgtgaccatataatgatcttttagagagaaggctgctactttttctttgtctacacaagggttaaaaaaagaagaaatgtttttaggaggaatgtaacatagtgcctggcacatggttagtattcaatagtattttactaatagtgtttacttagaaatatttatcagaaataacttcaaggtgtctttggaccgatacaatgagttaccaaggaaagtaaatacatctttccttcttcctttttttaccattaaaggaaaccaaaatacttcaccctcaaatatacttctttgacatatttgagatggctattcagagaacctgcagacaggaatagccctgtaaaactaccttttgtgggggagatttacatctgtagagaaaatctacattgctgaaataaacagccagcctttctgtgctgtgacttgtctggatctaggacagatgggctcctgggagagagagactgagagtttgacacctctggggatctaatagaaacttactcttttggagggct

SEQ ID NO: 76316 - DNA, 1060 bp, Homo sapiens
attggtcccccacactattgcctacactgcagctaattttttttctcaatctttgtgagtctcttgagtgaaacaatatcttactgtcatttatgtttgctttactttgattactagtgagatgaagcatctttttgtatgtttattgcccacttgtatagtatttctcctattatgaaacagaataggtcctgtccaaaaactctaggaaggttatggtctggttggtccatggaatgtaggatctggactgtaaattattcttcagtcagatcgtgtgatataaaagcctatatcacacaatgtgtgatggtaaagaaattattaaaaattatttgaaaaatattttaagaatagcttgttttatgattatatcatggagtttgagtatccttaacaaaggaagaaattcaccatgcttattggagacatgtaatcctagagaaggtgggactgggccatgcccctctgctgcagtaccagcacagaatgacagaattgttggaaacctctcctaattcataccaccccacagaggagcagctgccacagtggagcacaccccacctgcttggaggtgccataggccagcctctctgagttttatgatgcatctgaaatggagttttactgcatcctcccacgaccttacgaaaaaccacgggggaggaaagaaaaacagaacccaccaagaggagcaagcagacctgtccgagggtggggaattggctactccataaggcagcaggagagtaaactacaaaagacataaagcacaccttgctttaatcccttccatccgcccagagcccccagaaagctcataaagtctccctttctgggtgattggattcctttagctcaggggcaagtagggcatttttttggttttgttttggaagagggctgggtaaaggagaatggtaatcactggggttggaggagggagaatgaaaacgggggcaatcactggggttgggggagtcccttctcttcttgcttcgaggtagtgagtgggaaacgcaaacagctgctgcctgaaatcacagcgcgtgggtac

SEQ ID NO: 76317 - DNA, 1149 bp, Homo sapiens
gccagaactgtctgtcctttttgtttgaaatagagactttagagactagtcttttcgtttactgaaagaaggagaaagaaaggaaaaaaaatttgtctactttgcctttggtctgggtactttccacttgtttgcttttaacctttctcagtgtttgcagggtgcagggaaacggccttgtcagcctgggctgggctccttaagtcttgaacaacaaacacttaaaataatcaaaatgttatatttggcagttaaaagaagaatctcctaaaactatgtctagtcttatttgtttctgaactcctggtagaggcggggagaccatgttctccattctgtggcctagccactcttccgggccttctcttgttcctcttcactccctcttccccagatgtactcctagactgagctgcttcccagctcagagcccaccacgtgcctctgcagcttctgtgcctttgcagatgccgctccctctcctggaatgccttctccccacccttccctggctgaagtcctcctggccataaaaggctaccctaagtgcactgagcttccttgctaggcacatcttatcatcgttatttctgtaattcttcctttcattggctgacatccatgacatcagggcccaaccttaggtggctagcacaatgcctgtggcagtagtggcagcagtagtcttcgtgttaccagcagcagcagtaatgactcttactgggcatgtgccatgtactaggtctttttcatactcatctctaatcctcccaacaactctacatcgtatatgatattgtctcctttttagagatgaggaaattgggacttaggtggggtggaaagatgtgatacctttcctcactcatcatgagggtcacagctgacacccctttaacaaaagacaggttgatgataaaagcataacaaatgtatttcatcaaagttttacatgacaagggagtcttcagaaatgtagacccaaaggcccagggaagatggtctgtttctatgctttggtctgaggaagaatgggcagctgtgtagaaatgtgattggacaaaaaagggtctgatctaatgatgacagactgagggggtagacagagcaaggcctgtctgttcagattcttcttggcctccctatagc

SEQ ID NO: 76318 - DNA, 1079 bp, Homo sapiens
atcctctcattatgttttagctatggggggtaaggatggagaaaggggagagtctcctggtgcttgtttcatgtatcttattcccttgacctggtccttgttcccttgaagtcttttgtttgtctgtttgtttttgagacagggtctcactctgtcacccaggctggagtatggcggcacgatctcagctcactgcaacctccatgtcccaggttcgagagattcttctgcctcagcctcccgagtagctgggattacaggcacctgccaccacattcagctaatttttgtatttttagtagagatagggttttaccatgttagccaggctggtctcaaactcctgacctcaagcgatcctcccacctcagcctcccaaagtgctaggattacaggcatgaaccactgcacctggccccttgaagtctttatagtcgccccaaagaaattaggctaaacttaagaagtcactgcttctgtagatctaaggtggctgaatatcggccacagcatacagttcaaactaatgcagtgtatctattaaaggttataagaagatacctacaaacttccctcatgggattgttgtgagaattaaatacatataatacatataaaggacctctagtgcctaacacattgtgagctctcaaaaaaatataaatgttagctcttgtcattatttttgttaatccttgactggggtactaaaattcctaaaagagagtaagccaagaaaaatatgttaattattacagcaactaatatttattactatgcatcaagccatttttgtaaggatttttcatatattaattcattattaactaattttcatagcaatctgatgatgtaagtgttagccccattttacagataagaaggtgaggacagagaggcgaagttggggagcttgggatcaagtttctggttctagaacctacgttctttcataaccatcactgctctgaaaaagagtaagcaccagacctgaaagaaacataacagaggccgggcgcagtggctcacacctgtaatcccaacactttgggaggccaaggtgggcggatcacgagatc

SEQ ID NO: 76319 - DNA, 1035 bp, Homo sapiens
agacacccgtgaaacagagggagacactagcagtcagcgggcactttgtggggagggccaatttagaggacagattgaccagggcgagcagcaggatatctagaaagacgctttgcttctaaggagcgggagcctaatcccgttacaggctggagggagactcctggggccggcaagcctccttcccgctgtgcctggagggatatcattggaggaccgccgggcgcggtggagggctccactcgccagcagccccctcccccagccccttccactctcttttcttttgcagtgacacatactgcagtgcctctgaggtcatttgtttcccacagcctcacagggcgctgtggcaacaagggggacaatgatctctcacaggaatgatgggaggccttgttttgccttaaataagccccttcaagggagcagtaaggtctgttgtgtgtgtggtttgttttttcagaaaatcctcttgcacgtagttccagtgtgaagtactctggcaacttcaattgaagacataaagaatcttatgtgtgtgtgtgagggtttaattttatttttattgctgctttgagaccaggattgtgttttcccttctgccagttacccttttcccgctcaagctccctggacctccgcattctttcaatagttttagggcaggaattggcaggtgttaggggcagagagacgcccatgtctgggtgctggcttctgactgcccttagctttggtgagggagtgaaggttagcgtggcaggaatgtagtgctcctacacatttctcatcctatcctgggtctgaggaaagcacagggcactgggtggctagggctgggattcacaacaaagtgacagtggaggctgagggagacgtactttatgggccacctcggaatagatcatcagctttaacgccagagcttcagaggcatgtgcagaaagaaaaaggcctgtaagtagaataaagaggaggcaggttctgtgtctgattcggctgtccggtgaggaaagatgtgaagtgatctct

SEQ ID NO: 76320 - DNA, 1665 bp, Homo sapiens
gtttgtcttactgctctgtcctatgttttaaagtcttcaagctgctgaaggcagtcccacctcagagcttacatgcgtaaacattattatctgtaaaggcttcctatttgatgaatcatggtgtatcatacaatctagatatttcatctggagaaactgagatgaggcagattaaagtcttttccaaaaccacatgaggaattaatttcaaagcttgagattaaaacctacatcttgtagtttcagattattaacttaccagtgtgatctacaagttctttctccatgttctaaaaaacaaattttttaaggcaatcaagacattttcattctctcatgtgagcagtatgtatcagaaaaattcatctgtataaactgtatggcagtctaaattatatttttaacctgtcttttctttttttactttttataaatcatatcttccactgtttacaaattttgttatgtctttcacatatcagactcaaaaacagttggctttatgattgggccactagaagaaatataatattttttcacttaccttttcatttcctgacttttttttagtgataatctgaatatatttgtgaaatatttaggcaggaaggtgagttttccagatgtttctgttgattattgcaaacacagagcaattcaaagactagtgtcgctttttgataaattaaaaatactttttttgataactagttattcttgactttaataaacattcctaagattaattcttcccttaacaactttagtgtaattttaatttttcacaaatcctgaagtgggagtactggaattttggagaaataaattaacatgttgccttatttctctggaccatctgttaatgcttattctcaactaaagtactgttcatcagcttcaagtaacaaacataccatagacaaatagcctatgtctgtgacggtgataagacattggccaaatcatcctctctctgaccatgacaaaagtgtaccagtcgtagctaaagcaagactgaatctatttggtattcattgtaaaggaaacaacaacaacaaaaataactaataaaggtctgagacaagatgatggatggcaaaagaaccccctatggtcataaataagctaactttggaaatgtttgacttaaggaagtacagactatgcttagtctgcctcgtgtccctggactaaagcagccttgaaggctcatctgaacatttccccaggggtttcttgcctattgacaaatcccaccacatcttccagatgcacagaagaaagttccgttaaatccaaaatggtaaccaaaaatgttgaatagcaagaaactggcaggggtggctttgggaactggtaaataaataacaggcttgttgtcccacaccctagtttaatgctctcaagaggttcttatgttgctcgcattagtgggcatgtaaatgaaacccctgttggccttggcagatattggcctcttccgtgaccttgtttgactgaaacaaaaagtcattggtggaacaaaaattcagagctctgaacttggttgaaagaaaagggcaattctctgaattgggtaattggatcaccctcccaagtgccctagggcttatatcaaacatataagaaggggattaataacttcagtgtataaatgagcttcag

SEQ ID NO: 76321 - DNA, 1536 bp, Homo sapiens
aaccctagaaaactaacagcatttgagtagaattcaaatatatgtgagagaacataatacataaataccatctgggaagttctctaatcaacattctccttccctagcactcactgttggatctgtagtacatgcatatgtgagtgaagagctctttcacaaatatgaaagaagcatagtatggatgtagggtgatgatttacttagtgtggtaagtgtctccaagcaacacagtaagggacagaaaaagctgggccagcctgcctctgggagagacatgccaagcttttctatctctgtgaatctcacaagtaaatgaaaataagtgcaagtagtactatagtaattaaatcaaactatcttctttgagagtggctttgtatgtgtgtccccattatttgctaatttactatttcccactgcttactgattaccctgagtatgttgcatttattgtcctatttaatcctctaaactctatcattgccattttacagatgaaaacatagaggccagagaggtttaaatggcttgttcaaggccacatatctaggaagtgggagagtcaagattctaagtttaatgcccatcaatgatagactggataaagaaaatgtggcacatatacactatggagtactatgcagccctaaaaaagtgagtttatgtccttttcagggacatggatgaagctggaaaccatcattctcagcaaactaacgcaggaacagaaaaccaaacactgcatgttctcagtcataagtgggatttaatgatgagaacacatggacacagggaggggaacttcatacaccggggcctgttggtgggtggggggcaagggcaaggggagcattaggacaaatacctaattcatgcagggcttaaaacctagatgatgggttgatgggtgcagcaaaccaccatggcacaagtatacctatgtaagaaacctgcacattctacacgtgtatcccataacttaaagtataataaataagaatttttaaaaaagattttaagttcagtctttgtttccaaagccagagatctttccactataccacactgcctcttatgtagtcagtgataataatagcttggtcatttgcatttgtgaagcaccttttatttgaagagctgaaactctgtaagccttatctttgtaatctggagagaggaagaaaagaaccgacatttattgggcaccttatatttgtgtgtgatgtaattttaagcactttcataccagacatgttaattatcttcattttaaagatgaggaaatgaaactcaacaaagaaattaagtaaattgcccaatatcacacaactcccatatagtcaatcctggcactttccctcagcagattctaagcaccgttggagcagagagcaagtctgtttttaatcattctgattttcctagtgcctaggacagggtctcactctggcacataataggtgctcagaaaaaaaatgattgaatgaataatgagcaaatgtgctgtaagctgaactggaatgcattgagtct

SEQ ID NO: 76322 - DNA, 1080 bp, Homo sapiens
gacattgtgcctctatagcaggatgaactcacaggcatgttttctgtacgtctgtctctttttattgcatgtgacagaaaccatactcaaagtagctgaagcagaaagtaaagttatcacaaggatactggcatatctatagaaactaaggactgggatgcagctgactcaaagaagagatggaaccagtgttaaataacattaagttagttggtctcacactcttacacacacactatctcttacacacacactctaccactacaaccactaaatagctgcactgtcgctacatagccaccacccacatgtagctactgagcacatgaaaggtgccttaagtgtaaaatatgcactgaatttcaaggacagtatgagggaaaaaaacataaaatgtcttaattttcatattgattacacgttgaaatgataatgttttggatatattgtgctaactaaatatatttgacatttattttaccaatttctatttttttcatgtgcctactggaaaattttaacttacatatgtgacttgcattgtgtgtgtgtgtgtgtgtgtgtgtatatatatatatatatttttttttttttttaattgaggcagcctctctctgtcacccaggctggagtgcagtggcacagtctcagctcactgcaacctctgcctccctggttcaagcgattctcccacctcagcctcccgagtaggtgagcttgcaggcgtgcatcatcatgcccagctaatttttgtatttttactacagacggggtttcttttgctgtgttggcccggttgatctcgaactcctgacctcaagtgatctacccaccttggcctcccaaagtgctgggattacaggcatgagccaccacactcagcctggacagtgttgttcttctagttggttttcctaaacatctacagcaacataaatcttcccatgccttagttagcctgatttagttgagaaacactgaagggacaatcagagacatatatcaccaatcaagtatatatcattctatttcatccttttctctctcctttactgtccctcataatttctacatgagccg

SEQ ID NO: 76323 - DNA, 1058 bp, Homo sapiens
cttcctcacacatattgtcaagaagtctagaagaaggactctttttggggacggggagagccatatttccatagttccatttctgaattctgaaatatggctccataaaaatgggaagagaaatacaaatttacatcattgaaggctcccgacttgtgaataacaacatcgtttgccatctcccttgacaacatggtattaatggcgactctgaaaatccaagttttcattcaacttagactcactataagggttaatcattcagcctggaccagatgcagccacgctgggaggtgcacttcccacatcagggctccattcatgaaaacaagctaaaagtggctgaggctgctagaaaggaagctctgtgagggcagggactttgtatcctcaccgcctgatgtaagacctagcatagaattggggttcagtaagtatttttgaagtgagtgaatatatacattcactttcaaaaagaagtgtgtgtgttcggctcatgtagaaattatgagggacagtaaaggagagagaaaaggatgaaatagaatgatatatacttgattggtgatatatgtctctgattgtcccttcagtgtttctcaactaaatcaggctaactaaggcatgggaagatttatgttgctgtagatgtttaggaaaaccaactagaagaacaacactgtccaggctgagtgtggtggctcatgcctgtaatcccagcactttgggaggccaaggtgggtagatcacttgaggtcaggagttcgagatcaaccgggccaacacagcaaaagaaaccccgtctgtagtaaaaatacaaaaattagctgggcatgatgatgcacgcctgcaagctcacctactcgggaggctgaggtgggagaatcgcttgaaccagggaggcagaggttgcagtgagctgagactgtgccactgcactccagcctgggtgacagagagaggctgcctcaattaaaaaaaaaaaaaaatatatatatatatatacacacacacacacacacacacacaatgcaagtcacatatgtaagttaaaattt

SEQ ID NO: 76324 - DNA, 1035 bp, Homo sapiens
gcagtccctggtaggatctaaagacgtacttgtctccaagacacctgacaagctgagagtattgattcattctttcccaacttgggattgcaatggtgaaaggaatttggcattttatctaatcagcattggaaacttggctttcttttggagaattcaaaagttcagtttaggatatgttcacaagatactttcctccagaattaggtgggagataaattattaaatttatgagacttgtctttctttctttctttctttctttctttctttctttctttctttcttctttcctttcttctttcttttcatgtagcatttctttttcacattgtttctgatgacccttaacccctgctttttaaattcagtttcatttgtgttgtcacatatatatcagttgttgagtctttagtatgcggagatgctgagcttgcccttccaagatgttggaaggtcaactcactttatggtctaggtccaggaaacaagaatatttccaactcgctggggaccatcttggccttgagcagaaatgggatctgaattattacctaagagacctttgtagattgtcacagttggcagcctcaggacttgagctaatcctggaaattctttaacttcccagaaagaaggttccacaagggcaggctgaggtcctcagagagagcagatggaatagagcttacaaccagttgcctttacaactggacttggagataaataataacattatacccattttttttttatcatgaagcctttgactttcaggggatatctattctttattccttttaccctgtatgtggaaaaaaaatgctctgtatgaaagaaaagcaagcaaacttgttgactcagttcccatggtgaatgcaaggcagaccaggccaatagaaacaactcagatattacaaaaatgtgtttctttctggcagctgcacagtcagtcctttatatccagtcactgcaatcgccccatcacacaaaaccatttccaaggtcattattctggttgcgggggctgcttcc

SEQ ID NO: 76325 - DNA, 1150 bp, Homo sapiens
gcagggaatgaggtgttggggactgatggccagtgggtgtgggatttctttttaggggtttgaaatgttctaaagttaattgtggtaatggctgaacatctctgtgaatatagaaaaagctgctgaactgtacacttgaaattggaggaggtatgatagcaaattatctcaatagagctgtttttctaaaatgcaaatatagttgctattgcccttgcagtgttgattttcttatagtagaaaatatttttctataagtctatttctatcaaaaaggggaaaatgaaaagttagactgagagggttgtgaatttcaagagaaatggtaaagactatatctcttagtgggggtgaagaagttctacatgttaatatgcaagcacttggcctctttactaatgtacattattttcctggatactgaaagcatctggtattagacaagaaaaaatgtggtcatgccccactccctaaggtccacccacaactaagaagaaagagaaaacaaaggcagaaaaaggaaaggagtaatcaacatggtaaaaggagaagcagaagaggccagtagattggatgccaaggaagggggaagctttatcaactgctgacaagaggtcaaggaggatgaggccagggaagtcaggaggtcatgggagaccatccagtgaggaggctgagagaggtgaagccagagagagatgcagaggcagctgacaaagtgctcagagtgcattgtttaggagatagtatttaatctcaggcatgaaggactactgaaggcattttaagtaggggaatgatgtgatcagatcggaacaatctagattatttgttttcacattaatttgtgcatattttgaattgtgtgcataatgaactgaggttaccccaaattttattctttcttacactaaattctctttcaatctgatatccccaggcttgttgagaccttggttattgatttccatctcattcattcctgttcctgcttgaaccaggaaatagatatatatggttggtgttatctgacccaggggttctcaacttcagcactgctgtattttgggctggataattctttgttgtaggatgctgtcctatgcattataaaatggttagcagcatcaccagcctctaccctctagat

SEQ ID NO: 76326 - DNA, 2933 bp, Homo sapiens
gttacagtgagtagagagtgtgccactgcactcaagcctgggtgacagagcaagactctgtctcaaaaaaaaaaaaaaaaaaaaaaaaaaaatcagtggttctcaaacctggctgcacttaaggctcatcacaggagcatttataccaatgccaatgccccaccctgaccagttaaatcaaaatctctgccagtagagctgagcatcagtgtttattttatttgtaaagctcccccatgtgattctaatgtgcagccaaggttgggaacctctgccttaaataatagataagattcaggtagtcagaaaggggaggtgctggggtagagtgagctgcagctgaagaacaaacaggaggataggctgcatcgtcagagggcacaggctgggttttgccttgtaacaagagcagagggtttgggcactcattcatttgacaaacctttatttaatcacctcttctctgctagtcactgtgtaactagttgcgctggagattcaagaaaacaaaaacaggtaagagatggttgataccctctggttgttcacagtctacttgaggaaacagataagcatgtaaaccggacttgcagtaagagcacagtgaatgaagtaagtctagaggagatggggggtcctggcactaaggaaggttctctagcgatgaatgaggcagagcatgaggcagagaggagtggccgaggccttcacttgggaaactcttgctattacaaagtgccttctagcgagggctggaaaagctagagtaaggctggttatacttgaaagaaggaagaaaaactcgataaaaatattcacatttatacaatttctcctcaaatcctcatgaagtctggtcttacaaactacaaatgggattatataaattttcaagtgccctagaaagagtaatgaagtaaatgaatcctgactaagcctcacacccgcttgatgaaataaatattatgactctcttatttcaacaaattggaaagaggtctttttttcatataggaggtttatttaaatgaactttctaataatattttcatttctatttaggaggcaccctgaaattatgggatgcttgaggggcgagcctgaagtacctagtaaattgttgacagaaccaatatcactcaagctgctgatccacacttgaatctgtaggcttttctcaaagtcctagttttgcatcttagaagtattgcatcttggaagtatttctttgcatcttggaaatattcaatgtttcctttctggtgataggattctcagtgtccattttatattttcgaagactcaaatatcatcactgtgaagacttccctgacaccagctgtgatccgtccctcttccctctggcccacacttgcacctggcccttgtctctattcttagacttctgagccctgaattatgagccccttgaggtctataactgaatttatctgcataccctcaaatgtaagggcagtgcttgacacttacacagtagatacatttattttgaaagagagagagaaagcaagaaaaagaaatgcactccctgtagctactcgtgaacccagtctgaaggacgaaggactgcttatttagaatcattcttccgcatagaaattgagttttacaatttaaccattcctttaaaatgttagtaattgtcggtttaaaatgttagcatcaaaccttgacaattataagcagatacttaaatagaaatactgtaagaatactgaagataggaatactttttgcagaaccagcctgctgtagtctatgggaggatgggagtcaggcttcccctggaatcttatgggatagcctttgtgtaagcaagccagaaccctaaacacagacccaggctgagggagagaagggttctgcagctgctttcagggaccagatagcatgaggagggtaggaaatctttgttgctatcttctacaagtcttaacttctcctctctgtggttggacaggcttaatgaaagactgaataaccaaagaaaagttgataaattttttttcccagataagctaaagggtagatgtggggcagcatgtcaggcttatattcatattcacccaaagaaagatatcgaggatgatgttttacctgatgtaagtcatagttgtatatctccctactcctagattcctccaaagaaggattcaggcttagttgccctaactcaaaaggaacctctctcccttggtggcatggttccaggtcgctgtacttgttctcttgttttctactccagctcacctgctgtttttaggcaaggaggattatgtgagtatgtgtgtgtgtgactagatcccgccagaggagaagttcggctgtgctgcaggggtagatgaaaactctttttaagcataaatacctatagaaatagcaaagggaacataaaatccagtcaagtacattatcttgggtataaatgtctcctccctttccagagctgctcaagtgtgaaatccaagcccctgcccacactcttgcaacagaagtgctctaacaggtattaagtggattggggaaataaataaaaggggaacccagaatggtggcattaaaagaatcccttttttcaggcaatgtattggcactaggcactaggcaaatgtattaaaatctgaggaaatcctacggaaagtgtgtggtcccagtgaatgaatacaatgagctgctactcacagtgcagggactgagaaagggcaacacagacacccaagtggtcatctcccatttccatctccacatttgagataagaatacctgtatctttcctaccacccacaaacaaacaagcaaaccatgggactccctttgaaaaaagtcaatatatccaagaaatcactatttctgaatgagctcaagtagagagaactttctcttaagagggttccgctggaaattgccagctg

SEQ ID NO: 76327 - DNA, 1010 bp, Homo sapiens
cacagtggggatggacctgtgctcacctctctcctccagtaagaacctaagggcccaggaggtatagtggtgcctcccatagatacttcccttccctcatggatgatacagaatgacatataaatgatatctatttcttcatttttttccttgcaaagtcacttttccacatactaatccatttcacggtttatctttaaatcctttctcagttgtctattcttctctgaaagtattatcccagcatcctaatgaagattccatcaatgtctagtaaaatgacaaaactctctagcagtactatgttttgtttttggttttggtttgtttgttttgtttttactggtgcctctttataataaaaagatttggtggctccagcacagcttctaacccttcaacagctgtgcctataccaagctgttctctcttatttgtaactatttatgcagtgttctctccagatatactgttccatactgacctgcattggaatgttaggctcttctttgtgactgatctctatttcctacttgtgactccgttctgacactacctttgcctttttataccatcctccctacttttctcatgtagatttgctaaaagatccccatgactccaagatccctgtaactggctctgctgagtctgtcagcatttgatccctttgacttgaggaggccagtccttctcaggaaccacctgtaatctcttttttttccttagagacagggtcttgctgtgtcgcccaggctggaatacagtggcatgatcataactcactgcagccttgaactcctgagctcaagcaattcttccaccttagcctcccaagtagcttggactacaggcacataccaccacacctggctatttttaaaattttatgtagagatggggtcttgctgtgttgcccaggctgggcttgaattcctggtttcatgtaatcctcctgcctcagtcatccaaagggctgagattacaggcatgagccacagcacctggcc

SEQ ID NO: 76328 - DNA, 1527 bp, Homo sapiens
cattcaccctgtgttccactctcccagcaaaggagtcctggttttggtttctttcgatgtttacttggcctcttgcttaagcatttgcctttcctcctcaataacagtgaaaggactgaaaaataataaaataaagaaaagaaaatcccagggctggaaacattttgtttcctacaaaaagaatattttgcggccagctctgtggttgaaagtatttttcctgtggtctagggatgagttggatcccatctcttcttggccagggtctgagaacttagcctgtggcttcccatcgagtcagcacatagcatgctattttttgaacgagtgtctgatgatgttgaatgtgttcacgagtggacgaataggtctgtttgggtgtataagaaatgtgcgcatgtgcctctgactcttccagggcagaaggaacctgggagtggttttccacatgctatacatatcaacgtagcttttaagttttcatcactcacatgatgaccaaaaaaattcagatgctgacaaatgagaggagggtgatatgtgagccttatgtggatttgcaagtaatcagaaagccagggaatctaagattccctatcacatttctttccattttcaaatggaaaatgtcacatttctttccatttttcaaatgctcaaaaccaagacatggggttggttttattatggcagggtggtctgatggtaatgcagaagatgggaattctgagagctgccccagcttgtccaccttcagcctttgggacaccaactttgcctagccttgaataagtcactttttctcaaggactgcattttcctatatgaaaacatgaatttgtgtttaaaaaaaaaaaacaaaactttctgctttcaagaataaaagcttctctagtgagggatgaattttgaatattcaaaccgaattcatggataagaaatagtagtgctaggtaccttttctttactcataaagcattatgtactcatatttgtatgcttccagtatgactttgaagtgtatattagtgcctagaacttttcagcctgttctccatggcatggccttcatgattctatctcttacattcttgtaaagaatgaagaacgggtgttctctggactctcattgcacatggttttatgttcagttacctgctgactgcctccctgtcatgccagctgcaagtcacagcacagtgcctggcacagagcagatgcccaacttgtatttgttgacttaaataaaacttctccaaagatgacaagctactgtttgtaacttcagtattctcttgtgcgaagtcctctacatagctctccattcagggacatttctagagctcaaatcatcatgacttccaggaagaaaagttgtagtcactggattagggggcattgtttgaggaaataagcaaattccacaggtggaaagaattgtgaattgtgtgtgtgtgtgtgtgtgtgtgtgtgtgttttgaggtgaaagaggtttagggaaaatttgaaaagctattggaatggaaa

SEQ ID NO: 76329 - DNA, 1226 bp, Homo sapiens
tatattatattttttagggattcagatcagcttactttatgtcccctaatttctgtagaaaaacttgggaagtaggccacatgtagacaaattaataaattcatgcctgctcaaatacagttcatttttccatcctgccattttccagcactgtattacttctacagatcttgctcttctattatgagaaggcagtttagatgccgctaaactcattctctgctctgcccgcataatcctgcaaagctgctggtgttgaggcttcagtgttccatgcagagtgattttccaagtgatgaagcagattctaatcagtctaagatccaactacagactgggagttggacctctgccacctttccctccagctctcgcaacacaatggggaattcctgtgaggatcactgggtacacttcaagctcccctgatcctatggcctcattccagtcacagatcttcctgtctggagcatttccggcccttctgtcctttggcttggagagttcagctcaacctgggaagggacagaagactttggggttatcaaaagcctgttgaattatctgatgcaagactaactggtttgtttgcctccctggctctcttcctgagcttcaaagcagctgagaaaacaacttttttctaagtcttggacaaggaggaaaaccctggcatgaaggatttctgtcgcagacacttggcatagctagaggaaaggtttgtttaacttaccaatgggttttattagcctaggactccagttgaagtgagataatagggtccctgtagaaggacatttcagtcagtgggcttcctccctaatttctcgacaggacccttgcatgcagatgaaaagcatcagacacattcaacaaggaaatccccactgaatttatcaacgaccacgtaatcttgctgatcatgagggagactgagacaggattaaaaaactagcaggacaggaaattgtgtatggatgcaaagtcatattggggagctatctacttcaattgcttcttgctgaacttctctttgctgaacgtattacattgtctctgggccccacatcttatagcagatagcagggatagaaagaaagccagtcctaccacctgtccttacaggaagaaactcttctgcttatacttttcctctgccaggtcatttcactcttcctttcacctcccaaccaatgtgagatttggggttggggtgggaaggggaa

SEQ ID NO: 76330 - DNA, 1354 bp, Homo sapiens
ggagccccaggctttctgagccacatatatctacactcattcttgctcagttacatatttctttgaaccctcagacttccaaagccaactttcacacattgcacacaggtttgagtgcgatcagaatttttcactagggccctgttgttttattaagtacctaggcctccctgcagggcaccatgtattgaagaagatagaatgatacttgaaaaccacctaagtcagacaatgattagaactccccagatttatgggatggatgaacatctgaaccagcacagcctaaattacctgctggggggttgtctgctttggaagaggatagtttatagtttgaatggcagaagggtcatggggcattaattcagatcaaaaaaagggaggaatctatatgtatccacaaagatacatggcaagcatcactttttttcctgaaatatattgggctagaaagctaatttacacttcccctcactagtatataatactatagaatcttcaggttagaaaactcaaaagcaatgtgcatcttcatatagtatatactactagcatataatattacagaatcttcaggttagaaaactcatagtgaaagcaatatacatcttaatatagtatatgctagtatataatattacagaatcttcaggttagaaaactcatagtgaaagcaatatgcatcttcacataatatgtactagtgtataatactagcatatgacagaatcttcaggttagaaaactcatagtaaaagcaatatgcatcttcacatagtatatactagtatataatattatagaatcttcaggttagaaaacccatagaaaagcaatatgaattttcactccagtcctcttaccatgatgtttgcattgaagtgtttgtggtcattgattgctttgggcctctaaccaccttcttgtttgtcattttttcttttggaatttgggccccagtccaaacacattgcatcaggcatggtttcctgggtgaggaggagagcaggactatcacctcccttgttccacatactatatctccattgatataacctgagaacttgctagatttttgaaaattacatctcacagctgactaatattgaactatagttaaccaacattccattttctgaatgctgaatctcattctggctgttccataatgaatcattggtgctctgttctcaaggacaaggcatttcatttagttcaataaaattgcatcccaaacaatgtgtaggatttgttccaacattctaaccaaattgagatttgttttgatatcatgtttatctgatctaatatatgacctctttctctaaattttttgtcttctgttaccttc

SEQ ID NO: 76331 - DNA, 1097 bp, Homo sapiens
ggctctgccctgagaggactggtgaccccgagtgggagacactgatgctctctgaagccacccagcttccctctctcatgctgccttgtcatccccagagtgttgtccacacccatttgcttggatctggttcctgccttgggaagagcgaaagagaaagtggagggcacgcagttttcttatgaaaacataatccagaatttctacctatcatttgtactcacattctgctagtcaaagcttggtcacatagccacacctacttgcaaaagaagcagagaaatgtggaaacttggggagttatttactaaagggaagaaggggaatggctgctagaggaaaattgtaggctctgccataggctcctagccaatcagtggaagagctagattccaagcctatgactaaaacctgtgatcttttcatcacattttcccaccacttctcatagttgacagcaaatatttgttgaattaagataggccaagatattatatataagccttttgatcatttgaaattgtttcttccttctctcttgcctccctgattacctacacggttcagtgttcaaactgtctttgtttctgataatgttttaatgtgtaaaacaggaaactgataattaatcttcttcagtagaaatactataataaaataatctactaattattagaggttctgtagaaccatatgagatgtgataatggcttaatgatactgatttttttaaatgatcaaataaccatctcctttaaaataagtgttgtcttaggaaaatgccattgctgaaaacattttttgatattttggctggtatatcagttaactcttgctgcacgcactaatgcttcatgactccactaccaaaatctcagaggcacacagtgatatttaacttgtgtatctgtgggtctctaggggtcaactctttagcctgagccttcctggccaactctgtttcaggtatctattgcccttcttctgagatagcagactagcatggacatatttttctctgacaatggcacaaacgttaagagaacaactagaaatacttgaggctttttgaggcctcggctgggaactggcacaac

SEQ ID NO: 76332 - DNA, 1310 bp, Homo sapiens
gcagaaaggaaagggagtttacagtgagctccaggttgacccacctctcctctggtcatgtcctttgttcccttagcaagccccgaatgttgtgccacccagaacacagctgggactcaaggccaagaataaagattctgtcattgaaagcagctgggctgtgttgctggcgctgcaggaggcctagaggaaaacccaggtcccagctctccgggagccctcctagttttcaggggctcataggcacaaacacctgcggacttggtgaaacagaacctaaggaaggggaggtccaggggaatgaagggttgatctagcacagcctccccgttactcctttcctcagggatctggggaggatttgtaaaagaaaagccaggttgtttggaacaggacagaagatagtggcttagttcctcagtaagacagaagtgtgttttttatatcatttttgcaaaatcaaagtcaggtatgacaggtttaatttggatcctggggctgtcgtctattagtgtaggtttgaatgagcgggagctggggagaccagggcaccctgagacaggtccggagaaggtgctggagatgaaattagtttcccatatctccaaccacttggcatagggtggcagaagaaaacagaaaacaaagcaacagcgatcttttttagagctggaaagctatgtgcctcatctttcttgctttgcttttgcaatcaagaacagtttgatcaccttttgaaatgtatcaggacaggcattaatctcttctgtttgttcccttgtcacaaacttgcgttaagttttcccaccccatttttttagtcactgagccagctggatgatttattgacaaaaatgtccccccaaataccaccacttgagttcatcagatttcagtttgaatcagtaacctatcaaaatgttttatgctgctggactcaaagtgacccagaagattctcaatttatttccatccaggtacagaggtatctgcatggtaaataccacctccgcacctggcacagcctggcattcttgtaggagcctgggcaaagagccctggaactcaatggagcaaagagagtgaactcctctcccagaggtcatggagaagaaggcaaagcaggcctgtcacattgtccccagcctgccaggtgccactgcagcctcggaaagtttgtctaggccaaggcgctctcctttgctgcttctgcctgcctcttagtgtgggacctcccagggagatgagaaaggagaggaaggactcgtatctgttcagttctcttctcccctgtgcacattcactttaca

SEQ ID NO: 76333 - DNA, 2517 bp, Homo sapiens
atgatagagatgtactgcttcctcctgtagtgccgaggaggaatgcagtccagagctggtttggcagcttagctctacatgtctatcgaagagcccaggccattgactttttgctctgtcacacctaggatgttgccgttaccatggtccagaatggttcagcatcatgccctccatcccagtagcaggatgtgcatgagatagagaatggtggtgggagagaaagcatcccccatcccttaaggacattaaccagaagttatacacattatttctgtttatatgatgttggccagtctgtaaatatatgatcagaaaggctaaaaatatagtcattaatctgggtggccatatacccagctaaatttcgggatttctgttatcatgagaaaagaaaatgaatattcggtgacacagccctttctgaagagcccagttgcagagattaggtgcaatagtacagacgtaagggctgggcttgttgcataatagagttatactcttaaaatgcagcataaatattgtatgtattgaaaagtgccatcaggaccctctttggttccagactctaaagtagaagagaaagggtatcacttcaccaaggatcagcacccaaaaatcttgttctgcccacccaaaacagaatctccttcaggaaggaactttagtatgtgttttgcttttatgcagtatccaggaaagaaacttcaatgagagctactattgcttatagcacaaggcagggcatgaacttgggtccaaagtcatagaccaaacacttttttttttccaaaatgttttttcctacctccacttttaaaaaaaaaatgaaacaaaatatcagttgaaataacattattgagaaaaactttattccaaggcctggactatagttagactggatttacatttctcttttagaacctggaagccacttggctatctttgcagagttaacaatttgcatttgcaaaaatggccaggtaacagtaccaaaatatgttaaatcaattcaggttgttgattttctttgaaagtctcttccaaagaacttcatgttctttctggaatatgatttaagctgcatttcagtgagttcagttcagcaaatatttgttgagcatctattgttcacaaagcatggtgctcaggggtcaagagatataaggctgaaaaaaaaaaaaaaaaggtcccttccttttagtagcccagaatctagttaggagagatgtagttaaataagtttaatcaaaagccaactgtgatacctattaccaaggttcaaacagtggaatatagaaggataaagggaatagacttattccaagtaggatgactgaggtaggttcttgagagtacgtgggacttggactggatttcagcttgtgaatactgacaaaaaccgcattccattgtctcttgacagaagccaatttcttttgctatttgaggatagattcagggacactggggaatgctgattagttccatcactaatgctgattagtagtgaatgttgagtcatgctgactaatgtgttctaaatggattgactcaacaataaaggcaacgttgagagtcaagagttcagatcctgaatttcaccgatgaagtgtaaatcatttcgccacttagtgcttaatttttttgtcaattaaaatgtgctcgtgggtgagaatccagtaagtcatcttgacccatgagggctttacaaacttcaaggataacagacagcttaacagcaactaccaggacaggcttatgcaacctcaggttattcatagctcacacagagtcagaacacccatcacatgctgctcgccagccatgcgaaacttctgtttcctcacacatgccatgagaactgacaaacagtgcactgaactcacaaaacccgacaaatagaggagcttttgaaaaatcttcctatctacctactggggtgtctgtgtctttctacaacaaatgtcgccacagaactaagggcttgcattgcagacacagctctttctctcttttgacatctccccagctagactgcttgagaacctggccttccatgtccagatgtttactgaattctgaagccctcccagagagcccaggttcttttgttgctctccaaatcatttcccacagaggctgaccagtgtcctgaaggagcccttcaatagggaggataaatgaaggcagatgaagacatgaccccctgaggcttgcccacatccactggaacaaagggtgtgaggcacaaccttgtaaggagtgttttggtcagccgcgtccctatgcgaggccaagtctcccccacagggctgctttcaatggctaccatcatagtggaagtattgggcatttgttaaggactgtggtgtgctagatatagcacaaaacatctaaatcatggtcccctgcctttgtgagggcttcctggctacagatggcagctggctttctcaggggaaacttgggggtcatagagaaagctgaagaggggtgcttgcttctgtggatgac

SEQ ID NO: 76334 - DNA, 1035 bp, Homo sapiens
cttcttatctgattgggaaaaaagtagatgctggccaagaaatgcaagtatgactatgcagtttgagaattgctaagctaggtggggagggtgcatgagacaggaagaatgaaaacgtgggtggatggatacatgaatggatggttattacatggaaagacaaatgaatgaataaatggctttggcagtgtgttgatggcaccaggacagaaattacgttctgtttctttagggtttgtcttttttttttttttttttttttcaataatacagggcttacaaactcaaatgtgcatgccagacaggtaaaaagagttgcaaaaagaggccaggtgcaataataggcagttgtagggactgacagattagagagagcctaccgtatataaaggggcaccagttactgacaaagactctcattctgaccaaacttgagtcaggctcctctgagtcctctttctgactaggccccaaccttgggctctgtccttggcttgcttagtccagttttagcaagaatcctgctaagtcaattgagtgaaaattccccaccctttgtatttgatcaccctcagtacctaatcaaattcctcagcccccacccttaataccctatcacccttgcctgccttcagtaagaatcctgccatgtcagtttagcgggaatccccctagccttggtgtttcttcttagtaatttttcatccactgacatccaccctgctctttggctacacattatcacttttccttgttgtattcggagttgagcccatctctctccaaggctgcaaaaccccattgcagtgttccttcttgaataatgtcttacttaaagtctttaacaactgtcatgaaaaatttctctttcacagtctcagctctagacaattgttatcttgtgggatgctgacctcatgttgccagaatgtcggattttacaagggaagccagaaatctgggttttcagataaattttttcactatttttattttatttatttattttttgagatggagtttcactcttgttgc

SEQ ID NO: 76335 - DNA, 1679 bp, Homo sapiens
tcaattatgataaatttcaacattcagaaaagtaaagaaaataatataatgaacacccaaatgcccttatctagatttcctaattattacatttggcagatgtgcttcacttggtgagttttcctggcagatatatgtgaatggaacatgcagagatgtggtagagaagtggggagaattgcagaataaagacagactgggaagctgagagccgtaactaccgcagcctctacttattttttaaacttgtaagatccaatcaagtgtggatggttgccttttggataggaccctggagaagggacttctgtgcagaatggtttgttatggagaatacattgttagcaccttaaagaaagtaatataaatgggataacagaaatgattttattatttatgtgattttaatttatttttaaagtatcaattcttttgcaaagagaatatattcatgtattgcttatgtcattgaaaattaaaaatttctagagagactttcaatgtggaaatgtctctgccatgaagaactcaggggttgaaacttgtggatctgagagaagtctgataaaatcagtgatttaaaaaatgttggtcactaaaattgaaaggttttaaaggcagaaacactccgattcaaagaaagtatatgctaattataagtgattcgtttctggtagattatttgaaaagattctctaagacatattgccccatttctcaacatcaactattactgcatttaaatgctaactcttctctctggaaaggatgtcttaacaacatgaaagcaactaaactttgctttaaaattctattattcagactccacattaatttaagctgacactccttctcaattggggcaaatcatcaaagctttattgtattgagaaccttgaattcagcaacaaagagcgtggggtatggagggaaaacgttgagaggggaagggtggagagctcccaaggccaaaagaagggaggggcagggaggaacactgcaggaaggacagcagagagaaagatggaccttggagaggccaaggggagagcggggagttagaaaaaggctgagataagcaatgggaggcctcctcagaggggccttacactgtcaaactgcccctggagcctctgctcattaacatggtagaagcaaaactagcctacaactttgtagtcacaaatttttctccagagttatggataaaaagggagctaggagatagagaaagggaaaacattccctttcttcctacatttggatgcctctccaatgtccttcctaaggcaccctgcccagtggccagtgcctgccagtaagcccactccacagaccctgaggcctggagccccagccctggtcatggattagtgcctggccaagttgcactccaaccccaggcccgcagccgcccttcctcctcctttctgttgtgattgactctgagatatatgatgtgggatatactaggtgcaacgcatcatgttcgttattgaggcataaggtaaggaaggatcttttgaaatgtgaggacatcatccacaaactgtcactgaccatttacgatttataactagaatgtaataagatttataagatgcactttaaagcctaaaagaaaactgagttttttcaacatgtaacaacatgtaataaatattaatttcaaaaaccaa

SEQ ID NO: 76336 - DNA, 1008 bp, Homo sapiens
gttctctcagacaggacagccatatctgccagggaacattctagggggcatctttcaggctagatccagggtgatgtgggcccctgcgagggcatcttggaaggctgtgttggttctgcctggactggtccctctgggacagcctcagcctaccctgcctggcctcacccctcctccctctgacctgaagctcctttggaggactgacacttcatggagcctgcagtttgatcttttctgaagtggagacaacaaagcaaagccacttccactgtgtgctctctcaaaagaataggaaagctcttctctcctccttgggaatggatttggagggagggtggagggcgtaatgatggggaggccttggaggtattttggtggaggagggtgtgtgtggaggaaatgagccgcccaggagcatgggagaaattgacatgagaacatttcagaagcactggtttaaccggctgacattctttccaaaatggatggacaagcctttaggagtagacagagggcctcagggaggagaaacagctgaggaggaggcatctcccttccccctcctccagaggctgatgctacagagaaggcggcaaggcctcactgagcgcctacccaccactcactagatttctatctttttattaccttaccctgggagatgaatggggttatctccattttccaggtgacaaacagagattcagagaggtgacgagaggctctccaaggacccatatggaagtgtcagctggaattcaaccctcaggcagcctggctccaaagttcacaacctttcctacttgtttcagccctgccctgcctttcagggctaagaagatgttagtagatgttccataaatatttattaaattgaactgaactcagcagctgaacacacgcaggcctcttccaccctgaccaagaggaatcctttgagggtctgcagtatggaaagaaattctctgaggcgctaaataaaatcctgctctgaggtgcaaggag

SEQ ID NO: 76337 - DNA, 1053 bp, Homo sapiens
agctggaccactcactttaggtaatgccacagcagacaatcagtgcctctgatcatgaagactggagaaatgtgtctgggctgggcccatgcatgatgcttgggagggaaactctcccagtggactctgcgactgggatgtggaagctcagacagctagagatgggaaaggaaacttaaattgcaaaggagtaatcctttttttttctttctttttttttttttttttttttttttgctagttcattttcaatcattcatttcctggcttaaaaaataattaatagtaataatcgcatatggctttttaatggctctccattgccaaatactatttaagcacaaatttcttcactagacactggagcccaatctacacacttgatggtgtggctccatctgggaccccagtctcatttcttgttcttaatttctgtacagttattcctaatttgtgaactgcagacctgcaagaggccagggcgtttcagcaaggggtccataactcttagtgccacaccaaacatgggcagcagctgaaatccatagtatgtaaaactcaggcgaatttgaaaggccgttaaattcctagcagctctttgtcattacgtgttttcttgggtacgaagtttgacaattgttacaagaaggggcctgcattgtgataacagttttcaacctgggatccaaggaaccccacggagattccctgaagtatagatggagggagcacgaggatggagcaggagcagatggggacaccccatgcccgcacacacacagctaattcatccctgtaaccagagagactgttttgatcagttttgtacactgggctttctagtaagattttatttgaagaaaggactctgccacagaggtgagtggggtagtttgcaagcaatggctgcagacaaagtacatgtatttctagccagtcccttgccacagttcagtggggcacagtgagaaatctgtcagctgcccgctctgtccagatccacacagtaagaactctgggtttgttagtgtcttagatgcattaagtcccatc

SEQ ID NO: 76338 - DNA, 1076 bp, Homo sapiens
gtgcaaagacagtatccactttgcatatgtactgctgagggaatcattagaacattcactgctgctgagggtcaggtggggaattctttatataccagcttttcttgtgggccaaaatccctagagggatagtggccacttggggtccatttttatctccttcagtttctacccaaatgtgtctttgcttatgtggctggggcctgccactcaggctttcaggacacagtgtgcccccaggcagcctgggcctagaacagttgtagtaataagaggtgacaaagcaggaccttgagacagaacttccagaaattctttagctgagcctccgtcctcccagccaggtttcagacaggatgacacataaagaaatctctgaacaatccagagcagtgcacattagcgagtgaagctcaggcaggaaatgggaaggaatgcctttgtctctgctttccaccctgccacccatagctcattctcaaaagccacctccccaacactcaggctcggggtaaatgctacaaaacgtggtggaaacctctcacgacctcctctctgttgcatgaacgcctgttagaggcgaaggaaaacaatggcaaacagacccaggcctgtcacagctgtactggggccagctggaatgtggctgtgcgtgcgcgtgcatgtgtgcgtgcacgccggtgcacacgtgggaatataaacatccttggctccccagctcctgtgtgctggatcgtgctgagtgggcgcaaagttctgcatgtgtccgaggcagggaggggcagcaccagcacacctaggcgctctcatttatacattgaaaggcgggtgggggggacaaaggagaaggtttgggaatggctggctgtgtgcccgtgtatgtatgggcacatctcattgttgatatgtcttgggggaaattgagggaaattttgtgcttgggtatgtgtgcacacatggtaggcgcccacactcaagtgtgcagagggggaagctgaaagaaagtttcgagattctgtgaacattctcagttagaaaaaaatctggcaactccccataccacaggtgggtacaca

SEQ ID NO: 76339 - DNA, 1027 bp, Homo sapiens
ctaaatctggggtctgcagctgagccaggaggggggtccagtgcccttggcagcctgctgtaaccttctgaccctctgtgtccagcccccatccccatttttacctccagccaagcttccccctatgggggttaacagggtaaatactgtccaggcccttccctcaaagaagctgcaaatctagtaagagaataatatgtgcgtatatgaaactataatttaagacactgtgatcaataacctaaagggaaaggctctgaggacatccaggggtcttgggctcaaaggctggagcgccacacacacacacacacacacacatgcacacacacacacatgcacacacacacacatcaaatcacatattagctcgtgtcttcatgagctttccagtttgcaaaccgctcacacatacagcatttcctttaaacttcacatcagccagtgaaggggctttgtaagcctgacatgtaagatctaacaaccctcccagaatgatagaattggcagaggggggaggcagagactgtcaagcaatggcaagttttctgattggctggaacacagggcaggtgaccccgtgagctaaggtgaaacaaccaggctgaaggccttgcatgctgcagtgctgggtacaaccatgtcagttcaaaccagattcaatttggttggttaatgtgcccatttcccattgctgccatacaaacttagtagcttcaacagtacaaatcaattacctgtataatcctggaggtcagaagtccaaaatggatctcactgagctaaaatcagtgtcgtcagggcagtgttcccttctggaggctgcagaaaagaaagtgttgtcttgttttttccagcttctagaggccgcccacattccttgactcatggccccctttctctgtcttcagagccagcaacatcacagctctccgaccaatcattcttccattgccacttctccctctgacttggattcctcttctgcctccctcttcttcttttaggacccttgtgattacgttgg

SEQ ID NO: 76340 - DNA, 1132 bp, Homo sapiens
agagaaaggcaaaagggcctagactttgacttccttttttttctctctctcttagagacaacattttgctctgtcacccaagctgaactgaactgggctccagaaatcctcccacctcagcctcctgagcagctaggactacagatgtgccaccatacccagctaattttttaattttttgtagaggtggggtctcattatgttgcccaagctgatctcaaactcctggcttcaagagatccacccacctcagcctcccaaagcgctaggattacaagtatgagactttgccattccaatgagaattttgtccttagcaatctcatccaatggccactggagatgtgtgtagggccacaagaatgagaaagggggcaatggagtgacaggtgacctgctcaggtgcccctccccagaccaaatgtcccaggcacacagcccatgccctccaccatggagtacattttctccctggcttgctgctgagctaaaggaccagggacgtggaaacaggaggtgaactaaggcaccccgccacccactgtggcagcttgaatttcttgaggctgagacaaactaggatccagtagcctagattttgccccagtttctccactgagtatttactcagtgctcctgagccgatgccttcccctctgcctagatgaaccacagcattttggtaaatgcctcagcatgttaggagcgctggaacgtttattctcttccctcccaattatccactctaatggagcagaacacttacatggaaaatcctaaacatggaagatgatttaaaaatgattcaccctggaatacatgcttccagttgcttctacaggtttaccttgctaaaggcatttcgcttcctttgctgttacaataagcttgcctgccttgaagaaaagaagaccagggccaaagggaaatcagtcaagggagcctgttttgtctgaaataatgcatccatgaacaaatgaattgagtataactgtctttttacatcagtgtttctgtggaattaagagaacatccaaggccactcctagcttgagtagattaaatttgtccttgtgtttggagcaagggttgtgaagtctgtctggcccatcaaatgaccaatggcttttaa

SEQ ID NO: 76341 - DNA, 1006 bp, Homo sapiens
aagggagttcttaggaggtcacaagtctaggaagagggtggtcacggaaggcctttctgaggtgatggcatttaaattaaaggcaagagtgcatttctgtcactcacttcctcacccccagagcctaacacagggctggcacatggtagatactcagttgtttcatgaatgaatgaatgaatgggcaatgaacaaatatctctacatttcctgatagcccttggtgacttacaggatttgatgctgggtctattaatgtatccatttacaaaaaaaaaaaaaaaaaaaactggatgtcacgattcctcctgagggctatttgtgttatggacgtgctatgtgctgttcattcaattttagaggtgtttatgctgggtcacagctggggaaaacgatacccctgagatcccgcagggagtcttctagactcgccccctcctgacaccctcagactgcaccatggagaactctgtaaattaattcatcaaagtgaggaaggcaggccccttgacaggtgactggattcagatctgaaagcggagacaggttaatacttcctgtgcccagatgtcctaaccacagacccaagctcacgggaggcaaggggagaatagcaccacggacctaccttctttttctcataagagggtgaagggttcttggaaattcccctaaagcattcaaatgagcaaatccagggctgtttgctgtcaggtttctgggcaggattatgggcagactgaccagctgttccctcccccaggactgccttaatttccaagccctacttctcagtcccagggaaagttggcccagctataaaatgccctgaaactctcccagaactcaaaacatacccacagtacggtgtcactcttggggaacctgtccgtaatgaacagcaacaagcatcttctttcccttccctctccaacacgcacctttccaagaagagaaatgagagctagtgacattgagtataggcaaggccaccacatatagtttc

SEQ ID NO: 76342 - DNA, 1084 bp, Homo sapiens
ttctcggtgctgttgaaactcagcgcatgcgtgggcagttcaggaaagtcagaccaatgtcatatgactcctgcgcgatcctctcaggaaacagggccccaggcaatttcgttcctaagtgagacttcttccctcatcatcccttttgttttttctaagcaaaagttacttggaccttgcagataatttcatatccagagccctcccatgcctcgtgggagtacataggataggagccggtggttccgaagcgcctgcaggtgccacacatggagctaaggggtcactttgccaggaggatcttatgaaatcctcagacaaccctgagatgaagaactgttactgttcttatttttactgataagatgctaaaggttcagagagtttaagtagcttgcacgaggtcacacagccaataagtggtggagctgggacctggactagtcccagccctagtgcccacactcataccaccttatagcatgggaattccaggtctttcacaaagttggaagactgggatataatgaggagggaaggccatagctcccctacacccatggtcagccaagctctgcccatgtcgtgagatgtgtatcggagctacaactcctccaggcattttacctgagagcagggactctgtctcccttgaacttttctgcatacgctgtgcctcaagccaggcctgattcacaaaataatgtttattggcagaatgaaggaccgcctcccaagctgccctcatcctgcttttctcctccctctctcctaagctctgagtagacactgggctcgccaggctttctatttttatttattttttatgaaacagggtctcactctgttgcccaggctgtagtgcagtggtgcaaacatagctcactgcagcctcgacctcccagacccaagccatcctccctctttggcctcccgagtagctgggcccacagaaggcagggttcctgcacaggcaccaggttctactcaagctgacctatgttcccacttctgaccctagcatgttaaacatccatgtccctagatgggcagatgggggaggtcttgaacatgtgtccttcct

SEQ ID NO: 76343 - DNA, 1032 bp, Homo sapiens
ctctttttaaactccaggcaaactggaatcaggatgcagggtttttatttttgtctgtcatggatttactctgtccagtaatcctgtacagtaatctctgtccagtttgttccctgggtgggcctcagtttaccttctggagaagtcaagtcagctgcctttacctagggcattattcgatttttgaattgtggagactgaaaaaagatagttgctagggtttatcagagggtttggagtgtctactcgaggtgttccaaatcagcggagagtcagagaggggtgaagttgaagtaggatcttataagaaatgacaaatgaacaagatgtaagagagaggaggaggaagaggaataggaaggtgaaggaggaacaagggcctccaagcaacgtaccatgaaaacatcgggcaagtggctaaactgtgcgtccagtgttcactttgctaagacggagagtgagggcataagatgatttagttacagaagaaaaggcaggcaagatggagcaggcaggtgccttttgtctgggtttgacaagagagtttcctgggtagggaaggaatgtgatcaaagttatgattctaagacctgcctggaagatgaccagggagtgggcaaacttggaagcaaaaccagcctcccaaacacctgtgtaatatcgtgtcctgggccactgtataaataacctccctcctgttcatcagtaggctttgtagttctcagcctctctcctctgttgaaagtgtgagccagccctttgcatgaagaagcattagaagggatcactgcatacttctttaattgtcaagaatgcatacatgccatgcatatgaaagatatagtggactttggggactggggagtggagcaggttgggagtggggtgagggataaaagattacaccttgggcaccgtgtacactgcttgggtgatgggagcatcaaaatcgcagaaatcaccactgaagaacttatccatgtaaccaaaaaccactcgtacccccaaaaatattaacattaaaaaaaagaa

SEQ ID NO: 76344 - DNA, 1046 bp, Homo sapiens
aggaccacatgtggttgacttgggatttgaaatcaagcatcctggctccagaactccttcctcctttggttagcaagaaacactcgaggttttattgcctgaaacccatctgctgctagcgtgtctcgaggatgaatgtttaaggagaacatgaagtactaaaggaagatattctcttagatggcctgttatgggtttgttgcagatgattcaagtggaccaaagggatttaagtaggctctgggtcttggaaccaagagcagatgaaagccaaggagtctttgctaaatcaaaaaaataattaatcaacgatacaggtcctgagaactcctctgagtgtcagagcctgagggagatggaaagctccatgcttatgctttctttgtaaggttgccagagagtatataggatccccagttaaattcaagtttcagataaacaattcttaatataagtaggttccaaatattacatggcatatactaacactatttttttgttgttctttatttgaaattcaagtttaactggaagtctggtgtttctatttgctaaatctggcaacctaatttatctgggaagacagctcataacccaggcagtgtgtccataagaagtaagataatgaggcctttcgagaaggagaagttctggatttgaacccaaggaggtaacacgatctcctgagtaacagtctttggaaggggccttgtgataggaaggcttcctggcagggctggttcctaaggatggtgggaaggatctggaagggcagaaagggcggaagactccaggcacatgtgggactagcaagcagacaatgaaatatcttgaggagacttcatgctggggaggaccggaggtggaagatcagtctggggaagagtcttgaaggttctgctcaggaatctggacaatgtcctttggacaaggatgaggggctaattttggcaggattttgggaagatgaatctggtgatggcacgtaagactggcaggaagagtgcacgaatgagtaggtgtgaggaactgagcatgaggtggtg

SEQ ID NO: 76345 - DNA, 3129 bp, Homo sapiens
gtgagccagcccccgctctgagctcgcgagacagccgcttccgagaccgctccttctcggaagggggcgagcggctgctgcccacccagaagcagcccgggggcggccaggtcaactccagccgctacaagacggagctgtgccgcccctttgaggaaaacggtgcctgtaagtacggggacaagtgccagttcgcacacggcatccacgagctccgcagcctgacccgccaccccaagtacaagacggagctgtgccgcaccttccacaccatcggcttttgcccctacgggccccgctgccacttcatccacaacgctgaagagcgccgtgccctggccggggcccgggacctctccgctgaccgtccccgcctccagcatagctttagctttgctgggtttcccagtgccgctgccaccgccgctgccaccgggctgctggacagccccacgtccatcaccccaccccctattctgagcgccgatgacctcctgggctcacctaccctgcccgatggcaccaataacccttttgccttctccagccaggagctggcaagcctctttgcccctagcatggggctgcccgggggtggctccccgaccaccttcctcttccggcccatgtccgagtcccctcacatgtttgactctccccccagccctcaggattctctctcggaccaggagggctacctgagcagctccagcagcagccacagtggctcagactccccgaccttggacaactcaagacgcctgcccatcttcagcagactttccatctcagatgactaagccagggtagggagggacctcctgcctactccagcccctaccctgcacccacatcccataccctcttctccctacccatcccattccccacaggccctacattaacaaggttaagctcaacccctttcccccagcacctcagaatgtgccctccctctccccctcataaccccacctaacataaggacaagtcaatttgtcagtagcttcttctggcttgaaaccccctccctggattttatagcccacttaccatgcataacagacaagtcccatattttgtcagtagatgcctttttttttccggcttaagccttaagtgccaaatcacaagagaaaaagcagtaacagtttacagaagcaacttagtgccttgtaatctaactttgtcactgtgactacattacctcttcagcgccagagggcacccgtgggcctcccggagcctctgcccatggcggggtggagacccggaaccagcagccccctccactggcgacacaactgcaccttccctcatttcagtctcccgcacacttattcctcctcccctcttcccggtggcacctctccacctgtacccgcccccccaccccccccacccctgccccttggaagagttgttgccagaccagggttttgggggaaacctgtcttgacattcaaaacctttttcttcccgatctgaacccctgttgactaatcttgcctgggtttgtgtaggtctgcaggaaggaaggctgaaaaagcggacgaagattttgacttaagtgggactttgtgatttaattttttcttttttttaagtggggaggaaggggaagctagatggactaggagagacttgattttggtgctaaagttccccagttcatatgtgacatctttttaaaaaaaataacaacaaaaaaaaaatgagagaaaagctaaaaaaaaaaaagtaaggggtgagcagttaatggtattcattccacatacaatatctgtgtaaaacgatttcctgtagaagtagctttaatggtttttgctctagaataccgtaggtctatccttagagcactcacgccatgctttcttccctgggttttaaacttcatataactttcagaaattggagagcaaaaattttgcttgtcactgcacatcaatataaaaaagcttatttaacttatcaaaacgtatttattgccaaactatgcttttttttgttaattttgttcatatttatcgggatgacaaatccatagaatatattcttttatgttaaattatgatcttcatattaatcttaaaattttgtgacgtgtctttttcctttttttccacagttttaatatattattcttcaacgacattttttgtaactttacacttttttggttattttattttaaaaaaatgaaaaattaatttaaaaaaatgcaaaaaactgttggattatttattttagaaattcccccctttgtgttggactgcaaattgagtttctttctctttaggcctttcacaactaggactgagaatgtatgtaaaagttctgtgacagtacagaaggaaaacaactttttatgtatagcttctaaaaggggaaaaaaaaaaaaagagaaaccctttgacttccacgtgcccatctcaagacattccactcacagatttgaggttctggattccaggtctggagttttccaatgttaatgtaaacagaactggcacacacacattaagatgaatgtaattattattcctcttgctggtcactaccgtcgctttctatttctctttctttgtgtgaatttatttaaaagaaaaaaaaactttttgtaacgactatttgcagtttaaaaatcaataaaccccgttttttcaagaaacattgatggtggagctggttttacttggttttggtttgactttgccagtaaggttctccccttgtataccttgcaagtcctgggtagggggaggcggagagagagggctgtggctgtgggtggcggcatctctcatccctataagctaagcctatagctcccttccttgatgctggcagtttgctgcgcttagaggggacggggtggaggttttctgcaaaggagcctgtacttcctgctgtattacttctgaaaagactgtgcagtgtgttagttgttggctgaatagcagcgggcccagccttgccgacacttgtgtggcctctgcggttcttctggggagccaaggctcagggccttccagtccgccccgtccagcctgtgctcttcattcctttggatggtgtttggggtgccaaaatgataaaagaggacctagcacttggcacacttgcagg

SEQ ID NO: 76346 - DNA, 1969 bp, Homo sapiens
gggcgcctgaagcgccgggtagggaagtcagccgacttgaaacttttcctcttaaagaaaaaaaaaaaaaagttgtgcgcggctcacagtggggttttttttttccgccttcttttctcgtctcccctcccccttcttccttttgaaagtttcttctcctccccctgccccccctccccgcctgaccgcatggctgattcaactccagtgtcaatcaacttctttttcctcctcttcctcatttaaataagtttaaagctcctcctccccccggcccaccaaatctgaactttataaattgggctttgcgcgccccagcccggagtcagaaaggcgaggggcgccgggaactggcgtgtgggactccagacaggagaggctgcgccttccccgcaccgggaccttcgcgacacaccagatcctcgcccctggctcgcgcgaacgcacaggatgaccaccaccctcgtgtctgccaccatcttcgacttgagcgaagttttatgcaaggtaaaggggggcggagcatttgcttttcaaaaagtctttttcttttgccttaagaaagaacccccaaaagtttgggtcttggaaggcaatggggaaagtggtgcagcgagatgattcttttctcctccggcatttctcccaagtttgaaggaatttggccccgtccttcccaccctttgagtttcaacagttgctggcggggattacatgtgaatctggaggccagggttttgaggggcgaagtttgcctggcagggcagcccgggggcttcggggggagggctgggattgggacaagttttgggcgatcctgttttacgtaacgtgctgctggatcccaggtttgctggtctgatcgggttcccagtctgcgccctaggtctgtccagcggcattacccacccgtggggttgggagtgggaggtccctcggggaagtgagtctcgggacaatgttttcctccactctttggggggagctggggatatgcgaggaagaaaggccaagttgtgattcaaaaagatgttgcagaacaagtttgcagtggggcttgagtccgccctagctccgttgggcttcttcccgcgatagccgatcgtgcagcaaactttggggtgaaagaggcattcaggttgacccgcttacctgtgttgccgaggcattgcggctcatcgattgcgggcggggttggggggggaggtggcgacaaaatgctggcttgaactcgagagtcccgcgagtaaggatttaatggggggctccttaaaacatgttgcttgtcagccagtgttgaaaaagcaagttttaaactcggaatgttccaggactgcggtttaaatgtacatagcaaaagtctatggatgttgttaaatttctttccaacctccccctcccaatttgaaagggtgaagctgctgggctactttttaattgctgaagtgttttgccttctcttaacacgtcgggtcatgttgctctgttttcccagcttgctgctcctgttggtgcagctgccaacgccccagggctgcagggttggggtgcagggacgccgaggagctgaagagtagcatttaaaaagtttgaatttttcagcttccttccctccctgcacattcccaaactccacttgccagcccggctgccagcgctccccaacatttcttccttcttttctcgactctcccgctctttgatctatttctttctttggcccccctcccccctcacgactttttaaatgaacctcattgttgggaaccagctctcgactgggttcctgtaatcctctcggtggggtggttgcagttacagattcccggtccccccctgctgatcctaagggaccaacattagaatttgcacaatgacacccacatgggctgggaactaactcctaggtccctgacctgcaccatttccaaatcttgggtacaatttgggcaggtgaccagggtcctat

SEQ ID NO: 76347 - DNA, 1034 bp, Homo sapiens
ttctttaagaggaaaagtttcaagtcggctgacttccctacccggcgcttcaggcgccccctctccggggccgcgcgggcgcagagcgggaggggcgcgccccctcctttgtcagcctcagagcgcggctgtgacgtcactcattccactccctccggggttcttgttgtcatgttgttgttttttgttgggcaggaaggcgggctcgactttctctttttgccagcgggagctgaagcccgtccttagcgcccgggccgcggtttccatcttgagctggcggtctccttgaaacttccccaagtgtctgcacaacttaccttttcccgacttctcttcgacactcggctcccttcggcaaaccgggcaggccgaggacattagaaatttgggacgcacagaatgttcaagcctaggattttatgttgctgttttttttccagcggggcgtagggtggggcgcgctgctggggggactagggaaactttttccccaggaggacatggtctggcgggggcgagcgcggcacaatttagtgcgccgcacgcgtcgacactcgcgctcgctttgcagccggcgctctccgggtgtgggcgggtggggggcgccgcaaaaaaagaccacaacccgggacgattgtttgttttaccaggcctaggcgtgccgtttcttttcacgcatccaatctttaaactttttagtcaagaaaaccctaatccttcctgaatgccccttcctcccagaaaaagcccaccgagcaactcactactttccacgcgcgctccgaattctgggcggcgccacaaccctccctcctcctccatcctccccacacacacctcaagactctagaacaatgaaaaaaggttactttggtaagaatgaaggtaaagaggtggagggaggcggcacttttaacttattgttgcttctctctcgcccccaccggagtggaacatatggcttgtcacgctgcgccgttttggcgggaggtggagagggggacatgggagccacgaaaccgaagggcccg

SEQ ID NO: 76348 - DNA, 1034 bp, Homo sapiens
ccacctcggcctcccaaagtgctgggattacaggcgtgagccactgcacctggccaaattctcatttctctagggtaaataactaggagtgagatttctgggtgatatggtaactgcatgttgaaattaatacaaaactgccaaatcattttccagagtggctatactattttgcatttccaacaacaacatatgagagtttccactagctccacatcctcaccagcacttaacagtattactgtttttttgttttagtcattctaataggtatgtggtagtctcacactgtggttttagtttgcattcctctaatggctaatgatgttgaacatcttttcatatgcttattttccatctgcatatactttttggtgaagtgtctattcaaaccttttgcctattttttagttgggtcatttagttggtcattttcttactgttgagttttgagagttctttacatattctggatatataaagttcctttgttgcttatgtgacgtgcaaatatcttctcatgtctgtaccttatcttttaactctccaagcaaaggatctttcacacagcaaaagtttttcattttaatgaagtctaatttatcagttttaccttttgtgggtcatgcttttggtgtcacagctcagaaatctttgcctaaccccaggtcattaagattttttgttaccttctgaaagtgttatatttttcatggtctgttgttaggtgcataaatgtatataactgttctatcttcttgctatattgagcattttattaatatataatgtccttgtctcttgtaaccttttttttttttttttttttttgagacggagtcttgctctggcaccaggctggagtgcagtggcgcggtctctgctcactgcaacccccacctcctgggttaaagcgattctccggcctcagcctcctcagtagctgggattacaggcatgcgccaccacacccagctaattgttctatttttagtagagacggggtttcaccatgttggccaggatggtctcga

SEQ ID NO: 76349 - DNA, 1087 bp, Homo sapiens
ttctgtttctataagtggctgaaataaatttagcgaaacaaccccacccatctgagggcctaagatttcagagcaatgggattctctatcctgaaaacccctgtttttcagagctgaaagctttttgtttaaattccttttgggaatggaatgctcttgatctgaaataattattatactgcggtcatctattcctcatagataaatgctttgacacaggatagcttgcagaaaagctgatctacaaatgctctgcagcttaagattgtcaactctatggggccaatgcctagttggatctgttggggtatttattgtaagattattcttctaatgtcgtgcatattcagccaagtccctctgttgtctgtcatacagaaccctgattgtggctggctaagttagcgaagtagagaagtactaaatcttcattttttttccacgaatacttattgagggcctactctctgctaggcactaagccaggcactgggagttgagctgagagcagagagagcctgctttgatggagcatacatcctagtgggaagggaatgttaaaaagttaaatgactacaaaaaaactggcaacgaatgttgtattttaaaatgaaagactgaatgctttccccctaaaatcaggaacaaggtcagggcatctactcttaccatgcctattcaacactgtattgcaaatcctggataaagcaataaggcaagaaaatgaaatacaatgcatacgttaggaaaggaagaaattaaattattcctatgtatagacaatatgtgcttgtctgcattaaaaacaaaaacacacctggtacaggggctcatgtctgtaatctcatcactttgggatgcccaagcaggaggattgcttgaggacaaaagttagagaccagcctgggaaacatagtgagatcctatctctacaaaaaattaaactagctggaatggtggcatgtacctatagttccagctacttaggaggctgagatgggaggactgcttgagctcaggaatttgaggctgcagtgaactatgattgcaccactgcactccagcctgggtaacaaggtgagactct

SEQ ID NO: 76350 - DNA, 1030 bp, Homo sapiens
cttcccacgcaccagcaccacgttgtataaatatttacacccccggggctggcaggaatctttctccagctgcttccctggtctctgggagagcttgtttcctcacccagcagctgcagcagatctggttgcctttggtcagacaagagcaggccctggtttgggggcccacagtaccccggggtggagggtgcagttggtgggagaaactcagcactaaagaagtcacagggctgtggcaaagacccgtcctctctcactcccccgccggctgtccacatggcaaccctccaagagctgtctgatctctgctctggctggggaggttcctgtttctcaaaagaacagctctcagggtggagttggccataccagggccttgctagggagtagtggaggataattccaaagcaaactcactgatgctaggacaaaatagtaccttggtttacctgtgaacactttacagcttactagtaagtgtgaatcccttgatttgccctgaagatgaccccacagtttagagcaagacccccctggattatctgcaaaccaggcctctccccagcatctgccccaggccaccctccctcccaccagtccctgccagtcttcccgcctcaggggtagagagaggagaggacagacgctccttctcccaccttccttggtgacccagccaaggaagaaaactggcacttgggttcccatgggctgggcactgtgcacggtacttccccatgttctcatgtagttattcaagtctcgggcacagcagatttcttagcttcctcatgcatgtctcctctttctgccagcaaacagcagcagccaggcagcagcaagcccccagatacagagcccaggctttctctagtcctgagttcagccaggaacctctgagagccagccaaggactggacatcaatactggacttcaatctcagccacttgcagtaggtgcgggtcacctgctgccacctcctgctcctgtgcctcagtttccccttacatctgtgggaggtcatta

SEQ ID NO: 76351 - DNA, 1044 bp, Homo sapiens
cttaaagatcagctccaccaggaagccttcctggatttcccctcttagtttccaacagaatccgtctcttccgttctctgcccaccttgagtagcagtagcttcagctgtagactctcctgtttttcccttacagtctttgttgctgcatcctctttcactgaattgttgatgtgagaccctagactctcttgttttttcgttacagtctttgttgctgcatcctctctcactgaattgttgaattgtgagaccctgtgagggtcggcaccctgtgatactggccaggaaagggttgttgcaaggggatcatgggattgttgaatgggttttgatctggattttgatgttggaaatcaagttcccaaatgttttcaaccttgggtaaaggaacatgtaatggtgttttttaaggctgtcatggaatccttttgtgtgtttaattgctttgttattttagtagaaatgtcagggtgtcagaggaacaaaagccatgggtctgagcccaagcaagaagacaaaccactgagcccgtgctgggtgcttcctctgcgtggcctcagggtcagggcctgtcagatggaatggcaggctgcgggtccagccccaaggtccaaccaaggaagctcctggggccttggccgagcttgaggctgtgatttcagactcctcgctggtctaggtcggtatttcagaggaggcaaaagagaaagtgccttcacagccttggagaagactgggagctaaaggagacatccttgctttttccttttaaaataataagccaaatgttctcccatgaaggactccagaaaaccccgttcatgcctcacccacagatgatttgctgaatgctcattaaggggaaaacaaagaggtggttttgtttatttatttaaaaggaaaaataaatgagctgtgacaaaacaatttgaaaccaggcccctctgagacctgggctttcacttccttgatgggaagtaaaacagagaatcaaatccccctccaaataaaagtgaagttaataatcagacagctcgagccc

SEQ ID NO: 76352 - DNA, 2084 bp, Homo sapiens
cactctggcagaggtagggcatggtgcagggcgactaccttgtgggtcagagcccccaaatgagctctcctggatcttgaagctcctaaaagaagcagcttccaagtagacctatcatgagcaaacctgggagaaggtagatacccaggctggagctgcttgcatggggcaaggcccgcatttctgcaaagctgcttaacatagcctggccatatttgggaagcagtgatgcccaaacatggatggtgttcttaatctgctggagggctcattaaaattagactgtctgtccgaggcgtccagagagctcagttgagtgcgtgtggggtctccccaggaacctatacgctccaccagagtatctgctgatactgctccagcacgcaattattgcagactagtgtgattcagaagatgattataggtgtaattggcacatggaattagattggaaagtggcttacaaagtaggtactgaagtggaaaacctgagagaattttaaaaatacatgttgtgtatgcggtatgtacatgtgtggatatttacgtccgtacatcctgtagttacaggagggaggcaaaatgcaaacggcacatgctgccttcacgccgccaggctttgcggctgtgtcgggccgcgccgctttacggctgctggactttgcggccttcctgaccactctctcctcgcagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatgacagctctttgcctgctccttgcttgatgttttctggaagtgtgtgtggggtcaaggatggtgtggggcacctgtatctactcctaatgtttttgaccctgctgtgttcaatcttcttacacttcagtttcttcattttaaaaaggaaaaggtaatttcttcacagtctcctatgagttggacagaaagtcatggatgtgtaaaggacttcttgatgataagccccaccttcatttttccacggcaccaaacagccctgtgacatctgcattcaccccactcgttttatttttgctgcagtgaacagcttgagttgtctcttaagagtcatctcatcccttgctattcgagatgacccacagatggcagctgttcagcatcacctgggagttcattggaaatacagaatctcaggccccacccctgaatgtcgaatactgtgtgtactgctctagcttctccagagtaaaagatagtctctataggatgccgtctgctc

SEQ ID NO: 76353 - DNA, 4806 bp, Homo sapiens
gcctgcagggatgaatgggattcaggtgggccagggcaggcatcccaggaggcggaacagcaggagcaagagcatgggtactgaggaggtgagtgaggtctgccgaggctacgaggatcctggttcagtgggtccctgagatggacaagacttgggaaagggcatttgaatggcaagcagaggagtgaatatttaggttagaactgaccctgcatcccctttctgaggctgacaggtacccgagagttggtaggtatttcatccaatgataacagtgcttgttatatacctctgtggtgctgtttccatacctaagagcacccatgctaaaagtgtcttactaattaccagtgatggcctccttagggctgggatgggaactgagaatcatttgagggcttaataagtgattttggaggccccagtccccaccctatgggagcagagtgaggtggtctgacaaggtgcttccttcccggtgagcaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggaggtgggtggggctggccttgttcctcttcgggagcccgtggccccttctgctctttctcctgggtggggaagtctccaagggaacaggtcatagttggaggataaattaacttcacccctgaagcctcacatcttcaatttttagtaccttctgctttcccaaggaatgtgttgagaatgcacatttctaggccccatctctagaatttgcttcactaattctggggtggagttcagaataagcacttctggtggttctgggtgctggtgggctccaaacactggctcaggcatctgctttgaaaatggctacttgttttaactgtgcaagagtgtgtgtgtgtgtatgtgtgtgtgcgcgcgtggctgtggggttggaggttcggggaatcacacatttttttgtctcaatctttcctacccccaaatctgccctccttcctgacctgacccccattggcaagtcctggtttctttgctctcccaggcagaggctgccaccctgccccttggtcatctagggtccttgtcctagtaggttgtccttgtcctggttccccttcctctggtgacactcagccacacagaaggccaagtttgatggctttggccattttgatggttggggagtaggatgggcaggggccgccaggagcccaggcctgggacccctttgctgacaggccccttgccgtcctgcagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggtgagagccccatcctgtgctttcttagtgcagcccccaacccctgccccagggccctggagggcacttccccgggacgtgggctgccatgcaagtgaggagggagagaaaggggaaactgccgtcagcctgccctgactcaatgcaccctgcaaaaccagccttggaaaacctgtgttggtgccccataagcttccctgctttccgggagagagtgttcagactgtgggtagaaagaggacctttgacccctgatccttgctctcctaccatgaggagtcaccctcagtgaaggcttgctgctccctggctgtggagacagaggagcagaagagactcctcctgccctcgctggcccctacccctaccccgacctccagtggcctctgggactctgctggggatgtcagaggccttggtcctgggttcccatcccagctctgggtcaggctgggttttagtgggctgccccttcccagtgccctggggcttgcgggcggtcccaaggcgtgggagcatgggcttgggtgctgcccaccaccccacctgcttcatggctctctaggcacctggggggaagcccctggggaagcgggggggctgggtcacttctgagggagcttctcacccttgtggctcatcacaccccactgtggtcctgctccctggagcagggctgcgtgtgctggggggagggcaccccctggagcctcgttggtgtgtctaaccgtgtgcacttttatttcccctcctcccccgcccccccaccctccctccgcatgcctgtccctgtgtctccccacacacgccaccctcccccggggcatgcccccctcacggctccacctccctgacaccgcatggctcgctgcctggcgcaccgcggccccaggatcactccggcacactgggtcccgaggagttcaaagcctgcctcatcagcttgggttatgatattggcaacgacccccaggtactcgcctcctgcatggagcacgctcaggggtggcgtctggggcaagaaataatgcgtttttcctttttctcttctctctgtctggatctcctgtccccctcctgtgggccatggggctcgtcctctcctgctgtctctgtctgccccatcactggtccaccctctgccctctgctgtctttcatggcaacctactgggtgcccgctgtcttccgtcctcgctgctcttcatcccatgggtggatttttgcatctccctgctctgtcttcctcctgtctttggacatttccaccgatgtgtgttcgcatcttctcctatgttcctttacctatcctgacccccaaaaccataaatctcatccccgttctggccatctgttcctgtcttcctggccccgggccggcccttcctcttcctgccttcccgaccctccttgtgtcttggtaccactgccccccacagaagaagacaggcatgatggacacggatgatttccgcgcctgcctgatctccatgggttacaacatggtaacgtaaaccccaccctctgtctgccctggtgagaaggcagccagctggcgggagcagccaagtcccaggagtggcaggctggaggccctcaggctaggggctgccctccctggaggagccccagggcccatgtccttggggaagatggctccctgaaagccggcccggccacgggcgtgtgtgtatccgggaggcctgacctcctcgcctcaatctctgtgccacttcatcttctggtacttctcactcccactgtggacagctgggctgaccctgaggctggcaggaaggactggtggtgtgggacatcccaggtttcgggctggcatgcgtcacctcacatggagcatggaaaccgagacttccacctctgtcctggcggtgactctggttgggcctgccgcccctctggattgtcccaggccgtcccccaccccccaaccttcctagtctgtccccccttgcacagacattctgagcagagcagtcaggtgactcctgagccatggtgccaagtgcagagcccacaggctgtccagcgcagggcatgggcatggggctaggagcagtgaacctgggagtaaatcccagccctgccgtcattagtgtgttacctcaggtgaagtgggggaaccctacaggactgttacaaggattaaatgaaggaatttaagtgtgtgcatgtatctggcatgtagaaaatacagtgtggtggggagagaacagattctagaaccagactgcctgagttcaaatcccagttctgctgcttcctggctgtgtgaccctgggcaaatcacttagcctgtctgggcttcagatttctcatctgtacaatgaagataataaaatacctatctttatggttgtagtaaggattaaatgaattgaaataaagcttttagattaatacttgatatgctacataggtgtcagccattgttaatcattgttgtcattatagttattatcaacatgattatttgctctaagaggaactcaggcatctgcagggtgtggggaaccctgagctgggtctcccctgttgggtgttgtgtccccatcatacccttaggacaacccaggttaggtcagggggatgtgcccttctcttccagccataggctgctctgagcccccagggtcttcagtccatatgagatattcccagcaggccatgggctgacaggcctgggtttggctgttccctccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaaggtgggtgtcctatgggtgggcactgtgctggggtggcaggcactggctggactgtgatctaaaggggtgagagctggaacatgaactcctcaaccgccccttcttccagggtcctttggcctctccttgtttgccacttctactcatttctgtaatgtcttgggctcagctaaggtgtcaggacacaggattagtataagtgacccttccaggatcactgcatgccagtgagggactccatagctgggatgaaatgacgggtggcagatgagaatagagtggtgtggatgtgtgatcggactcttggagtccatctgacaatccctgggacttcacccttggtctcatcccgcgcatcggcacggactataatgggagcaggaagagggactgtgggacccaggaaggaagc

SEQ ID NO: 76354 - DNA, 1713 bp, Homo sapiens
gtgcactggacacactgaccgagggaaggggcccctgcagggctgccggcagccagtgacggtaactggggacattctaaaggcagggtactcctgaggtgcttgggttgtttttttcctggttataccagagggtgtggatggctgtgtttcccgctgtgtgtatagcgtcatgccctatgcattcccacagactcctgcatagccttcctgcgtagacactttcatggccttggaagtgctctgaggagagtgcttttccccgttgcgccggttggtggatgttctagttgcacatctgcttttgcaccctgcagatccctgcacaatgggcacctccttgagaagcacccccagaagtggagctcctggggccctgaggggtgggcggttgggaccaaggagatgcttctcactccagctcagccatgtggccctctctcaacccaggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaagtaggtggccccagacacccctaccctgtggtgaggggctgaggctgggctttctcagctgctgggggaggtgggggtgtggccgtggaagatggggagggtgggtacaggtgggtgcccaggtggggagggagtcaacgcaggagacaaatatctctcctggtggggaaggagcccgggaccactgccatcctgttaaaggccaccagttctcgcctgtagctagtacaggagcagagggtgaccaagacttggttctgagctttctcgttgggcctcgagggctccctgccattggccattgaggtgaaggctggtgtcacctccagccatgactgggaaaggggtcttctttggtctcctctctgccagtctcctgaaagaggggaggggtggaaggagtgcctggaaggtctcttgaagggagcgcccctggctcttcccagcaccaccagccaccccactgacagcctcagagagagggagatgggccatgaaattaacctgggtcccctgacttccttgtctcttccctccccagtgagctggactattatgactcacccagtgtcaacgcccgttgccaaaagatctgtgaccagtgggacaatctgggggccctaactcagaagcgaagggaagctctggaggtgagaggtcccagagggagatctaggcccatatccggcagccctgtggtgccccttcctgcttcttgactctctttgctttgggctaaaagactctatggcttccccagacctcccccaaccctggcctaaatgtggaagattcactttggcacaggatttggactttgccctcatggcgatgcctcctctcttgccctcacatgtctcatcctcccagtttagtgtgctttacagcccaaccccagccatttgagaaccctcctattctacacaccagactctgggacccaggccaggtgactgtgatgtgagatggttcatacagctggcaggaagagcttgttctttctgcctgattgagtcagtgcttctagacctggggctcaccaggaggatcttgataggagtgggggatgattctggacatcactgtactaacccttaccctatttggcactc

SEQ ID NO: 76355 - DNA, 1535 bp, Homo sapiens
ggggagggtggcttgcagggtgcagccccagtgactgtccagctgggcactgttgcacaaactggaggcatggccctgtctgaaggggcgtgtgggtttgcactcagcatctgtcctcccagaattctggccggctcacccaggccggggtctctgtaggctccaggttattgcccagaggcctgagtccatgaatggatccaggacagtggggaggctgggcagctccagtgcctgcttgcctcattgcacattgttggtctgtttacctcgggggccctttgccttagcacatgtgtgacctctgtgatcggttagagtcctgcgggaaaccagtcctagtcagggagagtctggggccctttccccacagggctctgttctcaaagtcccatagctgggtgaccaatgtagatgcaggtcccatgccttgcccaggaggcctggctcctgggagcccagaaaataccagtgggagatgggaggtatggtggggcagcctggctagggtggatatggggcagagatagggaagaggctcttcctggaaggcatggggcaccttcaggggtctagggggctaggggacctgaagcctaggcccaagccagaccctgaccctgtacctcccatccccacaggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggtgaggccagcccagcctcctgcctccccccagggcttcacttccctactcttcagcccagccagcagccactatgctattctttgcttttcatttgtttcatttggtctcttactagttccatggctttaggcaagttcattagccttctggtcgcctcagcttcctcatctgtaaagtgggaataataatagtaccaacctcacaggcttgtaagaattgaatcagttaatacataacgaagttctgaggagagttcctgcatagtgcagtgctgtgtgagtgttcactttgcagtcaaatcctctaccccgagtgttcactttgttttttagttttatgggggtttttttttgagatggaattgtgttcttgttgccaggatcgaatgcaatggtgaaatctcagctcactgcaacctccacttcgtgggttcaagtgattctcctgccctagcctccctagtagctgggactacaggtgcctgccaccattcccagctgatttttgtatttttagtttcaccatgttggtcgggctggttttgaactcctgatctcaggtgatccatctgcttctgcctcctgaagtgttgggattacaggcgtgagccactgtgcccagccgtataatgtcatcttaaggaattatgtctgcaaagagcctgtttccaaataaggttctatcttgaggttctgggttgacatgagttttatgggggaccccattcaacctaattcagtctc

SEQ ID NO: 76356 - DNA, 1056 bp, Homo sapiens
acccacattctagattcttaggaagtcagatggcaagaacttctggaaatagctgttaaccccctccatggtatagatgaggaaactgaggcccagccagttagaacctggtactaaaacccaggcttccttcctgccttttagttgcactaacttcacaccaggtctatgggtcttcccttagcaaagcagggaggttgagtgacgtgactgtgagtcgatgtaccctagtagccaggcttcacgaagcctgtggttctcagagggaacaccctggaagctgacttcatggcctgggaatgtcagtggttgggaaggagtgtgctattaggagagaccccttccccatgtgggagggctgttgggaggaaagggaggctggccctagcacactccctccccgcctcctcacctcctgcccccaccgccttcccaccctagctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggtgagcactgggggtgagcctgggcccccagactggactgcctccacctctgagctgctcctagttgtggtcaaattcagctttatgggggtgcggatgggcgtgtttgcttctacctacatacactgctccagaagtcacttcccccttccagttaccacccaggctcaatcccaaactcggccatgtggggcagccccctctgcccagaccattctgggtcaggcttgcccttccagacccctgagcatctactccagacctccctctcacaaaaaatcatccctatgaacacaatgcttttgacaccctgaaccaaacagggcataattgaatcgcagtcaagttgatttctacttccatggaatcttaagtagttaaaaa

SEQ ID NO: 76357 - DNA, 2401 bp, Homo sapiens
tgaaaatcacagccgcagttgcttcgtgccagttatgagtagctgccaaggggtttcagctgtttgagtggcacatctctggcatagtcttccggggtggcacatcctcacaaaaacatcagcctggaggaggacacgcgggtctctctgcagccccctgccccagccttgaagggaagtagtctggggcttccggcaagctgctccccagtcagtcccatgaggctgctggcctggttcccatggccccacttgctttctggggctccaggtctcctagacaggctccaggaaaagcatttccctcttcgttgcttcttgggattccccgtgggtgcttgttggttctcgagagagatggcgatcagtcaggagttgtgggtgagaagcagtcatggcatctccaggacagggttgagttggggtcagggggtgagggcctaaggatgtgactccctgtctcagtttcttgaggcccaggactcaaagtccccacctcaggggactcttagaccaccctctggccattcccaccttctccttattggttctcccaacccattctgacaccttgctctgcaggtcatgcctcccttgacctccttgactgtgtttctgacaaggcctttaggatgatctcattctgccccttaccccctgccccacacaccccagcatagtcatccatccacaaagcacatgatttggtgggcggattcgagaagttcttcaaggaaaaaacatttccgtcttccatcttagtcattccttccaattctaagcacgttcattctcaggaagctcttccttacaaccagcctcagttcatcttgctgcagttgaaacctgttttgtcttgttcatcaaccagttgtgaggtcctgtctttcaacctgttaatccagggatcatttttcatctgcagggcacccttctccagggtctcaggatgcatgtctgtcttctcacagatatcatcttctcccacccccaggctgtcttcctttctaccctctggcccccaaaaggctttgagttcacttcccccttggtgtagggttggaatgtatgcaagaacacagctggattttaaaaccacctatttgaagtggactcaggaatgctgggtccctgctggtgttaggggtacagtagcccccacagctgcagaaggcgctctcccactaaggtttcttagtctttgcctgggattgccattcagtcccctttccttccctttgctgctgaggccatcttgggtccctgctagcccagcacgcagcgcatgatgtgtgcttagctgtctggaagaggcctgtgctgggtttgctgggcattgagcccatacttggttgatccggaagtctggacttgggtgcagtagaatgtccgtcagttttctctaaagtgcttcaggctttgggccaagagccttgggagattctgcagggatcccaagaggtcccatgatttctcagtcagcactttatcccaggactcccggatttgaattcccacatctccaagaccctggaaaatccagccagaggtcctaagccttgcagttccagtgcctccacttggaattccaggatgggcatgaattttctcacctctccacctgacctgagtattttgattatatcagtcattggattagtttcttcccaacctgcaggttgggccttaaactcaggctgttctccaggggcccagttcagccaccaagacctctgtccaggctcacttgacccatgggacctggccatgggctggcaaggaggatggtaaggagagaggaggaatgtgacctcacagccttcttaactcccttccaaccacagggagctgcagggatgggaggggctttgtcagcacaggtgtgtaccaggtgcccctgctgctggggctggctggtcgtgactctctctgtcttgttgccaggcggagacagcagccaatcgcatctgcaaggtgttggccgtcaaccaggagaacgagcagcttatggaagactacgagaagctggccagtgatgtgggtacccccgggttcacctggcctgactctagcaagagtcagtcccctagaacgtgtacctccaagtctttccttggagcatagtctcaggcttgtatagtctctgatcccaatactgctagtccagggcagcctgagctctgttgtggctctcccagaaagtagtgaggtgggggcagaggccagtccctgagttatcatgagcctaggatatccctttgcctctcagagtcttcttgtttttttcacttgtcaagtgagagttgagccaggggatgtcaaagcctttccagcctagtgtactcttagtctgtgagttttgcttcagtgagaaaaggagcacatctggttctaagagggt

SEQ ID NO: 76358 - DNA, 1405 bp, Homo sapiens
tttccctcattagatgaggaccaactgctgtttgacaggtgggttttggttctaattctttctctgcttccctctcccctcctcttcccttacagggacttagaatggatggagagcattaagattttgtttatgtagcttgtgttttagagttcatggtctgctgtttctgagaaagaacacttgaaggcttggactcgatctgagagaaattcatgagccatctgggaaaacctaaaaaaaggagccggcagtggctgcggtctgaccagtgccctgctctgccccagatctgagcagggcaggtgcagtcacaagactgccggccaccaaggttttcttgagcagcagaaacttgaacatgaggtctgtggggggaaggcttagcaaggccttgggaaggggcagacagtgttgtggagggaggtgaccacagcttgtgcaagaagcttcggggtatgcaggcggagcctgcagtaggagaggaagctggcaaggtgtgggctgcctgaggaaaggggccagtttccctctgcctggtcacccaccctggcccactcaccgtgaggaagctcggatgcctggtctgagatctctgctgatctggggctctcttagtaggaaccctgggcttggtggctgactccggacagagggaaagactgggcagtggacagctgtgggaagaagaaaaaagcaggtccagctagatttgggaacattttggctacagatgacatagatgagatcctcgtggcattcatgtgaatctgtgggttgtgggtggtggagccacagcacatcatctggccacgtttgggtgttttgatgtcaccttgaggacagttcctctctagactgtgcctgtatcaggcaattggatgctgattattagggtagcagtttggcttgggatagctaagtactccagggataataatagttcatatcttttaaaaaataactccagggataataatagttcatatcttttaaaaaataactcttgaatatacaacaaagtgtatatgttaagttgtataatagcgcagcttaaagtaggtcataaaaaaacatgaaaattcaggttgggcgcagaggctcacacctgtaatcccagcactttgggagttgaggctggtggatcacctgaggtcaggaatttgagaccagcttggccaacaccgtgaaatcccatctctactgaaaatacagaaattagccagacatagtggcgcatgcacctgtaatcccagctactcgggaggctgaggcaggaggatggcttgaaccttggaggcagaggttgcagtgagccgagattgtgccatcgcactccagcctgggtgacagagcaagattctgtctcaaaaaacaaaaaaacaaacaaaacaaccatgaaaat

SEQ ID NO: 76359 - DNA, 1005 bp, Homo sapiens
agcccccaaatttcatgaaatgtgagcaccagaggggctcctgctccgaatcttgactagtctagagtttagagctccctaccccaactcttgagttatggatggagaagctgaggtcaggttagctacccacgagtcccactggttgagggcagagctgaaaccagaagccaggatggatggtgactaggccagtgccctgcccttggcacacgtttcttaggaactccttcctacccccgactcaggctgcagactacttcgccccattttcctgacaatctgaagcttgaagggggaaagagaatgctttaaacctccaaccagtgagccccagtggtgagaccagccttccacatctggagctgtcccctgaggatcgagctggggctgggagaaagtcgctctgctccccagtttgggtggccacccaattgggagtagccagtgacttgtggtggctctcactttatcatcccttcctccttttctccctctaggatgatccactcacaaatctgaatacggcttttgacgtggcagagaagtacctggacatccccaagatgctggatgccgaaggtgaaaggcgctttccttctgtgtctcttgcccatcgcccacctgccactcagcggctaagaaggggtggaccccagcagtccggggctggacgggaggaggcctggtcttctgggaccgcatttgaggagcatggggatcacagcctcttggggattcttccatcgttctttgagctttggagagagaggtgttagttgattctgcaaaggtcttaggggctgttcttgcatcgactgcctgaggatggttcttgtctttgccttggagtcaggatagcgggtgctggggtgtggggaaatgtgcccttgttgtccggcacagtttgggatgggaagtttcccttgctgagaggtgcactgtcctcaccctctgagccctgggtggtctctggacagctgagcttagcatctcctctatgcc

SEQ ID NO: 76360 - DNA, 2191 bp, Homo sapiens
ctgtcaagggaatagacttgatggccagggctcctccttcagtagctgcagggttggcatcaaagggtcacagtggggcctcctgtgagccggcatccctccctccaccgagtcagccctctgacctcgctgcccatccccttccccatagagacttcagccaaggaagggctgctcctgtggtgtcagagaaagacagccccttacaaaaatgtcaacatccagaacttccacataaggtgagtgctggggtctgaggggctctcacagaaccaggctgcctcccccgggagctcccagacccccttggctgggtcagtctcagctttagaacaaagtggagacctctgggggaagaagtagctttccttgggaaggggatgtcgccatcgctctgaatccccccgtctctctccctgcagtgtcttagatggggctgctgcctgatataactttggttgatgcttttgctactgggagcgcccccaaggaaattgtccaggaagtcccagcccagggctctggaacagcagactagggccataggccttggtcgggggtagggctggatatggcaggtttatctgaacttgtcaacccccccacaaagtcttgaccctagtgcctgggatttgtggcaggaagaaatgtcccttcccatcctgtcttctaactcctaccccagaaagctctatgtgttcatctctctggtgtctaggaggcccctgctttgccctggttgcccgtttgttcagcctcatttaccagcctgctccttcttctctctccccgggcagctggaaggatggcctcggcttctgtgctttgatccaccgacaccggcccgagctgattgactacgggaagctgcggaaggtatgtgtgcccacctgaccacccgctttgggtccctggcaggtggggtgggaaaagagcaggactaggacccttgttgtgacagtccatggtccagcctgagcagtgttggcctcttagaatagccagacagagccccaactgaaagtgaagagaaaacaccttccctgttagggcaacttcattacccttgtgcgtggtgtgtgtgtacttgcacacatacacagcccatcaggaaaatatcacagctgtgacagcagctttgtcagagggatggaatgatacatggtgtttctcccttctgtttttccgggatttgtaaagaggagacactattttcatcattgaaaacagtgcatattctaagggacagttcatccccgccttgtcctttgacctgctgtgcggtcctgggcagcttatcccacccatggatttggtttcctttattgctcaagtttggctgggggattttcttttggtttcactcccgccttcagcatgaagctgcagtgatttttcttgagtgggtgtgtggagtggggacagatgcaggagtgggagctgtgtttctagcctcatggtggttctcaatgtctgagctggttggacgacactgccctggaccttggagaagcctgtcctggaccctctgaccacactctccaggttccctcctggaccctctgaccacactctccaggttccctcttggtccatcttggtgccaagaggccacatggcatggccatccaaggaaagacccttcccacgccccaagttggtgacctggagttggggttggaatgtcgcctatctgtgctcagatctcttggcaagggaggcttcaaggagcggctggacttgtgtgtctctacttcaccttgatgctggagaacacagtgttcagtgtagctcttgccttgcctgggcctccaggaagggcgtcttgcttctcagtggccaggagaggtttaatatcactggggcaggagctgctgtgcaactcatggtggtggcaggccctttgtttcgggcgggtggatagcaagctgccaaaaaggatcttgagggaggaaaggagcagatgcctacccgcttccctgcaccgtgccccgccccacccccaccccatacacactgccccgtcacctgaagcttgaggctgaggcctctgcccactggaagggcccatctgctgaaggagaggagccacagcaggggccagcccttcgccagctaacctcctgggggaagaggatccttggcccacctcctcagctgctttgcaaggaaaaaaaaaaaaagagaacct

SEQ ID NO: 76361 - DNA, 1050 bp, Homo sapiens
tctcttccagcacctgtcacagtttattgcattaactttaagaaacatccaggccaggcatggtagctcatgcctgtaattccagcactttgggaggctaaggtgggaggatcgtttgaacccaggagtttgagaccagcctgggcaatatcgtaagaccctgtctctacaaaaaatgaaaaaattagccgggtgtggtggcctatctgtagtcccagctacccaggaaggtgagatgggaggatcgcttgagcccaggatttggaggctgcagtgagccatgattgcaccactgcacgctagcttgggtgacagagcgaaaaccctgtctcaaaaacaagcaaaaatcctgtttccctctagaagtagagctctggagtcttttgattcctagcgtggggcatggagtgctgtgggtgctgagggagtgttaattctgtccccgctgaggccctttctgatgtgtgctgctgctgtttctgtagaaatcgtggatgggaatgtgaagatgaccctgggcatgatctggaccatcatcctgcgctttgccatccaggacatctccgtggaaggtgggtttctgctttgttccatcccgccatcaccatctcgtctccctccctgggcttagcctggagaactcccatacccagggcaacggacgttgatcaggggccatgtcctgggcttcttgctcatttattgggcatcagccttctcctccagtcaatgtagaaaaaagaactgtttgccattctgattctcataggcatgttggcctcagggaaactccccactttgggaaagcccaaggctgccatggggaagtatattggaaaacccacctggctcttgggttgttaatctgaaagggtggggaaatagcggctgggaggaaggaccaggaggggcgctaaccccgtcctccactttgctcccctagcaccctctagtggccatttcacagatctgcaagggccgccatggtctggagaggtgatctctacgcttgattccacactcgggcagtttttgagctttatgtctgct

SEQ ID NO: 76362 - DNA, 1004 bp, Homo sapiens
tgatctgtcccaccttggcctcccaaagtgctgggatttcaggtgtgagccactgcgtctggcctcatcatctgtttgtcgtacttcgtcccaggcctgggccctgccctggaagagactgaggtccattgtgttctcagggggccaatggcaggcctgtgttagctctgcccattcccccacttgtggttagtgtttgttcactcattcgttcactcagcagatgctgatgggggctttgcctgtgccaggcttcatactgaactctaagcagtgatgcaaaacaggaagtattcttaccctcaaggggcttacattctagaggggaaagagagaaaatacacatgtacacctgtcagatggagaaaaccaaagcagggaggaacttgggtggtcaagggaggtgtccatgagaaggggacgtgtgagtgaaactggcaggaggcagggacaggccacgtgggtatctagggaaggggagctgcagggaggcccgagcaggggggacggggaggaggaggaggagaaggaggggaagaaggagcagggggaggagggggaacaagaggcccaggcggccagaccacgagggcctctctggccactggctttgactctcagggaggtgggaagctgtggaggttttttagcagagggtgatatggggtctggggatttacttggtcattctgtgtactgtgtacctttgcgaggtttctaagtacggggtgtgataaatagccttgcagcaagtgcattcattcaggaaccttactctgcatttcctttcattggctagggatagattcctggagataaaattatactgccaaaaagctgagcaactgtaaaatgcgtgctccttgtggccaaattatttcccagattaattgattaatttcccagaaattattattattgttttttaaaccaatttacacttctagtgtggtggccttgctgacatcaaggcgtgtggttttcaactttgggtttttttgttt

SEQ ID NO: 76363 - DNA, 1221 bp, Homo sapiens
gactagagtgcaatggcacgatcttggctcactgcaacctccacctcccaggctcaagtgattcttaatctgcttcagccttccaagtagctgggattacaggtttgtgccaccacgcctggctaatttttgtatttttagtacagatggggtttcactatgttggccaggctggtcttgaactactgacttcaaatgatccgccagcctcagcctcccaaagtgctgggattacaggcgcaagccaccacgccccgacgaaaagttcctttaaagtgagacgttctttaccttctccctgccctgaggagccagtgttttcagctgtggcttccaggagtgaaatcatccactcccatcaggctgagcaccaagattatgccacaatggccgctctgctgagccaagaaactagatgaggcagcaaatggcgttttgtgggcttttaaaagtgaaatggagtttattgatgtcgattataaaataaaaggcgatgggcagatggcatagaatgagctctcctggaaggggagcgggggaacgttgcaggttgtccatcctgggctgctgaaggctgtgactgtggagaccaggcccagcagggacacccctcaccccccaccaaagtctttgaaggattatcatgcagtgcaaggactaagacctctggctgactccgaagggcagaaccaggcccagaataggtaccctgtaggtaggtggactctgggagccttgggaaatggagccggggctctgggagggttatgagttccctgtccctgaaggtgtgcacatgaaggctggagacaaggagcttccacacataaaggggaggttagagcagatccttaaggtctcccctacgatatttggttctagaatgcatagacttcatggaattggcctgggtgagtggttggaatgtagttaaccaggggagagaactcaaaaaggattttgtattttaaggtctttgggcaggtggagcctgagggtttgggtgctgtgagcatggaggtgggctcagtgaggtagcatgtatctttaggatggagggggcggtgggtgccataccacagcattggtctgggaggtggtggcccctggggttctagtttctgtcacatggaatttctgcagcattcattctgccgtctgaatactgaacagatgacggtgtccctggagagagaaggagggagaaacatgttcccagta

SEQ ID NO: 76364 - DNA, 1111 bp, Homo sapiens
tttagagtgggcagaaaatgttctatccaggccccttcagtcctgtgaccatggatttagcaagtatttatggggcacctgctgcgtgatgtcagagacctaaagatgaacgaatctcactcattcaagacacatcgtggctgtgagaatggattgctcactctgtggcatatacttaatcctcacaacaaccctatgaggtagctctaagaattaattatcctgattttgccataagaaaacagatgcttaaagagattacgtgacttcctcaaggttccgccatcagtaagtggcaaagccagaactcaaacgcaggtcttcgtgacaccagaggaatgccctgagagtggccttcccttggagggggcaggggtcttgctcctgggaagtccataggagcagatctcttctctggttgaagcttacagtcccctctcttctagaaatggagggatatttatcaaatggagaactttaacacaggctcagcaaactgcagtgcatggggtcgagtccggctgatttggatttttggaaatattggaacacagcacaccggtgttaatgtatcatcagtggctttgtgctgcaatgacagagttgagtagttgctacagagcttatatggatcatagagccagaaacatttcttatcaggccctctacagaaaaagtttgctcacctctgccttatctggaattcaggccagtgcccaaggtggtcacgcaaggtgccttatggattccagcatctcccccaccagctgtgagcttctcaaaggcagaaaccttggtttctacatcctgtggccccagttcctagcagcatgatgcacacagtaggtgctcaatacatgttaaaaggatttacatatagcagtataatctgctttgtgatgaggaagatgttctctgccttataataagaaaagaacagtttgctttattagggagcaattcaagacttggcagaaaaagttataactaagcaggcgtgggaagccaaagaaagtcacccaggtggttagtgcaggctcggatgcccctggggcagggaagtgtagagaatttgtgaagtggttcaggggtcagtggcaggggtgggtag

SEQ ID NO: 76365 - DNA, 1030 bp, Homo sapiens
tggctgcaaagactcagacctttcctgaccactcctcagttcctccttcctcttcctcctcctcttttgaagagcatggatctttctttgtatttgttcattgtatatatttatttgtgtttctctatttaaggtctgtctctcctactggactgtaattacataaaggcaagaaactgttttgttcacccccctattcctagcacccagccaaatccctggcatgcggtaggggctcgataaataaatgttgagtggatgcaagcagatttcgacctgagaagcagaagaaagaagaggcagggtagattctccctctcattccctgccagggtgacattctccagcccctgagcagcgtgtgagcacacacacacgtgcacacatgcacatgcttctgcctagctaagctgtgctttggatgagggtgtagtggtagtagctctggcccctggctcatagcgtctcaccttcctcttcctccctcttgatccaaacaggtgaacgcttggccaagccagagcgaggcaagatgagagtgcacaagatctccaacgtcaacaaggccctggatttcatagccagcaaaggcgtcaaactggtgtccatcggagccgaaggtaaggcctacctctggtggccccaaggagcctgattttctttgtccccctggttctcttggccttttttgtgctgcctcctgggcccatgcatcacttgggggcattgggcagtgggtccccagcacctccatctggtcgcctgtggaggctttgtattgcaacagcgcttttcttctagtctcagccctgcccaaaaccaaggacttagacccctgttcccatgcctgcacctgcttagccacgtccttgctctgtggagtcctgtgtgtgtggcatgccacctcccccatccagaggcctgactgcacggtgttgcctggagcagaggatttgtgtatgggctggaaagggtgtgcagacacaggctggtggaggctggaggctgccccgagactccccggggccct

SEQ ID NO: 76366 - DNA, 1086 bp, Homo sapiens
ttagctggctgccaagtgagaaaggatttaatatactaatttaccctaaggtatcaacagggcttaatatgttccttcggggttactctgtcttaaaactgtgaagattgaaactaagtcttataacttaagaggtaacttgtaagaatggaattgtggcattttcaaatgtgggtgggcatgagtctttgagagagggctgggaggcggatgttaagggaatttgctgcttcatgtatcctgcttgctcccacccatgtagcaggctctgtgtagggtccctcagctgctgccctgtgggtagctcagtgcttggttgatgcagtgaatgagaccatggtggggcaactgtgttgagaggctctgctgagtaggtgtccacctcccaccccctggcaccattaaatggcttgtccaatgagggtgacaacaccagccccctgaccacttgcccttcttgtctctgcccagacattcacggcatggtgtaactcccacctccggaaggcggggacacagatcgagaacatcgaagaggacttccgggatggcctgaagctcatgctgctgctggaggtcatctcaggtgaggcggaacctggcccaggacgagatactgtctattggtgctgcctgacaccttggcatctgctctgcctatgagcgcagctggttttggtctcttgaaacaagttggggatgacatgtatgaattcatcctaggagcgtgggtctgagttctggttctgctgccagccatccaggtgccttggacatttgtttcagcatccttgtttgttttaaaaaaaaaaaaaaaaaaaaaaagggtttgaaggaactgaggttccttctcctccccagtgccaggattctgtggccaagaatgttaaccatgggtgactgtctccaaatcttggctccattactacttatctacctgtatccaggtgacccaggccattccccagcccctggtttgtccagatgtctggagggacagctctactggaacacacatctcatcctgcttatgaatgcctttctgccaccatcccttaaggggtgggagtcctgtgagtctagcct

SEQ ID NO: 76367 - DNA, 1008 bp, Homo sapiens
taatcttccctgaaactttctgtccttcattctaagaatagtagctcccatttttggagcctgtgtgtgggtgattctgcttagcattttccacgtgctactgcaacgatcttccccaccctgtgaggtggttctattaccatccccattttacagatgtggagatggaggcttggagaagtcaagtcacatgcacaaggtcactcagtggatccaggtccatcttgccgtagaatccacattcctcaccattcctcaccactggcctattctgcctggtctgtacccagcaagtttactcactcattcatggaaggatctttagatatttgcagtgaatccctcagccatctcatctctcctcctggtcatagagccccagttcccaaagttcccctcaaagggctgtctggtctgcttaccatctgtaatgatctctcttgcctcttgacaacacctgtctgtccctgggctctgcctctgtctgccaggctgccccagaggggctgcccatcttctgccaactctgctgatgttccatcaactcagactctctgtgccaatgctggctgcggtcccctggatttcatctggttggtgttttcacttcacagtgacccattttcagtgataccctatgagattcagcttacctgtttgaccattgagaatctcagccttggttctgctgttcccttccagcacccacccatgcctgcacctgaaatccacgtcattcgggtggagcagaaagtgtgaggggctggaggagtcaggaggttgagttgtgaatataatccagccgtgtggactggggaaagcctctcaccctctcttttttgtgtccttagtcgtaaagtcaaggtttgacttggatggtgcctaacacctcttctagctctaacattcttttatgaggtgtgttaacagcataaacttataataattatacccccaattgtggtggcaatagtaacaatagataattattgcagttgctataatttt

SEQ ID NO: 76368 - DNA, 1042 bp, Homo sapiens
tgccctgtggctctcctccccagtccactgggctcagggactgcctgggcacagctgagtgggtgcccgtgtggcttgagactgagcagggactggtgcaggctggtgggcagagctggatgagtccccatcattccccagcctgaacggagtctgaaggctggcctggaagagtttagcctcccagcagagtggagcaggctcaggctttgaccgacctagttcacacctcagttctgcctcttgccagctgtgtgactgtggggaactggcccttggtgtcctgttcctttgttcctttaacctagaattgttgagtggacttgctgagatggcgcatgcctcgtgggtgatgataacagtgagtgagcactcactgagggttataatggtagccaacatctttgagcaaccctaggatatgattccctctccttccctcacctccccttggggctccctgaagtccacgttgccatcagtgtccccatcttgaaactgaggatggaacgctgatctttcctttcaaggttggggggagggggctggggagccgaaagcaccccagggctgcccttgctgcagtgtctgaagtgaagcctaggagccccggtgctggtgggcaacagcaggcgtggatctctctgatctttgaagaggactgtgaatacactgaccacaggcggaagccccttgtcccgtcctgccctgcactacccagaggtccctgggcttctcagcagaggtggacagatctgcttgcagctgcccttcttcccacgcttctggaaatggaagttcccacagacacattcctgttcctcagcttgctgctccctgcttgctgataccttgccgccctgtccctcaaaccgggctggccataccaaggtgttggcgagctgctcagcctgctgagctgttgacaccccagaccaccgccggcctagtggacaggccaggaaggcagtgatggcactgggtcacattgtcctgggcctgggtgagggtttctgtgctgctttttaatgtgctgatctgt

SEQ ID NO: 76369 - DNA, 2538 bp, Homo sapiens
tcaagccattctcctgcctcagcctcccaagtagctgggattacaggcgctcgccaccatgcccggctaatttttgtatttttagtagagacgggggttccaccatgttggtcaggctggtcttggactcctgacctcaggtgatccacccaccttggccttccaaagtgctgggattataggcgtgagcccaccgcacccagccagaaaaccctacttcttaataagcttgttgtgaagagtaaatggggtcattgttataaagtgcgtaggtaagtgtcagtgaatgtcagcttttgtcaccgttgtgcctctgctaagtggaagggcctgggggggactccctgcagaaggccaacttcctaggacctctgtgtgctttctgtccatccaagccctactcccctgggagaggctgcgtgtgaggttgtctggttgggtggcagcagcttcccctgcagaaggaaactgcttcctccccagggagatgggagttgctaaactctggcttgggccggctgtgtgctctaagcagggattatgtgcgtgtgtgatgagggcggtgccttgggcttcattccagatacaccgtgttctctgacctcgcactcccttccttggagcccctcactccagcaccaggcattgtggctcagaactcccactgctccggattgctatttgacagtttcataggtgggtcctacttccctttttagatgataggctccaggacctccatattcctcatatttggggacagaaaataagagcttctctttccatgcagtaggatgcccctttctcctgtgggatgattgggaccggcctgtccaggcttgggggagggaataggaacgggaaccctgcttggagctgcattctgtgttcggcccctccctgcagaagacttcaccttgcagagactgcagagtgttagggagaacccagctttggagccagcagcactggtgtggaggcaagctctgctgtctgacttgctgtgtccttgagctggtccttattctgagcctcagtttcttcctctgtaaaaagacaatctgtcttgcagagttgttgccgagactaaatgagatgatggatgtaaaccacccaagctggcatcccatacctggtaggctccctaagtgtgttgttattttgtgtgtggatgggccaaggggtgcttttagcgaaccattcttctccacacagaggtgtggtgagacagacttcctatatacatttctgtagcccagagttgcccaaacttgcctgattataggattcacatggagtacttgttacttgttaaaataccaatctgtgagtcccatcccagaactcctgaaccagaatggtggttgttggggtgaggggtctctacttttaaccttttttataatcgggccagtctgggaaatgccgtttccctcagattgctctgccagttgctgtgtcattccatcttcacgggggcccattggaatgagacaagtatggccccttggaaagtgggagactttgcaggtgagactgaagcttgaaggggctggcctgaggccctgagctccttgtggtggaagcagatttagaactgagatctcccagtgatgtgtgtccattgtgcctgcaaacattccactaaagcatggaaaaggtgaaggtggggatggagagagatggagtgacaggaaggaggtgagggctgagggcctccatgatggccttgggaacctgcagagactaagtgggggatggatggtgggacagagccctgagccccactaggatgcttccccaggtgtgccttctgaaaaccagggccccagtgagcatgtggggccttgggcttcttagaaccactgggaatccacaggtgtcagagcgtaggcgcggtcttaggcagcatggacccagcgggaggggctgggactcctcctcagggctgctggtggagtcctggaagtcctgtgggtaggacttctgccacttctcccctcttcctctgccttttttattgggctgggaagttttctagaagcacaggcagggctggctcccttgttcagatagggaagttgaggaataggtatttccagggtcagctgatgatgccaggaactggggtcccactgccttgtctgcttcctccttctcaaagttggcctggtccattagagaaaaccccttttaggtccttactatgtcatcctttccagtttacccttaagaggcccttaaggaggatttcaacctctgctgggccccacccccagagggtgacttgattggtggtggtgaggtgggctggtgggctggtgggctgtgagcggaggggccctgttacggacagttgtgagagtgtggccggggcacggtgacctgctgccaggccctggggagagtcacgctgactgagcctgtggttgaaagtgtgtgactgccaccgcgggtggaattctggctcctgcatctactgttcgctgtgaccttgagtggctgtgagctcttggcctcggttttctcatctgtaaa

SEQ ID NO: 76370 - DNA, 1964 bp, Homo sapiens
tttgccaggctgaagctgtattctttgtgccccagaactccctgccgttggccgcctgtcacttcgacctgtctgcagcccgcagggtcccgggtgggtcattgctgctgcggagtccaagctggggcctgtcagaagctgcccagggctggcctccagcaggcctccctctggcgatcccaggattgagaagttgagtcaatccctaggatgtctagactaccagcgctggaaggtcccacagaaaccagagccagccccctctgtcagataaagaaactgaggcccggaaagctggagactgaaccagacctccctcagctctcagcttggctcactgctcttttgccagcttcatgtggcttcccttttggctactgtttgttttgctcttccatgctctactcccttaaagggccggccctggggacagggagtagggtgaaagatcttcagacccaatgggaagttcacaaggctgcgcttgttcactgctgtttgccagcattagtatagtacctggcacagggtaagagtttagaaaatcttgaatgaatgaacgaacgaatgaatgagtgaatgaatgatggggttacttggcctgagggtggggacactggtgctgcacttagagccattacttctgggaggggtaccaggcacgagtctccacacccaaagctctccctgttccaagaccacgtccagtcttctccaggccttcctcagtcccagcccatcacccggcttttacaggagcctggagtttcagagctgaaaggggccttggatatcaaatgttgcatcaccttcacgttagagttggggaaacggagtcaagggcacacagctagtcagcgggaacgtcaggaccagagcccaagtctgtggggttgcagagcttccatgcatccctccttgggcatttatgttgggagttgaggttagaaagagaaggccctgtcttgtccattgtgcctccccttttctgtatcttcctctgtgggatgagctgtttcctctttctctccctcctcactctggcttcctctcctgtagtggaggacggtggggtggtttctccataacagtctgagtaaaaaggctgggcccctgggattgggccaagtcattcccttgtgtcttcctagaaagggaaaaagagagtcggctggctcacttccttccggggaaaccagcgcctgagtcaccctggagtcagggcccagggaggagcctgcccgtcaccccgttgcctctggccatgggtggcgcttccctgccactgtttctcaaagggcggggggccagggaaggcctgtgctatccagctgccctgccgttcgtctgccttcgtcgcttcttgggagagtttcttggccttctgcaggcaggctggtgctggtggcaaggagggcaggcaggtgataacattgcccccctctaactggaggtcttaaacaccctcctgaatcacaatttgaaatgtttttgatttacaagtcttcaatatctgttttgttttatgataaaagtttgacatgcttagggccggacgtggtggctcatgcctgtaatcccagcactttgggaggccaaggcagccagatcacaaggtcagtagatccagaccatcctggctaacacagtgaaaccatgtctctactaaaaatacaaaaaattagccaggcgtggtggcgggtgcttgtagtcccagctacttgggaggctgaggcaggagaatggtgtgaaccagggaggcggagcttgcagtgagccgagatcataccactgcattccagactgggcgacagagtgagactccgtctcaaaaaaaaaaaaaagtttgacatgcttgtggtaaaataaaaaacaactccccacaggtaacactgttatttttctataccacagattttatatgtttgatttatatatatatatatacacacacgcatatatat

SEQ ID NO: 76371 - DNA, 1094 bp, Homo sapiens
atcttggtttggggatgtttccttggggcagagaagggggaagccactggaatgtctcagctgctgtttgtgttgtttgggtgaagagctccctgttgggatctcgtgatgcctccagcttgtggccatgtggatgggctgggattgatttgttctgtctggtttgttagacactctacccgctttgtctctccccacccagaaaaccacaatgaactctaaaggctggtccaactaagattcatggtaactgggagagagagagagagggacttgaggagacaagagtgacttgtgctttggtctgtgaaggagaggttcctttgcgatgaggattggaggtgggtcatgcaatgaggggcctcctgcctaagctgtattcagtgatcattcgctgcaggtgaccacaacttccttgtagatattctagctcccctgggtatgtccaccctctgctacccaagtggagaggttcactccaaggctatattccttataggatggcccgtggaccacctaggtttgtgtaaaactgtagcttcctgggccttttccagacctcctgaaccaaatgctctgttagagcccagaaatctgcatttccagcaagcgccctacttaatttttagataaagctagataaccctatgaaggattatctggaggaatattattgcttcagtctgaatggaaagagtttagctaaatgaactcaattcctttacattttttccccctttaatgtttttcactttttatgaaaatggagacagggtctcaccatgttgcccaggtgggtctcaaactcctggacttaagcgatccccctccctctgcttcccagagtgctaggaatacagaagtaacccactgtgcagcctctttttttttgtttttgagacagggtcttcatcgttctgtaacccaggctggagtacagtggcatgatcatagctcacgacagccttggacccctggtctcaagcagtcttcctgcttcagactcttcagtagctgggactatagtgtgtgcgccactgtgcctggctccagctgcttcactcttatttactcttcctccaggaccttcttaa

SEQ ID NO: 76372 - DNA, 1108 bp, Homo sapiens
agacagcagtagctgtcctccttcttctcctcctcctcagcctactcaatgtggagacaaccaggatgaaaactttcatgatgatccacttccacttactgaatagcaaatatagtttctcttccttatgattttcttaataacatttttttctgtagcttaccttattttaagaatgcagtatgtaacatacaacatggatgtcgatgtgtttttaatcaaatgtttatgttataggtaaggcttatagtcaacactgggctacaacagttaagtttttggggagtcagttatatgtggattttctactgcatagtgggagtgtgagggtcgttgcctcttacccacatgttctggggactcaactgtaggattattagaaatagtaactatcctgatggaaggtttgtaccctttgaccaacatttccccatttcgttcaacccccctggctctagtaaccaccattctactctctgcttctatgagtttgatttttttagattccatgtacaagttagattatgcagtatttgctatgtcttgcttatttcgcctagcctaatattaaaagaggttagtttttgtaagtcaaccctgaccctggttctgagcttcctggcagccgaagcaaaaagagaacttggaagtatcaagtgtttatttcttagtaaaagaaagtataccagttcacgagaaaggggcactttttgtaagcactaaaagctgagttttaccattttaggagagtggtgcagtaaacagtgctgtcagtattagtttcatggaacacacagaaactttttgtatacttgtttcttaaatcagctcccattgaaagccacaggtatggtgttaaatcacacttgtaggaaggcatttctgtggggagctgaggcaatgaactcgagctccactgtttccagaggtttaacctcagagaggcacaagtcctttgagatactcttgagcacttcttggagactctgtcgtggcagttgtttgacaggagctggagagcaggctgtgtggactcctggctctgagttcagaggttttctgaggtcttcacagaaaagagagctaataggttggtgcaaaagtaatc

SEQ ID NO: 76373 - DNA, 1073 bp, Homo sapiens
ctgatctggtgctggagggatgaggagcaactagtttgcccaccaagtcctaggcatctgaggccagccagggtcatggctcctgcctcctccttctgtgcccctccccagatgcccagttgtgagggagtgatcagaacatgtcgggggtattgcaagaatctcaaacagctgtgacttgagtgtacaagccatttttatccaagaccctgtgaaatccatggcaccacccactgggggctggtccctcaggatccacatagggcctatagcccacccccgtgcccccgcgccctgtgccccgtgtggcggcctgtgagatgcatcagaacacccaggggaacactgcgtttctagcctctgcttgccttacttgcttcacccacatgggcctctgtttccatttgagaagatagataagttaggggagaaaaatgaccatcttagaccctttctcctaaacataaccatttatattttcagaaacctatttttatttttaatcttcatgcctgcattattctgatagcggtaatcatagtgtacataaaaattagctctgcttttttatttccccacttggcattttatcaaaaacactttttcttatatagttacacagcctttatgttccttgcctggagaaagtgagatccaagtatagagattgtttcataaatacatgtttatttgtactttcctgcctctttccaaaaagcatttgaggtggatatattaaaagtctcgtgtataacagggttttttgttatttcgttttagagacagggtctcactctgttacccaggctggcgtgcagtggtgctgtcatagctcactgcagcctcaaacttttgggctcaagggatcctcccacctaagcctcctctgagtagctgggactacaggtgcatgccaccatgcctggctaatttttacattcttttgtagggtcttgctatgttgatcaggctggtttcgaactcctggtctcaagaagtcatctgacctcggccttccaaagtgccaggattaccaatgtgagccaccacacccccttccttcagaagttttt

SEQ ID NO: 76374 - DNA, 1432 bp, Homo sapiens
gtggatcatctttttttaaagttgacatttcaaacataagaaaaagcattgagaatcataaaatgaatatctacctgcttgccacccagacttaacaaacataaagcagacattctttccagatgagggacagatgcatggtctctgtctctaaggaggcctgtgagtgagagacccagggacgggcaatttccttgtcatatacaaagatatcacatctggtatagagaatggagttccaaggaaggctccagcccatcctggaggagacaggtaggacttcctggaggaggtgatcatgtgagctaaaaatcaaatctggaatatgtgagtcaggccaagcgggtgcgggggcagggtcaaggggaggtgggcctgcaaagggtgtaaccaaaggtaagaaaaagggagtgcaaagttctggggagggaggggcaggaggtgagtgaggagtgggctgggtgcagctggagtgaaagatatttgggagtgggcaacagtgaggactggtgaatcagtgagggacaagctctgggcatctttagggcagtagcaggcaccaggcttgtcctgagacctgctcagtgcgtggctgcctgaattagactccacacattgagaggattatagaccaatataatcccatgcaaagaaacccacacagcgggtgcggaagggcagaaactgtatcaggactatttgattgacctgggctgcttagagcaggctccaggctgtcatttgaaagaggggatgtgttgggttgacccaatggggagaagtaggacttggtgagagttgtgtggacatggaatctggctcagaatagaatttctaacagccttccaaagaagggatgcatggttgggcgagagtttcatggtcttaaatgtgttgaagtagtctcaggttggaagcaggcagggctggggtgtggagggaggagggctctgcattgcctggccttcaaggcctctccttactctgagttctgagatttaggctggggagggtgggtaagtgacctgtgggcacaggcaaatggtgctcctgggaaggcggctgtggaggaggtgctggcccgttgccatgggaaccatcactgccgtgggtttccagttccaaggatgccctggaagggaatgagctcactccacctgcgagctggtgagtcagccctgcctctcctgcttgctcgccaaggctaggcgggaatttgagcagtggaccctgcctctaccccctcctcagaccacccaggcgcccgtgccctggatgtgggctcttgtcgtaaaagatgcagggcaataaaggcagctgccagccattctggcatcagtggggatcctgactcggggaagctgctagcctagttggctaaaccttggctgtgttgcagagggtgagccattctctctgccggccactcagc

SEQ ID NO: 76375 - DNA, 1052 bp, Homo sapiens
tgcccagttagtacctgggctaggagagtcagaaaggacagatatgtggcagcctgcctgccttcattacactttcttggggcactgttgtgaaactcctctctaaagacatttagaggattctcaggggatgtcactgatctgtaactgatctgaggctccttggatgatcaaaggtggatttgtggagtctcctggggtccccctagtaatggactttcaggagctccctgatgagctcatcccagcaccccaaagagcaggtaagcacgaatcaagcttgcacatactaggtattcaccgagtatccagtgttgatgaacagtggtggtgagggcctttggacaggagtgtggcagctgtagtcctgcaggagacaactgacagatgctgagggcctgggtggtggtagtctgagtcaccaaggaccaccccagagatgaggttgattgctgggaccagggcagaggcccagttggctcctcaggactaagaggtgtgtcctggaatcagaaggaggacaggggccagggaagctggccttgtcattgggatggggtcatagcctaggatgacctcagcccctgccatgctgctcagcgcccctctctgagctggtgcgtccaatggtaggctggttggaactggcacagacctcccagctccctaccagccagcctagctgcgttttttctttggctaacagcccatcagattccaaggtgctggccatactgacatgtccctcttcatcctgccccttcctctctggagggtggggttattgcatttggctgagccctgcttcagaaaatcacagggaatttctggtccttttgtgtgggtttgtggaccttaaaggaagtaaaacctgggtcttggttttccttctccttccagtccctctgctgagggttctctctggagtgttggacgtcagcagcccactgtctttagccacagtatcccgaggggtgtggatctagataactgtggggcctcagcaaagctttcacctgcctcctgctccctttctgttgggactttgggag

SEQ ID NO: 76376 - DNA, 1915 bp, Homo sapiens
cccctgaacctggaggcctccccagtcccacgttcctggtggcctcttctggtgctgaccccagcttttgggagctagcttcccctgctttaagattcagcagcaccctccccttctctcttgttttggttccttcagtttcacctgttctgtctgtccttccctttgtttagagagtctcttcctttgtggtcaccacgggaaccaaacaggctttgaaccaggcagccgaggctcaggtttattttgattttaaaagcctgtgcacgtgaaacccgtaacgtttgaggttcttgtttaagccttgagacgatttagaaagttgatgagggagtgggggacttaggttggcttttggtgttacagggctggggagtttttgtgccaggtcagagatcagcaccaagtggggggcagtgccatttcctgacccccagctttgaaccttccaggcctaaatcagaggccccaaatgttcagctccaggccaaagagcagtcggctgggggaagggagcctcctctctgttaccttgtttttcctgtttcttggtggtgggtgatcgtggggctgttgaaagcatggtcacaaggcctgtgatttgaggccaggccagggcttgtaggggagcatttttatgggcctgaagatttattttttaaaagccatctgcaaagctgattataattgatgggagtgagacagcatctgagctctattttcaaatcatctgtaggtgaaatgacgggaggggaggcaacttcaaggtgggtgggctccttcaggccggtcccctaatggaacttggctttccaggctggaagaggcaccaagccttgcatgtgggtgggaggggttcttaaaatcagactctatcttttctccttatgtctgatgtggagatgtccaacgcataacagcctgtagtttggggatagagaagtggagcttttaattcttctgagtcaagtctcgacacccccaatatggggtcttggtccaggaaaaagagggcagcctccaccgaggtcctctgtcttaacacttgtgtctgtcgggtctgtgagcaggggtgcctgtctgtcagcgtttggctgcatgtgtctctctggctccaagaagcccctctgttgtttttggccacctccttgaccttggcagaggagtggctcccttttaaactccgcagacatcctccagataatagataatggcgctttccagtcgagttcccgatattttgtaagggcctttctttccaggaacccaaagtgcttttccagacttggccctgggagctgggagatgcaggaggtggcttatgaattgtgttttcctggaggcagggaaatggggccagacccctggtttcctgtccttcatctcggatactggtggctggggctgcatggaggtgtttttgcatgcatgaagtcctgaggcctcttattagaaatctgcatattttcccaactttagctccaaatgaagttttgctttgtagctttctttttctcttcttctttttcctctttctctcttttcttatatttagaggttcattgtgtatagtttctttaaggaatgccacattggggtctcagttatatagtgggcccgtgtgccaccccctcactgagtctgcttggcatgggcaaggaggccacagtagcacccaaaggtgcctggctggggggcctgtacctgatgccttttccccagaagccactggttcggaagcaagctcagcataggcccacattgctggccctgggactgttctgggaatatggagctgagcatccctgcgtcccgctgccctgcccccagcagcagccagccctggtactgtgctttgggccaggcacatgtctaagtgctttgcagctattaatgtaatcctcacaatacccat

SEQ ID NO: 76377 - DNA, 1571 bp, Homo sapiens
gctcccccttctctgcctctcctgctttccctcctttcatgtcgtaccagggggttatctggcgggcaagtctggttatctgggcatggtgagtctggtctagtgatgggcaggccccaaagctgtgtgtggcaacgttcatgaccccaactggccccttccgcatgcaccattctgccataaagttaacaagattccttttctcataataattatagtggctcgccctttttgagcacatggtaattatcagcaattgtcctaaggactctacatgcatgagcacatctaaccctgtgagatgggtcctcctgttatcccattttgcagatgagagagctggctcggagcagctgcggaactcctccaggcccacgcagccagcaaatggtggagctgggatctgaagccaggcagtcgggctccagcatttgcactccttctcaactttgctctgccgcttatacaacaaatgcttgcgtgggtagaacatttaacccaagacaaacatatacaaacaaaaccccggtgatggaaatgttctggaattggatagtagtggtggtttcacaacctcacaaatatacgtgaaaccactagattgtacattttaaaatggtgactttatggcatggaattttatctcaatttttaaaaacctaagaaattattaactaatataaagaagaaaatgacaattgcctgtcatcccacctcccagaggtaaacaagcattcacaggatttctgatggcttctgccatccttgtccctcttcccctgtttgtgtgtccccttctctgtcatgcccactttttagagctggggtccaggtttatgatgagtgagaggagtttagaagaggaagataagggcgggagcttttgtagaaagcgggatgaaggatgtggctctttccttggaaactgaccaggaatagatcatagatatgcacaggcaaacagaagactgggtgggttggggagagggtggccttcattttccaagtctcagtccttggggaaaatttctccctaacctctgtctataaaccctcttggcctgggattgcttctctccgtgtgctctccccagggttggcagggtgggagtccaagtgaggcagctttccttagggttgtaggcaggggaaggggagggcagggccagggtgccccccaaaggaggcagctgtaccactcttggaggttgcctagcaatcgtggggaaaggtgacctagcccactacagaagcgggaggagaataaaaggcagccaaagatggaaatcgggcgtacattgcagaggaggctgttcccctggaaactgcctccttggtccttggctacagcaggctacttctggggtggggatctgttctccattaagagggagtggggtcttccctaggcctgccacccacaggtcagggctgggggacctagggaaacccttcttgcacatggagtgtatgtcagatgcgtttgtcagtggcttcatttaacgttgacaacagccttgtaagatatgtgggatgatgacacttcatagatgaagatcctgagtttagag

SEQ ID NO: 76378 - DNA, 3351 bp, Homo sapiens
ccagccccgacccgctctgcctgccgggctctcggctccgggctctgaaccggttccgggcgcgcacgggagggggcgggggcggtgcggccgttgcgaggtggggtgttgggttacaggcgcctggcggaagcgggagcgcccctgccccggagcccgggaacgccgggccggagcgcggggaggtggcgccgctggcgggcaggtctccttgggggtccgtggtccaggccaccctgcggctgttgcaaccatccccgcgtgggctgtgctcgggggcggtggtcttcaggctggggctgagaccccggctcggggctgcttgctccggatcgattttcccttttcttccgcccctggccacctctccatatggcgtgcggtggcagcgccgcttcctgggccgccctgggttcaacctgagcggcgggcctcccgggaccctgctgccccttaggcggaggggagagcgccggagagatcggcggccgcctccggatctgcctggagaaggaccagctggagtgcggctggggacgagaaaactggggggcgtacgcgggctcccccgcgggccctgtgggggcggggtcaggacagcagaccgttttattgcttaactcagtgggttggaagctgtaaccccgacatgggcttgcgctacgtcctgcccctccgacccccgggaaaggtgggcagctcggttcgagttgaggggctgcagaacgagggtcagtcttaggggatatttggggccagtcactggggatccctacttagccacggagctgcatcccaggcaggcgcggtgtgccgggtgcgcgccccgccacgggagctgggctcggagctggcgatgggacccgggcacagtggccagtggcaggaagaggtcagaaaccactcgtggtggtggggggagggcgcctcaaccctaccgctgcttcctgcctgcgcggtgagcctgtgcccccaggcggccacgtaccctgaatacccctttccctccccctcctcccggctgcccacttccatccggtccctccccgtttcataccctccccacccccaggctgatctgggaatggggttttgggtgggggggggacaggatggcgcgtccctttggatagtgcggttagggctgggcttgagggagaacgctcatgtccaaaaatggtaacattcattcccttttttaaacttaaaaggggggtagtttatagagccgactgaagttttttttttcagccaaaggcatcctgtattagctcactcaggaatcctaggccctgaaacggagcccttttactcacttcatcagacaggcagaggtaatctaaaacacacacaatgggcttcctcaaagcaggatgacctgggccgcggtgcccaaggcctatgcagggctgggccctatacagcgacatcggtcatctacatcggacatgggaaggtcccctgacttcgaactgacttctttgtaatgtgccagttgcttaaactccccctcttcctgtcatcttcctagtaagagctgaagactgggggctgcagacagtcccccactcacttggcttatttcctgggaccatgggtgctgtgggtggaactgaaaagtgagtgagtaatttggagatccctatggggcaccaggcagaaggctctttaataatttcagggtgaagccttcttgagaatggattttaaattagaagtgagattagggtggtggattggggtcttccctgggggttagaatcgaaggagaaatccctgcttagggagcacctgctttgtgcctgggaggggcaggagtaacagagctgcctaggaactaggcccctgaaaggactgtgagaccaagttcctaggggacagacactgagcaccggcctgaacatcgtatttaatatttctgaatgaatgaatatattaaacgcagtggggagaagaatatagattcccagggctctgacctgggtggcagtgggtgtgccccaggcctttgggcagccaggtaggaagaggtggtctgggaaactgggttatcctggaggcaaactcaacagtgccaagaactggcatttgctgatatgtgccaggcacgaacaaggactaggaaaccagggccagagaggggaagtaaccagctccaagtccagactgtgtttggtggggctgggatgcagccatgtttgggactggcagcttcccctcacttgtccctccttggcaagggaggcaggaaagctgggcctcgcagccagagccagagcatctgggaaccaggagagccgacacgtgctttgggcggggttgatggaggggccatggcagaaggagctctgggcctgactctgaagattcagatccacattttttgtttgtttgtttcctgttaattctctagattatctttcgtgggcctcagtctgcagaatttctggcctgcctagttctcagtagggtgatattaaggaggtggtattacaggtgagggataagacgtaaggtaaacgtgttgcttttgacactctttctactgactgggaggcggggtttgtgtgggaccagagtccacaagtggacagaggctgatggttccagagggaggcaggggagtgagtgtgaggaggggaagaggaggacacagtgtagagggatacaaaggtcacccggtagaaggcagaagaccctctttttagctttggtgcagccatagctatttctgagactttgggcaagtctttccatttcatcgagcttttattaggtcattcagcaaatactttgtgagcactcattctgggtcagacacagttccaggtattagggatggggcactgagcaagacagaccaagttcccgttcttgtggcatttccattaggtttcctcctctgtaaatgggacacatttctgcccgtggagccctcaggactcttctggggaatcaggttaaatgatgcattgagaagtgcttccttggtgaaagtatggcctgatgtggaggcagggagaagtctgtgcaggcaggaggcatgactcaagaagctgcactggcttggccgaggcttgtccctctttcaaagaatgcttcggtacggagttcatgggctggtcgccatgcctccagacacaaaatgcagttatcttccagacagagcacgtggattagaggcatttcctctacttttccaggtttcataaccttcctgatctttgaggctgggctctgaagtcacttttcctaggagttgctgttattttcagggtgactgcagcccccagttttctcccttatgtaatttcgctcacattcttaggtgtatgtgtgtacccagtcaag

SEQ ID NO: 76379 - DNA, 1078 bp, Homo sapiens
ttggctcccatgatcgatcgaggcatagtgaaagaagggcaaagacagctttccagagctttgtgctcaggctactaaagtagttgttataggtgtgttaacgaagaagcttagtgaggagcagaatgtggtactatattcatttaactcaacccagaaccattggtcagaattggtgggactggcatcttccctcagacttgcagttgatagaggctgtggtgttctcactagactttgcagagcagtaggcatctcaaggtaacagattcttattgagtaggtctattaggagtcagaaggtgttggggaggagtctctggcttatgactcctggttcccattagtcttaagtcttctggttcccataaaagactcagttttattgaggtagatacaggtttagaagagaaaagagcaacagattttcagcgttgcagtcactcggttatctatgaagggttgtgcaaaacaggaaggtctgggaatgaccagatatcttgttggcataaatgttatgaaaaggcagaatactggcaagaaatgaggaagagagagaaaaacaatataactttcttgagtgcaaaggtgctagacaactaggagcccagctgggattggtgtagggagggccgaacgctgactagtgtggcctcactgccccaggcttcctttcagaggaaggcctgtcctgctggaactggagccaaggggaggctgcctatgaaggcagaagatgtggatgaattcaggcactgggggtgggggggttatttataaacacaaggtggttggtttaagccaaaaggagataccatcctgataagctctgtgaaagagaagatgtgcctggtgtgtgtaatgcggctggggtatgaaaacactgagaaggagatgaaggagtgtgtgtagcatgggggtgtgtacaacttaacacctggacttttactgggggagtgggaaagtgattctgtaaccaacattagaattactttggatttgtaatcagattggttctatgatttgtctttgactattcacagataattgtaaatgctggttttataagcccaagtca

SEQ ID NO: 76380 - DNA, 1050 bp, Homo sapiens
ttcatttgggaaaagtggtacctctctgtgcacagcttcagtcttctgaaagtctttaacaccttgggaaatcttcaagtcatcctctattctccaggattattattataatgtccaactactaatagatgaaactaaaagggaggaagattctggtggagaaagtatgtgattaccctgggccaagagacaggacttaggtaggtctcttgacactaggctaatactgtgttctagaccatgcatttccccacatctgattctaaaaacctcagttttcatacataacccacatgatccagtctggtaaagaacttatttttaagttggttagcaagtcctagttaaattacagggagagtctggggaagttctgccttggtgttctttatcaccaccagtgaaagaatactttccagttactccttgttgcttttgtttttcattttctgttcagatctggagcccatacaagcagccaggatgtactggagacctcgacggtcggattgaggacgattcccgctgcctctatacccatgaagagtacatcagccttgtgctgaacagtgggagtggcctgtcgcatgactacgccaaccagtcggtccaggaagacccccggatgatggccttctttgactcactggtacgccgagagatcgagggctggagctctgactcagacagtgacctcagtgagagtactatcctccaactgcacgctggggtcagcgagcgctcaggctacactgactcagagtcttcggcctcattgcctcgctccccgcctcccacagtagatgagtctgccgacaacgccttccacctggggcccctgcgggtcaccaccacaaacacagtagcctcaactccaccaacacccacgtgtgaggatgcagcctctcgccagcagcgtctgtctgctctgcggcgctaccaagacaaacgcctcctggccctttccaatgagtccgattctgaggagaatgtctgtgaggtggaactagacacagatctctttccccggccacggtcacccagccccga

SEQ ID NO: 76381 - DNA, 1071 bp, Homo sapiens
tttctgagatgactgtttatagcttttagagtttcaaaaaggtccaggattcaaaaagagttataaatggctgatttaataaagttatattccggaactgagtagctgtactgtctggccccgtggtctagacactgcttggacaggatgtctcacctgctgatgaaactcctacgcaagaagatcaagaagtggaacctcaaactgcggcagtggaacctaaagttgcagggggcctcaaatctgaccctgtccgaaactcaaaatacagatgtgtctgaagaaacaacgggaggtggaaaggttaaaaaatcaaaacattctatgaatgtgggcttatcagatgctcaaaatggagatgtgtctcaagaagcagtggaaaatataaaagttaaaaaatctccccagaaatccaccgtattaaccaatggagaagcagcaatgcagtctcctaattcagaatcaaaaaagaagagaaaaatggtgaatgatgctgagtctgatacaaaaaaagcaaaaactgaaaacaaaggggaatctgaagaagaaagtgccaagtctcctaaagaaacagaaaataatgttgagaagccagatgatgaagatgacagtgagatgcccagcctgcccctgggactgacaggagcttttgaggatacttcatttgcttcttatgtaatcttgtcaatgaaaacactctgaaggcaataaaagaaatgggttttacaaacgtgactgaaattcagcataaaagtatcagaccacctctggaaggcagggatcttcttgcagctacaaaaaccgtcagtggtaaaaccccagcttttctcatcctgcagctgaactcattgttaagttaaatttcatgcccaggaatggaacaggggtccttattctctcacctactagagaactagccatgcaaacttttggtgttcttaaggagctaatgagtcaccacgtgcatacctatgggttgataatgggtggcagtaatagatctgctgaagcacagaaacttgctaatgggatcaacatcactgtggtcacaccaggctgtctgctggacca

SEQ ID NO: 76382 - DNA, 1047 bp, Homo sapiens
tgcagattcaggaacactattgtgtacagatgtggcagcaagagaactggacattactgaagtcaactggattgttcagtatgaccctccggatgaccctaaggaataatattcatcgtgtgggtagaacagccagagacctaaatgggagaaggcatgccttgctcattttgcacccagaagaattgggttttcttcactacctgaaatgatccaaggttccattaagtgaatttgacttttcctggtctaaaatttctgacattcagtctcagcttgagaaattgattcaaaagaactacttttttcataagtcagctcaggaagcatataaatcatacatacaaacctacgattcccattctctgaaacagatctttaatgtttaataacttaaatttgcctcaagttgctgtcattggtttcaaggtgcctccctttgttgatctgaacgtcaacagcaatgaaggcaagcagaaaaagcgagtaggcagtggtggatttggctaccagaaaaccaagaaagttgagaagtccaaaatctttaaacatattagcaagcaaacatccaaccgcaggcagttctctcactgaagacatgcctttctttcatcttgaataactttgtcctaaaatgattcttttcctcccttgatttaacaggatttttgtagcctttagaatttggacttatctaacaagagtataaattgaattcggttgcaagcactgaacactgttacttctatcaagtctctcttatttttgggatataaaacaggctttaattttcttggttgcccaagggcaaagtaaggaatatctcatctttcttgtgatgatataatattttaattttaaatatccctccctcatacatacaaatgtatgttactgttttaattatttttgtacctttaaaaaaaagttatattccctctaccttctctttacaaaacagaaagtctgcccccttcctcaaaaaaagtttcctaaaacattcacgctctaaaaaagacatacaaggaattcctctgccacgacatt

SEQ ID NO: 76383 - DNA, 1023 bp, Homo sapiens
agcctatctcatgcctgattcctgtgccttgtgccttccagttctctcctgcgctatggtggaaacctgtccctccaaagtgccatgagtgtacgattcaacagcaacgggacccagctcctggccctgaggcgacgcctgccccctgtgctctatgacatccattcccgcctgcctgtgtttcagtttgacaatcagggttacttcaactcatgcaccatgaaaagctgctgttttgcaggagatcgtgaccaggtaaatgctgtctgcctcctgcatctcacacttatgcttttctttctgattgttctttctatactggtctttatttctcattaccattatgtcaggtagaaacaattaaggggaaacagtgagtgcctggagatgttctgacttaataatagtgagtttctttatcaaggctgtcaatgggtaaatacaaggcacacaccataaaccaaggctggccacgatatggttctgagccacctagctctgccaagtttgtgaacagattttaagattctaagaatgtgccatttcagaagaaaggagagggaatccatggaaaattagcctgctggtgagagagacattaaaaaaaagaaaccaataaaacacaatgatgaatgaaacaccctaagtaccatccaagagacatgtatcttgaatggcctcttgggatgccatctttttcttggatgaaatggggtaagcagctttgtttgagagggagccagatgctgactctttttctttttactgccagcatcacaactggaaatggagagcccaagctgtgagtttccagccttttctgagtctcaccaggaatggagatgctgatgttgacttaaagctggcagtttaagaatatacttggccttcttgcacctttctgtcttaaccatagaagttctgaagtgtcagtgaccagttgggctaatctgggtcaccaagccgaggaaagacaaatgggaagaaagacaaatctaaggaaagactgatcaaataaacaaa

SEQ ID NO: 76384 - DNA, 1020 bp, Homo sapiens
gggcagactgcttccaagctttgccttcccggcaaaccagatcatccttatcattctcagcaggagtggccagctgtagacccctgctgataaattacagttaatgtaacttactttctggatttcaggtgtcatttcatccctctggaaggaatagaattttgtgacaaaacatgaagttttcagtgttggtggctgctgctctttaaatagcacccctaagcattctaggagtgagattcctttgtactttctttgtgtgagaggtcagagttccctgcccagaagcataggcaagagaaaagttagttactatcctggagcccacaaccaaattcctatagtgtgatcagactgcagatggtgggtcagggagcttgggtggggttgggatggcccacatgcctgtcctgggcagactcctctacaggcctgactagaatgggcagaggaagttcctgttaacagatggaaagggtgtttgccagaggccctagctttcctctcaaggatgcctgagctgctgcaaacccctgctgctatgggtggtgaggctggccaagtctctttctgttgactcttgtttccaacccccaactcctagtcagtcctacaaatgctggtttatttgcacactccatactgatgttggattgaaagcctctcattgtttttgagttcagtgtttagataacaccacatgcctgtcgcagccacagcaccctgtaaaggaaatgcctggtctctaacaatcctgtcattcattttctgtatgcaagagagtgtggcctgtgtttaggaccattataagggcatttctctgcagggattactacttggggcctgcagggataccaggcccctccttgatgtctggaattctagggagggttttctaagtcttccctctttactttcattccaatcctaaaaggattacaggttgttttgcccaaggcttgtttccacacatagctgcactaccagagcattccttcctttggtgagaagactgctttg

SEQ ID NO: 76385 - DNA, 1048 bp, Homo sapiens
attgttatttcaccagcttttgggtagagggcgtttttgaataagccaggccatctgataaactcaaatgactaaatgttgagtcccttattttgtggaaagtcatgataataaatctgttattatactgcctcttaatttgctttgagatcttgattggttctgtggggcttttggaacctgtgggccaaaaaagttgaagcgttctgggctctagaacacatccactctgggcatgttcctgttctggaagataatgattagaaacactgcagtgcccgccatccatatgtgcttcatgaaagggctggatatgccatttgattatataaagatttctttacagaaatttagtcaagcctttctgccaacttcagtcaaacttaaatttatggagattcaaaaagtatactgaattcatctgtatatcaagccagagaaatgtggcagtgaatcatgttctggggaaaataaatgtgttcattcacagatcgcaatgtgtcttccttgggttggttgtccgacagttctggttccctctggaggtttcagtcttgggactgaggagtgcattaggaaaacaaaagagaaagcccaggttcttcatctcccttccaactcacataaaataaatggttaatggattatcgggactctaaacatacttgaatgcgaccagtgtggactgtgactccctgaacttgctgactttttacctagttctagtatcttctaggatttgtcatattctgtgggttgtattataggaaatacaaaacatcccatattccttatagatcatcctgccttaaatcagaaactgtgatggggagagactttctcccatagaaaggaccttgcttttctctctctacttgggatacgacaccagctctgatgtctgtgagttaggatagtagtgcctcgaccccaagcattccaccggtcttatagagctttcacgtggaaacaatgaggaaattcatgccagtggtctttggaaaatcttgttggtaccaccaggtgtatcagatggattagttaatca

SEQ ID NO: 76386 - DNA, 1029 bp, Homo sapiens
tacccaataagcatttgaaaagtactgaactttatcactcatgagagcagtgcaaattaaaaccacaatgagtgtcagtatacacctagagtgtttaaaattaaaaagacttatagtattaggtgttaacaagggtatggaccaactgaaacactcatacattttaggtgagtacaaattggtacaaccattagggaaatctatttgtcagtatctactaaagctaaacaccataactccatgacccagcaatctcactcttaagtatatctaagagaaatgagtacctatttccaccaaagacatgtacaggaacatttacagctgctttatttataatagccacaagctaggaacaacctaaatatccatcaaaagaaaatggaaaatggataaataaactgtggaatagccatacaatagaatattacacaaacataaataaacaacaaactataaatatacacattgacatggatgaatctcacggtcataatattgaataaaagaattcaaatacaaaagaatctctgtgattccatttgcatgatgctcaagaacaggcaagttatggaagtcagaatagtggttacctctgggtaaggtattgactaaggaaggcatgagggaaacttctggggttctatatcttgatctgggtggcaatttcatggttgtatacctatataaatttttattgagcaatgcccttagaattagtgcatgttatcatattatgttgtatctttttttttttttttgaggcagagttttgctctgtctcccaggctagagtggcgcgatctcaactcactgcaagctctgcctcccgggttcacaccattctcctgactcagccttctgagtagttgggactacaggcgcccgccaccacgcccggctaatttctttttgtatgtttagtagatatggggtttcaccttgttagccaggatggtctcaatctcctgacctcatgatccacccgcctcagcctcccaaagtgctgggattacaggtgtgagccac

SEQ ID NO: 76387 - DNA, 1026 bp, Homo sapiens
agagatattttggtctacctgatatactagagtttgaaaaattacaaagtaaaattgtagtttcttacatctcttgaaaaagacaaaagatctgatattgtcggacctttattctcatatggcaatagtcagccaaaacctttatgatgttagttaagggtcccaccacttcttgatgtcttaatacaggtgtatccctcatttacattacttgcctgaccctgtagacactggagttggaaagttctgctttagggattttagtggtgatgagtggtcactggggaggagaggcttgagtgtaggtgactggataaaaaaacatttcacacttacaagtgtacattgcatgttctgacaaggtttcatttatttcatttagatgatttctgctgttttcacaggtaacctcctttctcactgccagtgtcccagttatatctatcttgggctgttgcagtgccctctgaacacttttcagaactgagatcctctaatgtctagagaattcaggaaaagcaaaagtttcccctgctctcactctacttgtctcatccttttcattgccggttttagctgtctgcttactcactacctctctcccttccaatctctttattttctgtcaggaactgttagttctatgacagataacagtgtcttgctttgacaaggataataaagagagtggttttttccccactcaataataaaactggggcaagccgagaatccctataaagacttatcttataagacggtgctttcacttgtgtaaatgacacatctgaaaatgggcaatgagagcaagttcctactatcgggaaattgctcttaggttctctctgggtttggggacctctcagttaactgtctgttttttggggcctgggccaatcctacttctatagagaccagattaaatgaaactctgccttctgaacaagccagacaatctctgccacattgcatttgagggttgctcataccattataggaaaataaagcccaggggcttaatgtcaa

SEQ ID NO: 76388 - DNA, 1015 bp, Homo sapiens
cctataactgcaggtaaaattgtatggcttgtgtatctgagtgaacacatgtcatattttttctagggatggtagaaagtttttaccaagttctcatagagacccttgactccaaaaggataagagttgcttggtgttctgattaccctaggttttaaacctgttgtggttccttatcaggtttttaaatgacttctagcttgtaattgcacaggcatgtgggtgaattcagggcctgctgtcctagaaacagataatctccttggagcagtgatgaaggtctcaccctgaacaccttctccttcctggcttaacctatgtattagtcaatgcttgaatgatttccctgtcttaccccaagcctacactatacctctccacttggtagcctgaaggtataggaggagagtcatttttgtcccactgctgccctgaaataagctgattagagggctggctggcagaaaaaaaaaatgtcagctctaaagaagacttgaattataatatgatcagacttcctcattgtacagattaagaataagaaactagcccagtgaggtaaggggaggaagaagagcttgatggtttagtgtaggaagtataggctctgaagccatacttcttggttacagatccaggtagtacaccttaataggcatgtgatcttgaataagttacttcacctctcagtgtctcataataataaataataactaacatttattaagcattacgtgccatcggagtattgaccatcatatgaataattacctcatttaatccttatgataaccctatgaggtagcttctattattcttattttaagaaaatcaaggcacagagaggtgaaataacttgtgtgttatttgtgtgtgtgtgtgtgtgtgtgtgtgtgtgtgtgtatacatatatatcatccttcccctttcccctgtttttttcttttttttagtttttatttttagagacaggatctcactatgttgcctaggcctcagcctcccgagtagatgg

SEQ ID NO: 76389 - DNA, 1694 bp, Homo sapiens
gtggaggtggagatttgccaaacttgttgctgctgagtcagggattcttaagcctaggttggaggggatccctaagagggcttaaaaaatactgaactgccaaaattatatgaaaattatatattgtatattcaaataagtgcattttctgtttatcaaaaggactaatgacctttatagtgacaacaacaaaaggttaagagccattgcactgtggtgttcaggacctcatgtgtttctccacatggcactatgaaaagagcatacttaagacaaacctgaatgatggcatgaatcactaatgggggaatctcaggcatcattaaaggatgtgggaatgggggtgagtagcaggctcttttatgttccttaagtcccatgggggagggactactttttatggcacctgtacataaagttggccatgctgtattaaaaaacttccgtgtattgctagctagctcctctggaaattctgcatagatgtaatttcccacttcataaagcagtgttgcagaagaatatcatggaaactaagtgatgttataatttatttcacgggcctcagatgaaaggagtagttaagtacagaagattatcttccttgatgatttttactcctaggtgattctctccatggggcagtaagagatggttggaactattgtagcagatcggtgtagcccagaggtgtgtccctgtcattgagcaaggctccctaagcttcctcagggcagcagagatttctcctgccccttctgttgcgtaggcacctggctcttgcttttacagtctattgaaatgtgtgtagtggcaggacccctgatgtgcctttgcactatgaactttaggaggcttgctgtctgccaagaagacaactgtgttcatctgcagtgttctctgctacttcaggctctttaggaacaactgttctgcctcatccgtattacaaaaggcaggatttggacaaactgcaccagccttctctcaacctactatctctcctacttataattgcaatgaatagctggcaactggagtggggcactgagctgtttatctccagtggaaagcttgagcaattcatggtgtctgcagtgtcttgagagaggaggggagtgtggatattttaattctcccaattctctcccattctcttccaccagtttcttaccgtgcattatatgggccctcccccactttccacttgtctcctcactaataaatatagtttctttcttgttaaaagaattgaaagtgatgatgattattgtatttttacagtgacatttattggtttgggggttttatgcagaaaaaaataaaaacaaaaaaacaagttccatctccagattatctctgttacttgtatgtttttaaaatgtttgtctatcagtacagttctgcttctttctagtgtctgtagtcactccagaggtaactacagtgaacagtttcttatctttccagaacttaatgtaatgtatatacgactatgcatatgcatcctttaaaaaaattgagacagaaggaagcacgtagtaatactcactgttctcgatttcttttttaaattaacaatatgttttggagccttttttcataccaacactaacagatctagccccttcttttaatgactatatggcattcaatttatatgatgtacccaacaaccagggcttcttgtttcc

SEQ ID NO: 76390 - DNA, 1129 bp, Homo sapiens
ttgatttgtcaatgatcatttagtgtttttcttgatggccacagttttgttttgtgttgtttcccccctactttttttttttttttgagacagtctctctctgttgcccaggctggagtgcgatcgtagctcactgcagccttgaactcctgacctcaagcgattcttccacctcagcctccttagtagctgggacttcaagggtgtgccaccagttggctaatttttttatttttattttcatagagatggagtctaactatgttgcccaggttgtagccacagttgttttttttttttacatcatccactggataatacacattgggaactgttactgtgttatacttggatgccattattttttaaaaattctctgtaagaatgtcctatccttcttaaattatttctataaatcttttttccagttaacacttctaatttgtattagcattggctttgttcatattttttccctgaaaacttaaaaatactaaattgtaatgtggacagggaccaccttgcacgaatgatcagatgtctgcttttttcttttgcaggcaatgatgagcaagttatcctccatgatgttgaaaggtaaatagattggtggtgtgtgaaggtgattgactttgtttttcatatatgaagaggcaaatatctctttagactaaaatagtttttgttttttgaaaaaaacaacatgaaaccagctgttcttttctaaaaaaattcctacaatagtttgaaataaataaagttttgatttaaaaaggaaaaagggatttgaaagttttgaaagttggtatgagagtgtactttttaggtgaaaatttaaaacaagagtttagaagagaaggaaccataatatttaagaacagtaatagctaatattgattgagttcttactatgtgccagacaccattgtaaatgctttgtacatattcattcatttaatcctcacactcattttctgaggagatactattgtcatctccgttctagatcaggaaacggagtcacagacatgttagataacagaaggtcaggtggtactaaaacctgaacttaggctatctggcctcagagccatgctcttcatcaccatgccagattgctaggagaccc

SEQ ID NO: 76391 - DNA, 1067 bp, Homo sapiens
agtaaacaaaggagcaaagaggtaaaatgatttgctcagtaggttacaactagtgagtagtacaatcaggattaaactctgggtcttctgaccttttccctcaatagggaaagtcatgaggttctgcatttaaaaaggacttgctcaagtaaagtgttaaactcctaagtggcttactctgccagtacattgtatctgcagtttcattgcccctgaacatggttttgattaaattggtgatgccctattattttacagatgagtaggtagagattttccagggtggaggccaactgtcactctggttgagtctccagttttaattcttagcctgctgagctatacttccgtactttggaaagtctttgtttccttccaagaacattactcaggaggaggaattctttgcaaatccagatgcctgtcaaaatcttgttacacaacttcccccatgctgaatttccattcaagtcttgtatctaaattccagttgtatcttggtgttacaagttaaagctaagtgactaattggaacctttgaggattgctatgttccttttttttttttaaataggtgtcttgactatgttgatggcttagcacagatacctcatttatatcacttgctgccacagatgactcaagtgtgtgctttgccttagacatacagtagtcccccctcatctgtgggggatgagtttcaagccccgcagtggatgcctgcaactgcagatggtactgaaccctatgtatactatgttttgtcttatgtatacatacctatggtaaaatttaatttataagttaggcacagtaatacattaacaacaatagtaataaagtagaacaattataatattatactgtaataaaagttatgtgaatgtggtctctgtctctcaaaatatcttgactgtaatattttcggaccctggttgactaatggtaactgaaactagaaagtgaaatcatgggcaaaggggcttactgtactggcaagaaacaagtgaagtttgagtgtttggcagctagcccctgatttagtctcagggttgacatctctgttt

SEQ ID NO: 76392 - DNA, 1150 bp, Homo sapiens
tttatatgtttgtttaaagtttttttttttttttttttgcgaagaaaatgaacatcttttagggctctgattggatgaccaatcagaatgtatctctatgtgcatttgacttggattgttactccgcctttttatatgttgtaaagggcttgtgcaagtcatcttagcagtaaacaaaaacaaagatttggctctttggaatgagagtggctatattatttcccctgaatcgaagtttaaggcattggaacttatagagctagcagaataacccataagtatgaagttttgagttatagtgagagattattatcttttttgtgtgcttatgactaaatataggaaaagtacctttagaagtttttcaaatagcatgagcaactatgatgtttcaaagtattaattatgtaggagttgtgaatggggagagtcatttagttgcttggtcataatacttataaatggggataactatttagcctatttctagttcaaatgggtctctgaccatattgatcattataaggagccataatctatatagagagattgtagagtatgaactctgaagtcagactgcctggggtgaacaccaacccagctgcttggtacctgggttgcttttgacaggtcacttatcctctcttgtctgtttcctcacccatgtaataaggataataataccctacagggttgtggtaaggattgaatgaaataacatttgtaaaattcttagcacaagggcctaacccatgctgttgctactgctgctgcaactgttgttgttgtttcccttgaatgtcacaaaaggctttcaggagattgataccttcaacatctaacatatactgcacatggcacagtacaccatgaaatattgagaaagatctccatgaggtgaactgttcaaaatactttgtgaataagcttaaccagtactgtcatcaaagagtatttttaagcattgaataatagctattattacacctatatgcttaatttgaacctattaattaatggtcatttcctgtttcccagtcactagtttatatcacgttttatgaaatcagttttttgtagataaattagtctaaaagcacattatctgcaggtaagtcgtttggctttagccagttaaataaagcctgac

SEQ ID NO: 76393 - DNA, 1037 bp, Homo sapiens
ttgggagggatgaagggggaacccagcgctggacgtggcgcttagcttcacccaggtcggtccctgaatgtctttctaatttgtgtccgtgagcagctcgccagaaacttctgggatcttggcaaagcatccgtcttcgcgagtaaccttcggaagtgacatggggcgtacagtccaatttgggggtagcaaagagaaaggtcttctgtgatcattttatgataaaccttctggggtctgtccagaactgacttgacttttgtaccccagatcgttttctctttgactaggtagattttggccctagatcatcctctgaagaaacctgatctttcagacaaaagcctccttcccccacagcaccgtataaaattttatcaaataaatttgaagagcaaaaatgggggaagacctcttctttatagacctagctcccagtttccctgctgttgttttttatgtattcataaaactcccgatgtattacaacagagaagttcccagacacaagtaaactttacctaccgagtgagggagtttgggggtactcttttagagacaactgaactaatcatgttaacggaattgtaagtagtcacacgttgcccagcttgacacacctttatttacgtatttatttgagacagggtatcactctgttgcccaggctggagtgcagtgggctatcactcactgctcactgcagccttgatctcccaggctcaagctaacctcccacctcagcctcccaagtagctgggactacaggcaggtgctatcatgcccaggtaatttaaactttttttttttttgtagaggtggagtctccctatgttgcccaggctagtcttgaactcttggccttaagtaatcctcctgcctcaccccgtaaagtgctgagattgcaagcataagccaccatgcctagctcacactttaaaaaaaataacaaatttattgagataatttccatgccacataatttatctatttgaagttacatttttaaaagcacgaaatgttctttaccagttatt

SEQ ID NO: 76394 - DNA, 1442 bp, Homo sapiens
aaaaaagtctccctaccaactgactgatgattacaattttttttaaattgagaagcagttttccttcaactgttaggtgatcaaaggtttaaaatacaaaatactttgaagaagatccattaactaaaaaattcattcattaatcagcagttagaggtgagagtctagcttattgtttttttttcttcctagatcacacttcattgtgtacatagcctgttgttttgactgatatgattttatatcattaagagagccatggggaactgtcagagggcagggagatttcctggggtgaggatggagatagagatggaatacagagattataaagatgaagaaattaaaccattgctactatttcacatggaaatttatagcagttgttttagtttgtgggcacagagattataaatggggcattttttagaggaaaacttgtttatgtaaaggtttatattctgtatataaatatatttttgccatttgttttgcagattgtgggattagtgatatgcttttctaaagagtagaaaagtcgaagatgtctagacagaacttagtggctttgacagtgactacccttctgggtgtggctgtaggggggtttgtcctctggaaaggcatccagcgccgccgaaggagtaaaacgagtcctgtgacccaacagccacagcagaaagtgctgggcagtagagagctgccccctccagaagatgatcagctgcactccagtgcccccagatcctcgtggaaggaacggatccttaaagcaaaggtggtgacggtgtctcaggaggcagagtgggatcaaatcgagcccttgcttagaagtgaattagaagattttccagtacttggaattgactgtgagtgggtaagttaaaaagcaaaagttaaaaaaaaaaaaaaaaaacaacttctgcttttccaactgggaccttggacagtcaagtagaaaataaggttaaaggagaatgaattagcttgttctcaacttgcttataagcagattttagcagaagaagaagctgctgttcctctcaggatggcggagtgcttacaattatggattacaattatgtcaaacctatatgaattgtattttccccacttatcattccgtgaacttggacaagctatttagcctctctaagtctttgtttgtttggttgtttgtaataggaacgtcatggtacctacctccagtggcttttctaaggattcaaatagatcacccccataaaggattcagcacagtgtgaacatatagtagtaagtgttcatgaaatattagccactgttaatatttgtagtagcattttcataaggatgccgtggagaaaatagctaaggaattctatttaaatggaaattattacttaggattttaaaagataacagttaacatttgaaacatcatttactctaagccatgtact

SEQ ID NO: 76395 - DNA, 1033 bp, Homo sapiens
tcaaactggcatgctttcgtgtgaggatacgaaaatagctctcactgataaagcagtgcctaagaaggaagcgtaagtcttttgtgagttagatcatggttttactccgccttagaaaagaagttgagggctagagggccgggcatggtatctcacgcctgtaatcacagcactttgggaggctgagatgggcggatcatttgaggtcaggagtttgagaccagcctggccaacatggtgaaaccctgtctctactaaaaatacaaaaattagctgggtgtggtggcaggcgcctataatcccagctactcgggaggctgaggcaggagaatcgcttgaacccgggagggagaggttgcagtgagctgagattgcactactgtactccagcctaggcaacagagcgagacttggaaaaaaagttgagggccagagccctcccagtttttttttttttttttttaacagcagttcttttgtgatcttgactatttcctctgtgtgattttggtcacttcaattatgcaatgtacctcctctgattaattgtgacactttgcttgaaacattcctttggcatttaccatgtcattttctgtgtgtgtgagcttgtgtttatgtgtatccctcctactcctcctgtaagattataaattccttaaatcagcacgctctcttccattactttgtatgcaactgtggcactgcaggcccagcaggcagctagtacagtagcaagaggaccacattgccctagagcagagtttctcagcctccccgctattgacattttgggcagatgattcttttttgtacattgtaggatgtttagcagccttctggcctttacttactagatgcctatgtacttcctccccacttgtgacaaccaaaaatttttccagatattgccaaatgtctcttggggtacaaaattaccctcagttgagaactactattctagggactgggaaatttaggtgatagtgtgatagccctagctttgccatgatctcaccatacttggtcaaac

SEQ ID NO: 76396 - DNA, 1627 bp, Homo sapiens
ggtcccactggctaaattatggctgcaaagggtttttggttttcttttttcccatatgatatttttgggaatttttgtttaaatcaagaatatttaatgtaaaaatctgtatttctggcttctcttgaaattaggtaatctgactacactgagtctacagttctagatggcagcatttggctgggtagcatatgtgccctttagatgagcgtgctctgttcagtttgccagagtccccaccactcccattgtaaccctggctcctcctaataagcctttgagtttgtagagcctgctttaggccaaaaatgatggtagaccagcccttatctgggaggaagagagatttcctttagaattttattcctatggaaatttgatttcagcttgtctttttggggcggggagtcgtaattacctcctcatgtttatgtatgggtcctcatttataacaacgtggactgaaacagcctcttgccctgcctgaagtgacacagtcactaaaagtttggagatttggtaaactaaaagaaggcctgattaaaatctgtacttatcacaattttttagtataaaatgaaattttattttagtttgttagtttggcttatataaagatcttataagtgaagtataattttttaaagtaatacattaagatattgctgtgaaaattaaaactctgcgaaagtctatggagtataacagtaaaagccccccttcatcaggccctcctttctttggcaccagctccccagaatgccactgtcactgtgtgctgttagaggcagtgtggatagaggctaaaagctgactcgggagcacactgcatgggtaggagtctcagtgctgccacttgccagctgtatgacctttggcacagtactaagcctctctgttcctcagtttcctcatctgtaaagtagagttgataatgtagccacctcacagggttggtgtgagtattaaatgagttaaactacagaaaggatttataaagtgtttcacaaatagataacaaattatcattttcttcgatttctagtgagattcagtatgttatctctgtttattggccatttatatgtcttttttgattttcttgtccatgtcctttgcccgtttttgatgcatggttttctttgtttcttttagaaacaatttgctctgtaatgggcttagcctgaagtccctcgctgagactgttttgaactttccccttgacaagtcccttctacttcgttgcagcaactgggatgctgagactctcacagaggaccaggtacttcttatcagagtagttgaagaatggaaagtcattgtttctgaagtataactgtttataaaattcgaattctcaaatatagtataagtattggatggagatgccttaaaatagattcattctctggtgatactccagctaactggtctacaataatcacttaaataaaggataagagtcctgcttttgttttatttttgagatggagtctcactctgttgcccaagctggagtgcagtggtacggtcttggctcactgcaacctctgcctcctgggttcaagcaattctcctgcctcagcctcctgagtagctgagattacagatgtgcaccaccatgcct

SEQ ID NO: 76397 - DNA, 1054 bp, Homo sapiens
acctccaggtgtgagctaccgagcctggccaagagtcctgattttttttgagcatttactatatgttgggcatttcagaaaaagggattttttttatgaatacaaatgtataatttaaaaaaaatatagtgttataagtgtgtaggagttataacttattttaagaagcagtaagtagttccctgcattacctttccccattcctaatccttcttccttcttctcctcagaggcaaccactttcatttctttctggtaattatcattatacttctaaattacatgcatgcgttattctttcttatttatttatattatcttttgacatcatactgtgggagatacggtttagtactcttgcagctcccctgtccccggacaaatacttctcttccccatcctcccaatttaggtaaatcatcatttttatcaggttaatatacagtatttatattatttatagctgagtcacatagtaaactgcagttacttttatttcccaggattaataattagtattttgtttgcatagtgttccatgtacctattatttccaccccagactccttatcagaactatggatctcctctgggctggttcagacacacgtcaggtcacttacttgtttcattttcccttggagccttctctcctagagccctctatcatctggctcctcccaggacggagtgcactctaggcctgctgcccaactctcatcctggaatttgcatttaccatcagcctggaattcccttcacctttctctttcatagtagatcctctgttttttaaattccatgtcttcttcctttcttgccttggtggagtacattcataacagtttcttgagaaagggagcatgagcagtaaaaaaaaaaaaaaaaaaaaaaaaaaagtcagtaactgtcttttctctcaggtgacttagtttctccacagatgaatcttctagtattctattcaagaagtgtaagtcccactgcctatattccagtcactgagtgggggaaaggtgccagtggttttaacattcaatgtgtaatctctccc

SEQ ID NO: 76398 - DNA, 1033 bp, Homo sapiens
gtggaaatgaggaaagcttagcttagttctgtcattgaccctgatgtgaccttaggccttaacttctccaactgtaaatggggatataattatcattccttccttgtttcaggctagctgtggaaaataaataacatgtagtgcctcatacttttcaggagaaatgcatcatctgatttcttgttcatatgttatttgattatttagaatgacatccagctccaagaaaatgttactctctagccaatgaaaaatgtcctgtataacttattcctctattgtaggaagatgactaataagtactttggagcataaatttggtccctgtagcaaagtgcctttaggaattaattggatgattaaattgaaggaagtgttactgcatgtgagttagaagtaaatccacatggccctcattactttggcttgaactttaaaatttttaatgtactttgtttaatccagtgatttggcagttttcttgttgcttggttcttttttgcattcacagcagagctgtgtgtaaaccacttgacacactccctaatgtcctagtccataagtgtaaaaactagaggcataaactcattcatttttagttctgtttcctagcccagtgcaggtgaggattaaacatggtttctcactctgttttttccatagtggtgtgtttgaccttagtgttgagaatagttttgagtcactcagaagagagcatgggaaggcaacagacattttgacccacagttagcttccggtttgagatttctctttcctttccctgcagaaaatcacctctttatgataactgctttctccatgctcctgatggacagcccctctgcacttgtgatagaagaaaagctcagtggtacctggacaaaggcattggtggtatgagattcagctgtccttgtttatctctaattaggtgcattggatgctggcaggagtggggagtgagataaggaagagggagggatagaagaaggcagagagaccgtgagatgcatgggactgggtaggcacaacc

SEQ ID NO: 76399 - DNA, 1108 bp, Homo sapiens
caacaccatactcagtaatggtctgtcatggggacagtggttcccttttgctcatgaaagactgaagaccagttccttcagaagctgtgtccctctcatcctctcttgactggctgaccagctttttgagccatggttttattcatggagtatccagatgtcctgaagcctgctctgtgttgtaatactgtttcacatcagggcccctgcactgtgagggtgaggctgccgactacgtctgagtgcccagacacttgggctttctccctggcttctgtggagtcactcactttcctcctttctcccctgcaaagtgagacaaagtcattgctgccaagagtttttcctgagagcttagttctccttagaaaataatgatgaacctggtgaaccagggaaatagattaaggtattcctcagatgaaggaaattggctttttcaggttcctaggccttcttgagagagttgttttccagttgtcaaaggccattagagtatcttttcagttctctgagactttcccttctgggagcacagccttctcagaggttgttattaacctgtcactatgctggcccaccactgaagcccacagcaggtggtctgtacttacttgcaggagagaggaagctaagacacagatgggctgagagtggaataggtgatactgcctttctgtgatctgtgttgggcggtggtgcccaaggcttctcagtcatggttaggccccagttagaaccccagtagcctgtctgctgtcttcccatgtgctctgtcatacacttatgagcgctgctttccggctgggcttgttccaggaagaacgtgattccacatgagtaccggaagcacttccccatcgagatgaaggaccacaactcccacgatgtgctgctgctctgcacctcctgccatgccatttccaactactatgacaaccatctgaagcagcagctggccaaggagttccaggcccccatcggctctgaggagggcttgcgcctgctggaagatcctgagcgccggcaggtgcgttctggggccagggccctgctcaacgcggagagcctgcctactcagcgaaaggaggagctgctgcaagcactc

SEQ ID NO: 76400 - DNA, 1743 bp, Homo sapiens
tgaaggtggtgcagtgtcacagccagggtggcctgcgctccctcatgcagctggagagccgctggcgtcagcacttcctggactccatgcagcccaagcacctgccccagcagtggtcagtggaccacaaccatcagaagctgctccggaaattcggggaagatcttcccatccagctgtcttgatagctgctttcctcccagttaggacaagtgggaagctggagccaaggttgaagagtcacctcttcccattttagtacatcattaattgtcaaagcctgtgtgacacaactcagaatactaacctagactaatcccaggatgcttctgctggagcaaagatattgtttgaaggagagtttatggttttggattttaaacgggcagggtcttttttcctctcatttttgtggacaagagaggccttcgcctttatttttactctccctcttctgctgtccctgtgcagaggaaaaatgaagaattctcccagaagtgacttgtcaagacttaaaaaaaatgtttttaatgcatttcttccttgtctagtgcctcggtttatctctaacaggggctgtccagtatatcggtcctgttaggaggggagaaaaagttcttccaaaggctggagaagtgaacaaggagtcaaatttattttcccaattcaacttcataattatcatttctttggcttcatgctctcccgtaactcatgtggttgggatccatcccatctgggtcacttcagtctacttcacgtacttgaaaaggctttcctttacacttccaggaccaaacagcaacttcctgccacacacttccaccctatcactgggagaaatccttttctggacatgagcctttgacctgggtggggcagaaagaaccacaaactccatctcccaatagaactttgaaattcactcagcttttcctttcatgctgtttgttgcctgcttgttgcactcctcctgccccagaactgcaagatttttagcttcacccctttctgagagtaatgttatcttttatcagaatcagtatcagttcccctgtattctgtgcttcatcgaatttgcaagactgacctcttttaagcatttaattcactcccagagtcatctggtcaggttgcaatatgaggacttctctgtctcctctgaagcctgggacactgagcttacttaatacattagatgttcaaaagaggagcgttgtttcatctttcaaaatgttaggccattactttgagtataaaatcgacttattaatgattagtaatttttctaaagtattgggaaaactttcttattttataagatcttaacaagcttaaaaaagaattttatgaccagaatccaacaagagctctattttggaattgtgcccaagttggtgatgtttactctaaaattaataataaaactacttgtaagcacaaggctcactggatgtaaatgtaaaacttcgcgactttataaaactggcattcctaggggaggggctatttatcctacaggtccctgcctcctggcagtgccatggtatgtgtgcatggatataccagacacagtcaccatcggccatcagtagcagcccatgaacccacgtgcacatcctgcatcttgctcttctgacccttcattcccacttgtcttcaggcaggcatttctgggatctaaactagaaatccttgaaaacaaatagtaccagccactttgaggaatgtgcattcactgta

SEQ ID NO: 76401 - DNA, 1403 bp, Homo sapiens
tgtcacggatagagatcagatgacaaaatgtgttctgttgaaataaagccattttaatcatgcattttagactcttaagaatccagcaggcagaaagaggttttgttcaccttcctattcgcctattagtttggggccctaacatttgactgtaagttaagttcttagtttaccctgcctctcaatttttcattcatttatttatcctttcttcctttttttccccttccttatgtctcagccttataagaagtatcattttttcttttaaaggagatattttctcagtttgctagtttactaattattatgtattttaaatggatctttctttctggtcttttatgtttcctattataagatggttattttttgagagtacctaatccccttagggatacactgagaatcagtttctgttggaagagataaactaaaagagggtataagaatgattcttgttttgattaactgttgattgatatgaataacataaaaataatacataatctccccagtactttttttttttttttttttttgacatggtctcactccagactggagtgcagtggtgcagtcatggctcactgctgcttcaacctccagggctcaggcaatcctcccatctcagcttcccaagtagctgggactacagccttgtggcaccatgcctggctaattttttaatttttttgtagagatagagtcatgctttgttgcacaagctggtctcaaactcctggcctcaagccgtcctctcaccttagctcccaaagtactgggattacaggtatgagccactgtgctcagtcccccaaatacttttgttttggaattcaggtataattttcaggcattcaccaagataccccttgtgcaagagcccagcaccttctgcctgtcccagtcctggagtagttttgcatcaggcaatggagtagggatgacgtgcagccacacagcccatgtgttcaaaagtaccgattccaccagcctgctaggagacgtattagtcactccctttgcttgaggaagcaaggccttgcttaaatgctagcatgttatttagaaaggtgggaagtacattagaccattttttttttaaccagctttatctgtggccaactctggttgaaggcccctagaaactgggtaactggaccaaatggttaatcatttgagagataatcaagaactgcctttgcagaggaacagagttgtcaaaggacctagttcatgcatcctgggttgtacccccttctgatgtggtgcaggctgcctcaaaggtcattttgtgttgtgactgaatggagataatgtcataccctccagactgaactcaaagcatttgctttttgctatttgttattcttgaatttttctctcttgctggatgggta

SEQ ID NO: 76402 - DNA, 1052 bp, Homo sapiens
cctggcagcttaggtgggggtgggggatgtaagtgtgggtcattcaggatggagcagggatcttccccatcctgaatggtctcagccatgtcatccatgcagggtcctgatgctggaatccttccctctccctcagccttcggctccagccttttctgggcagggaaacagaatgaggcaaaatgcctggtgtgttttaaatagattcttcttgtggcagccaatgagtccaacagcttggaaggtgagtgacccttcccgagagacttatgttgtgccatttctcttgtccctagcccctggaatactgaccacctcgacccctcctgctgtcctccccttcgacctaaactccagtgatgttagccatcctcctgctgctccctagatggactgtcttcaggcttttctggttttagtatttattacacttcccacttggctttttctgtccccaaagctgattttcctcgtgctatttgtccactccacccagtgcacatccccatctgctgctgcttgtctgactgtcatggcttcccgatgatcttcttgcctccaccttcccgtggcctgcttggggacagcccagccccacctgggcctgtgtgcagctggggaggcaggagaggctgctcattgcagtggcaaacactggggcctgcaatgtgaggtcagcagtcagtgctccagcacagccaggacaccccagattgagcatgggcagcgtgcagagccattttcaaaagagtatcttttagcaaagagagttaggacttcagaagaccaatgtggcctcttcccaccctatccacggagaccacttacaagacctaagcatcatgatctctggattcccagtaaggggtcatacaaaggaaggacatgaatattttttacttgctaaggggagattggctgtgttgattctggaaagatgtagggtatggggtatgtgaatggacggtagaggctcctacctcgaacaatctcggttgtggggcaagtgagagctccagactaggaagcagacctcagtgatgatggctatt

SEQ ID NO: 76403 - DNA, 1012 bp, Homo sapiens
tgatgttatatgcctcctgcattaacagctttttcttcccgttcaattattttgactggtaagggagtagaaattacacttcaaaatatatcgatggatattttcagccttgctgagagcttcaaaatatgtaccaatcctgggaacattgctttaatttctacttcccagtttcacaaggaaaatggagatatcaattataagcaccattaaactgaaggaaatgcaggaccaggactatggatctctcttcaaattctctttggtcttgtcacctgacctttttgatatggagacaaattttattcaaaccctaggtcaaggggtccatcctgggtttcccgataaagcaatgagtattcctaagagactgggtccagggacttgaattaaggcatctgacagaggcagaaaaaaatgccagttttctgtctctccatcttcacacgaggcatccagaagccctcatctctgacaacatggcctttctgccatgcctaggtgctgggtacataggcagccacccagcaacatgttcaccccagttgtgtttctggctttctcatctctacctgactggcgacgtccactctccctgagctccatatctggatttatagatgccttcctggaccgaccacagacaactcaagttcactgaacacacctcccaaattggctcctcctcctatattccccatttcagttaatggttacattacaccaaagcactagtctcctaatcaagaaacttaacacgctattctcaaatcctttctctcacatccacctcaaactgaccaccaaatcctaccctctttctctcctgcttcagtgttactgctctaatctgtgcttctgtggagctctattatatcatcttgtgatttttttttcctctgaggcagggtcttgctctgtcacccaggctggagtgcagtggcatgatcatagctcactgcaacctcaaactcctaggctcaagctattctccccactaaccctcatgaat

SEQ ID NO: 76404 - DNA, 1045 bp, Homo sapiens
agcagccaaactgggaggcagggctgacacagccggccttgagtcttcagtcctcacagttggcgagaacatttgtggttgttttggtttgggacttaggttttccatatgccagttcactaacaggcatgggtgggaggctaaggtgttatatggaatttcactttacattttttaaaaagactactcattttcggtataggtgcactcatttgtgtcaacagtctcctatttagaactgtgaaagatttaggcaagaatttcttaaaccggagtttcttagcctgaaattgggatactactgaatgaccatggacacaatacttaacatctctggaccttggttattttgtcggctgaaattgagttaaatgatttgcaaggtttgttgatcctgagataagcagatgatagctccatttctagatgtaaatacatggctttaagggggagttctcctgaaaggtgttgtgaagtttctgcttatggaggaacatgctcctgtcagtggaaggtcccacaggaacccttgaggcctcgcaggaagcccccacttacctagcagaaggggatgcaaatgatggcttttctggtagtgttctcagagagcggatgctttaataagatctaaaataatttatattttatttataatgtgtgcattttggaactgtgggaatatgatttgcctaaatataataacagaaagtgattttgtatttaattggtttaggtaccacacttgagaaagagagtgaggaggaagaagcacaaacacccacaattccctttgtcaaaatgttcagatttttttcttttctttcttttctttttttattttctcttttctttttctttctttttttttttggacacagggtctcactctgtcacccaggctggagtgcagtggcacagtcatgattcactgcaaccttcacctcctgggctcaagcgattcccctgcctcagcatcctgaatagctaggactacaagtgtgtgccaccacacctggttgatttttatatatttttgtagagacag

SEQ ID NO: 76405 - DNA, 1037 bp, Homo sapiens
cggcccatctgaggtgtgtcctctgaggttcgatggctccctcagtgcccaggtgactggtatgacacagtgtcgtgtgtctctggcaagctgcaggcaccttttttctgtggtttaggtcacacacaattccaatcccctggcagtcgtgccctgtgagatgcttcttgtcaaagttcagattttcatcccttcatcttctcacagcagctctgcctgtagcttctttaaacaaactgtatgggagggcttctgatatttcaaggtctttcatgtcaagggaagctggccttgggctgccacagcccactggggcaacccgagttgccttccaaagttgctggatcagcggtccgttccagggggcttcacttctgacgcctcacacatctgtgacctgattatttccttggaagtcatcttttcctctccctgtggaagttctcactggatagggagatgcggggcatgtggcaggcttggggcattatcccagggatgaggggaagtgcagcctggggctcagggagaaagaacacgtgatcgcctagtgatgtcttgctggggatctggtggtttgaaggggcgaagcagttaggactgagcacagcccccacaaataccgcaccaacctagaggccggatgaaggagaaccaaaggtcagggcaaacacaccgcagggaccagggaaggcaagggagcagcaggccaaagcacttctccaagtggaaagcagaggctacccacggtgatgtgtgagtgcagtcttggtggtgccttgcgggggcatgaacatggcaagggccttctcccaaaacaacaacgggacatggctcatcgctggatgcaccccggaattgccaactccagttgttttttgtatagcagagaacacagcgtcacccaactacctcttccagacaatgcagcatccctgaaccacaccggggccggggctctggaactgggactcacagcggggtgaggatgggctagctcaagacctatggaacttgggagatcagaaggccagcgc

SEQ ID NO: 76406 - DNA, 1035 bp, Homo sapiens
tactactatgaggcccggccctcggccatcgggaaggccttcggcaggtgggcccccccagctccactgtctgactccctctacccacattagcacaaccccagcaaaatacgaagtggtatgtacgccagggaaccacccgccacctccccagccactgaggtcccactctaatgggcttctttgggtcctgggagggaatgcaaccgcagagacaagaccttaggctttgaggagcgtgaaatctcatgggagagaaggctcgcttatgaaaaagagctgcctgtccacagctgcctgcagaagaacaggcatctgtggaactgcttaggagggggctgcctgcagaaagcatttggggttctgcctccactccctgttcaaaattgagatctgttagcctattttcctgtcatggactgttaggactatggtctagttaagcattttcaaaatgcagatgggttgtgaaatcaatttagtgggtcgtgaccagcatttaaaaagagagagagagaagtagaaccctatagattagattagtacagagcaggatagaaaataagagttgattgcagttaagggttagtattgtccttatgaaactcttatttccgttgtgggtgcatgtgtgtgcatgcatgtacctacacatgtacagttgcccctctgcatctgcaggggatttgttccaggaccccccacggataccagaatccacacagatgctcaagtccctgatataaaatagtgtagtatttgcataccctatgcacaacctcctgaatattttaaatcatctctagattacttataatacctaatacaatgcctacacatcacgtcatttgcatggattcaatgtggtactcgatgcgtggcgaattcaagtttggctttggaaccttgtggaatttttttttttttttctagatggagtctcattctgtcacccaggctggagtgcagtggcacaatctaggctcactgcaacctccatctcctgggttcaagcgattctcctgcctcgtcctc

SEQ ID NO: 76407 - DNA, 1028 bp, Homo sapiens
cacatttctgccaggaccatcagcaaatacccaccatgacacacgttctccaaagcttgttctaggagggcgcaggcgggcacgccccgatgccctcagtgctgtcctggccttgccccgggagaggagatggtcagggtgctggactgttgctgggtagagactgagtaggtgcccctggccctttgtcctctcccttggcgcttcttggggctgggacaatagtgtgtggtctctcccttgttgcccggagaaagcaaggacagaagcccacacaggggtcttttgggtcatgaggcccagctgtgcaggcaggcagggccaggggaaattgggcagcatggatggagaggctgaaggctgggaagagggaaggggagaggggcagcctgcaggggtagctgaagaacaggaaggaggtgagaagcccggtgacctgtcagagatgccaagcccagggtggcactgggttgggtggggacggatggtgtcttggcagcaaaggatgggtaatttgcaaatgaacatggatagaagagcagcaaagcaccaaaagaacaaggtctcttacccaggacacagtcccttccacactttaccagccccagggtctgagcccgacgctgcctcttccggtcctgtgcctgtgggtgcccacattcttagcaagaggctgcagagggatctttaggggaagattcgggcgtagtttattaaacagactccacttctatttggccatgtgtcaggctgagacctctctctcgggcattaatgaacagctagtgccctgtccctgccgccaggacccactgaaaggacgggtagccacacacatccctgagtagtcccagcctcatttgtcatttttgactcctgctttctcaaaggtttttgcctctgtcaatacagcatcatgggtggttggaaagaagggaacttcccttctggaccaagaacagcccctaagtcattagggttcaacctcacccttattcccctccccgctacaggagcccctaagtcat

SEQ ID NO: 76408 - DNA, 1434 bp, Homo sapiens
gtgatcacccgcctcagcctcccaaagtgctgggattacaggcatgagccactgcacccagccaatttttttgttgttgttttttaatcactaaaggaaccataaaaatagaaactatgtaggaggaagaacacatggtttctggtcatactctgtcaagaagtagatatgtaacatattgggcatttaacttaaaaattctaagtcatgttttctttttccactataagattgtactaggtgatataaagttcatgtcacttaaaattcaacgactgtgtaagtagctctttcagcttttcattaagttcatttttggaaatgtgcacatctatgccatcattgggcagttataatttggggatttaaacacctggcagtgattgaccactgtgactttgcttattccctttctctcctcagttaccgagctgatacccagacataccagccttataacaaagactggattaaagagaagatctacgtgctccttcgtcggcaggcccaacaggctgggaaataattgtgttggaagcactgggggggttggggtgggcttggaacacaggtgtgtacagcgtgctgtagtggaagttttgtatcatagtaatcctgtttccactttgttatactctagccaagattgactgtattagatgaaatgtgaggatcttgttcaatcggaaacccccgttacctcctctttttctttctctttctttttttttttttacttaaacatttttatgatgatttagatggaagttgttcttcgtcacttaatgttggttccagtccttcaactgttcatatctactttataacattcacatactaacccttcttcaagatggggtggggggtggaaatgcagtttagccatgtcctcaagataaagtcttggtaaaaataaataaatgtcctttagttatattttctccctgagtgctttttttttttttgtctttgaacattgaattttcttgcaaagcattttttcattttaagtttaaaaaccaatagctgctacacaaagaatttgaagaaagtttaagtagtgcgcaacacattttgctgtgaagctaataacacttttacctcacttttccagcataattaaatgaatcttaattatagctccaaggtttgtacctactattgacgcaaacgttataaatgactttctggtgataaagcttgtccgcagcagcagcagcagacagatgaacttcttagtgttgatcagatgaagtactctttctaggaggtctttgtgcccttttcagagccttcagttggatactagttacccactactgtagggaagctataagggcaagggaaaaaccacaaaaaagtgtaagatagtcttgtctcttttttgttgttgtttttttgagacagtctcactctgtacccaagctggagtgt

SEQ ID NO: 76409 - DNA, 1067 bp, Homo sapiens
tgtcgccagggttcaagcgattctcctgcctcagcctcccgagtagctgggactacaggtgcgcgccaccacgcccagctaatttttgtattttttttttttggtggagacggggtttcacaatgttggtcaggatggtcttgatctcttgacattgtggcccgcctgcctcagcctcccaaagtgctgggattacaggcatgagccactggcacctggcctactatttgatgagttggaaaattgcatgcaagttgatggattccttaatgttcacaaaccagagtgatttttgttggggggaatggtataaacaaagcctgtcccacccagatatgataattgtgagaaattttgttcctttttaagttattttccagtgttaatataaatgttatagtctcttctgctacattttgcagtagactagcttagagcttatttaattaggaagcatggacaaagagttttcagaaaaaattaaattttagaatttttaaatttggttaagcatttttaaaaatgggaatcttgtacatttttaataaaccagattgtgaccttactgttcagaggaagaatatgatgttaattgtataaagcattcctactttggaatttatttcccttgccaaaaattgtagtttaggtttctaacttagtgattaacagtgaggactctggagtcaggagtatttaaaatctatctccagtccagcattacctagctaataacttgcttcactttttaaagccttggtttctcatttatgaaaaaggaggccaggtgcggtggctcacgcctgtaatcccagcactttgggcggccgaggcggctggatcacttgagggtcaggagttcaagaccaacctggccaacatagtgaaacctggtctctactaaaaatacaaaacattagctggacgtggtggcacacacctatagtcttacctactcaggaggctgaggcaggagaatcatgtgaacccaggtggcagaggttgcagtgagccaagatggcaccactgcactccagactgagttacagagtgagattctgtctcaa

SEQ ID NO: 76410 - DNA, 3799 bp, Homo sapiens
gaatccgtagatcatctgagggagtattggcatcaggtcttccaactcatgaacatgggatgtctttccatttattaagcatggtgtggtggctttactttctgcatggcgtggtggctcacacctgttatcccaggactttgggaggccaaggtgagcggattgcttgagcccaggagtttgagactagcctgggcaacatgatgaaacccctgctctccaaaaagtacaaaaattagctgggcatggtggcgcgtacctgtagtcacagatccttgggaggatcacttgaacttaagaggtcaaggctgcagtgagctgcaattgggccactgcactccagcctgggcaacagaatgagactgtgtctcaagggaaagaaaagagtccttccatgacattttatagtgtagggtgtacacgttttgtactacttttgtttcgtttatttctaagaattttattcttttttacgctgttataaatggagttttcttaattttattttcagacttgttgttaaggcatagaaataaaatttattttcatataccaatcctatatcctgcaaccttgctgtactcatttcttagttctaatagatttttattgtttccttaggattttatatctgtaagataatgtcatctgcaaataatgatggctgtacttcttcctttccaatctgaaggcctgttatctctttttcttgcctaattgccctggctagaacttctagtacaatgttgaatacaagtagcgcaataaatattctggtattcttcctaatcttaacagaaaagcatcccgtctttaaccattaagtataatggaggccgggcatggtggcttatgcctgtaatcccagcactttgggaggccgacgcgggtggatcacctgaggtcaagagttcaagaccagcctggccaaaatcgcaaaaccccgtctctactaaaaatacaaaaattagccgggtgtggtggcacacacctgtaatctcagctactcgggaggctgagcctgaggcaagagaatcgcttgaatccgggaggcagaggttgcagtgagccgagattgtgccaatgcactccagcctgggcaacaagagcaaaaaatccatctcaaaaaaaaaaagtataactgtgggtcaatgcctttttaacatatacgaatttattttcctagtttttattttctttccattcattaactcatgggtgatattctgtgatcacaatgtagtatgccagtagcaataaaaagccctaagatagttgtttaatagttctgtggttgaatagtgtttttattaggaaatttataaagttaatttggagctaataaaaggcttatgtatacagtataggacatgttttttctagataactagcatttatgtcacttagccattcatcatagtagtcttaaaatagttgacagcgggaatagactgaaaaggtgtattctccttttgtgggaataagaaaggagagtatcaggccgggcacgatggctcaagcctgtaatcccagccctttgggaggctgaggcacgctgatcacctgaggtcaggagttcaagatcagcctggccaacatggtaaaaccccgtctctactaaaaatacaaaaagttagctgggtgtggtggcgggtgcctgtaatcccagctacttggggggctgaggcaggagaatcgcttgaacccaggaggcggaggttgcagtgagccaagatctcatcattgcattccagcctgggcaacaagagcaaaactccatctcaaagaaaaaaaaaaggagagtattattgaataaaaactaaatagataatatactctatagctaattataattagtaatgtgggcttgctattaatgattttgctcattatcttttttattatatttaagtacttatatccttgttcatgtgctaatgctttatgtgtattatttcaaataaacctcacaattctatgaagaggcactcttaactctgtttgacaggtgtggttcagggaatggcgtcgtttgtcctcggtttgacaggggcagagttggaactaaagtctgtctgaatccatagtctaggattttttgtttgtttgtttgtttgagacagagtcttgctctgtcacccgggctggagtgcagtggccgatctcggctcactgcaatctccacctcccaggttcatgccattctcctgcttcagcctcccgagtagctggggctacaggtgcctgccaccatgcctggctaattttttgtatttttttagtagagacagggtttcactgtgttggccaggatggtctctatctcctgacctcgtgatccgcccgccttggcctcccaaagtgctgggattacaggcgtgagccactgtgcccggcctagtctaggatcttaaatatacattaggataatctctttccttgttgccaattttttttttttttttgctctgtggctttaggaagaattactgaaaaacctgttaagacccacagtgttatttgtttgagccatcagatggcaagtctttaaagccccttagctccagtggtttgaagtaatcattttattattaagacacaaaatagttacatcaacattgtggtgaatttctcagctgcccagactggagtgcagtgatgcaatcacggctcactgcagccaagtgattctcccacctcagcttcccaggtagctgggaccacaagcacacgccatcacgcctggctaattttttaatttttgtagagatgaggtctccctgtgttgcccaggcaggctggtcttaaactgtggggctcaagtgatgctcctgcctcagcctcccaaagagctgggattacaggcgtaagccactacacctgacctggtgaatttataaaataaaaaagtatttgctagtggcaataatcaaaagccatcaatctatcatcttttccccagcccaactttattaaagtaaatatgatatcaacatatagcacagctcataagcactgctcatatctagaagtgtatgcgattgtaagattttgctttttttcctatcctttcttaggtgtttgtaaaatgtatgaagaacatctgaaaagaatgaatcccaacagtccctctatcacatatgacatcagtcagttgtttgatttcatcgatgatctggcagacctcagctgcctggtgtaagtattagccaacatgtcttttatcttgtattttctattgcttttctgtctgtttgaggtgatttatggtattgggagctaattatgtgcctgatactgatctttgcatttgcatagtgtatagtaattaatatttctcttacagaaataagagattggcaacataaagccaaaggcacagaaaaaaataactttgctaattgatatagttagtatccagaaaggatcctaattcagaagttccatgtgcctcttctttgttccttatacctaattttttttttcctttacagtctttgtcttaaagccattggttttggattaaaactaagattatctttttttcatgacatttcaaaaacttaaatatgcgtatagctgaaatttaatttcaatcctacgctgtgtaagtacgtatattttggtatgttagagtgagattttttaacatatttgttatagtttgtattgataatctgcttctgacaattactaacaaggagcataaagtgttactgtagacttacctaatcttttttacattagcgaacagaaattgagtgtaaatacagctcatttaaccgaggaaaatggaagc

SEQ ID NO: 76411 - DNA, 1580 bp, Homo sapiens
aactttcccttacctttttgcctttatcgaagatggctgaaacagagtcagtagctgctctagctgccggaagtgactgtgcctctatgatccaaaaggctcttttgcgttgcactttcgacgacttccggcggctcctctcgcgaggattggctgttagcggcgttgtagttaagctcgtgtaacggcggcggtgtcggcagctgctgtagcgaagagagtttggcgcgatggtgagaaaggcctccgcggctacccgagtccgagtccccggcctccagagcgaccccagccccatacgttttcccctccccacgagccccatgcagcgccgcgtgatgctccccgccactctagtcggtggattgacccttcttcccgccgcagggacgccaggcctgactctaggcctcggagccccggtccgccctgcggttgcgcgcccgcctgctcgctcgggtccggcgtgccttgggcctgaggatgaactctctcccgattgttactcggtagagggagacgtgggggaggtgttttgttttttgagatagagagtctcactctatcgcccaggctggagtgcagtggcgggatctcagacccctgcaacctctgcctcctgggttgaagcaattctcctgtctcagcctccctagtagctgggattacaggcgcccgccacctcgctcggctaatttttttattttagcagagacggcgtttcaccatgttggccaggctggtctcgaactcctgacctcaagcaatccacccgcctcggcatcccaaagtgctgggattacaggcgtgagccaccgggccctgccggatatggtatttttccctccaaatgctctagcctgctgtaggaacaatgggccagggttgtctaactattctcgaagctgacagatccagctatacccagcatgtgggccaggagaggacgtatttgctttgcagtgttttttcagctttcgttttcctgtgctctgccttttttttttttttcctgtttttgagacctctaggtattgcgtgtggcgcgtccctcagccctcgatcctgtacttatctgtatttatatcctcttggggctggaggctgaaaagtaggctcagctcagagaccagctctattagaacccaaccgggatgatcagtaagctccaattcgaagaaagtgaccaaaactggcttgagaggtggtataatctgtaaagaatttgagcaggaaagcattgccatttaaaaatgataaccacttgaccacagtttttaaaatgtatcatgttatgttcttagtgatttttaatccttgtctttgggcagtaagtactgaaaatagtaaactttgcccggtgttcattttaagactagatataaaaagcaacatgctgtatagctttttccattcttaccctttcaaattagtcctttaatttgcattagaattggaatacaattattatagtagcagttgagatagctagtgtatagggcaacctctgttgcaagaatgcacgtggtttctacaaaattattttttcttaaatgactcgttgaaactttttgagtagc

SEQ ID NO: 76412 - DNA, 1087 bp, Homo sapiens
caaaagagccttttggatcatagaggcacagtcacttccggcagctagagcagctactgactctgtttcagccatcttcgataaaggcaaaaaggtaagggaaagtttccaagctttaggaagaattattttttttcaagacgctgtcttccgtactttcgttattaaacatacggctcaagtgatcaccggtatagacagtgacatcagacatctttcattagccctactcaaaaatggcggcaacgtaagtatcctgggccggaggtcggttgtaacccggaagtgcctttgtaaaggagggggtggttagacaatccggaagtggatggaatgaagagatgccacttggcggccatggcagctgtagtatcggcgactccgggtcaaggcccggtcgagtgcagtaccatgggcagcaccgggtatagggcagagacagctttgtgtcaactttgctgctgaacccctaggacccatcgttagagacctgcaggactcctttcctcatcccaggctcggaggagagtttgctgggactggtgggctggtttcctgctctggggggcggatcaccttcggggccgcctcttggagacaggggcgcctagggaacgaacaggttcgcttgagtcacttacccgccgccgcctaagacattgtgccaccctcaatccgacaatcgaagaaatcgatcattcgcacattttccccattgacttttcccatctctgttaacccacgagaatctaatgactggcatctgagaacccagagcctgggaccttagattgctgtaagctttctctggtgctaatatcagcaaaaagggtctgttgccgggtacgttcaagaggaaggtgcctcgtgaacacatctgctggtgggaaggcctaaagaactggaaagcccactctcttggaaccaccacacctgtttaaagaacctaagcaccatttaaagccactggaaatttgttgtctagtggttgtgggtgaataaaggagggcagaatggatgatttcatctccattagcctgctgtctctggctatgttggtgggatgttacgtggccggaatcattcc

SEQ ID NO: 76413 - DNA, 1014 bp, Homo sapiens
ttatactatttttcttagtatttaactctcttttcttcattatacttactctcattttaagctttgttttgttctttcgtgttttaaagttttgtgtctgtattagtccattcttacactgctaataaagacatttctgagactgggtaatttataaacgaaagaggtttgattgactcacaattcagcatagctggggaggcctaaggaaacttacaatcatggcagaagaggaggcaaacacatccttcttcatggggcggcaggatggagaagtgctgagcaaaagggggaaagccccttataaaaccatcagatctcgtgagaactcactgtcacaagaacagcaagaactcactatcacaagaacagcatgacctcccaccaggtccctcgcatgggaactacaactcaagatgagatttgggtggggacacaaccaaaccatatcagtgtctgattataataactgactcattcataataagtatctttaggggtttgagttacccgcaaatcaaaggtttattgtgtctgaagaacagatttattcagtatgcttctgcctctacaataggttctctttgaagtagatttaacaatgttacatttttaaggacttttatattgtctggtacattgctcttaccctcttatggtaatacaagagattttatacctgtttggaatttcatttgtaaattctaagatttgagccgggcatggtggcttatacctgtaatcccagtgctttaggaggctgaagctggaagtttgcttgaggccaggagtttgagaccaacctgggcaacaagtgagaccctgtctcagatgaatgaacgtaaattataaaattttaaactttgcaatctcagtaaatttatccatatctggaaagaaatcatcagcttgtcttttctcagattgaactacagattattgtttcataaggatccttgataaaactaagtttggatcaaataaaatccggttgcaatatgattcaatattatt

SEQ ID NO: 76414 - DNA, 1098 bp, Homo sapiens
caaatcattgttaacctggtcatttaaaaaatttcatctcagtcaggcacagtggctcacgcttgtaatctcagcactctgggagaccgaagcgggcggatcacctgaggtcaggagttggagaccagcctgggcaacatggtgaaaccccgtctctactgaaaatacaaaaattagccagatgtggtggtgcacgcctgtaatcccagctacccgggaggctgaggcaggataatcgctggaacttgggaggcgaaggctgcagtgagccgagaccacgccactgcctcaagcctgagcgacagagcaagattctgtctcaaaaaaaaaaaaaaaaaaattcatctctttgttttacttggcattactcatgcaattgatcatttttcatcttcgctgtctattgtagatgttggtctcacaaatgagcagctcacagtcttgattacagatacttgagaaactttttcccattaattaatcaaagtttgcaattatttcttttgctttctccccaggaacgactgaagctggtgactgttttgggtgctggccttctctgtggaactgctctggcagtcatcgtgcctgaaggagtacatgccctttatgaagatattcttgagggtgagaaagggaagagcattatttgagatatgttattgacttggagggttagcaggatgaagcttagtggtatgttttctgagcacagttcatgtttaccatagagttctaccctgagaagatttgttgagagatatcttgatatctttgatattgacacatccttagcagtttgtcaactgaatgtcccaattcatgaataccacttaatgtttatttgccacagtgcatgaatgagtcattttaagttatgacagttcttttttaatgcttactcaaacacttcccaaatcccacatgatagtggctgcattttttgtttaatttaaaaatatatagatataaatatttaaatttaaggaccctttacagtaaactttatagataattgatgaggacccatgcagtaaaggataactgaaaaaattaaagaggcctttcctgaccctaatagcaacaagcagagggaac

SEQ ID NO: 76415 - DNA, 1319 bp, Homo sapiens
tgtctcaccttgcgcatctctacatgtattcctagagtccagaggggaggtgaggttaaaacctgagtaatggaaaagcttttagagtagaaacacatttacgttgcagttagctatagacatcccattgtgttatcttttaaaaggcccttgacattttgcgttttaatatttctcttaaccctattctcagggaagatggaatttagttttaaggaaaagaggagaacttcatactcacaatgaaatagtgattatgaaaatacagtgttctgtaattaagctatgtctctttcttcttagtttagaggctctgctactttatccattgatttttaacatggttcccaccatgtaagactggtgctttagcatctatgccacatgcgttgatggaaggtcatagcacccactcacttagatgctaaaggtgattctagttaatctgggattagggtcaggaaaatgatagcaagacacattgaaagctctctttatactcaaaagagatatccattgaaaagggatgtctagagggatttaaacagctcctttggcacgtgcctctctgaatccagcctgccattccatcaaatggagcaggagaggtgggaggagcttctaaagaggtgactggtattttgtagcattccttgtcaagttctcctttgcagaatacctgtctccacattcctagagaggagccaagttctagtagtttcagttctaggctttccttcaagaacagtcagatcacaaagtgtctttggaaattaagggatattaaattttaagtgatttttggatggttattgatatctttgtagtagctttttttaaaagactaccaaaatgtatggttgtcctttttttttgttttttttttttttaattatttctcttagcagatcagcaatccctctagggacctaaatactaggtcagctttggcgacactgtgtcttctcacataaccacctgtagcaagatggatcataaatgagaagtgtttgcctattgatttaaagcttattggaatcatgtctcttgtctcttcgtcttttctttgcttttcttctaacttttccctctagcctctcctcgccacaatttgctgcttactgctggtgttaatatttgtgtgggatgaattcttatcaggacaaccacttctcgaactgtaataatgaagataataatatctttattctttatcccccttcaaagaaattacctttgtgtcaaatgccgctttgttgagcccttaaaataccacctcctcatgtgtaaattgacacaatcactaatctggtaattta

SEQ ID NO: 76416 - DNA, 1078 bp, Homo sapiens
gacagctgtgtgctcctggggtggcagcagcatgtgtggtgggtaccacagcagtcatggggaggtgggctcctagtagtgcacaaacagcagcagcaagaactcaggggcagctgcagcattctcatccaacagcttctgcagcacttcttagatatggttcctggaagctttgcctcaggcctggctccctggctctcccaatatccttttagtacattcatttcttttctgctgagtcaggtcagttgcagcttatggctgctggtgatgaggactagtggtgagtttgtgagccatgtgggccagagaaaggcaggatacctgcaatcattcaaaagaagtcctgcacggtagggcccagtgagcccagataatcctggggaaggctgattccttcaataagagaagtgaagcacaggtttcttcaatgacaaagagcaaccaatctttacctattccctctgcatacaggacgtatgaatagacctcagataatagcagttaaggctgggtgaaaggaaggctctgaggcaaacagctggagtttgatcaaccactagatacttgagtggtttctgttccccttgactaaccagcccagactgcaccaggtcagccttgggagaagctgtttctgcttccattgtgttctctacctcagctggtaggcgtgctgaaatcctggctgagttctacagaagacagaacaagccaggtgccaatcctgtgcgctagaccaagtgggtcagggccgcccaatcttgccaggaagtaagtgagaccagtcaggggtgaaaactcaggatccctaagtgccctacactgctcagacacagagctgatgttctaatacattatttacaacagacacatttcatttaatttttactatagacctatgaggtacatacatattatttttagttttccagatgagaaaaataaagttcaaaagcgttgtctacgtaagtcacatagctagtaatttcccagaacatgatataggtcctaaatatgtgttgaatgagggaaagtgacaagctgaagtttggcctgagtccttagcccttcccct

SEQ ID NO: 76417 - DNA, 1088 bp, Homo sapiens
aaaatacatacatatatatatatatatatatacacatacacacacatgtatatatttcttctttttttttttttttttgagacggagccttgctctgtcgcccaggctggagtacagtggcacgaactcggctcactgcaagctccgcctcccgggttcacgcgtctcctgtctcagcctcctgagtaactgggactacaggcacctgccacaacgcctggctaatttttgtatttctttagaagagacggggtttcaccatgttagtcaggatggtctcgatctcctgacctcgtgatccgcccacttcggcctccccaagtgctgggattacaggcgtgagccaccgtgcccggccacacatgtatatatttataagtgtaatataatatatgccagtagtgttaaatatgttcacattttgtgcaaccactctccagaactttttcatcttgtaaaactcaaactctgtatctattagacactccccattctcctaacccccagcccctggcaatcaccattctactttctgtctctatgatttttgactactgtatataccttatataagtggaattatacagcattggtctttttctgtgcctggcttgtttcacttacgataacgtcctcaagattcatccatgttgtagcgtatgtcagaatctccttcctttttaaagttggataatgtcctatcagttttcaggagaaaacctgattgaaatctcattcttctgacaaattgttggccaatggggagggccctggatgtcttaaaggacaagagagtcacagccaaaggaaactggatccctaccctttccttttccaggtttctccctccccactgtggcctggtgttagggatgctttggtgttcacgtctatcttcttcccagcagatggcagcatgctccgagctggcttgcaaattccaatgggaaagtgagctgagcctctgggagacggcgggggtggaggggttttggtgacaatctgctgcagttttgcactattggtgttgagtctcacccttgttctcccctttaaggtatgaaacaaaggactctgctttgtccatc

SEQ ID NO: 76418 - DNA, 1039 bp, Homo sapiens
catttggagatgacagcacaatctgcccacatccacccttgatggctcccgcaccgacccttgccaaacttccctatgtgtctcttgggctggaatagagaagcttgggggaaaggggctgatcaggactggtgagagggccccccaggagagggcagaggtggttgtccccaccccttctgcagcagttgccccaggcacctgttcgacattggtgtctgagacagtgttgctactgctgagggaacatcaccctggctcacctccatctttcaaaatatggcaagctgcacaaatcgcggaggcctcccagagaaacacagctcctccaaggtgtcaagccacgcccaaatgatccaaaaagcagttgattttttagaccttttaatcggccacctgagcaaattctcaccagttttgatagttttccagtttagtcccttgggttttctagttagacagtcatctgcagataatgttcaatttttgtcctttgccccctccctcattctaccaagtggcacaggaaattggttggtttggtgatgctgtttagctttaatagaaacccccagcccctggaggggctggattcctttgggagcagtgttccattccattaagcttccttgcagggtggggcccactccatgaagacagcagtcatgccttaagaagcagagctaccttacgtgcctgcccaggctgttcctgcctaaatctccagccctgcatgccgtctcaagggtgggccccagagagtttggagtgtaggattccctctgtgaaggaatcatctctacttctctgaggacaattagggtatccttggctgctttactgtggtggccgaagagctggaattgcctttgttgagagttgtgttcactatcagtggtcgtgtaccttctccacctgcccccaggaaaaagagtctcccccttaaatttcctggtaccccctcacctatgcctgaaagcatttcaccctctcaatgcctcacctttcccattcgccagatggaaccatcagtattcct

SEQ ID NO: 76419 - DNA, 5984 bp, Homo sapiens
aggcacgtacatacagactttccttttttcgcttggttttgagaccccagctatgagtgtggatctgactctccctcatgggagtcgtggctggggagctgctgaagtggagaaaagttaccctggacgaatttaggagcaggagggggaggtggttatggggacagcaagacccaggagcaaagaggcgtcaaaataaagtcttgggctggttaaagggaagttggcgtctgggcaaggaggcctaaagctgttgttcccacagaattttctttcagtggcaggcgacatgctgggctttgttgctctcgctaactgggctcctgtgtgctcttccagaggtgcagtaagattactcagttcaattaggcctagggatttactcccttttttgatctacagagatgggaagtatgtctttccttcacagtagttaattcatttcttgctgttttcgttcctctggtgtaaaaacatacataggagttacgcacacacaccttttctgttttgggaattccacacccaaactgtcaccatctagtggaggctagtagagacatgtgcttggcactgacttctgagttctctgggttttgtgtttttagctagaagcatattcaaccagaaattaaaattttcctggagttgggggaggtatgtctacatctcaggaaagaaggtatttaagcagcaataatatggaaaggttcttgaggacttactgagtaccaacctttgtgctaagggctttacttttttgaactcatttaataacagacttttgatgtagatattattatccccattcttctagttgagacccaaaccaaacaagttaaataactcgcccatgtcacataggtatctcatggtggagcccacagtctgaactactagattatactgctagtttctggtttgtttaccttttgataaaattgaacctggagtctttctaaaaccttctgaaagcactgctgcttcaggctgtttctcagatcatgagcattctaaactctttctcctgggtacacacttacggtatgtttgcataagattcatttgttcattctttcattcagtactcccaagtagttatgtgataccgaatgtatgccaggcactgtgctaggtattgcaggtactgcattgaataagtcagaatccagctctcatggactcacagcctttaagtccatttgttttggtttatgttgttagctttcattgctggccatttgctgctgaaggaacttctgcccagcgagttaaacagaggacagtattggtatgagtcctgatagataggacttcctgtctgcagagtaattttttggatactgtagtagaaatggcatatgaaacaaatcctcacttacacctagatagagacaggtgccagggtgctcagtgtttaaaccctgagagcaaacccactgtcaaatgggcaagtttgacttctttcgctgaagcctgccttctgaaagcccagaatttggtgagatagaagagaaagaagggtagaatgaggtgttacagatacaggctggcagataaagagacctcagcactttgtctgttttcctggtcagtctctgaggtgtggtgattgaacttgtgttcttttttattttttattttttttgagatggagtctcgctctgtcacccgggctggagtgcagtggcacgatctcggctcactgcaaccttcacctcccaggttcaaacgattctctgcctcagcctcctgagcagctgggactacaggtgcgtgtcatcacgcctggctaatttttgtatttttagtagagacttggttttaccatgttggctaggctggtctcgaacgcctgacctcaggtgatctgcccgtcttggcctcccaaagtgttgggattacgggcgtgagccaccgtgcccggcctgaacttgtgttcttatgtaatgttgcatctctcagtaggggatgtcctcctttgctcttttggtggggcagcaattcctgcagcagccttccctctacatgcacacacacaccccttccaaaaggtaataattcacctggtttctttaaagttagaacttctttcaagtttattgctactaagcattgtttcactccctccacacttgtccatttcccacataaaaacttggcttttgcttcaaatattttcttctgcccttttttcatatccttagctcttctgacaaccaagttactactggtatcatttgtaggctgggagaaatacagcatctttaaaaaaaaatagtgaggtacatactcttcctcatttcagtaccaaacaagtgaactgtggagaatgaagcagaaccacttgccagcagagagggaaggccagagggcacacgtggttgtctttcccctctagttccccatttattaagagacaattcacacttgcaggcccgaatgtcagcagatccattgggcccaggttgtgtaattgccatacatgaagtgagttattaagctcctgaaatgacatgctatctcctagttgaagctgacaagcaggatttattttccctcttctttctgtctggacactatggaagtcttgttagagggtgttcgctcaagcagtgggagaaagatcagaaggagccaatagaggagggagccccatgtcttgtcttcttttcaactttgagagcaaacattgctttgttgcagacttgaatgttgaggattaggacatttggttaaatgtaagctttgggacaaatgcaaaactaggggaaatagagactctttccccaggtttctcacgagctccatagtactcaggaacctttgggtggactgtccttgcgcgtcaagatctgttcactccacccctggcttggattcaaggcaacagccattgtgtgtcccttggatgagtgtaagtttgtgtttctgtgtaagaacctttcatcttaaaaagtacaagttctggggaaaggtgcctcttacaaggcttaggttttcgcagcagagcctgttaggcacctgtgttcttcttgggctgatgtgtctgcgatggtgtcctttttcttccctttttagttttttttggcctggaaaccagcagggtgcctccatttgctctctcatcctctggttcttacttgagtgtggaagtcgctccactggtggaccttgcagtggcactgagctgggtcacttcagccgtgaaaggccaactgtactactgtcaaggcttgggacagttaagcgtccgtgaaggtactggatacagcgacagcaggaagtgcagcagtgagaactgaaactaatttcacagactgtggtgttgcctgtgatgtagtctccctccctggctcttctatctcaaaaaaggaaaatagccacccttgaaacatctgaaggctgcgtgccaagaattcacacagtactcctgaaacaggatattactgaagcatttttctcaaacagaaacagatgtagttccctgttactgtcgccagtgttagtagatccttaaaattacctgacagcagtgtgcccctaaatgtactccccgctcctacacacatacacaagtgttttattttattttattttttggcaaagcctccttccttgatttgagggaagttagcctgggattcctgatgacagtaatagattctcagtgggtttgcagacggcagaggtggtgactgacaattctttattactcagaagaggatcttctctggtgaaaaatgattcaggattctgcagttggagattggatacaaaacctcagagaagggacacaaatagagatctttctcagcctcccctttcttgctaccctttgtagaggagagggaatgtctcatatttctaagtccaacctactgccagcagtgacttgccttcacccacagaaatttaagattagagtgtggaattgccctttatgtaaactgtccttgctgaaattttctttgactagactaggcttcagcttctgacaaagacagtaaaatgaaactggcttctgggaatggcataagagcctgtttatccaattcttcctttagattgttctcagttgagctcagcaaactaagtggacggaggcttgtaaaaggtaactgcaaaaagggtacaaggtgattttgcttaatttgcattttaaattatagcagtctatgcaaactgtttgaaggaagactgagagatgttttttggtggggaggcacaagattacagatagcttggaaaataaaagggaaaaaaaatcagcatgattctaccaccctaacataatgtgtattctgttttttccatcttcagatggtagtacctgtacattcagctttgtatttttttcacttagcttttttttttaacaggtcataaaattcacccatttaaagtacaattcagtggtttttagtatatttacagagttgtacatctatcaccataatctaattttgcaacattttcatcaccccaaaaagtcactccctatttctctacaatcccacctagccctaggcaaccactcatctttctctctatataggtttgcctatttggacatttcatatagatggaatcatatgatatgtggtctttaataactggcttctttcacttagcataatgtttttgaggcttattcatgttttaccatgtatcagtacttcattccattttattgctgaatgctattctgttgtattgatataccacattttgtttatccattcatcagctgatggacagttgggttgtttctgttttttggttatgaataatattgcagtattgctaagaacgtgtgtataagtttttctgtgggtatatgttttcatttctcaaggagatacctttaaagctgcatccatccatatctctactttgtggttaacattctcctaggttatgcagtttgtttgaggaagaacagtgttttagtaaactcttgatcctactgtggtgttgcggatattgccctgaatcaagaaaaggtgccaccaaaaaaaaatccaaaacccaaaaacaaaaagagagaatcctgtttttaagtttgaactctccagtagcattgtttccaaatatttggtgcagaactttaaccattggtgagagttgacagacgcgatagtgcctaaattcaatgcacatgtactgctgctttaaacaaataaagaggattttcaatgcgaagcctcagctctaaatctcatctttgtgttttatagagaggactttaccatgaacccccaaagccttccttatcaaatgtgatttatagttctcagaagcttttccttttcttgtgaaaaattccatgccagggttctgtgcacctgctcaaaggcttctgctaggttggggagtggaatgcttattgaacagagagccagccagcaaggtagggaggagggagagggtctgtgagtgccctgaaaatgtagatctgagaaagagtgctctttagagcagcccccacagggcttttccaggtggacctcaggtgtaacccgaggttaaaaacagatcatgccagacacaaaaaggagcagatggtgctgcttggagtgtcatttcctctacaggatgtgtccctgtgtggttttacatcatgccaaccatattaatgaaataatgcaacagaatgtctccttttgcccttgttccaattggaaccacaggttgagtttccctaacctgaaatatgaagtgctccaaaatcttaaactttttgagcacccacatgatggagaattccacacctgacctcatgttttaggtcacagtcaaaactaccttcagtctatgtgtattacgtgtaaatgaaacataaatggattttatgtttagaccagggtcccatccctgagatacctgattatgtatatacaaatattcgaaaatctaaaacatttgtgatcccaagcatttctgataaaggacactcagcctgtactagcacttgtgaccaa

SEQ ID NO: 76420 - DNA, 1020 bp, Homo sapiens
accttgagcaaatttaacctctttgatacttagttgttttttttttttttttgagagggagtttcggtcttgttgcccaggctggagtgccatggcctgatctcggctcaccgcaacctctgcctcccaggttcaagcgattctcctacctcagcctcccaagtagctgggcttacaggcatgtggcaccatatccggctaatttttttgtatttttagtagagacggagtttctccatgttggtcaggctggtctcgaactcccgacctcaggtgatccacctgccttggcctcccaaagtgctggaattacaggcgtgagccaccgtgcctggccgatacttagttttatcatttgtaggatagaaatgatgttaacactacccatctatagaagggtggctaccaaaattttgattattgcctggtgtggggaattctggatgtgaatggtaaaggataaagggaactttaacttcttaaacttgctttttgtttcatttgaattttttgctattggcatgtataacttgaataatttattaaaattacatttaaaagtactcccttgtagaattttatgaaaatcaaatgaaatgggatatttaaaaagataggtatgtgtctgacaactaaaagatacttaaatggcagtttggggaagtattaattagtggctgacccttttgtagtgttaaatgttctgtctgactgtgtggcttcaggtaggtctcttaactttgttaagctccagcttctttaactgaaattgggagttaagagtagtgtgtattccacggggggttttgaggattaaatgattctagatggttaagcagttaactcagtatctggcacatagttaagtacccagtaaatattaactgttatcagcttttatcctcactatgcttgaagagaggaggcagtgagtgtaactttacctactttaaagttacagaaaatgaggcacagggtagtgggtgacttgtcctaaggctagatgttgggttagcagca

SEQ ID NO: 76421 - DNA, 2252 bp, Homo sapiens
gatagggtcttgttctgttgcccaaattggagtgcagtggcttgatcatagctcactatagcttcgaactcctggacttaagtgcttatcttcccagctcagcctcctaagcagctcggattacaggcacgcatcactatacctggctaattaaaaaaaaaaacgtgttttttttttgtcttgctgtgttccccaggttggtcttgaagccctggcctcaagtgatcctcctgctttggcctcccaaagtgctgggattacaggcatgagccactgcaactggcctgtcccacttctttagaggactctgctctgactcccactagcttggcaacaggtggatcctagaggatgttaaagacctcatggaagggaccctcttaactaattgcaaaataagaatgttcattggaaaagaaaccctcccaccaccatggtggaagtccctctaaaacacaagttgttcaggacttttattatgttgctctagtatttatctggtttttgaagatagtcttgcttaaattaattctgatttcaagagtgatgactaaaagttttggaggaggtgtttagaaaaggatgaagctctgggtttatttcagggctaatcatgaatttgcaggagcagcttcaggacaccagggagaggcatggcacactgccttggagctgtccttaggatgctgctaccttttagggacatactgtaggcagtccttggtctatgtaaagttgtgcctgggccttatcagaaattaaacagatgttatttatttatttattttttctttttgagacagagtctcactctgttccccaggctggagtgcagtggcaggatcttggctcaccacaagctccatgccattctcctgccacagcctcctgagtagctgagattacaggcgcccaccaccacgcctggctaattttttgtatttttagtagagatggggtttcaccgtgttagccaggatggtctcgatctcctgacctcatgatccgcctgcctcggcctcccaaagtgctgggattacaggcgtgagccaccgtgcccggcccagatggtatttctagtaaaagtggcagatgttcttgctgtcagaattaattttaatctttttacatgtaaatgtgggattatgggactctttttggggggtcttagtctcatatggaagtgctgctcttactttacagagattttatctatcccttgctcttacccaaagtgactttttttttttttgagatggagtctcgctctgtcacccagtctggagggcagtggcgcgatcttgactcactgcagtctttgtctcctgggttcaagcgattcttctgcctcagctcctacgtagctgggattacaggcacctgccaccacgcccaggtaatttttggatttttagtagagacggggtttcaccatgttggccaggctggtctggaactcctgacctcaggtgatccacccacctctgcctcccaaagtgctgggattacagacatgagccactgctctcggccccaaagtgactctgaactctgttttcccatcccctctgatcactttctctcaccacgtgggtcatttgtggtggcaaagtacaaagtgaccagccttctctctcatagaatttgaaggttgctgatggggctatgttactaatggggctgtgtgcttgctacagagatactgctggtgatgaaagtgtatgacatttctgttattcctttgggttaagacatctgtatttagcaggtattatacctagaaggagtgtctatatcagagtatcccagaaaagaaagaagaaaaatcccctggggagtgggaaaaggcagaaagtattgaatgtgtgccctgtgccaggcagtgtgctcagtgctttaactcggtaggctaatcttcactggataaatcaggaaaccaagctctgaaacatttcagtactgttaattactgtattggaactagaaccaaggttggagtgattctaaagcctgtggtgggtttttttttttttttttttgagacagggtatcactctgttgtccaggctggagtgcagtggggctatgtaggctcactgcagcctccgcctccccacctcagcccccaaccccagtagctgggactacaggcacataccactacacccagctaatttttgtattttttgaagagatggggttttgccatgttacccaggctggtcttgaactcctgggctcaagtgatctgc

SEQ ID NO: 76422 - DNA, 1676 bp, Homo sapiens
tatgttatataaaatggaataaatttcaactctaccaagattgcatgcttttgggtcagactgtttagtttgatatcttggtctcatcactttctatctgtgtaagcttggataggttatttagcccttctgcttctgttttttgttttgttttgttttgcctaaaacggatataacagtacctaccttttaaggttgttgcaaggattaaataagatattagatgtaaaatgcttacatctgtgcgcagtgactaagcactcaaatgccagttaataataataattctgtgattatcctgaggtttcatgtttctggagtaggattatgaccacaacatttacagaatgaagtcctgcaggatgacaaaacatccctgtccccattgacacagccccaagtcacgggcttgcaaaagaatgtttgccatccctaggaagcctaacacagggcgctgggaaatgcttgcaaaagcagatattctcaggtcacatccttttagttttctgaggcccctgtgtttaaaggtacagcatgactgttctagggtggtcagaatctgtcacaggtgggagggaagtacttgtttagaatatggcagagaatccaccaaggtgttaataccaacaacagtttcttcttcattctgggctttttcctccccttatgcttgtttaatggttgggaaagagggctaaattgtacttttcctttgtaaaggtgcacatctcaaatttgtttcccctagtagcttgttttttaaaaagttttaagacatgacaaattatacttctttttggaagaaagattaggaaatacaggttaatggcaacccttccagagagcaccactgttcaccctgctattgccctgctgcttctctccctggtctaggatgtcagggacggcagagtggccaggtggaggggtcaggcttcagagggaggagctgcatttctgggagccaggctggccctcctgttgctctcagggctgacacttctctgtctcatccctcctccctcagtaaatgcagctggggaggattgcctagaaggggaaaactcatcgtgtaaggagaacacttccctcgtggcttttaaaatgtaatgcttccttccccttttctcttcttcccagagtaagagctgccagtaaaacttcagtgcaggactgttgagacgtatttgtcatgatgtgatggacaaaagaattgtcagctcctcctttctgtatcatctcattgatccccctttacccccttgcaaatgagaattacaggaaatcacaactagcattaaaaaaaaaaaacaaaacactgggcagatgggaaggatgaaatgtgtaacccccgttcccagaaacaggcagaatggctgagatgactgaccctagcatttggtgttcactgagccaaagcattgcctgaagataatgacaccgtctggaaatcaaaacctgagtcttcctgctctcatccaaaactcccctcttttgagcttctccaatctagtcagtgacccgccctcccagttctttctttcacaggttcctatctccaccaccctaaccagaccttgtcatccgctggccttccaggctgtttcaatctctcttgccaggttcaccctgctagaacacggttctcctctccggtgagactaggtaagagaaaa

SEQ ID NO: 76423 - DNA, 2350 bp, Homo sapiens
caagaatatttgttgacttcccactacttactgatccaaggcagaatttctctgcctgtttttcatggctgtgcaaactggccttaccttaaatattcagttgaatactcaatactttgtggaatagccagagtctgctatgtgacagatgctaagaaaaccagcaagaactgtcccttgccctgacagatttcagaatggagtttattttctgttcttccctgatccttggcctctcttcccgaccttaccctgccacccgctatctagcatgtttgcttcggcattcctgccccagaaggaatgttccctctttacaccctcatacttattcagccctcaaagctttcaggtcagatctcctttctttcctttttaaggcgctctttgattatcttggttcagattaatttctttttttcctattttttcattattttgttcataactcacaaatagctgcagcttattcttccttatattctaatcattcatatctcactggttagcattttattgcacccatgtagaatactgaaatagacatgattgccttattgtgtgttttgattgtttgctgtttgggtttgcagcctcctcaactccactgaaattcttggtaggctggggattgtgccttctttgcattttaaagctgtatatagaagattgtcaggaaatgatgatacatggaataaacaaatgtgaaccattggaggtgaaaggcgacctgatagtactttgggagtgcagttcccagtaggattttgggtggcctggagcacagcagcagctggaggctggggaccatccagttttaggactctggtgaccaagacctgagagaaagtggaaaggtcaggaagggtcagacttgtctcccaagagtttgtattatcatgggattctcttgaaactctggttcatgtggaaaatgtgcttatcctagaagttgactagggttcttggggaatgatggtgaggccagatgcctctgtttgatccaggttctctgcatggtgaatcaccccagaaggagggtgtgaaaggtgcctggccacagggaagcttatagcttcagggaatgaactcttaggagcaatggtaagcagacctgtcagattgaggatttgatttatttgtattattggcacttgtattgatttttctggggagtttggggatttgaatgtattttgcaaatacaaacattttctttgtcatgtcactgatgtggtttataggcttatgttgcattttttctttgaatagtagaatcttgcatgaaattaaaagcagtatcctccacttctgacttggtagggctttaagcatcatgctaacttttcccctccatctccctttcatttcttagatccacctaggactgtgaaataggttggtaacatctgtgggctaggacggtttcagccagctaaattccctgttacacagtttagatttatgaggcacatctaaatttactggaattctaggtaggaagtgtggttgcaaaggcaaaactctttgtgattgtagcttgtatgaaaatagaagcagcttgaatttttttctcacaaactttatccaaaacatgtctttacatcttttatttctggtaaatggattttggggtggcatccccactactgttgggatgaagggatataacaagctagagggtgatttcacagaatcctgagcctttgaaaaatgctgttgcttttgaaaagtaataaatatagaagccaggccacctttttcagatttataccctcttcccattctattctcagctagtaaatactatggcctcagtttgcctaaaaagataatggcttaagtttatttaaatgtcagcagtagtttggtaatgaattaagtcctttgatgatgatgatgacgacgatgaagatgatgataatgttgatgatgatggaggacactcagtagcagtggactgagttgtggactagttctttctaaggctcccaggaagaaaattgctaactcacttaatatgtgaaggccttagtgtcaggtagaggaggaagcagctgtggagtgtaaagaaatcatctgcccaaaggtacactttagagaaagactttggatgaagttgtgtgttttctttttggaatagggtgtattgcttcttttgagaaggccttttacaatagtacaatagttcctctggaactcatagcaggattctttttccaccctcttctatatttacagctgcttttcccctaggggagcattcatctgttttaaaaagcagggagagaaaacaagttctgtcaaacagtgaggtttggaaatcagaactgtacttacttgcctttca

SEQ ID NO: 76424 - DNA, 1027 bp, Homo sapiens
tacactcaaagctaatgagtgctttcttccactctgcacacactcttgctgcctggagtgggcggcaggctatagaaccacaatagagcaagtactgttgctgttgaaggcatagacggaggtgacagtaagggcagctaggccctgaaattccagtggctcagacccctggctgatggcttacctcctgaggtgagaccaagaggaaggccttcagcttccctgaaatgagtgcttctcacagttaaggtagtgtgaccagccaggggtagggactggcttcctgaggaagagggtgggagagccttaattaagcctgcctggtttggcagtacctcagactcgcctcctctttctgtgttggctgataatttccttcagctcttagaacaactcttcatttcctgggggaacccattgttgccaatatacactcacagagcctatctccggtactgccatgtgtgctttctgcctcctttccagaagaggcaggtagccagtctttttttctcatgagctgttcctaccttgttggagttcctggaggctagtgctgctggacctccagtctggcagaggcctggacgagagctattccttgggttctcagaacagacctagcctagtggagaacagttctgggcctggctctgtgtccagaagggctcagtcagtggtcagattctgattgggagatatatgaggaaactttgtttggtgagagttaggagaatggggttctggttcagccattctctcaagaagtcatgatcatttgataggcctcagttttcctctcctaaaatgggtagattggattttataagatgatcccaaagttccttaaggcagtaatgtgttaggattccgtgacaaacccgggagtctgcccctggtctaggtgaccaaagttagcaaaggctgggacagcacagattgcagttcccaggtctcttttgcctcccagctttttgatgtgtttcttctccttggaatgccccaccactccctgtacccacctctt

SEQ ID NO: 76425 - DNA, 1007 bp, Homo sapiens
tgtatttttagtagagacggggtttcaccatgttagccaggatggtctcgaactcctgacctcgtgatccgcccgccttggcttcccaaagtgctcggattacaggcatgagccacagtgcccagccccaggcatcatcctttattgttctcactcacctcatcctattagtttttgatatattctatagcatttggcacatcacaggcactgaatgaatgaatggatggatggatgaaaatgtttgtttatttcatccaaatttaattacaattaagtaccttggccttggtgaagctgaatgctcctggttacactaacttttgggaaggtcatttgatttttggccacactgaaattatatcaggaagactcttttgaaagataaatactttgttggaaggattagtcattattagaaaggggtggattggtcactctgctatcttttagggctctctaaggaactgctgagaagtttgtttatacagttagaggtgaggtgggtgaagtcaaattgtgctggctggtggagtgggggtggggttgtccatggtgctcatgggagtacagatagtgtgttggtgaacttgccacaatgctacggatttaatgcaagaaataggcaaagcttttctgctgggggaagtaatatgccccatttcactcactaatggatgtcctaattgtatgctagtatttctaacataaaggctgaggatgtgtatttaaccgttttgccaagtttatctcccttttcttgctgtccaaccccctggaaaaaaaaaaaaggaaaaaaggagaaagtgacttaaagaatcaggatttgggctgggtacagtggctcacgcctgtaatcccagcacttcgggaggccaaggcaggcagatcacatgagaccagaagtttgagaccagcctggccaacatggtgaaaccctgtctctactgaaaatacaaaaattagtcgggcttggtggcgcacacctgtacttctagctaatcggg

SEQ ID NO: 76426 - DNA, 1127 bp, Homo sapiens
tcctctctctgccatccttttggtgagttgttcttccatttctttatctttctttgtaagtagcactgtgcatgcaaaacactgtcctgggagctctaaatttgtgcatgggttcaaggtccaactcaaagctttctctttcacttctccctactcccatcagaagtctttgttcctgtgtcctctgtgttctcatagcactttttaaaaaaccttctttggggccctagtaacaatttgacagtgttatatagataaacataattcctctcacgtaagttgtgaattccttgagagtaagaattgaactgtgccccaattcatctctatgatcacccaagccttgcatagaagacagccagtaaatattagctgaattgcagtatagtcattggagacacagagccctaagaagtcagctttagcaaatcggcttcccggactttatttgccaactgggtattgaagcctgttccactcagccctgatgggaaccaagcagagagatgtgatgacacatgagatatatctctagggtctaggaaccaattacagtcgcctctgccaagcatctgttttgctacctggccaaaatttcaggatttatataatcttttccctcttgttttatacatgctgttattttgccattttgtatttttctatacaaattatatcttgtgagtttatctttttttctcattcactcgagaagtattgttgagcacttgggggcagagaattggtggtctctgcaggagtttattacctgcggaaatgcagcatacaaaagttaaataactgtgagtggccttcggggagggatatgattgactgtcctattcctggtccaggcagggatgctgagggtttggaagagccttccatgcctttgggctgaactgagaaattctccccaaactaagatgggaactaagcttgaccttttatttggaaaacaaaagagcagggagccctattagggaagcaggaggaggaaagacttccaggcctcttgaattccatttatctgtaaaatggggctaattccacctatttaatgaggtaatgagtgtgtgtatgtgtatattcccttagtctgccagaaactaatattattttaggat

SEQ ID NO: 76427 - DNA, 1366 bp, Homo sapiens
actgcacagcaacccaatgaggtgggtatcatttatccagtttacagacggcgactgtacctagaccacccaattgccctagaccacccaattgatagtatctgccataatttttccatgatactggcctccctgagagatacatagttcaagtgttctgttttactgatgagaaaacaggcatggaagcaaagtgcttgtccaaggttggcccctcagtcatgttgaagctgggtttggagaaggggtttcctaccttcaggtcaggaacttacgacaggctttgttcctgctcacaggcactttgcctcctcccccctctttttctgtctggtcttatttgttctctcttgccttctctcttgcatcttttctccctttctccctgggcccctgtatctctgcagtgtgcagaggctgggttttgttgttgttgttgttgttgttaagatgtgttattttttgaaagcattttaggaacactgtgtacggatagtccatacaaatgtgctgatggattgattaaaccctaaagggaaagtggactgtcctgggtttgctgcaatgcagagggatatggatggtagggatccgtcttgggaagatgtaggggaatgtgctgctcagtcagaacaatgaggatagagttaatgttgcttccttccagtcagagcctgtgttgacttactttttagaggaaatacttttgggcccctcctattccctagaagacattccagttttcttacagctgaaaggtcctttggggatcatccaggttcacccctgagacagaaagactcactgacttgcctgaggccaaaccgcttttcagtggctaggacctaggctgtccctcctgtcctgtgatcaggtccctgctgcagtcatcctgctgttaggtgctagagacttgttaaagagaagacttaggtggggtggtagtgtgtctgctggctttcctgttgtctgaagttggggaaagcgtgttgcccagatgatgtgagcaattctgggggtggaagacaagggcgcagggaatatcaaagcaattcaaaaaaacctctgacactgtgtaatggcttaggtggcttaagaggaaagctgagggtaatgtttgtgatttggaggctgtgtgattttaacaggagtttgatgtttgccttttcaagtaggagctggagattaaaggaaatggataagttaatattctggcctgaaaggatgtcagagtccggtaaaatatgtggctgtcgaagcactcaagtgttagtggcaaaaaggaaaggggaagatatagaagttagtaggactggaagaatccattgatccacaatgggagaagatagaaggcatctataaataa

SEQ ID NO: 76428 - DNA, 1045 bp, Homo sapiens
gcggaggtgggactgagtcattgaggccctctcctctgtctcagctctaagttcagatgtgatattccttgtgaggatggccgagtgctagttttgaacttgatgcttagttctaggttcctcttcagtgataattttttttaattaggaggagtagtcactaacatgccaaaggaatactgaagtgaaatggattctttttgtttaaacaaagttttagcctcagtatttctctagggataatgaatacctagtgaaacttttttttttttttttttttgcttggtgtactaaagccacaatccaaggacaagtcttgtttttttaaattctatattcaaggcagattatttcttaaaatgattagatttatactgtggccctttctccacagtagctgggttctcccattctgggcaatactttggagatttaggggttagctttcctctgttttatttctgaagcagtaacccttggcctagccttacatataaacaccccactgactaccttctatttatcttttctttgcaaagccctcatttccatcaccccgtctgttctgcacctgtcccgtcttaggcttcaggatggaattggttcctcgactcaggtagctgcttaagcagtaagggaggagccagctattcctgcaaagcaaaaccaaaaacaaacaaaaaacctaaaactgatcaggaactcatacatgtacatcttgtctgctccatttccataccggctcctccccacagtattcatgattttggcagacctttgctacctgcctgtcagatgccaggccttgtgctggctattgaagattccgagttgagtaattcactgtccctgccttcaaggaagtctcagcctggtgtggtgagacagataaacaaatagatacaataacctgttaaaggtacagtcatagcagggtaagaaggggtcatttctacgttggaggtgggtgtggtgtgaagtgtcaggaaagaattcctctagatgacccttgtgctgagcccctaaaatgactctattcctggta

SEQ ID NO: 76429 - DNA, 3506 bp, Homo sapiens
cagattaaaatcagatttggtaccaggtgcagtggttcacgcctgtaatcccagcactttgggaggctgagatggcggatcacttgaggtcaggagtttgagaccagcctggccaacatggtgaaaccccatctctactaaaaatacaaaaattagctgggtgtggtggcgggcacctgtaattccagctgcttgggaggctgaggcaggagaatcacttcaacccgggaggtggaggttgcagtgagccaagattgtgccattgcactctagcctgggcaacagagcaagactgtgtctcaaaaaaaaaacaaaatcagatctgggtagtatccctggcagagtcccaggggcatcctttattagggttatagatggcagactccctaatctatgcatataaagccttattaatggagaagggggtgtgtgtgtgtaacttaaaaaaaagaagtgtaatattatatggaatacctgttgtaaactaaaataactggcaaatgaaattaaataagttaactgaaatataataggcccacaccataatgtattgtaatgtatcgtcaacccatttacctccctaaaggcttatagaaaagaatctttaaagtcttgagctctgatacacacactctttctcactctctctctgtctctctactggttcctatttttctgaagtctttgtctgaactagagtgggtgggtggtagggctagttagcaattgcagcccattctccatgcctccccccgtctcatctttttcagggacagccaacataatgtggtcacaggtgtgttgggtgagccttgattaatgagattcacggctgtcgagtcaggtcctccggctcatcagcctttggcagtttagcaagcaggctggggccctcagctcccactgctgcattccttctctaggcggtgtattctctctttacgacacgtgttctctctctttttttccttttggttagttgaacttgttctgagtccaagtggcaaaggcaaagcctgacttgggtgtagcagctctgtgtcaatagccgtctctctgctggagcctccaggcaggcggtggggcagagctgggcagtttctgaaagccctgctgtgcctgactgccatccaggtgagacagagctcacctcctggcttctgcacgctgcaggccttgtttccccagggaggagttgaaaagccacttctgtgcttgcctctcctggcagcagggattcgaatagttgctagaattctctcaactttgtgtgtgattatggcttccttaccaaagtggctgcttttaactaacttatggctgaagttttcactttatgtccttgtttgtttgttacaggtgaatcagctcccggccgactttaggattcttctggattttaaattttttctttttaaaaaaacttggacggataaaagatgtgccatggcaggatagcaccaaagagcacctcagtgtttgccgtggcctccgtgggacatggagtgttccttccgctagtgatcctttgcaccctgcttggagacggacttgcttccggtaagtcctgacctgccttctgtgtgtgggtgggaaaatatttaataccattgtttctctcgaagactaggacaggggactctcctcctggcaggcggtttcagggagagcagagggtggagggcttttgtggtaaatatagcagggagccagtccttctgaggtctaatgagtcacctggaggaggggcgtgtgggagcctgctggtggtaaccttgtcacccctctcccccagccataatcatcatcaggaggacagaggtgtaaggttcagagcacaatatgcaggttaaggggacagactttggaatcagactgcctgtgttcagtgcccattctcactacttgcctgccctgtgactctgaacaagttattttactgctgcaaggctctgtttcctcagctgcagaatgggataataataatacctacctcactgggtggttgtgaagattgaggtaataaaataagtatgtaatgattgttagctgtcttttgtttgttcgtctttctgcgctttttctcagaatgagtgggtagttgaagtattgtaatttagtgaaaataagacccggtcactgacactacaaatgttgtgatcttgggcaagcgacttaaccattctagggctcagtttttccctccatcagatgaatgggtttacctggaataacatttaaagtcacttctttgcccctcagtaaatgctttgatgattctaaggactttgtggttgaagatggtgagctggacgggccctagcaggggctagacatgccccattgagcctttttgtttgtttgtttgtttgtttgtttgttttcagagagtctcaccctgttgtccaggctggagtgcagtggcacgatcgtggctcactgcaacctctgcctcccgggttccagcgattctcctgcttcagcctcccgagtagctgggactacaggctcatgccaccacacctagctaatttttttattatttagttgagacggggtttcaccatgttggccaggctggtcttgaattcctgacctcaggtgatccacccaccttggcctcccaaaatgttgggattacaggcgtcagccacgtgctcggcccattgaacctttttgagtttgtacagcccttgttgccttcaacagtgctccagagacccttctaggcagtctttgtgtgatcttctagacaaaatgtccttaaaggacatgtttgggtgtgtacggtaggcctctgggtggtgtgccacaacctacctctgtgtctacactccagaatcatcattgaactcaccaatactggtgttcctactggactttgttagaaacacatacatggcagtttccttgtccagtgcttcctggagagggatctcagaactagatcctggaaggggactttggtggggacagtaggggagtggtatattgtggctgtagagcctccatagtttagtgctacttctttcattctctatcagctcccaccacccacttatccaacataaacagataatggcacagtctcagctaatcttttttttcttttcttttctgaattgttggaagaaacaattacagatttttttgttcattgtagccttctccactaccaacatatagatgtgcctttccttccaccctattctgacacttaacccaagccttttccccctaggcatgaggagcccctggcacagcccagggggccatgatgattgggaccccacaatgtggccatcatggttatatgaggtttcaaaggaagagaagaccaggctataccaatgtgcaacaaaatgaagcagagcctcctttcatagggtcaccccaaaaccagaggaggcctctagaagtgctagttgcagaaccacagagtgtggttgactctcttattcaccactgtgtctttagagcagaagttggcaaactggcccacaggc

SEQ ID NO: 76430 - DNA, 3425 bp, Homo sapiens
tgtaaaatatacagccttgctatccagtgggctgtagtagaccctggctatatgcgtgtgtacaggcacattcatgactctgagaataccactagacataggtaactgggcatcctctggagacaatttgtctgcatcgtctctggtcgtagataccacagtcatcataatctgtatcatctcatcatcaaatatcacagttttgatcacagtctaaggtaggaagaatcaggtacttgagagttctggagtaaaattacatcatgtttaaagttcagtttccatactggtttctctcatctacagctcgagatttgcagttatagcagaaaaggtgttagagaggcattgggtccagctttcctttggtcattcctttaaatggggagaattattgataagtttcctttttaagagtggcaaaaggaggcgtatcttattcttcacacctagtcacaccatgcagtggatagaccagaattaaaaataaaatctatgcacatgctatccaatttgcctttcttggactaggcggaattaagatcttttctctgtagcagcctttctcaggtctccaagtctttcattttacctgtagtcttaagaaacttgctgtatgacctgaggcaaatcacatgacctctttgtgtcttttgcaaaacagaaacaataatccttaagaatgttaagttggtgttgtgtagactaataaaaatgattggaaggcaggcacttggcatataaaatgaagtgtgtgatgtaattcccaaataacaacaacagaattggtatgtgacctactgttgagttacaaggtgcagtagactttttatgcagttgatattctttgctgtcattgaaacacaaaacttaaggtgcaaagtactgtttgagttggggataagagatttttggagcagttatcaaatttgaccagtaaggagggattaatttacttcaggaatccccattgctttccagaaagctcatgtttgcatagtttgatcttaatccaactggcttgctgactcataaaaagtttttgtttgcattctctttctttcctgagcttatttactaaacaaactcagtattttacttgtttctgatttttttccccttaaaatgttgccatgacatgttaggccgtgttaaacatcacacaatcacctaaaacaattttagaatagcagggaaaacagccatctgcatttctacatgacagaaagccaggcagttagttttcattgaaaatggaaagtgttgagaactaggttctctgggagatgacttggctttagcctgtagcagagagatgttggcaggtggccctggctcacctcatcttggaaggaccctcgagtcagagagaatgtacactgagttgagaggagaaaacaaatgggaaactaatgtgtatagagcatcacttatgtgtcaggctctgttatcgttccatataaagctctcagaacaccccagctaggcagttgtgcaaccattttataaaggagaaactgaaccagagacaggttcaataacttgttcagaaactgatgattttaagtggtgaggctggctgggatttgtgctcagtatgtctgactcttgcctatggtcttttctgggagccacgctacctgtgctgagtgacaggcttcactgagacctgttttttgtatttcctgtttgaagtgctcagatcagcctccagaaaattattctgatggaggaagaaagagatgatgttttctcctgatggataaaaaggatacaagagtcatctctgggtcaccatgtttcccactatggttgtttctttttttttttttttatttgagatggaatctcactgtgttgcccaggctggagtacagtggcgcgatctcggctcactgcaagctccaccttccaggttcacgccattcttctgcctcagtctcccgagtagctggtaccacaggcgcccgccaccacgcccagctaatgtttttgtattttttggtggagatggggtttcacagtgttagccaggatggtctcgatctcctgacctcatgatccttccacctcggcctcccagagtgctgggattacaggcatgagccactgcgcctggccctctgtggttgtttctgttctcatctacagtggctcttggttgtttggttccagtttaggcacaaggtttgccaaggtggttctattcttggaaaggaacaatagggacgtagtaaatagtttgctaaatgaggatatagttcccaaaacatccgcaaagcatcttcctgtcagctgcaaaccctgttgatgaaagtgatgtaatctctccatggtgtaattacctgtgactataaaaaaaacttagagattatggtaggaggctggatgggtcattatagttctcgatgaaccctagtgtcatgaaaaggcattgagaaattaccctctgcacactaattgttgtgccatgtttaaaacattgacaacacatggtaccaccctcgcactgtaactttctaataaaagaaacccagagtccacgtaactgggtccctattgggttaaagtcctcattaaacacagattccatctgctgagcaatggtgccccactaccctgctaacttgccagcttagaggttattcttcttacctacccgactttctgcaaaagagaggcacaggatgctaataaaacaaaaattagggttaacactcagtcttcaatgattctaggtaggtttccagatgaacacctctcaccacttcttacccactggaagagtgcagtgcatcacttgggagtgggagcctgcagagggtgtgaggagcccttccaggtggcctgtgctggtgtgcctggctgcctggactgggatcagatcaggagagaccttggcctgcctcagatttagctttggggcccagagggacagaaacatttagagataacgtttccatggtgcaatgtgaatgaggagttccctggctgctgacttctttccagccctgttcatcgacctcatcttcagctaatttaacacatgaaaatccgaattcactgaaagatgagggtgtgactataactttttttttctgagacagggtttcactcagttgcccaggttggagtgcagtggctctgtcacagctcaccgcaacttctgcctcctgggttaaagtgatcctcccgcctcaccaccttagcctcctgagtagctgggactataggcatgcatcaccacacctggctagttttttaaaaatatttttgtagagatgggttttgctgggtttgcccaggctggtcttgaactcctgggctcaaacgatccacccgccttggcctcccaaagtgctgggattacaggcattagccactgcacctgactgactataactttttaagaacaggattgtccc

SEQ ID NO: 76431 - DNA, 2591 bp, Homo sapiens
gagttagatccttgatattcgtgaggttttctgagtccctaaattctcaaataacacatgttggtttcccatacatgaagacgagtagcaaagagtggtaaatgcccttctgagatgttggtgctggagtgagatcagctaagtgatctcactgtgaactatttgttctcttcagggaggctaccctgttggtatttcagagctgatattcctcagggatgctatttgttaggaacatttggagtcagttttgaaactttacatattaaatatgagaatgccaaggatctgttcttttaaagacattttttatttcgtcagcacagtgatgtgattggaaggttgcattttacatgattccaaaacacaactgggagaatataacattagaattaaaaaataagaaatatctttttcccatttggtagtccttttgcttcctcttgcttttcgtagctatattggtatttcttcttttaggagcccctttctacctagatttattggcatccctggtgatggagatttttttcttgtttaacttctttgacttattagctttgccagtaaccagatcttttaaaggagaattgtttagtcatccaaaattctgggaagtagtgcagggaaggtaaacagattgtcttcaagatttcttggccaagttttttttttcattctttttaaatcacaaaagtatttttggtatttcagtggggagggggcacaaaatgtgtttcaggaagttatgaccaagtaaaaacagggctataaaataattctgcttcatcctttgttattctgagtaacaagtgacactctatgaaatacaaagggcttgatcaattcttcccatgtagtagacacatgtctccttgggagagggcgggacctttgtgtttattgtcactggcttggcttctgatgattcggccttgttgaccctggctatggtaagaggcaccagagaatgtcattgggattgttgcacactagactatgactgagtgggtatgaggatcagcctgtcagtgtttcctgagcactggtctaggcacagaggggtttggtggcagataggagaaaagtcttggatttctctttttccctgttgatctcattatgatccagaggctggattgcaaatgacccagtggagtcttcagccagtgcagccccactaaggctccttgataactgtgcatggttgctcacagtttcttttttttttttttttttttttttgagacggagtctcgctctgtcgcccaggctggagtgcagtggtgcaatctcggctcactgcaagctccgcctcctgggttcacgccattctcctgtctcagcctcccgagtagctgggactacagacacccgccgccacacccagctaatttttttttttttgtatttttagtagagacggggtttcaccgtgttagccaggatggtctccatctcctgaccttgtgatccgcccgcctcagcctcccaaagtgctgggactacaggtgtgagccactgtgcctggcggttgctcagtttctgattagcggcccatgaagttagctggagcccttcagtaggctgtgtggctctctgttttatacctctcacacacctctctgagctttgatatctgtacacactgctttcggttttatttctttggttttgctctttgtttttgattcttgttctttgttcttgattccatatgtgtttgcatataagctcgttgaacacagagacaaaatcctttttatgttgctcctttgctacagccaggccagtgatcatcccagtagatccaacacacgcattgtgggaaaggtactccataggtgggtttaccccataggatgatccagaatcatggcttgtcctctgtgtgaggaaagcaggagcaagtccagggcccagtgagcagtagcagtgtgtgggggcttcccactgagtgatggttcctcatagtattctgtccccagccttctggggaggaagtggaggagcacgtgaaagtgttttcatgcctcagggatgcaggtggtggggctcttctgtggagaaaagagagggcccaggcaacctgcctagaagagtacgttgcagagtatgctacctttagcttgggtgaggatttcgaacccagtgtggatcctgttaggtgatgaagagttatatagtttgaaagtatatccccagctgggtgcagtggctcatgcctgtaatcccagcactttgggaggctgaggcgggtatatcatttgaggtcaggagtttgagaccagcccggccaacatggtgaaaccctgtctccactaaaaacacaaaaatcagccgggcgtggtgatgcacacctgtaatcccagctacttgggaggctgaggcaggaaaatcgcttgaacctgggaggtggaggttgcagtgagccaagattgcatcactgcactccagcctgggcaataagagcaagaattcgtctcaaaaaaaaaaaaagaaaaggaaaagaaagaaagtatacccctaccaaatctcatgttaaattgtaattgccagtgttgaagttggggcttggtgggaggtgtttg

SEQ ID NO: 76432 - DNA, 1052 bp, Homo sapiens
tcattaccagtgggaagtgaaggaggaatgtatatggaaatcatgctggctgtaaacatatcctgacattagagaggggcatgagagtgccacttgggtggggtttggcttcactttcttgcctactgcctttgcagccacagcttcctctacctctacgtctgtttctaaagatcaaggctaagggacaactccttctcccctaaacatcttcaagcttattctcacctggttcttcctgtggctagaattctacctcctgccttttcctcccatacttctctttatccttcaaagtccaacttagcttcttctgtggaacatcacccatctctcttaccactagaattaatagggtctgaaggaaggagagtgggctttgtgtgtgtttattgaatggaattaacaagagctcctagtcgtagttctttctcttgggaggatgtcagacaggttttcctaggagcaggattccaactcttagaatcttgactgactttgatttgaaaggattggccagctttttatgacctctggtaattgcagctttggggaacttgaaccttttgttctgtacatcatggtacatgaacgctatagaccttgctccaaaccctaatgaccctgggttttggtagggttgctgtggggcagattgggttttgtattttcatgagtgttaactccttaagcaagtatgtgttgacataaggtgggcaggagctatgtaatgccacagagggctttctggggatgaggtactaggctggatcttgacagaagttaatcatatgtagtaagcctgtgagaggagggcagcagcagccaggaactgtgctctgcactggaggaatgcagagttatggtttagcactctgatttattccacaggtactcgttgaattcctgctgaatgccaagactgtgccagctactgaaaatagaacaattccatgtgatacatgctataatcaggaaagtactgcactacacaggaatactcattagggggtctcctgactcagcttgaattggtcatggaaggcttttct

SEQ ID NO: 76433 - DNA, 2294 bp, Homo sapiens
aacgtacataccatatagggttgtggtgaagatgaaatgttgctgttatcatcatcgttgttaaaatgtggcacttgccagtggcaggtacagcccgctgttgcggggagtctggagggaggagaggaagagagtatggtgtctgctctgctcatctcagcacttcctttcctgggaacttcccatgtcactgttgaaactttggatgtccaatatactgtattccctaaactaatttgtttcttgccctgtgaatgaagaagtgttctctttcactctggtggagtatgttcagtagctgtagtttcaaaaaagaaaaataaagtctaaccttagcctaagaattcagggatttaggttgagcacaccaaaagcacagtttgaggaagcacccagataggactgagatgctgctagtggaggcaggtgcctgtcctggctgaattgtcagaattgtggaggaggaggaggaagaagagaaacaagctctcttggagtatcctaaggatcaaagagttaaagaaaaaacaaactctagctaatgaatcaagaagttgaatgagtctaaacaggaaaggaaagagggttggaaggaggatgttaattttaggtacaatttgtgggagaggattggggatgagaagaatagcagtgggcacctatttgcctatgggacaggaagtgatgggctaggtgaggctgcccttctggtccgagggaagaggtcactcaggacaggccacaggagtgcatgcttcttgactctcatcacctggcctcagttcagccaactcgtaggaggcatgtctgacaaagactccttatttcagcaagtctgatgtaccgcgtggggtcccatgtgggtcttatctggcgtcacaaattccatggggaggctggagggtgtcagaggttcttaattgcttggggaagggagaagagtggaggagcagctggcgtctgggcccttcagatgtattccaggatttgtcctcttggatcaggctggggtaattggagaagttggggtgaggactgtctgtgatttgatgtgttcaggggtgcagagaactattgtgacttccagcagagatgtgtctcaggtttctttgagtggctttcagcaaaggaaccctttcttggtgctattgttctcaataccttgttgttaggcagtttagaggctttgctgttcaactggctcctctctctggcattcagaaaatctgtcaccagtaacgcagaccctggccttggaggaatagttaagattgtgaataataggattaagtgagataatatatgtaaaagtcccgggtaaacaataaaagtctatttcaatggaatggattattataatactattttttcagtcagcatctcttttctgaattgctcagagcacttcgttaacactaactggttaatccaccatccatccctggttggaggctggcatttaatagcccccctttgtatgcaagatcaaacacaagtttccaacaaacccccacatcttgagcttgaagcccaaacctatggaatcgaaatctaaagcttggacttctaaatgtgataatgcctcattcctgggaataaagaaggtgagaagagagaggagggatcattaaaattttttttttcatgaataattggtcatgtcagacaaggctgtcatagtcaggattttgaatgacctagaagtcagtcagtcattttcctctgagaagccagagttcctgctggaaatgaaacttgataggagctggagaagcagaaggctaagaagagcagctttggggcaaagaacagggaagcagagagggggctggcagatttcttcattctgtcctattaggctgtggtggaagtacttgagatgccaggttctgcatcacagtgctaactgcctggcacatggcagtgggaacacactctcccctctgatgtgtaccaggaagtgtcagggggacccacagcaggtgcttggtgtattcttcaggtctcatgttgaaacttcacagagcacccccgagtgtcctgctcaggccagttttgctgcagaccaagtattgcagtccagtttggcagggtgggatctgagcagatcagccttaggccgactctccagtcaaggaaaggcctaggtgcattggtccacctgtgtcccttccgaaggctggtctcaccagcctagagctggcatgaaaaggtcctgttttgttcacagtactaggtgaggccattcagagtcatcaggacctttttccaagcttgtacttccctgcctctgg

SEQ ID NO: 76434 - DNA, 2409 bp, Homo sapiens
aacttggtacagttgtcttcctttgccctcctcgcttccatccttccttccctgcttcctttgtactcatttttactcctcagcactctggcagagctagcatgtacgtcgagtgctttgggggttaaaagtatacacaagacaatcataaaacaccctatgcaagccatctatgtgaggggttcctccagagctccccactcttcctccttgtctcttctgcccactttgtctagggtagctgggaatgttttcactgtcctaggggaatttgctgttcttcagattgaatttgaccccgttttcagcctttatttcccaccagagcctgatggtgtttgtattggcaagccagaagactcctggcttggagagaattagagttagtacagcctgcctggccctgtcttttcagcctctatctgaaggggcaaaacaaatttttcggccttggttaattgttacttagcccctctgatccagcctgggcaactttcaggtagctcaggcactgactagcctgaagtctctgttgaaacagggaagattaaagttgatttgattcatttgaagtaaaatcagcaggcttttgatgatttcattaatttcctcccttctgaacaccctcctgttagcagtaattggaaaccctgactctgtttctcatttcccccccacccctctgctttaatctgagacaactggaaactgcactcagctttttcatttactggaagaatggtttgaagatggttttaatgactggctttgacactgtttccagaagctgagactgttgccgtgcttaagttcacacctacctgggggcctcagttttgctcaccttgcttctataaaactgcttagttcttggtgtgcaggtggaagagggtccccatgagaattctctttttatcccaggcaatatatatgcaagcttttcattactcattttcatcactcaacatttacagactgcctggggtgtgtgccaggcactgtcctagtaactgagtgtgttcccagcacctcctcctggccctggtggacgtccagaggactaggtaggtgagattccagcaggatggtggctaaactcaaaccttgggaactgtagtctctggggctttctttctctatctgtttttatagttgcaacttcagtttctgtgctttttttttttcttgggcctgaagaggaataaataatatgaaccaccacttgatgtcagagaaatagcaggtagcaatagctgcaacagctaatcactattggcagttgacaagatgtacaaacacttgcttgtatatcatgtcatattgttgtcctcacggtaaaccatcacagccagtaaaggacaaagccagaattcaacctaggccttcccattacaaatcaaatactttttgtttattattgttattatttttagagatgaggtttcactgtgttgtccaggctggtctagaactcctggcctgaagctgttctcccacctgagtggctgggattacaggtgggagtcaccatgcctggctctgctttttgtactatgttgttttgtttgatggtttggttttgtttttaacgctgacttcccatgctattgtctttagtatgacttcaaccacttaagtgttaagaacctattatgtatgcattgggtcttgtacaaggaagtcagggtctcacagtctaatggggggaaaagataagacaattcatcttagttgcccttgagtgattcaggtactgaatgctattagaaagaagagaattaaccctgatgtctgtctagggaggcttccccagaagagccaagacttgaattgggcatggtggaaaggcaatactcaaaccaagagagaggtgaggaggagttttggttcctatatgactacctcagactcggggatacaaagaaggtggtaaggtttgtttccttcttcagacttagaaaaccagtatcctctggggtgatgctcctccaactttactgtgctttttctttttttttttttcctttttgagacaggttcttgctctgtttcccagattggagtgtggtgggtaatcacggctcattgcagcctccacctcctgggctaaagcagtcttcccacctcagccttctgagtagctgggactacaggtgcatgccaccatgcctggctaatgtttttattttttaaaaaaattgtttttttagagatgacatcttagtatgttgcccaggtgggtcttgaactcttaggctcaagcagtcctcatgccttggcctcccagagtgctgggattataggcatgagccaccgcccacagcctttactgtgctttttaaaatgagattcccacatattttgcccacaaagaaccatttagtagatctctgtacagcccagcaatct

SEQ ID NO: 76435 - DNA, 2067 bp, Homo sapiens
gatcgcttgagcccaggagtttgagaccagcctggccaacatgatgaaaccctgtctctacaaaaaatacaaaaattagccaggtgtggtggcacatacctttaatcccagctcttcgggagggtgaggtgagagggtcacttgagtcccggaggccaaggttgcagtgagccataaatgtgccactgcactccagcctgggcaacagagcaagaccctatctcagaaaaagaaaaatagttaacaaaagaaaagaagttgttaaaaaaacaatgctgcaaggaacatccttgtgcatgtgtcctaagcatgtgtgcagaatttctctggtatctacacctggcaggagagttccggattgttggaaatgcacttcaactttctgcatattcttcacagtaattgtaccagtttacactactactgatgtataagaagattcttatatctccatatgctttacaacaactggtattgttaggtgttaatttttgccagtttgatggacatgaaatggaatctccttaaggctttaattttgtatttccttgattatcctctcccaatttgtagattttttgaacttttcttacggcagtggttttcaaggacctttgagatccttttaggggattgacagggttgaaattattttcatattaagatgctatattacatactaagatcctgtttgccttttttgcactcattgtttcatgagtgaatagttgagtttacagaagctatatggcatgtgttgtgatcattgatgttaacatctgtgggtttattgttattttaaaatgaattataaatatgtaaaatttttagttctattttcaaatatggtaatattgataggtgtaacacacaaattctttgggcatcctcaataatttttagtagtgtaaagcaagcttgttcaacccacggcccatgggctgcatgtggcctaacacaaattcataaactttcttaaaatattatgagtttattttgcttttttttttttttaaagctcatcagctattgttagtgttagtgtattttatgtgtggcccaaaacaattcttctttcaatgtggcccagggaagccgaaagattggacacccctggtgtaaaggaacctgagagcaaagagtttgagaaccactattattttactatgtcaatttttaaaatatttttttcctgtctggtaggtttcttgtttaagaaattatttcctatccaaatttcataaagatgggcttttatattttctcgtagaagttttggaaagtatttttatgggtggcgtctgccaattcccaggcccttcaaccactaggaatagtttttaattttatgccttctcagaaacacttatatggcctgaatggaacatcttccctatctgaatataattttttggaagggcagtatgtgggaatagggatttagccaccttcttcagatcccttttgttcaagagagcctcctagcattttgcagagttcagcagtctctccttaagaatggtgtacactctcattttggatccttgggttcactggttttgcagttggctgttcagaggcccagaacccaccagtgacagggattctggaagcaaaatccctctctgcagcccctaacccacatgccccagtttccactggatacttgagtttctgtcaaggcatcagtgcccttactcctggttgtgtttgtgctggagtgggaaggtgtgtaggcagctgactggttaactgcagtcaaggatataaacaatggcctcctctaaggaaaaaaattacattgctgacatccaaggccccatcatctctcaccaggctcttactggtttccgtgtctccagtgtctttctcacccttcttcccacaaatctgtcttccaccctgccagaataactctcagaatctcatacttggcatgatgctacttctcctcttaaaacaaaagaaaacaaactcagggtcccataagacttatggtaaggtccattcttcttagcaatataaccctcatctgtactttcagctttcttgccagctgcttctgta

SEQ ID NO: 76436 - DNA, 2260 bp, Homo sapiens
aaattttatttacagtgttggccccagttgttttgcagcctagttcttcagtagttgcacaaaaggaagatgccttttttgtggttaagagctgatgttgatatccttataaattgtcttcctacatgcctttccttcagggagggaatgcactgaacagtctgatggcaacaactagtccctcacccttcgctaccaccaattattgtgcattttgaaaaagtagtacattgacatctgtcatattttaaaaatggtacatgaaatacgtgtatgcattaatgctgtctgcagaaaggtcctgctcagggaaaaaattctggatggtgctgtttttcccatttagccacacctagcctcctgcctcccctttagcagcctaaaaaaataaaactttataaaccctggacatctgttagacatgcaaattaagcagattaacttattttctgaaagagctttatagcagaaatccacatggatgtggagaaaagggggctcctgcttggaagactgctgacgtaagtggcctgcagtaggagggttgtggtgggccagagaaggggacggccccgtagggggatctgaagtgggagactttgattgcaggaatcttcatgtcattgttaacatctgaaagagttgactttctttggcaacttatttatagccttttcattacttcttgagaatggtcgctataaagatgggaaaagtaagatagtaaaatgggggaaaaattatttccttggctcacattgcagtgatcatggcaaaggtaggattggatctgttgcatgctgccttttagtctgttgcaaacaggctaggtgggtatgaattctcaagttcatgaaaagggcttacggctaaagaagtggggtctgagcactcacaaattctgggttactgtgttaaatactgtgttaaatgttgaaaaatatgttttcatatggacatgcatcagagagaagtttcttttgtgggtaatgcttgtcttgttacttgaagagtactgctaatgttgctgtaatgtttgattagtagtagtttgagaaatgaaatataggcctggtggggtggttcatgctttaatcctagcgcttcgggaggccaaggtgggaagaccacttgaggccaggaattcaagaccagcctgggcaatacagcgaggccccatctctactagaaaaaaattctgaaatttagccatgcatagtaatgcatgcctggaatcccagctactcgggaggctgaggcgggaggatcttttgagcccaggagtttgaggcattggtgagctatgattatgccactgcagtcaagcctgggtgacagagtgaaaacttgtctcaaaaaaagagagaaagaagaagtggtaaaatacaagaagtaattaggtaagccttgcatatcaagcagaatggtaccaattttctcattctgccctactttgcccatgtctcttcccgtggaacccaggccctctggcacatatgagaaaaacaatccttgtaatcaaaccaaatgtatgaaatacaaatttaaaactctccccaattaaaaaaaaacagagtatagttattgcaaaaagattttgccatccactgaaggagtcactgtgcaattgttttaaagagcaagggctctggtttatctataataagattacattttcccctaattttttataatcacatttgttgtttaaggcatctaagagaaagagaaagtgggagggtggagtcccagtggcaccttgggcaatatcagatgaagtgtttggttgagactgcaactctgaaaactatgctgagttccacatctgatcataagaagttgcctcccttttttcccctgcagccctgtctctcctagaacaggctttgccaaggatgaaaagcctgaatgtcaaatcctttctgtctgccctggcagggaagctgttctgttttccaagaagccttttttttttttttttttttttttcacttggggaatttttactttcctcttatgggaagttgcttcatcatttcccaaaaatatactgtacctcctgtttaaacagggtgcccttgaagagctctggagcctgaagggggctaggggtgttgtgaagtcctttgtttcatgctttgatgtgagctgaaatgcaggctgtctacaggcagaagtctcagagtttgccacgactggggtctggaatggggtgtaggaggagaggctccctgggaagcaagagctgggatctttttaa

SEQ ID NO: 76437 - DNA, 2051 bp, Homo sapiens
aggctgagctgaggccatgatcatgggtgagtgaggccagtgggggctgcctagttggacttgatgttggagaaatggaacaagccaaagtgtggagacatgcatagccagcagaagcatttagacttgtagaaagtggcagcctttggacgattctgaaaagaaatcatcatgaggaaaaatgtgttttggggggaagatttgcatatgaggataaattatagtatgcctccaggtgggctgcaggaaggagccccaactctgtccatggtttttggaaggagatcatgctgtaagatactgggaggggaaaatggcctggtagaagtctctttttgtcttgggtgagtgtggtcccatagtggtgcctatggcccagtggccttctgcagtcccccttgcagggcacagcagttggagccatcaggttgttgctggctgagtaggatcagctctcaggcaccaccctaagtaaagctttgatcaggccctgctgcaggtggaagtgatgtctcctagcggacccagtggggtcaagcataatgtgtagcaggtttcaagcctctgctggtcgttggagaatgagattggccaggagatactgtccaggtccaagtgacaccagtcatttcatgcctaatcagcagtgaaagtgcggtttcctgaaacctttgctgatattgggtgttactaccttcctttgtgccttggacccccttaaagattttaaataagaaatctgatatgtaaaataaaggaggatcagtcaaaaagtgttcttagtagaatatgtatctagcagtcactctttgtgaaaaatggaaattgggaaaatattttgagagagattctatcagtggggacaagcaagcataaacatgttatgcttatcccaagatctattaatttccagtagaagtagggagagtaaattattgccaagggagatactgcccagttttcttaatggtcagaaaatgaatgacagtttcaatttcagctgctgtccctgggctgggcctgctgacttgccccaagtgccttggcacagaccgtggtgtggccagtggaaacatcgtgtctgtagccccgtgaatgagcagttcctctttgggggtcagctcagcatgttgccaggccagggggcaggtcaggccgaggctccactgttagccttgacttcccctgccaggagatgtggggccattatggcagaagaggagctaaggagaaacacctagcttggagccttgagtcttcaactttcacctcaagttactctccttaaagaccagcactttctttcccacttttcttgaaagcctctaggtccctgatcctgtttcaaactgctggtatataaactgctcataccactctgagttatcactttgttagggctgagtagcagggtggcccttaaacaggcctgactttcagtggctctgcccacgtttgcagaagtcacagtgggaaattttcacatttttctctgtccttctaagatgggacagttgagaggactcaggaagggttgagggagaaagcagcaagcccagagttcagaatcggttgccttgcagcttgtccttttgtggtgggtgatttcacttggtttttcaagtgaagggctgcaagtacaaatggactagccctaaaggacattacccacatgcatagagccatgaggcacattgattgtttcccataggccactttgctccccgttgaggaaggaaccattgtgctactaatattattccactgcaaggtctggctggaggcatctgcaaagactcttcagggccctgattgcacatttgacaagtcttttccatcaacaaagcatagagttcggggaaacccaggatgagctgtcattctgagtaacaggcttgtgcaggtgctgactagcttgacttcccttgattcagtgcaaaccttgggaccctggaggcagtcctggtctcttagtaaaatgcaggtgtgtgtgtgttgctgagtaccagagattttggagcctcgatactttcctcatttgtatgtggacc

SEQ ID NO: 76438 - DNA, 3302 bp, Homo sapiens
cctgacctcaggtgatctgcctgcctcggcctcccaaagtgctgggattacaggcgtgagccactgtgcccggcctagcttatgattttaagctgtcagatgggcttttatttaaaagactggcctgctcaaacattgctagccttctataacataaaaccccaggtttggggagttaagagaaaaccaccaaaaaataaaccagctcttagactgtgaactttctcaaactctctagtttcaatccgtaactgtgggtaggtagagttgttatgtatgtgctttaaacgacaaagtttttaagaaaaactaaccaacattccacactggggtactattataatagagaaaaatctctctaattatagcagtattgtgggcttctcccatgcctggctggccacgacatggagttgataagcatacagtgtctttcgtacttgccgttacaactgttaattaagagaattcagctgtggcaccagctggggatgtctggctttgtggaagattgcaattagatgcttttttttctttttgttttttttcttttttttcccttttcaactttggtggaatgcctttgagtaggggcttttagtctcagcagtataaatactttataatgtgcctaattatgtaattatacagttatactcttctgtgtacacacacattgttttatgaatttgtatgcccttttctaatacatgaaacatctagcctgctttttggttgttgtggtagagccagactcctctctgcattgggcagaaagaagaagactagatgtatttactgattagcttctgattatgatctgccctacttctgttcctcttccacctccctcttgaccctctatctcccaaataattagcatcttagtagctacctagcaaagtcaaggtaatttgaataaaattggattgtataatactcttatctttccattagtttgcaaatgtagtccttcaaagtgtgtagtgttatttttcccagtcctctgttctaggcagttatagagcatgagcctggacgtgagagctcatgcatgcatgcaggcacaatgggacccattgatttctggcattcagcttgtgcatagaggacctgtgaccccagctgttagaaccaggacctgggagcagctgctttctggatccagtcctccagggataggccatctgctgccatgtgagagaaccctggaaaagaaactgaccacaagatatctttgtattccttttctgtgtgctccagcccctttagttctttcctgtcccctctcacctaggcaaacttgagaagcatgatgaatctgcactggaaaactcgcaatggattttccgttttcttcccctttccccactccaccctgtcagcacatccagcccattggaaaatagtttccaggggatgtaggcagacttatatgggcagcttcttcagtgggattggtactatttagcaggctttcattttattatgaataacatggctttgcattataggcctagaagtgtccttaaaatctcatctcatggaagaggaacccaagattccacattctttagccttgcattcagggcctaccctcttctggcaccagcctgattttctaaatgttcagttatctcctgctaaacctggaaacatttgctaacttctccgtacacataccacctcttcttgattctctgcctttgtttgtgcctttatgtcccccaccatgttcttcccactctcctttatccccgtcataatcctttatcccgtactcatgatcctacttcccgtgaagttggagctctgataccatttctacaatcttctttggtctcttccccattggattaatccttcttcagaactttctgtagcccatattgatttctaacatatatctattatagtcgtttattagaaagctcctagagtgtaggaccaatatctttttatctttccacctgcctaccttcacctgccacagtgcttttggtacttagtaaaaacttgttgaaaaaatgaatggcagaattaagctgagggaagagaaaaaaagaatgaatgggtaaatataatccttacatggattctggaagagaagcagtagatattactattattttaatcttgttggggctccttatctgtattcccaaagagactgaagtctcctcaagggcacaccatgtgtattatttgcccttgaatttctagcagcagcctaacacatagtgcttaatagaaatttgttaaattaatgaaggaatttgttaggaaagtgaaacctggagagaataagaatcaacacttgtaaatacttttaaaaatttgtttaattttttgagatggagtctcgctctcaccaggctggagtgcagtggcatgatgtccacttactgaagcctccacctcctggcttcaagcaattctcatgacaagccctcccgagtagctggaattacaggtgtgtgccacgttgcctggctaatttttgtatttttggtggatacaaggttttaccatgttggccaggctgatctcgatctcctggcctcaagtgatccgcctgtcttggtctcccaaagtgctgggattacaggcctaagacaccatgcccgtgtttttttactctcttttgagtgaaagttattagttattaaacctgctgtctggaggacaagagattaaaggtattttctgtacatcaatgtggcatttagacatagttatctaccaacatgcagtgtgtgtgaggctgtccgaggcattgtcttctgactgggcatctcagactggtcagtcaaaagtggcttgcgagagactagggtccaaagagccaaagaggccatgacaggtgacaggggcatggtcctcaccctgataaataagcatggttgagactctactcctgactgttagctagtttaggcccaagtttcactattttgaggttgttttgttttactagagccagaccaatatgtacacaggctaacatcaaaggccagtcctagaccttcagggccaggcatccatccttctttggactttgcagcaggcttgaatgcattcctgttgtttttaaagatccttaaagaggcttaaatgtggcttcctcagagaaaagcatgtgggaaggattcaaagagaaagcttgtaagaggagcagagggatcttccaggagcacggtatgctgagcaagatgcaaaagttcaaagtagtgaagaagagaactcctagggggatttgactcctcactgtccagaatcagttggtgaaagttcccctctgg

SEQ ID NO: 76439 - DNA, 2069 bp, Homo sapiens
tccaaacaggaattatagcagcttttgtccatatgtatcccacccctatgttatactttgtaggtcttggggtaaatttttttctggtggcatcagaaaaaatcaagaagcttccttgtagaagggccagccagaatttgaatgcagactctagtacttagaatccaggtgacctcagtccattactaaatttttcagagcctcagttttttctgaacaaatcaagttttataccaccttcttcctagggtggaagaatttaataggataacacttttaaagtaccagtgcagtgcctggtgataaatgttaattctcttccttacttgtatccttttggcaacagagatcattaaatttgttttaaatttgattgtgtgtttcttgaggccctgctgtgtatgcctgggactgtacttggcattaggagttaccattagctggtaggattggaaatgaaaccacaattttggcctttgtacccaagagtccaaccctgttttaaactctaagccagactcctaagtcagttatcacctgctcatcagctttccttctgagctgccgtaaacagccatctgggcctttcctgagaggaccagtcatctcctctgggagatgaggaattctgagaggggagagcaaacacatattttagctcaggtaggtgatatggtgaaggagatgagaacaagaagtgacaatggctgatgaggaaaaaataagcattctctgctttttcttaagcctttaactgccactgtcaagggaaacagtaacacttgctaatacacgtggaatagcctggctccctacctccattgtcatcccaccatctggaggtggaggtaggagacagctgtgggctctgctctataggtcactgtactgacctatagcagtggtagtggctttgggcactgagtgggctagccctgtacctggagcagcaggataaaggagaatggtcctctggcctgcccctccttgtagcagtggtaacagtgggagggggaggggttcccagccccagctggcagcctgtttccctgggtccctgagctgcaagaacaagaggaggtgaaagggtaacaggccatatggagtccatttgtcagccaagagcagcctgggctgtattgtcgagaacgggaagtgaaaaaggagccggcttattactgaactggaacaaggagagagcaaacaacaccccccaaagtgcttatcctgctctgttttctgcctgccccctctccaaatatccagaaatttctgaaataatcctttttctttttaccaaagcctttgcccattccaaaaatcagagataagggtttagtttgctacatgaaaatttatcagtgcctagtaatgtgccaggcatgatacaagaccctttcaagtatgcagttttgttagtcttctaaaaaaacctgtggagctggatattggctgctaaggactaaggctcagaggagttatgacagttgacaaggctgcagagcaggcccctgggtcaaacccagattcatctgtctgacccccaagactatgctcttactccatgtggctctggtcctgttaggtaggcagtgtattttcacagttaggtaccaatttggagaatacaaattgtaccctggagagggatgctctttgccgttgtctgttattgactcatctcaaatcaaaaatcattgtggctcattgcagttgaaaacaagacagtgttttgaaataaggacaaaattttgcaagtcacgttggttttctactaagcatctactatctcctggattatttgtcaggtactagggatacaaaaatgagcagaacaagtctctgccctatggcttagatgtgtgggttggtggttattggggaaatggaggaaggaccaacctgtgagaaaacctgcagagactacaacatggtgataggttacaaataggagtgaagatgatgtaatgggaacccagaggaggaataataaagctgctgttattgaacacttagtatgtgacagacccattaccaggtactttacctgcatagttgtgattaacctt

SEQ ID NO: 76440 - DNA, 1060 bp, Homo sapiens
acctcccctttgaaaaaggctgttcatactgggtataactctttcttttatatgctgtacgaagtagctggatgtctccaaagccataggctgagcacatcaaatggggaaatgagccacaaaacagaacctggcaggtttcctgatgccctgcccccctcagcaggccccggcttaactgagtggtcaggcttgcagcttagaagccagagttcctggtgaatccagccctgccaattacaaatgtgtggcttgaggcagatcactcaactcagttaagccttattgtccttatctgtaaagtggagaaaatatagtacctgcttcatgtagagagagaacccagaagagtacttggcacaggtaataaactatctgtttgcaataattactgttttccttattccaaaacaaacagaactatacatttaaacacctttgttctctgtattgaccttgctttttctctggatctctttgcttctacaaaccattgaaggctagaagtagaaatataacctttatatataagaaagggttttgagagcaagcacataaatagtgcttttctaaataactttaagagacccttagtgctaaatgcctccttctttccacatcttcagcctcacatttcatgccctgtcgtgtggttctgaaccttttccactgttttcagatccccagacctgtcctgactgctggccaaggactccttcactgagactgtgctgtccactacaatagccactactaggtggctgcatgtggtgactgagaacttgaaatgtgtttagtctgagttgaggtgtgctataagtgtaaccggaaaggggtccagattcagaccccaggagagggtccttggatcttccacaagaaagaattcagggcgagtccacagagtaaagtgaaagcaagtttatgaagagagtaaaggaataaaagaatggctgctgtatagacagtatagacagagcagtgtggcatgggctactcggctgagtgtatttatagttatttcttgattatatgctaaacaagaggtggattattcatt

SEQ ID NO: 76441 - DNA, 1231 bp, Homo sapiens
aagaggaacccagtgacgggacactgtgcaccctttttgaatttaataccttgtatatttcccatgagtctgttttttttgttttgttttgttttgtaaaagtattttagataacaaaaacctaatccctaaagcattacaagaaaatactggagagtatgtttataaactcagagtagagaaagagtccttaatccagaagccataaagagaatgattttttaaatatatgtgtgcacttaatggtcatatccctatttggcaagaaggacctgaggtgcttatatttttgtcctttttcagagcatagcacagtgaccccctactcagaatcagtaagtattagttgaattgaaattaaactgaattacaagtcacttctttgcagtcctcacttttttttttttttgacttattatgagtgctaggtgaccgccaggatcccgctcaaagattctgtggagatgtgggttttatggaaagagatacccagcaaagcaggagtggctttagaatcagcagctcttcccctgagactgtccttcccagcacattggacttgtgtgtgggtcctgcctgctttcaggagctgccatggggtgctcagcattaattatgccacggaaatgaaccaattagacacagtccaaggagagccagggagtaagtcagggagatctgtggcaggcctgctgccctgaacaaaagagggaaagtgtaaaggctaaagcagtttgcggaggtttctttggaaatctagctggccagcgctctgaactacttggccaaagttaaagagcaccagaaggagtgtttgcgtttttctttctcctgttcaagactctggtggtggaggagaatagggacaagttgggtccttagaggggacttggggggagcttactggagctcatctcctagtttcagagaagctgccagacttctctggatccctgtggcacctacccagctttgttttgttaatagctttttaaaaatggcatcttttttttagtggcatcacctaaaaaaagaaaagaaaaagtgccttttctccccatctcaagtgataagcaaattgagggtagggagccatcatctcttttccatttggtgtccactccccaacctggctggcagtcagcttgcttaacagccatttgtagattggaaagaagaggcatgggtgagagaggctgtgagggcacagctgcagggtggtgtggtctgc

SEQ ID NO: 76442 - DNA, 1969 bp, Homo sapiens
ggatgggggcaggttatttgtcagcaaaattgaatttcctttggaaaacttttggtctttattgcattcatggttgcctggccattctacctcagcccaacattccaaacagtgattctgtagtgcccccacttttactgttttggctggtaatacccggcagtccaccacctggggtcttcagttttgcagtgtcagtccagagtggaatcagaggttgtccttttcctcctcaggtccactcagaccttccagatcctctgacttaccattactgcaacttaccagggttcccaccatacctaggcactgcctgccatctccctaactgaccagtttcaagagggcaaaggggaggtaaccttgacacccataccccttaaaggccatgcagctcatggggtagaagcaatgtctgctggtggaaagagcagaggtttagaatcagaagatttgactgtgaccccaagcctgccatttaccttgctgtaagcttggctaaaagtcacttaacttttgtggccctcagtgtcttcttcttcaaaggagagtaacgatagctgtctcacagagttgtcaggacaaataaggcgggaggtgaaggtgcttttgaaactaggcagtcctgtatatcagtggaaaatgtggaatttatcatgggatagagacaggtggtgccattgactactatagtcagagaatggaagatgcacagggggtttgggaagcctcccagggaatctatcagaaatcccctctcaggccaagagtgcacgtttttattatacaatagagtcttttctgacattgatagtggaaacaaggccaacatttttcctcctttcactgtgatttattatgtgtgttacaggctttattacataatacaggctttattaaaactattatgtctagatctctataggttcaagactttagagtctgccgttcatttatggatggaattctcttaaggcatggtggggagggagggggaaatgttgcaagcagccacttcccctgttgccagtatacttcccctctgtcagtggcaacctgagtttccagggtttggttaacagttcctccaaggaaagggttatttcctcctcctgtgtttcctgtagaggccttcagagctgcgtcactgagagcagactcctactggatacctcaccactgtacccctgctctctccctgtctttgcagtgtgccccctaccaccggagccagagaatggtggctacatctgccacccccggccctgcagagaccccctgacagcaggcagtgtcatcgaatacctgtgtgctgaaggctacatgttgaagggcgattacaaatacctgacgtgtaagaatggcgagtggaaaccagccatggagattagctgccgtctcaacgagggtcagtctggcagatgaaaaagggatgctgctggggttctgctttctgttaactcacaggatgcaaagcatgcttcctccagagcactctttgctgtggtgcagcccagccccagttgatgctctgcagcctcccttccttgggtcttcatgtctttgtggaagatacttgaggttgctggtgcatgtcctattgcatttcattgagccatctgccctgctctgtaaagcccgtttgatgttcaggatctcttgtttgcatggccaagtgttggtgacccttgaccatgttctgccctcacagtgagcacaatgctaataccttctctaatgtatcgtccatttcatttttccttgaatggagctacagaccagctggacaaaagacctcccacccttactgcttcctcctgtcttgcatgacaggaaaatccacctgcttgcaggaaagtgtgtcatataaccatctttgtgcttcccactcaggcttcaagaccagagcatgtttaacccatgacaccccagaaatgggtgggaaccaacctgagagttacaattaaag

SEQ ID NO: 76443 - DNA, 1028 bp, Homo sapiens
ggatgtctgtattgcaccattcaggaggcatttgacaagatcagctgtggggcccatcagctgttttgtgtatttgggtacaaaacccttctgatgatggcttgtttttatagataaagacacccacacatcacttggggtccccacgctgtctatagtggcttctactgccagctccgtggcgctcattctcctcctcgtggtgctgtttgtgctgctgcagccaaagctgaagtctttccatcatagcaggtgagtccagtggcagagctgacatgagacaggcaggtgcaagcattactgtgggggccagtctttggtggagggttgctggtggccccaatctctgtgggtctgtgtgtgtccagggagtggggagggccctgccatgtgtcaaactcctagatgtgcctaccattgtgcttattgctttgcatacattatcttaatcctcataggaacattgcagatgaggaaattgaggctcagagaggttattcactcagggttatacctctagatgacaacagagctcagaactgaggctgcgcgcggtggctcatgcctgtaatctcagcacttagggaggctgaggtgggcggattgcctgaggtcaggagtttgagaccagcttgaccaacatggtgaaaccctgtctctactaaaaatacaaaacaattagccgggtgtggtggcgcgcgcctgtagtcccagctactctggaggctgaggcaggagaatcacttgaacccacgaggcagaggttgcagtgagccgagatcacaccactgcgctccagtctgggagacagagtaagactctgtcccattaaaaaaaaaaaacaaaaaaaaacggaaatctgttcaattccaaagccatgtcatttcccctacaccagtcgttctcaaagcgtggttccagcagcgtcaggatcatggaacttgttaggatcaaccaaatgagaagctctaggggtgaggcccagtgatattgtttaacaagctgtccaggtgattttgatgaacact

SEQ ID NO: 76444 - DNA, 1060 bp, Homo sapiens
gtttgttaaaagtaactggctagttttgcttgatttgagtagaggggagatttggttttcattgtagaccccatttaaattttgtgctgtgtacatatattactttttaagccaaacactattttgagtaacaaaagtcaagcacatgccagtttacacactgctttcttttttttctttttctgagacagggtctcactcatgttgcccaggctggagtgcagtggcgtgatcacagcctactgcagccatgacttccctgggctcaggtgatcctcccacctcagcctccctagtagctgcaaccacaggcatgtgccaccatacccagctaatttttttgtattttttatagatatgggtttcgccacattgccaggctggtcttgaatcctggtctcaagcagtctgcccacctcagcctcctaaagtgctcccatcaaactttcccttccttccaaaaacctctgccacttctctcctctcagagtgtatgtagcacagattttactgccaagagcaggtgaggaaattgagaactactaacaacaatctagcaacaataatatggtctagcagcagaccatctatatttcttgaattgatgagctgaaaggacacagcatcacctaggattggcctgaatccaatgctgaggaaactattagacaagtccagattgtgggacattctttgagacagctggcctggactctttaaaaaaaaaaaaaagccaatgtcatgaaagaaaaactatagtggactgtttaacagattaaatgagatgaaagacacaggacaattaaatgcaatacatgatacttaattgggtcctggatgaaaacaaagaagactgcagctgaagtagatatatttttggatagttaggaaaatttgtgttattgtattacaccaatgttaaatttctgggatctgatgatgtagttgtatcagaaaggatactcttaggaagtatatgttaaataacatcttcaccttacttttagatggttcagggaaaaaaaaggcatgtttatgtgtataacaaaagtgatcccca

SEQ ID NO: 76445 - DNA, 1072 bp, Homo sapiens
acctatttaatgtgtacagtgaagtggtttttagtatattcacagatatatgccaccatcattctctcacttccttattttagctgtgctgaatgaatgcctttatttctgggtctctaggctcctagtttttccacagggtaaaagggccaggtgcctgtgtacccagaggttaagaacacagtttttggaggctgatggaaccggattcaaatcctagctccatcctttaccagctgtgtgattgagggcaagttaattaacttctctgagcctcatttgcattcttggtgaatccctacctgaaagggctcaggtgagaatccagcatgataaggtgtttaaaattcctagtgctttgcctggcacatagtaagtgctcaaaaatggtggcggctgctattattattatcatgcctgtttctctgtgtgtttattctaattcatcctttgtcttttcctcctccactccaggcgtgaccagggggtatctggggaccaggtctccatcatggtggatggagtccaggttgcactaccatcatacgaggaggctgtatatggcagttctggtcactgtgtgccacctgctgaccccagagtacagattgtgctgtcagaagggtctgggcccagtgggaggagcgtgccaagggagcaacagctgccggaccaaggggcctgctcctctgcaggtggagaagatgaggccccaggccagtctggactatgtgaagcctggggctctcgggcctcagagactgtgatggtgcatcaggcaaccacctcttcctgggtggccggctcagggaaccgccaactggcacacaaagaaactgcagattcagagaacagtgacatacaaagccttttatccctcacgtcagaggagtacacagatggtgagtggtccaagctgaacatgaattattagctgcttagggtccttgctgggagtgaggaaggactgtgagcctttctaaataattggtatatttttagcaaaaaaaagatagtacctggggtatttgcctacaaaatagaatttcaccctcagagtactgagtagggc

SEQ ID NO: 76446 - DNA, 1964 bp, Homo sapiens
aggagagaaagggaagtgactagaccagcagagctaaggcagagaggaggatggtttgaataccaggctgaacattgagtttttttcacataggcactgggaaagataagctagaaagtcataaaaaaggaggtagggagtttttgcctacctagaagtgtatgagtgggacatttactttctttaaattaggggctatgtaggatagcccctaagttgcagtggggtcgagagtgctctagagttccacacaaggtaaccactgtgcttttcttctggtcttcctgcagatattccactgttgaaagaagcatgagggcagcggccagcctttcctctctgcgaggttctctcagcccttcctccctctccctgtgggattgagcaccctgtactctccagccaccttacctggatacctgagctgccacctgtgtatctgtgtatctctgagggccctataggcccaccttgctggaaactcaaggaagattctcgccatctgcctgttggacagctggaggagctggctctttgcctggccccgccttcccatctgtcagagacatatttgaatgtgctggatcaaaccctcccttttcctaagcctctgggtcccctccagccagctctttggcggcagcccccaccagctcctgtgggcctgagtgctgctgtgtttacttgtgcctttcccccaccctgtccagtttccctgtcatgcagacttgttgctgtccacaagccttagtggctgcactgctgccccctgccacacagggggccgggcctgggtctgtcctgtttcctttgagggttgcccctactgccctttgcaggaacagatccaggtgtgagagctcttgagtcaagagtggcagaagtggctctaattggggtgagagtgtagtccctgggcttgccctgggttgaccctggtggcatatttccttggctgaggatggaagatttggagaatcatgtccatgctggcccaggacccagccatctggcccaaaggcacaagctcctggccctgttgagttgagagtttccaagaagcatccagaagatcccaagggagagaaggaaaatggctgataatgattgtcttcctaatatgcaagttctcacttcctacttccagcatcggccttcctggccttgtcttttttttgtttccctggagtataatgggaagttgcatgctgcctcctgggttttatcccagatagctctggctttcttgctgcccacaggggcctggggcaggaaggagacttgctgagatgccatggagtgcccatctggtcactggcagtctgggcaggttgcccctttctgggtttgtggtgacggaggggaggccgagaggcacagaccaagtccccgggtggctgcaggcagctccagcccggtcctgaggatcctcctcaccatggtcacgtgccttagtaactgtgcccaggaagtggcctgctgcttgctgtgctgctgcttttcctacttctgcccttccctgccacccctcgcatgtcacagctgacaagcaattccttgtcttccctggccccctgggggaagggctgagaaacagtccgtgtgcaccccaaccttaatggcctgaggtgggcagaggggtgtggagcagcctggagtacagggccctgggggaggagcccactgatgaggggcgctctcccatagccatgtgttgaatgctaactaggctggggtggacgaactctgccaactgctgtcatcttagaagatagatgcagcagtaaggaatgtttgttttgcttttttctgaaattttctgaagcactgtggctgggaaacttcgaagcggaccctgtgctgcatgtctgctcctcccctgagcctgtctgcttgggggtggtaaaaataaaaatcccagtttattttcagtaccttacctaacagggttggctccaggcgtg

SEQ ID NO: 76447 - DNA, 1558 bp, Homo sapiens
cctcttgcctcctgcctccgcgcttacacacgcactttaccacccggtcattccctggcctcttgctgccacttgtagtcttccttccttcctctcagggtaagggcagtgcctgctgtgcctgttggccactcccacacttcccctcccccaggagccctcatctgctgtgctgagtccaggaaagcatagttaggtagggagctggttggagaaggtgctagaactagaaggcagatgagactagcatgggcccacctggagggctgtccctaatggccccagtcgccttacctcacccacagcagtgcccttgtcttcctccaaaacagaaagcagtgacaaaagggggaggggtggtaatctgaagtctcactgctgagccttcagcttttatttttcactgtttcaaaacccgcattctattctagaatggtttttaaaatggaagatcttacctttttctatcttgttactctggggttttgtccccctaagagattgcactttttgtttggggtttattcagctgcatagatgaccagcttgatccctggtgaaatgaaaagccttccttctcctgaagcctctttccgccctgccctccactaacaacactgaggagcacaagcccaggcttgcccacctggtaggaaaggaagaaattagaacaatgggagccttggctcccctctcgtctcctcccctccttcttgtcactggctttgatgaggcccacttcccagaggctcctgggcctgtgagtgcaggagctcattctcccctcactgctgaagtctgtgacagcttcttcctccagttatgtctttcttccaaagcaatttcttaaccatcagccatgtgctgctatttctagggcttctgggctttgtcccttactgagagattagggactccacagctgccttgaggtagggcctggctgagagacaagggtagcagcaggtggcaggctgttaaaagacaggctgcctgaggagcctggagcaggtggaaacaggtggaagaaaccggccacagccctgctttaccgggctcacctctagggcattccagcaagaggctgatgcaggagaatggccagcaccaaaggacatttaaaagagtttttgggtttttttgtttgtttgttgttggtgtttgtttttttttttttttttttggcacacttgagctgactcagtgcaggtttaatatcctggtgacttgcagtcacattctaatgactttcaagggccagaatatggtgaaaatcacttaaaatatccgtcccttccatgccttagtttagcaggtaggctctatcttttgccatttctgtattttatgtgctgtgttcccgtttcactgggtatgaactgtgaaatcgactgaatcctggccactttatgagtttgtttggttttataaggcatttcaatgtacattctataaatacaagcactccatttgcaaacagatcttaagctaatattttctttcccattcatcttgccctccccctcctcccgccagctttaaagttcagtggagaagc

SEQ ID NO: 76448 - DNA, 1018 bp, Homo sapiens
ttaccctttttacaggtgaggacagtaaggctcagagagattcaagtacagtccaagaccacataggtcatgcatcctcagctgagttgcggtttgaattcaggtgtgccactcctggcctcttcacctcacgctgctcacttgctcacctcttctactccccagcttttctccctgggttcttgatcacctgaccccttcacacctactatcctgcccaagaatccctctcagcaatgtccaaaaccaggacaccaagccatttagcaaaatgcagtcccagatgctcagcagtctcagcagtcaggatgggttctgggtccctggaaagatcaggcaaggccaggagacccaggcagcccctgtctcctccctgggccttgcttctgaaaggtgaggagaatgctctgtattctcaggtcttcccacttctccttgggactagagctgggggcacttgccaggcttttctctttctgttactgaaaagggaatttcatcagctgtgaacctggggtgagacatgacacattcccaagttgagcctaggttcatcctccaagctgcctggtgatgaaggagcattaccgggcttggggaccatccaatcccacacccaagaggcaaacagctgctcggcatttcctgtgacgctccagtgcccctagaaaaggaaatttcacaagctaggaatgtcctgagcaggctgtctgggacagtatacactgttctgaacctgggggagtagatgattctatggttcttcctgcagaggttttggcaagcatggacttccccatagcagagttttctgtgggagtaagtagccctgcctgcagcaaaggcagcctattgcagatgaagcgtgtcagcagggctcagcgtctgaagggactggggtatgcgacaagactatggctcaacacaaatgcacccagcgtgggggctgccctggcttctggggttggcctcttgagggccttgagcagctggggtccagagacttttagggactttt

SEQ ID NO: 76449 - DNA, 1031 bp, Homo sapiens
acgcccagcagacattgctttcatcagtgggacaaatcaaaatcgtgtaccacctgacaggaggcaccaagtgaacacagcatcacttccatgatattcctacagaatgcaacctacgctaataatggaaaagaaaatgagacagacccaaagtgagtgataattcacaaaataactggcctgtaatcttgaaaatgtcaaggtcatgaaaatcaagggaaaatctgaggaactgttgcagactgaaggagactaaaagacatgaataaaaagaaattaacatatgattctgaactgtgtccttttgccatgaaagatgttagtggggcaaaactcaaacagggtctgaggattcaatggtagtaatgtctcagtgttaacttcttgatttgacagttgtggttatgcgggagaatatccttgccagtgggaaacacacattaaagtattgggaggggattgggaaaagtattctcaaatgcttcaggaaatgatctgtaaatttgtgattgtttctaaacaacattatgtagataatgcactctttgcaatgatatgaaattctttcaccctggaaattgtatgacttagtttgttcctgttgctataacccaataccttagactaagtaatttataaacaatagaaagttatcacttgaacctgggaggtagaggttgcagtgagctgggaaggctggaggctgggaagtcaaagggcagggaacctgcagatttggtgtctggtgagggctgctctctgcttccaagatggcactttctggctgcatcctctcatggtggaagggcgaaagggatgattcctacatcctcacatgggagaagagatggaagggcctaaagaggcctggctactgccctccagcacttcataagggcatgaatcccattctccagggtggaaccctcatgacctaatcaccttccaaaggcctcaccttttaataccatcaacttggggtttaagttccaccatataaattttggagggaggcacacattcaaaccata

SEQ ID NO: 76450 - DNA, 5151 bp, Homo sapiens
cgtctcccttttggcatactgtttgaggggtactgaggtgaaagggcggtcactgttcgggtcgtttttacacagcggttgtgcgcccgtccctgccagtcttaatgtcttcatctcctggacacgtagaatagtgggccgggatctccctgactttgctggcgatgcggctgggccttttgtagggcggccgcagtgacccccgagaagggggttgctgggaggagaagggaagagggaatttggcacgcgcagctctgctgcctttgattccaccgccgccattttgtggccgcagagcgcccgcccgctgctgttggcgcaggcgcggtcgaggcgtcgcgagattctggcttccacccgctgtgacgcgcccgcgaggccgccattgggctggctttgcggagggcgcgggcggctccgcccgcacttctcggcctttcctaactgcggcagatgggagggggccggagagcccggagagtgtgcggctgcgcagttggaaaggtggcagtgggcgttgcggttgctgcggtctgggcccagtagcggaccgtgttgggagggagctgggttttcattttgtctgcaggtaacctggcctcattagaggctctgttggcaatctcgttcataacatcactgtgtaaacattttatgccgttgatgtttttgattgtttaatcaggcgtttctctgtgacagtcattgctattatctcgattgaattactttctaataggaagtactagccggacatcatgagtggctgtcgggtattcatcgggagactaaatccagcggccagggagaaggacgtggaaagattcttcaagggatatggacggataagagatattgatctgaaaagaggctttggttttgtggtaagtatttagaactgggtgaattatctgctaagtaggtagagttttgataagcagttgttttcgatcttgagtccgggtggaatatttgccttcagaaaatgttacccagccttatgtctgaattttattgaggctgaaaacaactttaacttgccggctcactggaaccccactcccagtggctccttgattaggtttgactgtatggcagtgtcgttaagatactcttcccattctgtctcctgatttcagtgctcttaatgtgttgtagaatactcttctaaagccaatgttaagagtcttatgcttacattttaggaatttgaggatccaagggatgcagatgatgctgtgtatgagcttgatggaaaagaactctgtagtgaaaggtgagattcctgtgtaactagataaccctgggacatagagcagactgggtctgctggcatatttttctaagtagatttatgtagcttaagtgtgtaacggagatttttcttccctttttgtagggttactattgaacatgctagggctcggtcacgaggtggaagaggtagaggacgatactctgaccgttttagtagtcgcagacctcgaaatgatagacggtatgtgaagggtggatggctgcattgaacaattattgtaggggtagcatttaagattcaggagtcattagcagtgatgattttgggtcctgccgtataatctgttcttctattcccacgttagccagttgttcttgatgaatctatatgagtcatagaacacaaatctattgacggaagtcattagaatggcttgtgatatctgatggcttgaacttgcccacagttgaacacaagtgctgtcattgcatttcttccattgtgaatacgaattttcttcctcagaaatgctccacctgtaagaacagaaaatcgtcttatagttgagaatttatcctcaagagtcagctggcaggtttgttgaaatacagttttgagttattttgatgtggctttttaaaaaagttaatgggtagctaatgttgtattgttttattaaaagtagttttaaattaatggatttaatggaattgtaattttaaacatttaattaaatgtaatttgggggatattttgaactttaatattagtgatcaaatgtaaatgttttgaggatatttttcttgttttttaaaatcaatttttaaccaaatattaaaccctttatttgccagcctgtctgtgtcgttggccttatgacgaggagtgcctgtgggttatcctaatcgttgtcttggtcactcttggttgggcctggttgactttgccagtcagctcctacagtgatcagttggccacctctagatctgtgtttgccggtctagacgttatcggtgcacttccttgaagtgccaggttgcagcgatcccagagcgttgataacgtgatctgatccctaagttgagacctgtcttcctgtaacgcttccgaataagaggtccggtcgaaaagagttgaaagatacgaaattaggtggtcgttggaatcctgatcgcagtaaagtggtccttggtaactgctcgagtagaacatgtctgcatccgccaatagtccgctaatagggagggctgtgcgattaaaggcttccatcgattgggtagtgtccttcaagtgggtggcgaagagccagtcgggcatatgtcatgaaggtttctccgaccgattaatggtttgctgcttgactagcctagggaaataataataaaggtaaagtaaacttttttaatgacatatggggcacaaaataactggtgtcttgtaaatgttctgtttttttaaataaaacttctctactttagtctttactttaaaaatatgtactgtttccttttttgttgtttttttgtttgtttttttttcttttgtactgagctcagcatagactaatactaccttaatgttaaaatctgaatttcttttagcattttgcttaaaagcaatatgctatttgcttattccgtgccctgacatagataatttttgaattctgatagaatacaagtgtggtaaatgccatgtttgtactttatctaacatcttctctttcagtagtcttgttttttttatatcatgtgattgtttgtgtgtcccctttcctcttctttgcttaacacaattatcttgtgttaaggatctcaaagatttcatgagacaagctggggaagtaacgtttgcggatgcacaccgacctaaattaaatgaagggtatgtactggaaactgtgaaagtctttaaaaatatccggaaaattttactgtgaacttagttttgaggacttaaaatttgaatatgttagaatgcagagattctccagagacaattttgctgcttccctcctcccccccacacctttggcagtgtctggagacaagtttggttgtcacaactggttgagagaggatgctgttggcatgtagtcagtaggggctaggcatcctgctaagcatcccacggtgcatagggaaccccctcaacaatgaattggctcaaagtataacagtgccaaaactttgctcttttaatgctgtgttatccagaaataagactcaatagtagcaatagcaaaagtgaacatagaaacgacttacctagactgctgtgtgcaatgtgtgagactacaggatgtatatactttaaaagtggctgttttccattttagggtggttgagtttgcctcttatggtgacttaaagaatgctattgaaaaactttctggaaaggaaataaatgggagaaaaataaaattaattgaaggcagcaaaaggcacaggtatctctaattttttaaagtcaaaagttgtatttaatgggtttgttgtagagtcttatctaggctgatttcttttcatttttcatagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggcctttttttaaaaaacaaaaaccacaaaaattcccaaaccatacttgctaaaaattctggtaagtatgtgcttttctgtgggggtgggatttggaaggggggttgggttgggctggatatctttgtagatgtggaccaccaaggggttgttgaaaactaattgtattaaatgtcttttgataagccttctgctcacatttttgtgaatgtctgaagtatatagtttgtgtatattgacagagctcttttataactaaagcaaatttaatttttttgtactagaaaaaaatttgaacattttagttcttggttataaaaatgttaattcagaattagtttaatgccttaattaaactaattaatagctttggacacttaaaagagctctaaatttgcttgtacataaaggcttaatttgttttccttgttagggtcaagggtgtcctccactctttaacagctgctggacagacacattagagcagctgtttgttattgataataaaatattataaaactactttttgtctgtttgtctgaagaagtcctatgctgattatttctcatccttatacagtagatttaaaacacagaacacatccagaatcctggagttggttacggtctctctttaaaaataatgtttttgacgtctccaggctagtgaaaagatacagaagtaagtgaatgccaaaatcacaattgttgagttttgtgtccgtggcccccctgtcccccaaagttctttctctatctcctgaatttattggcatcaggttacttaagcttccagagccaagaggaggatagtgtgggaagcagtgtttcttgcctaccttaaagattaggacaggtttttttgttttgtttttgagatggagttttgctcttgttgcccgggctggagtgcaatggtgcgatcttggctcactgcaacctctgcctcccaagttcaagcgattctcctgcctcagcctcccaggtagcagagataacaggcatgtgccaccatgcccagctaatttttatttttagtagagacgggtttcaccgtgttggcc

SEQ ID NO: 76451 - DNA, 1301 bp, Homo sapiens
tagcagatgatgttggttagataatagagaaaacaatttgaacaggtaggtatatatggatataataagtaaaaatgataggtggtagccttgtcaaaaatctgcgtttttaagaggatgttagtaacccaaatctgtgtttctcgttttggtgttgggagtacttgttagtcctgcacatttgccaaactgatacccgaaaactatattgtcttggtttcatttgtacctgaccatacaaaatgataaaaatcccaagtaactaataagcatgattgactttttgtaattgttaatattagttgttaatcatttacttgatccttatttacatatgatatgcaaaatgtttaaattttattagagacaatttgaaatttgtgaattctaggtatttgaacatttttctttgaattgggaaacgactcattttggcagtagtttgctgtacccagttttgggggcgccttgtgttaaaaccaaatacctactgaacttaaaaaagagattattagtgaggtaacattgtgttaatgtatgtgtttgtttcctggtttttccttgtcaaaagttttcctcctctactaacatgatgcattcgcccagttttttcatttcattagctattttttgagtttgttttgcctgattgcatcttactgtgttcacttttgcatacttgatgtcaaatttgacttttcgggagcatcatcccaataatgtcaaaagggaaggaataggatctgaactttttaggttagaacttctgaagtttaattctacagcacttgtgagcatttatttctcttttgggtcacaaaacttggaatgggatttgggtatttgagtaatgggttaaacatatatattgattagttcaggaattgagtgactttaagatgcttatcagacacttttagagatcccagcaagaggcagattcggtttctggtttcatagagtttacagtcactgaacaagtctttaaaataagtagcaaattctaagttggggataggtgaggcttcttgggtagacaccctgtctgtgttcccggccaagacttgatgattctgatagatgtactggaaatgctggagaaagactcaggcaagactggtgtttttgctgctctctctagtttaccacactggctttcagaattgctttgggaccagaatccaggccaccaggggaagggctaggctgtgcaaggggagcagtcctcccctttgtaggtgccatttcccagagctcctggaattgtttcttcagttgtggcagctgtgtagatcattttt

SEQ ID NO: 76452 - DNA, 1808 bp, Homo sapiens
ggtgctgtggctctgatctggttccaggaaatgagaacctagtcctgagaaatggaaacttccccaactcttgcgaatagaggcctttcacacaactaataacctcagttgtccaaggcagttttgtcctatgatgtctccccactgagacaaagcagcccaaattgcttcagttttatgaggtaaactgcatctgcaatttcattctcccagctagaaggaagaaatggagtgcagttgatggaagtagtcttggatctttaatgcttcttgggtgcttcttggggctacctggttcttagtgacttgataagagttaaagccctatccaaaaagtccctgctagaaacttgcttgttggcaggctcaggtctaatattggagcagaacttgaagtggggataatttcagtactcacccttgggagtcttgaatttctcatagcaccaaaatatggcaatgaggagaagcccttctccaagctggaaaatcatgtagaggaggggaaagaagaaaagtggtccaatgacttcaggtggaaaggccacattgaggatggtggaacagagttggacattttggcatccagtctccatgctgacagtgcgtctgcacctgtgccggtgaagaaaaccccacatacactcagagggaactggagggagcaactttgtcccagtgctgctaccaaagagtttcgcagcagatggaatctagaccctggacaggggtactttgctattgctgctggtgtttggatacctttggtgtctggatttttaacccgttcaataccttcattcaatttttttcaagtctaaagtctcttgtccagttagtgcatctgaacatattgccaggaaagtgtcttgcccagatttcaggttcctagcttcttattcgtttcctgaaagactaggacaagaatgaagcccatgggacagtgggacctaaaataatacctatctccaggcatgcagtggctcacacctgtaatcctagcactttggaaggctgaggcaggtggatcacttgagctcattagttcaaaactagcctgggcaacatggtaaaaccctgtctccagaaaagttaaatcagctggtcatggtggcttgtgcctatagtcccagttacttggggggctgaggcaggaggatcagttaaaccctggaggttgaggctgcagtgagctgagaatgtgctactcccctccagcctgggcaacagagtgagaccctttcttaaaaaaaaaaaaaatacctaccgtccattgaggcagaagagagcagagagaacataacccagcagaaagccaataaaaggcatcagggaggaggtggcaatcaagagtggtgtcatggcaaacatgatgctcttccccacattgatggcagagagaactgtgacggccacactgcacaagagaatgatgatcatccctccctgggaatgaagacaagaaaaggcaattagaagagttggggatagagaggaacagaggtggggaagcacaggtagaaattggaggtgggaaacattgcaataaaacactggaagtggaaaggaatatgaaagacctttatcttctttttggattcctttctttaaatttttttaaaattattaacattagagacagggtcttactatgttgcccaggctggtcttactcctggactcttagcggtcctcctgccttggccttccaaagtgctgggattacaggtgtgagccactgcacccagcccatctttttagatttcgtatcagtagctaggaagcttggggacagctgattaacactt

SEQ ID NO: 76453 - DNA, 1480 bp, Homo sapiens
caggatctacctccatcatgagaccttcctgcccattaggcctacagtgggtcatctcactctgagttcctacaacacactgcaggctttactcttttttttttgagacggagtctcactctgtcgcccaggctggagtgcagtggcgcaatctcggctcactgccagctccgcctcccaggttcacgccattctcctgcctcagcctccccagtagctgggactacaggcgcccgccaccacacctggctaattttttgtatttttagtagagatggggtttcaccgtgttcgccaggatggtctccatctcctgaccttgtgatctgccctcctcggcctcccaaagtgctgggattacaggcatgaaccaccgtgcctggccagctttactcttaaatgtggtccccaggtatctctctggtctgtgtcttaaattagatggtaacctctcagagggctgggtgtgcatccaaagatccatcataataatgaacattgtgcaaggcgtagaaggaggtgcatcaaagtgcttactaaaaatggatgaaaagattctattctgaagatgagatgaggaaagaatcctctggattatatagaaacacagatatatatatatatatttctttttttctagatggagtctcgctctgttgcccaggctggagggcagtggtatgatcttgactcactgcaacctccatctcccaagcaattctcctgcatcagcctcccgagtagctgggattacaggcatacaccactgcacccggctaatttttctatttttagtggagatgaggttttgccatgttggccagtctggtctcaaactcctggcctcaagtgatctgcccacatcggactgtcaaagtgctgggattacaggggtgagccaccgcgcctggccagaaacacagatatatttgaaactggcatttctagttagtactaaatatttgaggccttcagacctcaatctgtgatataaagtattaattttcatctactgaaatatcccattgcaaatagaagtcccacaagacaaggagtatgactgaaactggacaaaccagatgccaagatagtcagattatttttggaccatgagtctggcctccagggaaagaagaaacttgtcaattttactttttttgcttggatcagaagattaagcctggcagagagatactgtttgggactagtggttctctggaattcctaaccttctctgggcttgggaggagttgggagaagaaaatgcatcatctgaatgatggccatggttacaacaggcctcatatgccaaccagagggaaagaaaatacttgctgagcagagtaactggaaagcagttgctcatagtttgaactaaactacatgattgaaatccagaataatgtagatttttggaccagtgaacacttggaaataagctttctggctggaaagcagcatttgatgttagggatggaaa

SEQ ID NO: 76454 - DNA, 1502 bp, Homo sapiens
tctacctgtaaagtaggaatgtctgacctatttcagaagattgttctgaggataaaatgagatgaggcatttgtcctgtcctcttcaaatgccatattgtgatacttttcacttaattattttaagggctttaaagactccatctcctttacttttgacaacatctcatggcaggggatactatttttatccccattttacagagagaaaaacgggaccctggatgagtcaagtgacttcttcaagcttataccactaggtggcagactcaggatttgaaccctgctgtacagctccagagtctgtctgaccaaagcactcattcccagtggaggaaaagatagaccattcttttagaagtgcgcttcatttttgtttggagaaccacaagtactttgttattgttccagcatccagtctgagctttcttgtcagagggcaatggggagaggggaagtcgtttaagcagggaatggtgagttccggtttgctgcttaaaaggatcactggcttctaaatagcgaatagacacactggctgccgtgtggaggttggatggggccagtgtggagagagggcaaaactgaattcaggagtcaggtgcgaagctgtttcatggaatccaggagagaagccctgagggagcagagctaatcttaggacctctcagaccagatagggagggggagtgtggcactgatgcttacaatcaaattatagaaaagaatccctccctgcgaagtagcccatactgatggaagtaagcactaaaggttgttctccacataaggagatcgctctgggtttcattttgcgcccccccgcccccttccctgtgatttcctggagatgtcagtctcactgaaggcagctgagcaccttgctctgttgaggagccggtgtgatgcagctgtgaccattcccaagatggccttccggggatggccctgggcagagccccccaacatctgactgaagctccgctgagctgtcctctccaagagggtcgggcacccgggagagatctcctctccttgttctaccccatctctgggatctctgcatcctcagactgccgcctcctcatctatacttttcctccttgtctcccatcaggggaccagggcctctctgcccgcctcttccagagctgctgggctatagagaggctgccccttgccctccagttcagagggggaagctaggatgcctgagttccaatcctggatcatacggaccatagggctgggagatgtgtgtgtgtgtgtgtgtgtgtgtgtgtgtgtgtgtgtgtgtgtgtgtgtgtgtagggggttaccgtacccaagaggccctccccagcggccaatgcccagcacacgcttcaccttgtcccttgcgacttctcccggggcagccgctgtgagactcaggatgtcacctcccagggagagtctttgaaagaagtggatgctcccattccccactccaacgccacagcccaccctgtgcgggtcatccag

SEQ ID NO: 76455 - DNA, 1028 bp, Homo sapiens
caccaccactctccctttcttgacccaccatccctcccctgtccccgaactgtcactggtgggttttctttcccaatctcttctctcctgcattttgctcaagaccctcagaggtgcctcctgcgtcggagagaagctcgctctccgctcatgcagggcttccctgtggtctcacgctggcgcccggtccagcgcgctggagttgttggcaggcggcgggggttgggacgggggcgggtgcagctctgcctggagagttttaggttacccgcgagccacacaaggaccttgtgttgttgttttaaaaagcgatcactgctcgtaaaacccacagcagataattttaatgtcacctcctgccgggcaggcactggaagagggtcagaggtggggtactgtaaagaggtgggaggggagagttgcgcaatgttcaggggtctctccccctgggttcagtgctgggaggttgaattactcgttgaaccttggtctgattggagtttctgaacgacatgaaacctgccaattctgtgcacaggacagattgtccagggcattgtaaaatctcctggaaccgacagtattgtgttcatttctggtctagattatccccgcaacaccccccaccaattggtctaataaagaatttcactgccttgaaacatgtactattaaacgacctagtggttcttttgaccaaacttaatccaggcaatctctggccaagcatcagtttatgtcagggcaattgactcttaactggcagcctgagagtccatgtgaaagtagctaggatctttgtgaaaacaaggttggctcaaccaactcgtgctttctttcttgaacatccttgggcctggccctttaccacctgttcagattgcaggttgtttattcatagcttttactatatgagaatcatctttatagctgtcgtgtggagaaaaagtcttgcaatgcttgacaagtcttaatgactgcccagatgctgggttgattacatccaagcccaggtatcactgtgagat

SEQ ID NO: 76456 - DNA, 1797 bp, Homo sapiens
ttctgttccattggtctatgtgtctgtttttatgccattaccatgctgtcttggttctatagctttgtagtttattttgaagtcatatagtgtgatgcctctggctttgttcttgttactttttactttgctttggctattcagggtcttttgtggttctacaaaaattttagggtttttttttctatttctatgaagaacatcttagtatttttatagggattgcactgaatctgtagattgctttgggaagtatagacattttcacaacatttgctcttccaattcatgaacgtgacatctctttccattcatttgtgtattcttcaacctgaaacttatttcttaaatgttttagatatttgttatttcttctctcacctcttgatcacttgattcatccttcaaaacccagttccaacattactctctaggaacttttctacagagcattctttttgcttaggaacgattactctctccttcgaacaacttctttttttttttttttaaggaaaatttgtattattttaattatttttatgtacagaaaactcaacagtgtacatttaacccagtttagtggcaagttctttagcctttgcctttttgcgcttggcgatacgagccacagacttaggacccaggacattgccaccccagtgacggcggatctcatcgtatctgtcattgtaattggtcctgatagcttccaccagcttagccaaagcgcctttgtcttctgagttcacctgtgtgaaggcgacagtggtgcaggtcttcctgtggactagacgtcccagtcttgccttccccttgataatgcagtaagggacccccattttacgacatagggcaggcaagaagacaaccagctcgatgggatccatgtcgtgtgaaatcaccaccagctgagctttcttgttctccaccaaggtggtgacagtgttaactcctgctcgaaggacaggtggtctcttcttcgggacgtcccctttgccagcagctttcttctcggcccgggccaacagtctctgcttcttctcttgctttgtctctggcctgtacttgtgggccagcttaagcagctgagtagctgtttggcggtccagggcctgggtgaactggttaatcgcaggaggcactttcagccgcttatagaggatggctctctgccgctgcaacctgatatagcggggccatttcacaaagcgggtgaggtctcttttgggctggatgtcctgtccaatgccaaaattcttaggccttttctcaaacaggggattcaccactttcttagcctcctgcttcttcacgacagctggggccggagccaccttctttcccttggccttctttcctttcggcatcttgggcagcgggaggagagagctcctttgaacaacttctatatctggtccacttgtattctaacttgtattaatcctcctgcagtgagcatcttaatatcaggccagcatcttcctcttctttgcaccaagttggccctttagcatttcatgcatgatctgttttgttaaatgaacaaatctgcaagccccttgaggacagaatagagacctcattcatcagggtgcttgtcacattgtaaagcattctgtaaatatatattgaaatgaagtggactgcataatgatgtccaacctgaacccctgctgttgtttaaatctgaaattggttacttacaaactggcttttccatttttgagtttttgttctttgtttaaaaataagtgtgtttggtagttacaggaaggctgggggaagagagactca

SEQ ID NO: 76457 - DNA, 1119 bp, Homo sapiens
ccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacaggccagagacaaagcaagagaagaagcagagactgttggcccgggccgagaagaaagctgctggcaaaggggacgtcccgaagaagagaccacctgtccttcgagcaggagttaacactgtcaccaccttggtggagaacaagaaagctcagctggtggtgatttcacacgacatggatcccatcgagctggttgtcttcttgcctgccctatgtcgtaaaatgggggtcccttactgcattatcaaggggaaggcaagactgggacgtctagtccacaggaagacctgcaccactgtcgccttcacacaggtgaactcagaagacaaaggcgctttggctaagctggtggaagctatcaggaccaattacaatgacagatacgatgagatccgccgtcactggggtggcaatgtcctgggtcctaagtctgtggctcgtatcgccaagcgcaaaaaggcaaaggctaaagaacttgccactaaactgggttaaatgtacactgttgagttttctgtacataaaaataattaaaataatacaaattttccttaaaaaaaaaaaaaaagaagttgttcgaaggagagagtaatcgttcctaagcaaaaagaatgctctgtagaaaagttcctagagagtaatgttggaactgggttttgaaggatgaatcaagtgatcaagaggtgagagaagaaataacaaatatctaaaacatttaagaaataagtttcaggttgaagaatacacaaatgaatggaaagagatgtcacgttcatgaattggaagagcaaatgttgtgaaaatgtctatacttcccaaagcaatctacagattcagtgcaatccctataaaaatactaagatgttcttcatagaaatagaaaaaaaaaccctaaaatttttgtagaaccacaaaagaccctgaatagccaaagcaaagtaaaaagt

SEQ ID NO: 76458 - DNA, 1058 bp, Homo sapiens
taatttatttgttgagtaaacaggtcttctggagtttccgcactagattttgctgcctgcatttcttttgcattttgtaacatgtttctctatcctttatatttctcgtaaaatgatagttaaatcaataggtttgatcaggtgtaggtttgatatatatatttttaagtatatttcatgggagttggtgtgtgcttctttcaggagacatacaacatctgtgatgttagcacccattgatgatcattgctagacctgttaattcactgatttttaaacaagtaacaggctctactgaaaagagattctaactttcgggaggcattgccattattttccttgtctctggtgttgccatggagggatagagaagggggtttagtgctaaagttcccttctcaaggctctgtcagtggggaggctgcatgcgattgcaaagctctgagggggaaactatgccctgagttcttggttggtggccttgggaggggaaccaccttggtttctggttgaagtggtaagagcataaaggagctggttttactttttactgctaattgggaggttttttggatgtaactatagatttgctttttgtgtgatctttggtatatttatatcagttggatatttatgttacaagaaacagataatgcattttgaactggcttatacagtgaaggagattcattggctcaagtagcagaaagtacagaggtaagacaggtgccatgggctgaattctatctccttcaaattcatgtgaagtctcaacccctaggacccagaatgtgattgtatttggagatagggccttgatgaaacaattaagttaaaatgagtctgttacggtgggcccttaatccagtctgactggtgcccgaataagaagaagagattagaacacagagaaaaactagggacatgattgccatgtgataaggcagcaagagggtagccatcttcaagctaaggagagaagccagagaggagaccaaccctgccagcatcttgatcttgaacttccagcttcagaattgtgagaaaataaatttctg

SEQ ID NO: 76459 - DNA, 1026 bp, Homo sapiens
tactcaggagatgtccaggaagatgaagagaagtgctatagcataaattagtaatagtccatgagggtccaaagagaagggctgcttgaattgttaaggtacatttgccctctgaccatctttgttcagggcctgaagcacagctctaaccaggaggtgcattttgactcatttcctcactcctttgttcagcctttgactcattcattcacttgttgtggatatcctaatttctgcagtttaaactgtaaatattcttggggatggaactatctgaggtggtctgggaattattaatttactgatggcacacatcttcacattgtccctcagccttcatgtagttctggcccagttgcttctaagattttatgagttggcctataatggggctgtggaaagtaagggggatgttgtgtttgcatctgttccagaaaaaaactctgagttaaaagtattctgattcctattagggtaggacatcttagggaggaatttgacaaatgtctgagaaagaatatcttttgccagattgaagaattgtgcaagtgcatattgcaaaaggctttgtcctatgtctttgtttttcaaatgcacaagaagctgttcagtggtgcacacaccaccccgctgggaaacagggacttgtcagctggcaaaattccatgatgcattgggagagggaaattcagtgcattctttggtggctctttgccttgtcaccatcttgagatgcctattgtaggaaacatctgttgttttggtctgcccagcctctactctgtcttttctggcaatagaatctctactttcctttggggaacaccgtccctcactctactcttcataacttgagtggactgatcccacctcccagttctagggtgaatgcatgacccaggcctgatcagtgtatgccctcctctggtttaggaatggtcatgtgacttatgctggaccagtggattcaatttggagactttttattgaaactctggagaaagacaagccctggggtttgtatgc

SEQ ID NO: 76460 - DNA, 1046 bp, Homo sapiens
cgtaaattcaaccctagcctttgagtcctctgtggagcagagacaaatcatgccttctctgtgctttctgaattcctgacctgtagaatctgtgagcattataaaattgttactttaagttgctaagttttgggaaaatttgctatacaaatagataaccagaacaaggacaaaaaggaggagtcaagagaagttggaagccaactgagagagagggaaggcttgaagtggtcaggacagtgaacacctaagagacatccactgaatttgcccactaggaagccattagtgacttcaataggaacatcttcagtgcatcatgaaggccaaagattgccatgaaagagaggaatggaaatggagtgtgggccactttttcaataagcttggccatgaaacaagggacagaaacagtggaaattagatggagatgcaaagtcaaaatttttctttaaaagatgttagagagagatttgagaagagaaaaaggttggagatgcagcaggaaaaaattactagaggaatgtcttgagggaaataggaggagttaggtggaaacagtcatatttctgagaaaatgttcttgaacaacctctggtgtagagggaaggaggtttaatgggtggtggaggagacaatttctgaggctaggggccatgactattttaagttctgggctgccagaacttaaaactagtctagggattaacaaccacaggaagcagcactgtggcatttaatgtcttatcatggaggaattattattttgatagcaaaaattagttaacttcactgtctatttataaaaggtaaaacctactacatggaatcttagatatcatctttttgcctctactctgagaaattctttctgtaacatgcttactgattatctattttcttgcttaaatatatggtgatttctttgtctattaaatataattttacctttctgagtcttctacccattgatcctagttctccctttgtagttacacaaaagagaagaatttcagatcccactttatcttgtaatgaaccaaggg

SEQ ID NO: 76461 - DNA, 1002 bp, Homo sapiens
tgcaggtaagtgagcctgtgggtggccctttcctgatgtttcacacccttggatgaggtcttgcatcttcttggtggctgctgtgctggagggtagtgggaacacggacagactctggccgcaggacagcctgtgtttagacgaagaataggaaagaacacagtagacccctgggaatctgctagccaggtctgggagggcctgggcctcagcatcctctttgctttcctcatctggccttttgacagtgccttgggatctgtgggtgccgtgctggccttccagtgctctctgacaggtcttcctattagtgttggaggctggatgaggagatcattctggtttattgtggtaacctccttaggtacaattaggacttggggcaggctgggctcaaaacagtgtaggggagttgtttttcagttttgtttctctttccttgcctcttttcttttaatcttaggttctggggtgtgggggtgtgtgtgtgtgagacaagtctatttggaagaactgtattctcccaattgtttctttgaaatgtccctctcttcttcttctctgcctcccagcactttatactcacctcttctaaagtcctctatggtgatggattggctcgttcactgtagatttatctctttgctccactagactatgggtggactccttcaggtcagggactccatatttccaactataccgaaagaactcagaagacagggactgtcttaaatctccatactcctagggctcagcactttatcaagtgctgaaaaattatctattggtgatggcaccaagcagcatatcatcataaatatgtgagtttttggtgtccctgaatcatggtgcatattcactctatatgctttgttattttacttcagcgtgtgaaatatcgccttatgatctgaacatgtaatacactgtgtctgatagcaggaattggctgagctcttccttattttttgtggtagacttctctaagcaaatacattt

SEQ ID NO: 76462 - DNA, 2668 bp, Homo sapiens
atgacatgaggtttatgtttccttatctccttggctcattccttgcctgtttagagaagctttttagagtatatgtcttctgtctgtttatacattggaacctagagttagagtggaaatgctcaagttcactacagagtcatgaataagatcctgatcatgtgggtataatgagcttcctaaaccagtggttctcaaagtatggtcactagaccagcagcatcattatcaccaaggaactttgaagatgtgcagatttgatccccagcaaagaccccttgaatcagtaagtctaggcgtggggcccagcaggctgtcattaacaagccctgggcgtgattctgatgctcctaaagtttgagaaccactgctataaattaggggtctgtaaactttttctggagcagatggtaaatattttaggctttgtggggtatagggtctctgttgcaaatactaaactctgccactatagtgcaaaagcagccacagttaatatgtaaaagaaaagaatgggcatagctaagttataaagtaaataaagccttatatttacaaaaatggggagctgggccagatttgtgcacccatttccccacagtagtttgcagacccctgaaaaaactaaaaggcatcttcagagtagtcagacttgcttgttacttgcctcgtctatttagtgatacattcaaaatgctccttaacacccacacgatcagaagtgggagacaccagtaggaaggaaacaaacaaacaaacaaacaaacaaacacaaagctgcctaggtctggtgaagtagccattatcatgcgagaagatgcccagtgaccagagatatctgtccctctctaagtcttacctggtttccaactgtaatgcttattaatgagacctttctgactgttctcactagaaatttgttcttacttatcccaagtgctgcctgacagttctgttctcttcctctagtccattcatgcttctggtgtgctggaagactagtttacgtattcttttttctaatttattttattcattcattcattcattcattcattcattcattctgttgcccaggctggagtgcaattgcatgatcttggctcgctgcaacctccgcctcctgggttcaagtgattctcctgcttcagcctcccaggtagctggaattatagccgcccaccaccacgcccggctaattttttgtatttttagtaaagatggggtttcaccatgttggccaggctggtctccaactcctgacctcaggtgatccacccgcttcagcctcccaaagtgctgggattgcaggcttgagccaccgcgcccggccagtttacacattctgtcctcaaacttccaacacattggtcctccttcttcaatctcagccttgcttcctctttcactgagaaatccaggcaatggaagatagtttcttcaggttaccattactgtatctctgaatctacccatgtctgtgccctgaacctcctgtcactgtggatgaactgctgttgcatctgtacggggcaaacccctccacttttgtgctaggtcgtatctcgtacttactcaaggacattactgtagccactgtctcctgtcttctgtgttactatccaccacctcccactagatcatttccttgttgtcaaacctattataatttctaccttgtcacctttttattagcatcccatttctctgctgtccttggcagcaaaactccctataatggtctatacatgctttccctgatcccttgtctctgtcttctcttgaacttacacctctcaggcttgtgtctccattacgtccctgaaacaacttgtcagtgtcaccaatgacctccaagctggctaatgtgcagatacaggcaatgttcagacctcattgtactgggtttttagcagctcttgacacagttaatcactgcctccatcatgggacactttcctcagtttctgggacattacttggttctcttcctacttgcctagatgctcccacttagtcttatctcctggctccccctcatctctctcacccataaatggtatagttcctcagggctcagccctaggaacactccctattctcattcctttgcttatcttttctaattttatggtttaaatagcatctctatgcagacatatctcaaatctatgtctctagtctggatatagccatacctacatatctgccttcttgctcaacatctctatgtgggcgtctgataggcatctgaaaccaacatgaaaccaaaagcccagattttccctaccaaccttaccaaacccatttacccattcctcaactcaataaatgacagctccatctttagaggtgcgacgaaaccttcagagtcatccttgaccctcctctttctctcatatcccaaatcatatccatcagcacatcctagtgattctactctaaaaatgtgtccagaatctacccgcttcttgccacctctgctgctatagcctggtccaagccgttaggctctctcctcaggataactgcagtagttgccacactggtcttctcttttcagcctttgggctctaccctctgtaagcagcatggcagcagagggagctttctcaaatgtagatcagatcattcactcctctgctgcccattttacagcggcttccag

SEQ ID NO: 76463 - DNA, 1039 bp, Homo sapiens
atatcgtaacacatctgtgatgattttacaagttatggacctgcagaagaaatggaggtattaaacttgacaaaacccataattggtagccttgtgaatgtgaagctgggcctcaagcttggcccagtgggactcagatctcatgctgtcaactcacaatcatcaaagctgcaatgggagttgggtgggcctaagatctacagggaatcctgcctcattcactctcctggctgtgatgaaatcagtggaaaccttccagaggtagacttttcaaaaaatgtattttaactctacaattagccaacataattttggataacttatattgggtaaagattatccaatatgaaattaatacaaccatctggactaaatcatcctatgaacacaaatacccccccccccctttctcccctggagtagggataaaaggcacatacattgcatcttaacatggaggtaagtgcctgccatcatccattagtctcctgggaggcatggatgcatgctctctctccttggcagttgcctaggctgttgctatggactggatttagtaaagggatgtcttcagagcaaggcccagagcctctatcaggaactggatcttcagacagaaggacagcatgtgcccctgcactcgggacaaaagccaatgaagcccaaaagcttagagccccttctatttggcagtagaaaactccttctgtgatctctaggtctttgctatggctgaccttgtaagaatgagtgaaccccaaaatgtgatcctagatatgattagagccagtgctggatgtattactgccgtttacctctgtaggttttatggacatgtaaattaggcagtgcagatgagatgtggggctcttcctggcagcagacagccctcatattattattaaggggctattgctagaactaggacgtagaatcataatttatgtgctcatacatctcaacaggttcctgtcatattcaaatggctctgtcctccccaattgtcatggttctgtcctcccatcccaatgcaaacatt

SEQ ID NO: 76464 - DNA, 1036 bp, Homo sapiens
aaaggaggaggagaggtaggggaggtaggggagctaggggaggcaggggagctaggggagctaggggaggtaggagaggtaggggaggaggagaggtaggggaagtaggggaggtaagggaggtaggggaggtaggggagctaggggaggtagaggaggaggagaggtaggggaggtaggggaggtaggggaggtaggggagctggggggagaggagctagagaaggaggggaggtaggggaggagtgagagtaggggagctaggagaggtaggggaggtaggggagctggggggagaggagctagagaaggaggggaggtaggggaggagtgagagtaggggagctaggagaggtaggggaggtaggggagctgggtgggaggggagctagaggaggagggatgctaagggaggaggggaagcaggggaggaggggaggtaggggaggaaaagaggtaggggagctaggggaggtaggggaggtaagatgtgactctcacatgtgtgtccatcttttttcctttagtagattggagggctcttgaggggaggaaccatgattgtccctagattttgtgtgggcagcacccaaggttgacattcaagtgtgtgctcaaatgtcacctcctcccctagagtctctttgcaatcacaggatccagtcccttgctgtgctgtcaccccattttattttcttcagagcacagattaccacccgacattgttttatccatttatgtgtgtgcttgtcccgatccccttaaatgtagagcccacggggccggggcttgtgtgtcttactccctgtgtctccgtctccggcactaagaacagtgctgggcacatagtaggttcaaatatttgttggctgaaagactgaacactggaggaagcaaacaaagagatgtgaatcagggctgctggctctctggaacctggaggggttcactgtagaccaggtagtctccatccagcaagttcattgtaggttagaggttgttctttttccaattttcttatcagaatgggcagagc

SEQ ID NO: 76465 - DNA, 1071 bp, Homo sapiens
cctggagaagaagggagggatatgatctcccgggggaaaagtacaactcaataaagagcttcttggttctggattaaacacaggtggaactgcttcttactggtaattgggagtttggccagattgtggggcttgtttcttggtcggacagggaaggaggcagccccagaggcgttaggctgacgaaggaaaagagaggccttcttactcagaaacctcttcctggtgtctgggccaagctaggatcagtctcttttctggagatgcaagtagggtctggtacaggacttgagagttcggccccacatctgtggtgaccctcccctagggaggcagagacgtggctgggggagcagccccaacccctgtatccacttcagagatgggctgtggaatccacatgtgcttctgctgcttggcttctggatcattcctgattctgttcccacctctgccctcacccctttcatccccagtgactgtacccctgacagcacccttcccactcccctgacagcacccttctcacccccctgacagcacccttcccacctctgcacctctccagccagttaccgagggacctcactgcccatcccaccacactgcccgtcccagaaggccgtcagctgccggatcacctcacttgagaggtctgtaggggcacttgcgatgtgccaaaaacattgctcaggttggatggatgtgctcttggcatgagggtgagcagaaaccgagtcctcttttgtgcaacattatgtttaaattgcttgaaccaaactgtggctttggggcagggctgtttttccccttagcagctgactgggtgcagaggaacaacaccgagtcagttccagccactttttctgggtaagtgatggcagccaggtcactgggctggggttttaggagtaggaggtctgaggaagggcccctgggtatgcaagagaaagggtcaggaaatgggagttcctgggcctcagggcttaggcctcagaaaagctctgtcaagggaggaccttgagagcctggccagctagtggcttctgaagccggcttcccaggcaagga

SEQ ID NO: 76466 - DNA, 1031 bp, Homo sapiens
gggttctttctgggccacagaactgaggctcggctgtcttgagggagccatcccaccttcacacagacatctggcagcagccacatgggcgtctcctctgtctcctgcgcacgcatggccgttttattcagggtgctctcctctgcctgacatgcctttcctcgtctcagccatgaggccaaatgttatttatccttcaaggggcagcctgagtcccgctccctccgggcagtcttcccagctgccccaactcctccttctccaagaccttcagctccactcgctgtcgtcctctggacaattccatgacaggcgggcagtgtatagctcttccttgtttgttggtcttttctcttgacccagagcattggcttttggaggaaggagccagatcatgttctttgggagctgacagcaggcgctgggtcaagcctctaatgagcacttaagaaataattgttgaattgatcaacaggaaataagcttagattgcagcacaagggatttaggttggatttaaggaaggatttctagagagccattagatgtttagaaaggatggctgagggagactatggcagtaccaggtcttaccacaattatgaaaaataagagaagattctcctgaaaatcaggggatgtggcggtggcagctgtcaaggtttacatggagaaaggtggggaaggagagaaagaaatggccacgctttagtgtccagttaaaggactacagacttttggctggaatctgcctttctacttctgattcttgtcattagctgagggctttcttcacttttccctcctgtgacgcagcttgagtcaagctatacctcaaggcgtgggatgagaagtggagcaggtgtcgcgcagggagcggggcactgacctcaccagggccaaagccatggagcatccgcctgttctggcagtccaaagagtggctttgccatcccgttcctcagaacccgagctgttcctcaaccctccaacaggtgcgtggtgggttgtatggtgaaggcatgctcaag

SEQ ID NO: 76467 - DNA, 1048 bp, Homo sapiens
agcaatctccaatctagccagatggggcaggaaggatggggtgggactgaaccacaggggagaagtgttgggtcctagaaaaattgctgctgaggtccaggtgttatggcctttgaaggactcagcatctttgtttagtcctactcctctcctttttaagggaatagatgggaggaggtaagaatgtggtggtaggatcttagaaacctacatcttctttactaaattatgcaaaaacatcatttgctgagcctttacgtagtccaaggctggattgagggtttagctcctttggatcttcacacagttccttggtccttgttggctgacatataatggagccataggtctgggtttgaattctgattatatggccttgatcaattgctcaacttttctgagtctcagtttttccatctgcaaagtgggatgcagaagattacctcttgggtggttgtcaggatcaattaaaataatttatttaaaattcttagccctgcccctggcacatagaaggcatacaataaatgagaatcccctggaaacttatttctattctactatgacttcttcctctctaattccctcttagaatgctgtaaaatttcagcagtgcaattgggtgctttatagtctaggttttagataaatgtagtcttctttcttggaacttctgtactaaaatataatttttaaggcagttttctggtggagacagggaccccaaatagatttagatctggcatggggaatctgtttaaggtaaagcaacctctattttaagtgtctccttcagagatgcttttaaatgcaccaaaagttggggagatataccttatcgaggtaaaaaggagaaaattgaaaattgtctttttctgctttccctagaagaaatagtttcttatacaagaccaaacactccagcacaagtcatccttagccctatctttttggaggccgatcagaaggcagtcagccctgtattttaacctagcctaagtactctgattagcttgagcaacttcagaagttggcctgtggcctcccg

SEQ ID NO: 76468 - DNA, 2816 bp, Homo sapiens
gatgagaaaggagacccagcaagaggagagtctgtcttgcaggttcagtggctcaggcctggagagtggcttttgggcttcttaccccttaagatgttgttgggctgctgctgtattggggatggagcaggaagcacactgggtggggctcacctggcccatttggctcattgaaggagggacaagcagtgtccatgacttctgtcggtggcgtgagggtctcttataggacactgataaggtctccattcacctcctttggggaacatactgtgatatcggaggtcttatgtctggtgatgcagagcagatccagaggggaggaaaacaaagacttccagtgctattgtttttgcaagtaacttagctggcagctttcttcttccacattcttggtcctagactcttgaacaagagccagtgattgtgccctccaaacgatgacttcctaagggctcttctcagtgtgagggtgtgtgcacgcatgtcgctgtgttcatctgatggaagcacacatgcctcagctcatgaacaggttcagctgatcagcccttttatttaaagcactatccaactcccacccctttcaaactctccgtcggactctgggccaggttagcttcatttcagccacattgtgagttactgagtgtattagtctgttctcacgctgctaataaagacatacccaagactgggtcatttataaaggaaagaggtttaatagactcacattcagcagggctggggaagcctcataatcatggtggaaggcaaaggaagaacaaaggcatatcttacatggcagcaggcaagagagcgtgtgcagggaactgccctttataaaaccatcatatcttgtgagatttattcactatcatgagaacagcatgggaaaaaaccacccccatgattcaattacttcccatcgggtccctcctaccacatgtggggattatgggagctacaagtcaagatgagatttgggtggggaaatagccaaaccatgtcactaagacattttgtctcacagccagttccagtgtcatctttatggaaaaccaatctctggatcttactggcttttgcaagttctctctaagtttggggctgcctgttggaatcccacagtctgctaaagggacccagtctccccttagcttctattctgataactttttgataactggtatttccatttctcttctgtctgtgattatacaatagtgccacattcacatttactcctaaattacaatgactctaagaccctcatctgctcaaacagtaactccccttagtccccactttggtgtgccttggatacttgcacaaataagttataatttcctctttgcccaaaggatgcttagtgctggctgtgcccatggtgaaagccaggtccaggtgagtgggactatctcccactgctgccaaagctgtcgattcaggtgccagagcagggatgggcttcatgcagaggtgggaagaaggacccacctcatttctgtttctctttgccatctagctctgtgagtgcccagaatctctcaaggggaacttgaatcttttggatgccactttcagcttctgcatctcccactttgtccagaatctctacaagtctcttgcgaaaacaattctgtctgttttgggatcttgtctttccaaccagaggggttcagtcactgcccagcacccagttgtattgagaccaaccccagccatcttccccactccccactgaacttctccctcagtcccctagtggtaaaacacatctcacatatcactgggtgcaaagagctaccagtgatgatgagctgaggatggtggcccagggtccggtggcacaggagtatccagcgctcactgccacaagccagcaggctcagtgccatgctagatatttgtgttcttagtaatgctcaatgaaaacttagagcatattgctggtcagatctcataggagtgttcaggataactttataaggagttactacccttggctgaataaattgctcctgccaggtggagcgatggtgctaatttaacaaacccttcctatcagatgtgtgtgtcattgggaggaagggcaggacgcttagaaccaaacaggcatgaagaaactccttctttgtcctctttgcctttgcacccccacaagtctaagtcctctcttataatccatgatctcttggatgcaccccaagtgtaagaccattttgtggctccttgttaataccatcagcttaatctctattttttttccctcaatgctagtgggctgagaggattaaaaatatctggatccctgggtcctggagagctctctgtttatttgatttgtagtgagaggagtttttgtgctggtggcagactttgagggatgaggagagggaatgggcatgtgactttctccagcctctgcttccctagtatttagtgacagggcaggggtgtgtgtgcacaagcagaaaataaaaataaatgccttccgtctctgagtaaaaggtttgatgccctgtcggtgatcaaggaggactaaaacctaaagggcatttaagttgtaggactccactcatgcaaagaagtattttgatctccacttgtcctcctttctccttctttctcacgaggatgcatgcttctggcatcccgccctgccctacctagcctcgtggaagtcctgtagggcagcgacaaagcccactgatattctccatgggcagcaaccctgttccataagacagtgataggatttggttcttggtgcttttatttcatccagttggtccagattccacctggcgcat

SEQ ID NO: 76469 - DNA, 1039 bp, Homo sapiens
gaatttttaggatcctctatgatctctccccaacctggccctaggggctgatttcttctatgaagggtcatttctaaactctatcttgaaattactttgcttgtgtacttaggtgtacctgttgtgattctcttagcttgtcctttcaacatcccttcctacttgtgaaaatcttttaagacccagtttatggctccttccctgagaaattctcctggatcctttcagtctgaatttacctctccttctagccctacagaacacagtgtcagctgctctgtccagcactcagcagagccctgaagcataataggtgctcagtgagtctttgccaaatggatggttctttttccttcctccctgcctctcctatcctctcttttcctttctacgagtttgctgtgaccatctcacatcttggattgtctggcatcccattttcccatatcctatctgtttgtttgtgacttaggctttgcttcctggtttcaaaaatgcagccccagtggagatatgtccacatgtcagtctttgcaactagatcagcttgtaggggcagggcctgtgttcttgtttattttcataatcctcaatgtacctagcatggtggcttgtattaaagggggtgggcagagaaatcgccagaaacttctctgagtgcctatgggggtgtctgatgtgcccttcaaagcaaacattctttggaattttttctttagttttgtgtttattgtttttatcttgtttgtttgctgagttgtaatttgcgtggagtacaattgaccccttttaggtgtacacttttatgaattttaacaaatttatatagttgtgtaaccactaccataatcaagatctagaatatttccatcgcccacaaacatgttctcctgcttctctccttatctccagtccctggtaatcattaatccaatttctgtcactttggtttggccttttccaggatgtcacataatggaattatatagtatataactttttgagtctggcttctttcatttggaataatgctttattt

SEQ ID NO: 76470 - DNA, 1041 bp, Homo sapiens
aggtgtcattatccccatttatagatgatgcaacaggtgtgggatgtggagtggcagagctggggttcagactcacaaatccctaagtccagagccctcagaagccctccatactctgttggctctctgagctggcagctttaaaggaggctctgaggtgtgttctggaaggaggcagtctggtggtctggttagagtgctgctcctggagccggacacctgggcacgaagctcagcccccacccctcaggtaagtccccgagcttctctggggtcagaatttccttatctgaaaagtggagattgattattatgattgcttatctgttgttattcactattattgtatgtaataataattgttatatattatatattcctataattagtattgttaatgatcattattatagcttccctcattaggttgtgatgaagataaaatcagttaacacacatgaaacacttggaactcataaataatatataaatttttgtcattatcatcatgattattcccatctctactgtagttctactactgaaatctttctatcatgtcgataccactataccgcttaagaaaaaaaaacccaccaaaccttttgttgaaaatccccaagttggaaaatggatgaactcttccatcaattttttaaaaactgtttattctggtaaaaagaatgtgggtgatctttgtatatatttaaaactgcattgcaaagaattcatgtctgtggggaggaatcagacttctctcagattagtttggggctgagacagggtgaaggtaaaggaggagagtggagtttgtggccatcggctttttctttctccaggcttgtgtgatcctgggtgtgttggttataggaatggctgacccctgccctcctgattctgaagtgttggctacctcgtgacagacagcccactggccagcttttgttttggtgaggccaggccagaccaggtggtgtttactgagggaaaggaacttccagattagtccaggctaaattgctaaacgagagagtccctgaa

SEQ ID NO: 76471 - DNA, 1047 bp, Homo sapiens
gagctccgtggtccaggaacaatctttcttgatatagttgtatgggcactaccacttctcccattttctaattctaaccactgctcccctccaacagtgcacacatgtacctgatttttttatttcctgaggtcattgcatatagggatctatatgcatggatcccttgcatatagggatctatatgcatggatctcttgcatatagggatctggggagatgtaacttcttcttgatgatgctttgttctgaagttggaagcttaaaaaatgttctgtggctttttgacaaaggcattgggctctattgtcatttccatagttcttactattgtatttcctaaaacctagggaaatacacacttgtttcctaagtgcctggggttgagctatgaagcagatcttattgttcctttttagctccccagccccacagtatagaaacgcatcttcctgacgtcacccctgtagactcgagttgtgtgactagcttgccctgggaacaccttggtttaccgtctggtttttcttctttcacattcccagcaagtactgaaggtctggatgcttgacatgaactgtgaaactttgttggcctggactgatgaaacattggcaggctgaacatcctcatagggtggaaggggtttgtcctatctttgatgagcctgggagtctaataggagttcaggggccaagggcctttttgtcttcatgtggatatatcttgcctagagcaacagtttggctctctcagacagtgtagaggaccctctaggtgaagtactgagacctggggtgcatctgtgagctggaatgtttccaagcttcttcagccacagttggcccctttggatgctgcagaaaaagtgggctctgtgtgtgtttagtggatggtgccctgctttataaagacctcctgccttttggtctgtggacaatgccagcttttttttttaaagcagtcatactgccaaaaattcaagcccatcctttatgtacagatggtataaatggtaaatggtccccactgttgggcacttattgc

SEQ ID NO: 76472 - DNA, 1346 bp, Homo sapiens
ttttttgtagagacgatgttttgtcatgttgcccaggctggtcttgaactcctgagctcaagcaatctgcctgtcttggcctccgaaagtgctgggattacaggcgtgagccactgcgcctggccaaaaagctttagttttgaagttcaatttatcttttttttctcttttatttcttataacttcattccttttcatgtgtatattcggttgtctcaggactacttgttgaaaagactgtttttccatcttgaattgtcttggtcctctcatcaaaaataagcttatttctggaatctcaattctattccttaatctatatgtctagtcctatgccagtgccacactctactgattactataaccttgtagtaagttttgaaatcttattttttctttgtaattggacagtgagatgagggttgttctgcacccatgtatggggttaatgctggctccactcaccgaggcagagcatctagtagggggaatgcacaggaacctgtagcctgtgctgtggtcctaggtttggagacaatgtcagtacccttggcatgatatttgtaagaaaagggaaaggttgggagagaacggtaccaaatgggggtaggaaactttttagaatcaccaaagatgagcattgtatatctctaagagctttcagtctctgacaggccaatacttctttgaatctacaagcaggaaagggaattccttttcaaattagaaactctgggttacagggagccttgaaactgtagaggagaaatgctactgcctgtcggagtagagcggtgtgcttgtgctggtccctcccgcccctcccccaatggcgtatcctctgtgggcattaaggttctcagcacatcaagatctgggagaggtagaagctggagccccagtgagcagcagccagtagccagcttcccaagggcaccctacttttgccttcctgtgggaggtcaaggtggcatatcatttgcagtgagtgaacaatctcagttatgcagttacgaaatttaatttttaactttgtcagtgatggcaagagcagggtctgacccattcatgtgcaggaaggacttgtctaggaagtgaccggtctaatctcttgcatgtgttgggagcctctactatcatgttttcaatggaagaactggtccccatgcccccatcacccatcaggtgcaaggatgtgtgataagatgagggtggatggagcacgctttgtgctcagaacactgtctccattgtgctctctggggactcgcctatcccactctctgctctgtcctgctcttcaatggctgttttctagctgaatggccactgtgagtcctcttcag

SEQ ID NO: 76473 - DNA, 1823 bp, Homo sapiens
tttttagtagagacggggtttcactgtgttagccaagatggtctcgatttgctgacctcgagatctgcccgccttggcctcccaaagtggtggaattaaaggaactgctcttcttttttagataatcatcatcatcaacaacaccaccactttcttaacctatacacaaggtgccaggctgttttatatttgcctgacacatgttaagttattcagtcctcactataagcactgttacattcccattttattgatgtggaaactgaaccacagagaagctgtgtagcttgcccagggtctcacagtgtgcaagtggcagagtcagtattcaaacccaagtaccctggctccagagttcttgatcctaaccatgattccacactgcccctctaagagacattgccatcttttaaagtgatgttgccagactagggcatattcaggagggtgactcaggtgagtaaagttgggaaatgatgtcatgtgaggaatatccaatggagccagagataacaaccaaaggatggataaaaagatgactaggccgggtgcagtagcgcacgcctgtaatcccagcactttgggaggccgaggtgggtgaatcacctgaggtcaggagatcaagaccagcctggctaacatggtgaaaccccatctccactaaaaacacacaaaaaattagccaggtgtggtggtacatgcctgtagtcccagctacttgggaggctcaggcaggagaatcgcttgaacccgggaggtggagattgcagtgagccgagttggcgccactgcactccagcctgggtgacagagcaagactctcaaataataataataataataataataataaaaagatgaccaaagggatacctgagagccagatccaaacctttgtctgtgaatgataataagtcttttaagtgtagtcccacagagctgacccaggatcactgagtacagtatataaagagtaggattctgactcgaaatagggaagaacttttgacaagtagagtagctcacagacagaatgtctgactcaaagaggacttaacttcccatcctggaaagtgggcaatcagagaccaagtggatatccatcagctgtgccatggggatgggagggagtgttcctacattgggaagggggttcaattgatctctgaggaggaaaacaccactttttaggattttatgaaacaagagctaatgtccaatcaggtggctaggcacacagtaggcccacaacagacatttactcaggaaactttcaggcagagccattaagacacacgtttagggcttttgccactgctctgtgagtgcacgtaacatgctgggaggtgacccggcaggtcagtcaactaaactcttctgcaaaattgaagggatcagaattttttttcatgtcaaaatagggaagaataataggaactcaggtgggaggtgtgaagacagaaaagttttattaaaagtgaagtcagacaggagaacaaggaaaggctccactcctgcaggccacttttgtcttccccaccagccagcgttctcacagttctcatctgagtaaatgctcctatttatgagggactttcttattatgtactttttaaacataaaaatatatttgatacttaacccccaagatagaaataaaattaaaggaacaagaggtatcatatttgctgtttacaaaacctggaccattctaggcaccagacagaggaacaggagtgaagacagtgaagtttcttgggtccccggagccctaacactcgggtgttccaaatgtctttatatgtcctttgtgggggatgctg

SEQ ID NO: 76474 - DNA, 2095 bp, Homo sapiens
gggccagagacacagcctcgggcgatggacttgagggcacagtcctcatggagacagaggcctaccttggccatgggagtcaagggccctgggagtgagtcagcgtggccattcagctcctgggacatgtttccccagaggtgattattgaccaaggaggagagagcagcctgccaggctccattaaattgctgccactggcaaggaactgtctttaggaaatatcccctctagggtggatggagtctgaagggatcaactccacatttccagcagcatttcccacccaagtctgtggaggttactagaggagatctggccctggaaaaggccagcttgccaggcatttctggcatcgctgagaacaattctcaccaccgccactccatatccagccttcgctgggtgccagacaatggacttccttaccttcaggtttcacgttgttatccccattttatagatgggctcaaagagctgagcgatgtatctagttcataactggctggaccaggattcaaatccacgtctatctggatttttttccattccaccattaaggctcctcagaaagtagtgttgacgtgaccccaagatattgctcttggatgaacatttggggtagcaaccatggccatgagatgaagtgggtgtgggacatggtactggggtaaaggcattgaccagaagacccgagcagggtctcagatgcaggagctgcgggaaatgcctcatttagacagcatgcaccttcgtggtaggaacaaggttccccctatcttgtcttatccttgatttctgtcgataggtccatagcgaaacaacttgtcttggggaaaatgacggtgtttggtgtccacacgagagcagaagcctttctacagcttttctgcctttgtgataacttttggatttcaccaaggctgtcagatgtctcctctcactgctcccttccatcccttaccactcaatttgtgtgctattactgtctagccttgatttcaatatgtccttgatttcaagaagcacattttcttcacaccttaatatctttgcagttggcacatgtcttgtaattgagatctacatttaatgtagtggggttgtttaaattgacattgcatttttataattgatggagaccaagaattgagaaaataggataatggatgcctttattcaacccatcaatcacctacaatgaatgtcaggcattatgttagattctgggaatgtagaaataactagcatgcagtccctgaggtcacgatcttgagaggggggagtggactggatgaatcaacagctagagctcacagtgataagggctgtgattttgggggccccagggtgtgtgggaggatcagaggaaggaggcaggggaggctgggactgctttgaggaggtgtatcacaaaggaggaggggaatacgagggattaggagtggatgggagatgggttggggaagggcattccagacaaatggaatggttggagcaaacaaaggctcagaatcaggagaaactaaaatgtgtttgggagcatcagagggttctgtggccagagtggagggtgtgtgctgggacatgggcatgaaatgaggctacggaaatagatggaggcagatcacagaggaccttgtgcataccaatgagtttcatctctatcctagatcccaacgcgaatcactgaaggattctaagcagggaagtaggccttaatgtgtgtttaggaactccagattgaaagcaggatagtggggtggggcgggaggtggtgggtagggtgacagctactggaagagaaagaagagctaccctgaaggatgaaaaaagcctcattcctttttgctattcccaggcaggcagacctgatcttggaggcttgaggaagatcacacagtggtgcagcagggcatctagaaataaaacctgcaggttttacccttgccttaatcccgtcatgtgtgccctcatctcaagacagtcacaagatcaataggcaagctgatctatgaatggatgctaggagaagctagacaaagaagaaaagcttaccacttgtctctgcttgttaaagaaatgtcatttcaat

SEQ ID NO: 76475 - DNA, 1025 bp, Homo sapiens
agagagaagcaggtaaaatgctgtggtttgcgtgggagtcccacagcaaccatgtacccagtgctgttcactgactggaccacccatgagagacactctggagacagatgtggggatgagaggtggaagatgctctttcaccgtatgggtgatgctttgaaaggggttggagatgagtcttgatattgtgaccgagacttatggttttcttcccttttcacttccctgaacaggtgcagtgccatacttacactgggtactgctggtgtgtcaccccggatgggaagcccatcagtggctcttctgtgcagaataaaactcctgtatgttcaggtaccgtagggaggggcgggaagaatgaaaagggttggagagagacccgttggttggtctcctgcatcttgtgggagaacctttagaaggttgatggtggtgatgaacctttttctagatcagggaggattctactctaacatgcttgctcggaagtcagcaaatgataaggcatgacagtgtatgccatgtgtgtgtatttatggattttgagtttagatttttggttcaatgctctccttctaagcactggctgtaatctcatagagctgtggtggcatatgagttactagcttttgtgctgattctgattgctagtggctcttgaagtgctttattgagttggattttgagaccacctgggagctcagcatccaaggctgtagttatctattagtgatgtctatcatgggatcaggagagaagaatggtggcttctgtgtcatatactcaccacccctgaagaatgtaatgtagagaaatggaaaattttcgtaacagtggcccttaaatctgactgatcaacagcaatgtctgggaaattaaagagaacccagatatcgaggcttcctcttgtatattctgatccaggaggcctggagggagacctgaggtctttgtttttatgaagtctctcaggtgattctgatgattagacaagttagcaaactattgctttatagtgatccatt

SEQ ID NO: 76476 - DNA, 1104 bp, Homo sapiens
attaaaccagagaggatgaggaaggtagggtgcccaagtctgcccttggctctcttgttgtgtaagcacatttgggcatttttcccccctcgctgatgctccttcataattgtcccagcacatccagattctcttcactaaggcgaggctggctttgtgggcatgcgacctgtgcagttgctatcctgaaattctgaataattctgtctttgagtctgatgggacagtgaagatgcgagtgagtggaggagagacacgtcatatgagtgtctgctgaaccttgtcacctcattagcacaaagcttttgtgaggtgtactatgtggcttccatagcatgcttaaaattttaatttttctttatctaggacaatactaagtagcaaattaaaataacaccgtgacaaggtaagagagagagactatggaataaaggacaaagttttgtattttagtgcctttaatggcacttttccctgctttttgaatgaaaggccctgcatttttactttacactgggccccacaagtgacgtagctggcatctgtctgagggctgtttattggacaagccaacatgagccataggtccctggaatatgctgaccatagtttttagcatggaagacagttggaggcttaagattcactgccactgacctccaggacagcatatgtgcagagctggtagttgaatggaaagcaagtgtgcatttcatctcgtgtgcagcctctccaggactcccatctcaggctgagtttggggcttcccacctgcatctaggccttggaaactacatgctcatcagggcccacgtggagccttgggcttgctgagggtcattgtgaagttcacaggcttgtcctgcacacacagttgcagggagaccaaggtaaagccctgggccctgcctccagtgcttatgccatgggatgggaagaagaggcgaagtcacccactctgaatgcaggagataaggatctggagaacctgctgcccccaaatgcaggtgctccaagaagatgtggaagtggaacaggtgataccaccacccaccagaaaacagggaccaatgggccagatgggctactgctctttccctgggc

SEQ ID NO: 76477 - DNA, 1167 bp, Homo sapiens
tgaccgggctgggagggatcggctgtccctcccaggctggaaggaatgaaaagatgtattgtgtgaccacggagagtctggtcgccagccaggaattagttctctgaaggagaggaggagaaaggcagagcagaaggaggctgggggaggaggcccagagagatggcaggaggaagggaggagagagagaggctgggtggtcacagccgtttggtctaagacaggaggcctgagtggctgtggctcctggatccacaggtgtggggccccagggaagaagtgggggaaggagggggagacactgttatcttacccagatgcacgtgctccaggaggggaggagggtcaaaacttcagactatttacttaatcccttggaatgtcctttcctcactctgttctttgggccccttgtgtttaacgaactcctttatgggcacatgtgtggtaattaacaaatgcagtgtaggtcctggaccatgtgtttgagtttcaaatatccattgatctggggcaatcccatcctggctgccccctccccttcttctcctttggtcctggcccttaaagagagacgtgtgtgtgttgtgtgtgtgggagagggggacggtgcacatgtgcattcacatgtgttttatggatgctacagaggaatatcagaagagaggaagagggccccaaacagcccctttagctctgaaaatgcactgctaaaacagttgaaggctgaagaagtagagatagaggtaaagttttggttttcactggagtcatccaaaggaaagtagattggaagcagaatggtttcagagatcaagaagttatcctgcagcagctttacctggctgtaccaaggcctatggatttttctgatgtgactctttttggggtctcaatgctaattaccataggtgatttgaggagcttccaggataactgaacacaggttcaggggctggccctgcccttcattgcttgtgaagtgcaaggagggaaggaagttcttagcctctggtggggtgaaggggggcagtggtgaagagtgattaaatgaaaggatatggaaaagcacttgtgaaatgatttctggcagttctctgtgagcttttgacttctgagtgcccagagcatcagaggccatggggtgatgctgtgataaatggcaag

SEQ ID NO: 76478 - DNA, 1076 bp, Homo sapiens
gctgttggcttctgctcacatggcttttcttggagaaggattctctctgattctgtgcctgctgaaacagaactgtgcctgagcagctccaagcctgagagaggcagctcgtttgctttctggttctccgagccgcctccaccaagcctggaatgttcatataccagcttcgcagaggtcagtttcagaaggggtgtgcttgcatgctcacacatgtaccatgtctccctccttcccatagctaactgctccgccagcttggctccagctactcaaccgcctccattttggcccgtattccagggtctctgaagaaaagtttatgcatgaacagcactagactgagagtttgatttcctgccatatcctcatctccaaggattggagagagaataagatttagggatctggaaaaagcctcttagacataaattcatttgaatccctggtgttattagtaaccattgatattttacgcttggtgcttttactcagcaaatatttatggagaacttactaaatgtcaggcttgttatcgtcactaaggacccagggatgagtataacagtacgagtccaggcctcacctcctggagctcacattctaattgttcttagccttttatgatggaggttattcatcttcaggtggaggaaaacctccagcggagcagcaggcttctgtaagctctgggaagttgccacctctgcaggggagggaaggcaggtggcccctccaaacaaccctgtgtggtagctcctgtagccagagcctctaaggaaagccccttggagcgggtggcctgagctgagcaaagccctctgccaggttcctgagccctctgactagtgcctttgtggggccactgaagtccaggtgagagggctcagagcttgtcaggccaatgagagtatgttcatttgctccctgctcccggcctaagttccagtgtggcacagcagcttgcagagaggtagggatatgggcacataggtggacaggccttgggcctgcttctgacccctggtctccagctcagagggccacagaactcgtgtggtaaaggccgaggaact

SEQ ID NO: 76479 - DNA, 1413 bp, Homo sapiens
tgcttacagtcatgtcttctctggtctgatcttttggtagggggtcttgtgagtggtcaagtttgagcactggctgaaccctctgtagaaagtgataatttttgaggggtgatcatatttgtaggatttttttgtagactctatttaataacaataaagaccagagtcagtaaagtctatttactatcaataaagactgaatgttcatcaacaggaaaatgtgttcacaagcgaaatctgtatctctatcaaggaggatcatcttttcaaccgaagacttcattatgcgaaataccactctgcataatttatgcctggttgttgaatttagccctatcttcttttccttataggtggcaagactatgaacaaaagatatatgactttgaaccagcaggcagaattttacatgacaatcaattaatgagtgtcctgtcattggtcccctttaagttgacctgttcaccagctctgtcctaatggtggcgatgtggcattagaatgcaaggaattatatagaccaggaggtgaattcacacgccatcagttgagttcctctgtgacttgggctggtcattgccttttcatgtgtctgttcactgataaaagttggagatatgggatggtggagtgaaaggagactgtgaacccccttgggtcagtctttgacagaatagtgcagtggttaaagcacaggctttggaattagtgaaacctgggttcacattgtagctccaacacttagtgaccccagtcaagtcacataattcctttgagcctcaattctcattcacaaaatgggaatcacaatctctccctcaaaggactatggttaaaagttaactaagataatgtctatatggcactcaactgatgcctggctaactgataaattgtaagtacatatatttattattatcattattattggtatgaataacgggaatagtaatgatggtgcttattttgaaaattcttcaatcagaaagaatttatgattgtcaccttaagcaaaggcatctattaggcttcttcttaggaccccctctattcccctttccctgttaggcaaatataaatcaaatagaagtggttttggtgcctgtagtacctggtgccggaagtaacatttgcaactggtctcctagtccctgaggccctggaaggtctgcaagacccccatgagttaattctcattctgtgaccaagtggaagatacgaaggtgagctctgaattataacatacagcacttttttggctgaaacactcacttggcccttaacaattgtttccttgaatttctttttcacttacccatgcatttgattgctttggggaacgatggaggagaaaagatcatcatcatcatcatcaaaattagaatagcactgtcataatagctactttgttat

SEQ ID NO: 76480 - DNA, 1089 bp, Homo sapiens
agttgggttggatcacagccacagccatatatttgtgtagtgtctgtgaccattttcatctaaatagtagagtggaatagttgtgacagaccctgtatggcctgcaaagcctaaaatatttattatctgaccctttacagaaaagctttctggcttctggcatatatgattgaaatagaagcatttggatgggagtgtgtgtatggggatgtcttacttaagttttctggcccctctcatagtccaggcaggaggatgctccctgacatgcccaggtaagcctgcatcagcacaggagctctgaggcagctcacaaggctcttcaccatctcacacataccttttccaagctttaatgtccggttctggtgcatgctcccacaaacgggttgccaaaaaagcatcttgatgtttggctttcttaggtagtggatagggagtcttttgcatgtagcggagataaaccatgtaatggcaaaagcatgggctttggtgtcagacaaacctataacctggtttccaatgctagcttcctactgagaggtttggtgagcttgggaaagttaattaacttccctgagtcttgatttccttatatgtaaaacaaagttttagtgccttgcaggatttctttgtgaggactcaagagcatctgtgtaatgcctggcacatagtaggtataccataaatgattttttaaacccaacaaaacactggtgactcttggtggaatatctttatgtcttttgctagccacttgtcacatgttatcatatttggtttaatgagaagtcagatataccttaatgataacttatgtctggatatttggctctggtagggactggagccttttggccaaacacctgagacagtttttcattagagtttgatggatgatcctgggttcaggtgtgcttcagcctgcatccccggggaggttgccatgggactccgtgaagcccatcggggtgagagctcttcttctcagctgtctctcagaggcaaaaaggctatcccagtttcttttacaccccacacatccttttttcacactcagaccctgtgacgccaggtttgttttctggc

SEQ ID NO: 76481 - DNA, 1028 bp, Homo sapiens
actctgtggcctcaagtggagtagagaggtgtgacttccctctttgttttgtcatctctttctttcctttgtccctgtttttttccagttaacttcttccatgatctgatcaagggcctcaaggaggccctagaccctggccctgtgagttaaatctgaaagggccatgcctttcctcccttgcctcttagacccacagcgctcccttctctacatcattgaatggagcagctcatggtgactctgctccctggagatacagccatcagcacagacataaggtggaaatgcatttcttttaagttttaccatgaaagtgacaccctggcctcctcgtgcatgactgtgactgtgttttctcatgtcaccttacctgtcacaggtaagctgttcacagtatcagagtgctgctcttctaggcctgcttcaggccatttggccacgtcttggattgcttcttcctcacccaggaagttcctgctgggatagctgctatgactgggacttggggtcactgaggcaactgcacctcctggctggattccccaccccccaagccagcactcttggcccgcctagaaaccaccggctgatgtaatgacttgaggcctggaaaaataaacagctcgcagggaaaccagcggtagccgtcgtaagcaaataccccatggccacctggaatctcgcacatgacgtgattgggaggaagaatgagtaatccactaacgttagcagccgaggatgggtctgggcttgtgtgcatttaaaatatctatataaaaatacaccctggatatttatttccataactggccttctggatgtctgcccatctctctgatgcaggtgccttggtcaatcatggccagtagaattgagctggggatgggggatgggtggtcatccctatggctttctccatggcaacaaaggcctttttctttcttaaaatttccctttgcggagagaagcaataaacacacttggaggccccatgaagcctagccgcacagtccatttttaccttg

SEQ ID NO: 76482 - DNA, 1592 bp, Homo sapiens
aactatcatgtgctaaggcctctgtttgccactgaggggtcaaaggatgaaatacaaggaacatttaaggcaggagctgaccactgggcagtggtgcaccaaagggatggggggtgatggtgtggtccataccagtggggaggagtattttatcactgacattgttttgaattgctggcatagtgattataaaaagcagatagactcttagctatatgtgcatattttttttagtttacctacagacctaatacccctttattgcctgcctctggagcatactgctccattcccctgcccttggtcagctactggagtcctgttgaggagacgggtcattcacagggatagggcaggaagaccatgtttgctccacaatgctaccttagacaagctaataggaatagtagctaccatttagcaacttactgtgccaccaggtttaatgtttttcacacacgattgcatttaatcttcacaatgaccctgtgaggcatgtgcaagagttaccttacttttacacgtaaggaacctgaactggccaaggtcacagagaaaacaaggggtagagcctgaatcattgaccacaaagcccatgctcttgactgcctatattgcctctattccaactgttgctgacttcagaacctcctaacatgccagacccttcgataggagtatgcaggaggagtgataggcacttactactgcttttagccttgccaaggaagccctagtattccctcatcccctacctctagttccctctgaccgccctgagttctctctggcagttgagcttttagaccatcctcacatctccatctgggctggagctggagacagttcttctcttggccagtgagttaattagaaaggtgctccctccagggggtcctcccgggtccctttgtaggttacaattgagggatgatgttagatttttgctttcttttgctgcctattctgtgggggaaagggctttttagcttaaaggggatggaaaaacccatgccaacagaagtgtgactttaattcgtgcaaattctgtttctattctccccataccctccctctacctgatacaaacctgagcacaatttcggtggctgactttgttctgtttgccagcgatgtttgctttttccttgccctggtagagcctttccttttctgggccagttgtctaccctctatttggaaaggagccctgagcaatggttctgtgggctctccccctcatcaggggctcccagagcccctgcataactctgagtcacatagatgttgagaaattgggaattgggaattggcgatggccaagtggcactgagtggtgtgcgtgatggaaagccatggtagcagggcagagtcggcccagcaaatggtgcttggaaaaatgatcctctgggggccacttagcccctcctgtgaaaaagtgcaaagtccacaagtaagaaaaataacctgttcacatagttggcttgaaaccataggtgctaaaaccccctgtggctaaataaacagcaagggcctgctcagtgatgtcccataaatcatggagtgcagcaacccttccctggggcaccaca

SEQ ID NO: 76483 - DNA, 1051 bp, Homo sapiens
tgtgtatctataatctgtagatatctagcacttgtccctgtgctagcccttccaaaacaaatagatataaagatacatacacacatacatatacgcctgtctctgtcttctgttggttctctttctctgcagaaccctgagtgacacagaccttctctgtctactgtctgctctctccacccgtctccccctttgacctccacttcctccatcaccatgaggttcccatgttctttctccaaaaagcttacagcatagctggtctaccaataactgctgactgcatgtgcagaaggtgctttggtgttgggttacccaggatctcagcttttctgtctgctcctttcttcagcagttcctcctctggaaggcagtgtctagaaagaaaggccagcccaaagatctgaaactcaaatcttgtaatgtttatgttttttggccatttttgctttaaacaaaaaaagaagagaaaggaaaaagatgatgaagaagaaaaggtttctgggataaaagactaaactctgggctaaaatcaagtctggggattagctgaggatttaggttatccatgctttcctttgttcctaatcaccatgagtaattgagaggcacagaggcctgggctagtcctagccgacagagctgtgctccaggcttatcctctcttggtgggatgtgaaagaacccgtgccctgggcctggagacagggttcatgtttgtctggtccaacctcttttttcctctcctgtctcctgccctgcccactcctgctggactttggtccttctttgctatgtgcaattagtggtggacagggttgtgtgccttctggtgacaaggggtggacatggtttcacttctatctgagtatttaccatgtgccagactaggtactggacagtttgcttggatgttttttctattgtgtttcttctcttaggcagtcagaggtttgtcagtgaaactttaaccactcattgccaagtgcggaatgacctgactctcacttcttctctgcaccatctgagggacaggattataggggcgggc

SEQ ID NO: 76484 - DNA, 1092 bp, Homo sapiens
aactctgacctgggctggcccttcaggacaactttgccggccccacctctcctcacatattcctttccttcccaccattatgttccaggtactggttctcctcagttctggttcctcaaacaagtcaagctcttgcctgttccaggacctctatgtcagttgctcctagaattcagttccccatcttccaatgactggcccctgcttatctatttaaatgtcaccttctcaagtaccactcaatctgtaggagctgcctgttcaccctgtacctcagcacccctttttaactcagcctagcatatatcacggtctgatattttgctggcttgttgatatattatctgtctccctaaacccaaggagaatttaagttctatgagagaagaaacattttctgtcttcttccctcctgtattcccagagcttagactagtgtctggaacatagtaggtgcccagtaaaatatgataaatgaataaatagctagagggacgggggatagatggatggatccctgtctcgataagacctctttctggcacacatcagagggtcaaccaaccaccacaagaccaagtataaggctggagccagctgtcaagtttactgtggtgctattttgtaaccagggcccgagggtaccctggccaggacccagggacttggagcgccatgcagacagaccctggccagttgtccctcttgtttgatggaggagcagaggtatgaggcagctggaggtcaggtagcatgtctggaacaggactgacgaagacaattaggaaatccaggcattctgagttttggccttggctgtggaattcaggcagagttggggctacaggcatgaggttaaggaagccgcatctgatccctcctttatcctctcagactctagtagttaaagctggacatcagctggggccagggaaacagtctcacttggggacagtgggaaaaagggatagaagatgtttggacagtgcagaaaaaaggtgccttcctcccagtctacttcctgtcaggcatggagatgttggctttgcatcagctctcacgtttcaacccgcccctggtatgagctccatg

SEQ ID NO: 76485 - DNA, 1053 bp, Homo sapiens
taggccaggggagggacaatttggattccagctctggtttattcagcaaattagatcaagccaatttgtcttgagcacccatcatgtacaagaacatttctggctttggtagagggtgagtcatgtttgtgtaataaggattacccacctggggagtcctgagaaaagaatggtccaatcttaggatttgagtcggagaggatggcttaacgttgccacaggctgagccgctgtgggtggactttggcttggaggagccgtttctacctgactttctgggggcagtcataccagggctgatggttcctgcaagatcctgattggtgttctctgcggtgggggtgtttgtccatggcccaggttctcagagccagaccccagccacaccctggaggagcgggtagtgcactggtatttcagccagctggacagcaatagcagcaacgacattaacaagcgggagatgaagcccttcaagcgctacgtgaagaagaaagccaagcccaagaaatgtgcccggcgtttcaccgactactgtgacctgaacaaagacaaggtcatttcactgcctgagctgaagggctgcctgggtgttagcaaagaaggtgagtgctctcccctgtgctcctggcctttcaatacttgcccccacccaggcatgggaccaagggctctctgataaatgagattccagatactcatctattcatcaattatttgctggaagtgtgctatgcttcatgctagatgtttgagacagtggtggaattgactgataaggtccctatccttgcacagaagacagagcttaaataagcactcacatgagctgtgatacatgctgtgagagtgtgctagggtgggccaggctacagtcacaagtagacccatacatcatggcttgacacagtggaaaatttttctttcccatataatagttcagcatggtcgcaggttgtagggtgtgtgtgtgtgtgagtgtgtgtatgtgtgtgtgtgtgtgtgtgtgtgtgtaggggtaggagtaggggcagggattgctctatgcagtca

SEQ ID NO: 76486 - DNA, 1047 bp, Homo sapiens
aggattaatcaatggggtggggtgaagtggaggctgagtagacttaaagcctatgcagaggcagaaaggattcctgtgtccccactctccatttcaacacacaccacaggacacactgctctggacccaagcagcccagagctagaaggctctgtgggtcctctagtccattttgcagtctaggagtcaaggctagcccagagaggagtagcgatttgctcaagggtacatgtgaggtaccaccactgctggcgcttggcccagcctcaggattcctgggccagactgctgtcccctccaggagaaggaccccagtgtgtttgaagatgtcgccttgtgtgagcaggccagtcttggttgcctggtgaagccaagggagtggccagtgggggagtctggggaagagggggagcagaccagcctgggggcagcgtgggcaggagtagaggtgttgcagggggtgagggtgccaccagcaacctgagtggggaagcccacagtttccaggcaggcagtgcctatgggatgacggaccactattgagaggcccaggagcagtgtgggtataccatgatcaggcacaagtaggggctggagtaagtgcagaggccctgaagtcagatgggcctggcttgattttaatcccagctctgacaattaccggatctttaatccttggcaagttacctaaactctctaagcctccgtttccccatttgcaaagtggagattatagtacctacctcaacgatttggtgaggatgtaatcagataatgtgtgtgaagaacttagcacggtacctggtacatagcgaaggcacaaaagaaattggtagcggtagaggaacatgtccgggaaagaaggtatgagtttcagaactgccccctccatccctctgctctgcagggcggcagaaaaaagcccctgtggtcaatggtgtgcaggggctccgggagcagagcctatgcgtcggtcatccatcccgtgtcgtgcggtgccccctggtgggctgcgaggggcttgcatgctaggtggggacagaagct

SEQ ID NO: 76487 - DNA, 1749 bp, Homo sapiens
ggagcagaaaacccaagggcaggtggagagtccagggaggcaggatggatcaccagacacctaaccttcagcgttgcccatggccctgccacatcccgtgtaacataagtggtgcccaccatgtttgcacttttaataactcttacttgcgtgttttgtttttggtttcattttaaaacaccaatatctaataccacagtgggaaaaggaaagggaagaaagactttattctctctcttattgtaagtttttggatctgctactgacaacttttagagggttttgggggggtgggggagggtgttgttggggctgagaagaaagagatttatatgctgtatataaatatatatgtaaattgtatagttcttttgtacaggcattggcattgctgtttgtttatttctctccctctgcctgctgtgggtggtgggcactctggacacatagtccagctttctaaaatccaggactctatcctgggcctactaaacttctgtttggagactgacccttgtgtataaagacgggagtcctgcaattgtactgcggactccacgagttcttttctggtgggaggactatattgccccatgccattagttgtcaaaattgataagtcacttggctctcggccttgtccagggaggttgggctaaggagagatggaaactgccctgggagaggaagggagtccagatcccatgaatagcccacacaggtaccggctctcagagggtccgtgcattcctgctctccggacccccaaagggcccagcattggtgggtgcaccagtatcttagtgaccctcggagcaaattatccacaaaggatttgcattacgtcactcgaaacgttttcatccatgcttagcatctactctgtataacgcatgagaggggaggcaaagaagaaaaagacacacagaagggcctttaaaaaagtagatatttaatatctaagcaggggaggggacaggacagaaagcctgcactgaggggtgcggtgccaacagggaaactcttcacctccctgcaaacctaccagtgaggctcccagagacgcagctgtctcagtgccaggggcagattgggtgtgacctctccactcctccatctcctgctgttgtcctagtggctatcacaggcctgggtgggtgggttgggggaggtgtcagtcaccttgttggtaacactaaagttgttttgttggttttttaaaaacccaatactgaggttcttcctgttccctcaagttttcttatgggcttccaggctttaagctaattccagaagtaaaactgatcttgggtttcctattctgcctcccctagaagggcaggggtgataacccagctacagggaaatcccggcccagctttccacaggcatcacaggcatcttccgcggattctagggtgggctgcccagccttctggtctgaggcgcagctccctctgcccaggtgctgtgcctattcaagtggccttcaggcagagcagcaagtggcccttagcgccccttcccataagcagctgtggtggcagtgagggaggttgggtagccctggactggtcccctcctcagatcacccttgcaaatctggcctcatcttgtattccaacccgacatccctaaaagtacctccacccgttccgggtctggaaggcgttggcaccacaagcactgtccctgtgggaggagcacaaccttctcgggacaggatctgatggggtcttgggctaaagg

SEQ ID NO: 76488 - DNA, 1080 bp, Homo sapiens
cccactttcaggcctggaggaagcatgcacacatggagacggcgcctgcctgtagatgtttggatcttcgagatctccccaggcatcttgtctcccacaggatcgtgtgtgtaggtggtgttgtgtggttttcctttgtgaaggagagagggaaactatttgtagcttgttttataaaaaataaaaaatgggtaaatcttggcggctgttgcctctttctttgggtggcttcctttaatgaaaaggctttatttcctagaaagcttagttcgtttccctggcctgggtgctctccacttccatccaaggacatctgaggtgctgccaatgatgaacctagcaggggacccggaagtggccagtgtggtactgcacctagagaggggactcccttgctaaaggtgtttgtgcactctctgtaattcttcctcttacctccacccacatgtctgccccacgggatgcccctccctgactgccattcccttcctctcactggaatgtagggaatgttgctggcagagctttgggggcagggcttggggaagagcctattccatggcttcaggctgttgaaagtgggtacattgccatcatccagatgacaagacgccaggctgaaatgtagccataggtggggagcagacccccagtggagtttttcagcctgtaccccagttttgtggggtatctattctggctgaggctgcaggtctggtttgcagagctggagaactcccagacgaggattggcagcaggggtggagattctaggttttctccagcgtgaccggcctctttgcctttttccctgtgtgcacacacagctgtccctggaaatgaccgcctcagccatccccttgggaaccttctccagattccttgtgccacactctgcccccttgtctttgcaggtgaacagaagataattccccttgtaaacctctcctccagcctttgctccagctaggctttcttgcgacagggtctaagccccggaatttgatcacgcaggccactccttgtccagggcttgtccttccttgcagctcagaagagaggacaggtggttcacggcac

SEQ ID NO: 76489 - DNA, 1098 bp, Homo sapiens
aggcctatctacctgattctctctccttctcagttcctgaaacctctcctctccttccacttgggcctaggaggaagcaaactcataaagtggaactctgggtttgggctggtcatgagcagctcaaggacaacttccttgatgagggcaaatgggacccaggtagttcatggtaaagggtggcatcatcaatactcaaattatcactgaatggggtagagaataaagtggagggcaagatgctgggggatcaagtggttctaatgctttgttcctagagcaattgcagtattttcaaaaattatgacatcacctgattatttgcatgactcttgagaacatacatgggggaaaagacaaattaaaagctattaacatgcacagggagaactggaagtcctcccaggaaactttaaaggagtccctcctctcctatagctgcagggaccacagggatatggaccaagcccaagttgcagcattaattaaatgctggaccccattaggactcttcaggacatgagtagggaaggagtaacaccaaataacatatgacttaacctacccatgtagaactgggtacctttcccaataaattataaaattgaacttgctcagaaatatttattataaaatggaagtggtatgtatatagggaaaacagcccattcatgtcaagaaagcaccagtaacctgcacaaacaggcagttttgactcctgtggtaactccaggtaacagctttgctgcctttccctcaaccacacattgacttcatggggaattccctgtgaccagtgaataaatgagaaaaaagcatgaacctaattctgcacagcatgccagcaccagccagaagtggacagcgccatctatagccctactcacaggagaccctcaaagactgtggtggatggaaattttcccagtggacagaacttcaggcagtacattgaactgtccacttgggcctgaatcatggatctacaccaactcatgcagtggatgatgagtgactggctcattgaggacttgaagctaattggtggcaagaaaaattaggaatttaggaattccatgtatggaatgggccccatag

SEQ ID NO: 76490 - DNA, 1047 bp, Homo sapiens
gttcagtcattcaacaaacatttgttagatatttgctatgtactagctacattactaggcactggggttaaataagtgaataagacaagctgacatttcagcgctcaaggatcttactgtcaagtggagaggatcaaagggtacagacaaatcaaggaacgtgagagaagtggtatggctgagatggattgaataaaggagcaatgagagctccctgcaatgtgtgtggtaccactgaggattctaaattaaccttcattaaggacttagtagtgacagaggtgaagtggggataggtacatgattaatttacatccatattacaatgaaaccttaacatttaagagggatattattgatgtcttcatgatccagaagaatcctcacctttgcaaccatcactatagtcacttcttgagaattatggcctttaagactgtagcatgcaatgacaaaacctcacagaggtatgggttctgcccgcacactaatttcactcattaaacaagtgactggctcctatatcccaggctctcagcacgcctttgcaaaataacagattattgcagctcttggacctttgatgcctctgggaatagtcaaagccacagatgtcaaatatgtaaatgccaagatctattataattaaatagtgcaggcctccttcaaagaaaaaaagcatgttggctgtgctgcacgttctccaaccaaatcagaatgttaaagctcgaaggtatctgacctcccattttttaaattatgaagatgaaattcagaaagggaaggtaacttatccaagattacatggctagctatgatagaaagttagagttggaaaggacgttagaaagtgagggtttgaaaggactttagaagctgcttattcaatgttctctctgccctttcccatcttaggcttctccattttacttttatccatcaataaaatgttaacttcaaaaagaatatggcaattcttgggtaaaagatgctctggaagtgtgagtccgggagtattatgtgactaatgtcttaactaagaataat

SEQ ID NO: 76491 - DNA, 1300 bp, Homo sapiens
ggggagacatgtcaaagaccatgtatgtggactacaaaacagaggatggttctgccaatgcaggggctgactatgagttcacagagggcacggtggttctgaagccaggagagacccagaaggagttctccgtgggcataattgatgacgacatttttgaggaggatgaacacttctttgtaaggttgagcaatgtccgcatagaggaggagcagccagaggaggggatgcctccagcaatattcaacagtcttcccttgcctcgggctgtcctagcctccccttgtgtggccacagttaccatcttggatgatgaccatgcaggcatcttcacttttgaatgtgatactattcatgtcagtgagagtattggtgttatggaggtcaaggttctgcggacatcaggtgcccggggtacagtcatcgtcccctttaggacagtagaagggacagccaagggtggcggtgaggactttgaagacacatatggggagttggaattcaagaatgatgaaactgtgtaagtaaccttcctgtattctgcccctccctgaccccatcttttgccatctctttctgtctttctgtactgcactttacaacatttccttgtgtttgtgttaatgtcaaactttggttccatcacaggtatgcaggatcagcagacaccactggacaggttctgcttccaaactcttcttcagttttctcactttaaattgtttctgggcaaggaatcctgtgacaagagctaaggacacaaaacattttcttctctgaaacacaaaatgatagctggtggagctgtgggatgacagaagttttgtgatatcagattttggagaattcttgtgactaagaaggactagagaactgcttgggcctcttcttcctcccttcctcatatgaagggtatctatgagctttgaaaccaatcctttccattctgggcagcaatagcccatcagaacattctaaagaaaacaagtggcattggctttgttccctggtactatattgccagtctcactgtgtaaccagattccaggcacgtcttctttaatttggaaattgcaaaattgatagaaatttagcaatctttttaaatgaccatagactatttaatggtgtgaggcttgcccagcctagttgaattgagtcagtatggtttggatactggaaagtatcttggagaagcagagctcccagggcagtggctacttgtctttagtcacaggtctaagctccaaaatctggtgaagcagtgaaggagaaacatcctaggaattgtgggaggaaa

SEQ ID NO: 76492 - DNA, 1754 bp, Homo sapiens
gtgctctctggctgcctgtcctctgggcactcttgtcccaggtctattgttttcatgacccaccaggatggcgcttcacttcctcagaaattgtgatccccaggaaagtgccccacaggaggggtggagttgagatgccagaccagctctcttacagcatgcatttccggggccgaagacacgtgattcacatgaagctcaagaagaacatgatgcccagacatttacctgtttttactaataatgaccaaggggccatgcaggagaactacccttttgtcccacgagactgttactacgattgctacctggaaggggttcctgggtctgtggccacattggacacctgccgtggaggtctgcgtggcatgctgcaggtggatgacctgacttatgaaatcaaacccctggaggctttttccaaatttgagtatgtagtatctctgcttgtgtcagaagaaagaccaggagaggtcagtagatgtaagactgaaggggaagagatagatcaagaatctgaaaaggtaaaactggctgaaactcccagagaaggccacgtttatttgtggaggcatcatagaaaaaacttgaaacttcactacacagttactaatggattattcatgcagaaccctaatatgtcacacataatagagaatgtagtgattattaacagcatcatacataccattttcaaaccagtttatttaaatgtctatgtacgtgttttgtgcatatggaatgatatggatatagtaatgtataacatgcctgccgacctggttgtaggagagtttggttcgtggaaatattatgaatggttttcacaaattccacatgatacctcagttgtttttacatcaaattgacttggaaacagtgagtgttatgccagctttgacggaatatgcaaccccaactggggagcaatgtttgtgtatataatgaggtatcacctatttaggggggcatgtgttacagcacatgcactaggtcataacatgggcttgagacatgattctgttggttgttattgttttcgacgaaccaactatctcatggctcctgttcctgatcttaatgatatgatgagcaattgttcttatgagataattcaacgcaagtttaatcaatgggatccttgtttgagtgctccaaattttccatacctaattttccatacgtagctcctcgttgtggagacaatatcaaaaatcagagggaagaatgtgactgtggctcccttaaagattgtgccagtgatagatgttgtgagacctcttgtaccctttctcttggcagtgtttgcaatacaggactttgctgccataagtgtaaatatgctgcccctggagtggtttgcagagacttgggtggtatatgtgatctaccaaaatactgtgatgggaaaaaggaagagtgtccaaatgacatctacatccaggatggaaccccatgttcagcagtatctgtttgtataagaggaaactgcagtgaccgtgatatgcagtgtcaagccctttttggctaccaagtgaaagacggttccccagcgtgctatcaaaaattgaataggattggtaactgatttggaaactgtggggttattctacggcgagggggaagtagaccttttccatgtgaagaagatgatgttttctgtggaatgttgcactgtagcggtgtcagccacattcccggttgagctgagcacactacatttcgtaatatattagtacacgacataaaagaag

SEQ ID NO: 76493 - DNA, 3295 bp, Homo sapiens
ctcagcatttcttgacgctgttccacactcaggcctataccagttggctgtgaagtgttatgtcttgggtggtttttctcagcacatttacatagcccattcttcagccactgtgcacgttttgtagaattctacaaggaatctccttcaccaaagatctgtaaaggctagactacttttacatgaacttgttatttaagaattttcttcagttctgttaagcatacatatcttacgttacctggataatggccattattctttattaaaatcttttaataactttagatcatttcataactatacttatgaaataatctaaattcttcttgtatgctaaattagttgaattttgttccttcatgtatatatgtaatacagactcctggtaaaactataagtgaacagtattttcatttactactttcccattgattaaaaaaaaaaatcctgtaacttgctaacttgtagttctacaagtgctataccagtaatgatgctatgaagagtttgtctgggagtagattttccttctagttcttctaggacctgtagaatttgagagctgaagactctcaaatgtagagtatttggtccaaccttttcattgttacttatgagagagttaatgcccaggtggcttaaattactttccaaaggttatatagctagttagtaagagagtaatgcttagtatccaagtgtcaaggtaaatttattccattttccctgtctctggatataagctatcctatgttttcacagctttttttttccatcttactcaattatttcagaacaaccaaaacagcagatatgtaaaagttaatgtcagagtggtggtcagtaggagaaaggtgaagaaacatttatttcttcccttttattccaactatttttgtgcttgagaggtacttcagactaaatgaaggtaggatgatccataatgtagttgcagttagtttcagttgcccaaaagtgttttgcttatgatagatagctgtaggaaagtcttttcattcctaagcccaggcgtaagacaaatgatcttggtctcttttcttttttgtagaagactttagggtctccaccctttgttcttttcttcttattttctaccatcatccctgataaccctttcagtcactgtgctggatcagccttcagatttgtacttttgttttcccagcttcagccttttccttgtcctctcaaaaataaggcatgtagactctttctctattttaatagttttacggttaaggtggcgtaagataggcattaacatcagtaacaaatgaaaagttctaaatcttaagatgacatttcatcaatgattgtagttgatttatttgctacagttgtaatcgaggacctatcggatactttctactcatttattcattgagttagttgtgtcctaatcaaagccacaggctcttatactaatatttatactttaattttttgtggttctatagaaaatcaaagactccaagtttgatgactggaagaatattcgaggacccaggccttgggaagatcctgacctcctccaaggaagaaatccagaaagccttaagactaagacaacttgactctgctgattcttttttccttttttttttttttaaataaaaatattattaactggacttcctaatatatacttctatcaagtggaaaggaaattccaggcccatggaaacttggatatgggtaatttgatgacaaataatcttcactaaaggtcatgtacaggtttttatacttcccagctattccatctgtggatgaaagtaacaatgttggccacgtatattttacacctcgaaataaaaaatgtgaatactgctccaaaaacagagtcacgtattccactctccaactacccacatattccttttgcaatagccattagggcatcattttgatatttcattctgatttctgattctctgatttctgattcctaatgaggacagtaggtctggatccaaattctcacagtaaaatcaagcagtaattttctctcatatctattagggaaagaaaaatgatcacagtctgctaagagtcttgattttctttgtaatgcctcacatagtatgataatcagtctccaaagcatcacatgataattacaatgataccattaacatgtcaaggaaattatattatttatggttgtcaaaaattatgaagtagtgtatgattataagcagatatggcaaatttgttcagtaaatccatagatgactacattttgagaaatactaagataatactaaaaattatgccttagcataatttgcatgcaaaattgccctctagtgtttttgttttgttttgagacatagtctcgctctgttcgcccaggctggagtgcaggggcacgatctctgctcactgcaagctctgcttcccgggttcacaccattctcctgcctcagcatcctgagtagctgggactacaggcacatgctgtcacacccggctaattttttgtatttagtagagatggggtttcaccacgttagccaggatggtctccatctcctgaccttgtgatccgcccacctcggcctcacaaattgctgggattacaggtgtgagccaccacgcctggccgaaagttagttgttttgaactcattttctcctttttacccctgcctttatcagcttctaccttctggtttcatgctgagttctagttgcctaaagtctccattgaaacactcctgttataattgccataaaatcataaatccactccccctttctcctcctagtcaaaatttgtattcttttcagcaggttggttttaataaaaagtaaattaagttgattatctagtgataatttgtgatagacatgattcataagatagttatctgggggagcaattggatttcagagaaaaaaagtctccacttattattcactcattaaacaagtaactcaaaaaaggatcattgatttaaatgtaaaacataaaagtataaaacttttaggaaaaaccacaggagaaaggcttcaacttaccgaatagctcttaccaaagaatattgataaaagaaaaacttgacagattgacacatcaatattacaagcttttgtttgccaaaggccctgttaaaaggatgaaaaatatagacagagaaaacacatgtaaaccacatatctggcaaaagactcatacctagagtaaagaactctgtaaactcagttaaaaaatatccaattagaaaatgggcaaaaaacatagaaacatttcactacagaggatacac

SEQ ID NO: 76494 - DNA, 1408 bp, Homo sapiens
taaataagcaatttttaaagtatatttaaagaaatgaaacataaggaagtgtataggctgtcaggtatgtggggaagtgaagttcatgtagttttcatgtggagcccatacagattttattatagtcaattttagtgaaatttatcgttggtcagatgaaggtttttttccttcattcagcaaataactaatgactgcctactatgtgctaggtgccgaagatagagagataaataacacttagtcactctaagctgaaattgctcagcatatgaaagtggaggaatatttgtaggtgattttgatgttaaagtatttttttaacatcacctggtagtagaagattgagttatgaagctgtctacctctcacctgtaatagttttagagttggttgctattttggtgtaagtcttttttgctgttcctcttttaactgcaaatctttttgagaccagcactcacatccaaaagggcaattgtgataaaaaagaagacagtattttaaggattctgatcagaaccagattcttttcttttcttttttttttttttttttttttttttgagacggagtcttgctctgtcgcctaggctggagtgcagtggcacgatctcagctcactgcaatctctgccgcccgggttcaagcgattctcctgcctcagcctccccagtagttgggattacaggtgtgtgccacaacgcctggctaatttttgtatttttagtagacacggggtttcagcatcttggccaggctggtcttgaattcctgacctcgtgatccacccatctcggcctcccaaagtgcagaaccagattcttaactgccacagactcttgtattatgtaatttatatacagaacacaaagcacttgatttgcttaactgatgtacttgatgatactataaaacctatattatgagaaagcattgctccttcaaaggaatcaagtgatagcaaacactcggtcctgtttccaggttttcctcactgttcattttgcctttgttcttgcagggggagaatgaaaggggcgagagctaaagtgtgttgtcaatgcaagtcaatccttaaccaacaataatttacaaaagaactttatatttgctgtaatcattaaatttagttactaatcccaggaaaagggttagtccttcctcctagtttgtagatttgcaaatggagatgaataattgaatcctattttaatcttttatctgcagtaatctgggcttcttattaccggatatatttgcattttacctccaggccatgttagttcttagaagattattttcctcatgaaccctgttttgttttgcttcctttctgcttcaattctaatgtcacattgcatacctggatgtaaacagcagtcagtttctcagatcaaatagagcc

SEQ ID NO: 76495 - DNA, 1417 bp, Homo sapiens
ctcacagcctagttaagagaattcataaacaggtgagaagttaaaagtatatcagcaggctaagtattgaaaacaatattaaaggggtaccatgcaaaacacgatgcagcaacaaagaagatatgcaggtaatcatcacattttcttttagaaattcagggaaaaaaagatgtcacataatggcatcaggctcaattggaaagggaaggcttttgaaaataagaggtccggtaagaccttgcctctgggtcactactggtatagggagaaacttgctttaaacagtcctgacataaagtgccttttgacatcaactattcaatacctttgagactcacttagacaactggactcattgtaggttccacagaaaaacacggacaacattctagttgtcactccaaccagccacactaggagggcacagcctctggtaccctttctgttcctgaaggcatgtacagcggcttctacagcaagcttgcttacctcccaggattcacctcatggtttggacactgattcctgagagagccttgagacacacaaagtgaaaaaaatgtcaagcaggaatgaaagctctagttttttgcttgttggtatatgtaaatttgtttaaaaagtatccattctgtcgttggtagaagttttgctttggttgataatagagattctgatgtactcttataacttaggttttctcagaaattaagtagcattgaagatcaatgtaatacagttttaagcaggtacactaattatattattgattctatagaaaactaaaattatagatgaggtatcaggatccattataggttgtaaaaaaattcatgttcttcatagattgagtctaatatttcttctatagattgcatctaatgttcctactacctaaattattacgttcaaagttttgaaaattgaacgaaggtatttttaagtacttaaaacatttctctatcattctgtattacatgtataattataagatattgtttgcttcaactagctgtactttgttttcctgtgaagtttcaacttatgtgttatcgatttaacttaattgttccatctagccatgtataatggaaaaaggaagttaatatttgttattgtgttctatgccagggactgtaccaaactctgattggtacattatttcatgtctcataactctgggatctaagtattgtcacaaagagactaaaaatgagagaaaaaattacttgactaggattatgtaggtggtaataatagaatcaggatttaaactcaggacttcagatgccagcatcaatgatattctctcactggaagtggttctcaaagcaaggtcctgacaaaagcatcagcgttactggggaacttgttagaaaagcaagttcataggctgggcatggtggctcatgcctgt

SEQ ID NO: 76496 - DNA, 2633 bp, Homo sapiens
aagatcataggttttatctcatgtcttcattttcctgatacgatacacaaatagcaaggtagaggcagtacagaaacagaaattacctgacttgccctcacgggtccctttaggtcagcaaggttaaatgcctccccattagacctattttctttccaaagatcctgtgacactgatgcatcagctcaggacaaagagaggactccttctgctaggtattgctgggggttacagttttgggtggtctagagtctacaaacccaggtgatgtatcaacctgggcgtttcagttgcaaacacacattagtcactagagttaacatttttctttcccttccagttacaggtgcagaatggacctataggacatcgaggtgaaggggacccaagtggtattcccatatttatggtgctggtgccagtgtttgccctcaccatggtagcagcctgggctttcatgagataccggcaacaactttgaaaaacttgctctctttcaatactcccaatgaagatacatttcactcaccctccacccctgctattctgccatgtctttccctctctctgcatagccagatttgaagtgactgatacccaccccaaaccttgctgttcacagtctccaattcttcatattctaatgggaaagtaaaggtattgtttgaaggaaaactgaagaaaagacttggcttagaacaaatgaggagttatatattttactaggacttttgatagaaattcagctacaacccaaagagagaaagattgagtcttcctgtcaccataggcaataccttttttcttagctggcatgccataaaggccagctatgtgatattagaggaagaaaggatttttctttttaatgatcttccttgggaaattattgtggcctttatttaatttctaactacgtacctgggtgcctatatcgacaaagagtgagaagagcatttttacttttttaaaaaagcaaatacatatatacacatacgtatgcaaatattatagtataatagtgatccctatggagaattaaaggtgagaaagctactttgtggtgtctaggtttctgataaaagggatgatcttaactgaagaatttaaagagatacttaaacagagcaaatgtagtaggaacaagggagtgagccttataagaggacgttcagtctcatttattaaaataataactgagactgggagaggtggctcatgcctgtaaatcccagcactttggtagcctgaagtgggagattgcttgagtccaggagaccagcctgggcaacatagcaaaacctcatctctatttaaaaaaaaaatagaaaaaaatgtaataactgaagcaactaattaaaaatcttagaagaacaatatttattcttataacagccaactatggtgagttattataaggtaaattgccataatccagcgctgctcacatctaaaaaactttgaggtgtaaaggtaaatcgtaccaatctctgggctgccctagtgacttttttgatacctcagagtcctattgaagaaccaggtggaatgattgtggtaagggctatagtgctggagccaaacaccccagcaagaaaactctaaaaggacaaaagataaggtagtgcctccaaggtggcacctgaaccctctcaggctactttttggtttctactaacaaacctgagggaaggaactgcctccctggcaggatgggcatcaaatcaactctggcttcagatttagttaaaatgaggccgggtgcagcggctcacacctgtcatctcagcactttgggaggccgaggcaggcagatcacaaggtcaggagttcaagaccagcctggccaacatggtgaaaccccatgtctactgaaaatacaaaaattacctggacatggtggcgcgttcctgtaattccagctactcaggaggctgaggcaggagaactgtttgaaccaggacctgggagacggaggttgcagtgagccaagatcacgccactgcactccagcctgggctacagagcaagactccatctcaaaaaaagaaaggcatggattgctagtatttttgaaaggctttatacactacatacggcttttaataaacctttttgcagcaagagggaggaaaagagttttgtttgctttaggaggtagggaaatgtggtaggtgtttcatgcggcctaggaggaggatatgaatgaatggatactatggaatgccagtgatctcgataaggtgggaaccatcctgttcatgttcttttaaggctggttttaagcactatgggtagctgaattttctggctttaagaaaatcatttccattagccaaatatattggccatactataggccttttataattttgttagcaagattatcaggactcaggcaatcaactgtatttcatttctagcttggacagtctggtaattaaatgttgattggacatcagctttgtcaagacacttttacaaagaagtacagtgcatatcctccatcccatagggcttttgggttccaactgcgaagacaacactcttattggccacataggtaggacagtgtaagtaggggtcatgtttatattacagacagcaaaagagaaaagttactgagaactggg

SEQ ID NO: 76497 - DNA, 1566 bp, Homo sapiens
cagctggcaatgccagggcttaggaatataaaggttagggtggtaacctggaagaccatgctatctttaaggaagcaggttaacactcatggaagaaatgctaatacggtaacagattcccaagtgtcaaaacgagacaggcatagaagctaagaggaaggagagaccactttttattttacataggttctcttcagatggcctgtggaacttcagttctaggaaaacatagttttgaaaatgaaaaaagttctaagttctgagctctaagtaactttgcccatactcctagtccttgcaatttgctctgaaggagtttgttatttaaagtttggccatttgaaaataaattgttgacttctaatagccttcttcctttcttactactctttggtgttttgacaggtaaatggccaagacctaaagaacctgctgcaccaggatgctgtagacctctttcgtaatgcaggctatgctgtgtctctgagagtgcagcacagggtaggtatcactttgagccagaaacctggcaccaggcttttgcactgtacttctgaataagcccaatgtgtgtaatcttcagtgttgctttttgttttaccctcactcccctgaagagtttctcaggcaaagggaggggtccattggtacttctgcttatcattgaaggacattcaggccaggcacggtggctcacacctgtaatcccaacactttgggaggccaaggtgggcggatcacttcaggccaggagttcgagaccagcctggccaacatagcaaaacctcatctctactaaaaatacaaaaaattcaggcacggtggtgcacacctgtagtctcagctacttgggatgctaaggtgggaggattgcttgagcccaggaggtagaggttgcagtgagccaagatcataccactatactccagcctgggcaagagagtgagaccctgtctcaaaaaaaaaaaaaagaaaaaaagagaaaaaaaagagaaattcacaacagtatggcttataaccaaggtccttgcttcaagataatatgccttaaagataaagcttgacaaccaaattaaaacagatgattaaagaaaagccaggtgtggtgactcacatctgtactcttagcactttgggaggccaaggtggtatgattgcttgagcccgggagttcaagaccagcctgggcaacatagagagacctcatctcttaaaaaaataataataaaaataaataaaaaattttaagagtgacatggaccaatggaaaataaataaattaattaattaaaaagatggtaaaaaaacgtagccaattttactttttggtagggaaggaaccatatgtctaccgctgaaaacttatttataaaaccattggataaaacactacaaagatggtgggttttctggtacccactatatgcttttccctgtcactgccatgaacccttcatttatcaacttggtgaccctcttaaccaaatctttagtgttcataggagaactccaggaaaaaggaaatggaattcagaattcagtcaaggcagcacctatccctgcatc

SEQ ID NO: 76498 - DNA, 1035 bp, Homo sapiens
gcccagctaattttttatatttttagtatagacagggtttcaccatgttggctaggctggtctcgaactcctgacctcatgattcgcccacctcagcctcccaaagtgctgggattacaggcgtgagccaccgggcccggcctaagatctttttttaaccttttgaatcatagcacagtgcttaataatgtttaagaaatgaacaagttaagaaattcaggcaaacctaaaaaggttgactgataaatatgggcccacagacctcaggtcttaaaataaattagaacaagcatacagtcaaaactattaaaatgcaaaatataactctggccctattgttcatttctctaccttaccatgggccacagtaatcctatgatactatcagtttgctgggggataagggagtatagttggagataattattctgtagaatttctttttttattaatcttcaggactagtgaaaaatggccagcttattacttgtatggaaacagtgcagatgattggtataaagaatggaaaaatgctgagggggtgagatattatctagaatattcttgggagagctggcttcaaagggctagacttaaataaaaggaaattgaaataggatagggcttcggagccctatcctctccagatgggccataagcccatggtccgaagaggagaaaactattccctgttttcttttagaactgaatagggcaagatggccacgttgggaaaacgttgaaataaatgaatgaagtacagacaggagaagtcttgattggcagaattaagtattggtctcagatacatgattttgaacctacctctataatgagttagcttcatcccttaaaaattttttgctatatagtttcatttgaattttccctttcacattacttctcatgcagttcaggtgattagtgattaaaggtcatatgtgtgaaatctcttgctcttcttagttgtcagcttattgaacacctctctgccatgaagcccatttggtagcagaacctgaaggcagagataca

SEQ ID NO: 76499 - DNA, 1035 bp, Homo sapiens; identical to SEQ ID NO: 76498

SEQ ID NO: 76500 - DNA, 1035 bp, Homo sapiens; identical to SEQ ID NO: 76498

SEQ ID NO: 76501 - DNA, 1035 bp, Homo sapiens; identical to SEQ ID NO: 76498

SEQ ID NO: 76502 - DNA, 1035 bp, Homo sapiens; identical to SEQ ID NO: 76498

SEQ ID NO: 76503 - DNA, 1536 bp, Homo sapiens
gtgtgctttggctacataaaatgtgagatttttgtctctctttgcaatctcattagtggattgcctgtaacacccattccggtctggttcgatgcttacagaataatacaccttttttttcttttctacatttgtggagattttctaggatggcaggagatttttttaaaattttttttctcgacaatatcaatttatttaggtcccttacttttactagccacccccttcccacttgcttccaatggcaaattagaatggtaacttgccccttgctcacctcatgcttggctttgggaaccggtgagaaactgcaatccattggcggtaggaaccacgattcccagcattcccagtgctccgagtccttcgggcttccttttccgggtctcgaggctgctgaaaccgaaaccgctgtgctgtgggcgcagcgccgagattgattcaccttcacctgtgctgcactccagctgacccaagtaggaagccagacgagctgtaaaacatgaacggaagagtggattatttggtcactgaggaagagatcaatcttaccagagggccctcaggtatgtgcggaaagggtcatatctgacagtaggggattagagggtgtaattgcagacacctctgctgctgagccggattcacctggcctcggggcgggcaggccacaacctagaggtttcgtgcaacgcttcggggtgcttagagaaaatatattgaaatccatcattagccagatacgggtctgaggaatccacctcaaaatccagttggatgaacacaaatatatatagtcaagaaggggttctttgtgcaaatcgtgctagaaaagcctttttaaaagcctgcttttttagcctgcttatcgtggataccacatccttctttccgttgcctgttctatccctccccctatgagggaccgtttagtaaaatgggagcataaacggtgtggactctgaatgcatagccgttttcctgcagctaggatccctccctcgctcctttgatttctgggaacttcatttacaatgtcaactagaatgttaaagcaggaagagcccttagaaatcttttattacacaggttcccaaacttggttccgccacaaaattacccagggctttaaaaaaaaaaaaaaaaaagaaaataaaaagttaaatcttatctcccatctgcagggatttggatttaatacagatttattttatttatttatttattttttatgaacacctcatgtgattttgagcagccaaactgctatcctcttcccccactgtggctcttcattaaaccgggctcttgacattactacattctgcctgctttcgactttgtttactttcctttacaactatttagttgatcaattaagagctctttagctttggaattacagtatctgggtctaaatcttgtatctaacctcttactgattcttgatacttattggctaacttaactgatgtaagccttagtttatcatctctaaaatggggatggttataaatatacttcatagtgttg

SEQ ID NO: 76504 - DNA, 1035 bp, Homo sapiens
aggactttgctgccataagtgtaaatatgctgcccctggagtggtttgcagagacttgggtggtatatgtgatctaccggaatactgtgatgggaaaaaggaagagtgtccaaatgacatctacatccaggatggaaccccatgttcagcagtatctgtttgtataagaggaaactgcagtgaccgtgatatgcagtgtcaagccctttttggctaccaagtgaaagacggttccccagcgtgctatcgaaaattgaataggattggtaaccgatttggaaactgtggggttattctacggcgagggggaagtagaccttttccatgtgaagaagatgatgttttttgtggaatgttgcactgtagcggtgtcagccacattcccggtggaggtgagcacactacattttgtaatatattagtacacgacataaaagaagaaaaatgctttggctatgaagcacaccaggggacagacttgccagaaatggggctggtagtggatggtgcaacctgtggcccagggagctactgtcttaaacgcaattgtactttttatcaagacctgcattttgagtgtgatcttaaaacatgcaattacaaaggagtatgtaacaacaaaaaacattgtcattgtctgcatgagtggcaaccaccaacatgtgaactgagaggaaaaggaggtagtatagatagtggccctctacctgacaaacaatatcgtattgcaggcagcatacttgtaaatacaaaccgagcactagttttaatatgtattcgttacatcctttttgtggtttcgcttctctttggtggcttttcacaagcaatacaatgttagggaagagaaaggaaaagagcccacacaatggagtaaattacattgacacttactgggagatataatcaatagtcactctgacaattacatcatcttttagcaattctgatgtcatcttgaaataaaatcacttggcaatttaaaaaggtctgtgtgtttaaatttacttaacatttcatgtctggtcacattct

SEQ ID NO: 76505 - DNA, 1459 bp, Homo sapiens
aatatgacatcaggaagaagaaattttgccaagttgacctgttttcttctttttcctcttcctctccctcccttttttctaaaaaattatagctaaagcctggagaaaagcctgttccaggtatggttcatgtaatattcttattacgcttgaaataaggtcaaacagcttgtaaatcaatcacaagtatagcatgtgaaatgagctgtggtcattttgtccttctagagctggggctgggtctcattggaagaagaattgtcttgggtcacacataaaataacactaatgatggctgatgagctgaaaaaaaaaaaaaagtctcataatgttttaaggaagtttacagatttgtgttgggccacattcaaagccatcctgggcctcatgctgcccgtgggcggtgggttgaacagtcttgttctagagtctcccattgtagttttttactcttaatctttgagagctgctgaactgtcagcaggtggtgccattgtggtagtgattgtggtagtgaaaagatgaattgggagggaaaaagtaggtattgaggaggtgtgaggaagccactgtgattcgaggtttcttcatcaaatctgtatttttacacaatgatgttttctgttacattattgaaaacaggtattgaaccatcatggtactgggttagaataattatatatcttgtttttacatactgtcttacttaaatgctatgtagttttgtctagtatcattaatttccttgagttttcaggttgttaggtttgtaactgggttcttgtatacatctgcctggggaaacagctagatctagaacttgagataagcagttaaaaatgaatttgaaaatgtgagccattcatattaaccatttatctcattccccccacccatatctccctcccaaaaaatctacttttgatatctagtggatcaaacaaagaaagaggcagaacctataccagaaactgtaaaacctgaggagaaggagaccacaaagaatgtacaacagacagtgagtgctaaaggcccccctgaaaaacggatgagacttcagtgagtactggacaaaagagaagcctggaagactcctcatgctagttatcatacctcagtactgtggctcttgagctttgaagtactttattgtaaccttcttatttgtatggaatgcgcttattttttgaaaggatattaggccggatgtggtggctcacgcctgtaatcccagcactttgggaggccatggcgggtggatcacttgaggtcagaagttcaagaccagcctgaccaatatggtgaaaccccgtctctactaaaaatacaaaaattagccgggcgtggtggcgggcgcccatagtcccagctactcgggaggctgagacaggagacttgcttgaacccgggaggtggaggttgccctgagctgattatcatgctgttgcactccagcttg

SEQ ID NO: 76506 - DNA, 1377 bp, Homo sapiens
actaatactgatgtgatgagagtttcagtccttggagccttttatgaggactgtctttttattgctggttttagaagctgctagaataccataggatattacttcaactaggattatctaaaccaaagccacctgattaaatttgctccaagaagcactcttgttatatatccccatctcagaccgtgttctactagtctagcaggacttactagaaaagattagacagtgtattatgttgggtaaataatgacattattccaatgtccaaatatagttcagtgtccaatatagtttaaatgtagttcagtgctgacagtagaaaaatcccccttttcaaattttttactctcctcaatgttcctccctatgtttcctctcctattttaaagaaaaacaatttattccctcaaaattactttggacatgttaagtattgatattttcacaagataatgtgatatgtggctttgttgggggttctcatgatgactcccgtatttggggattgctagcaggactcagaggactcagcatgtagttgtactcagctaagatttattgctataatatagcaaggatgtatatagccagatcataagggaaaaggacacagcagagtctggaagaatctatgtgcaggctttcttatactttctccttcccttaagaggttacacagagtgcactcttctctcaacagtgaaaatgcagcaacatatgtgtgatatttctgcccagggagatccattagagacctggtacccaaggtgtgtttttggagttgggggagctcttcatgtaggtatcctctatctagcacataccaaaatttcacaacctctgaagaaagcaggtattcagcctaaattgcattgtttgtacagtctaggcacagtgagccactattaccagggaatggtgggaaccctccaaaaatccaagtttctagacactaaccaagggccaaccttgcaagcaggcctttctaagtatagcagcctcaggccttctgtggtaacctttttattgcacagtggataataatgtgaagctcagttttggtcttgttaagtgtaaagattcccaggacttgcagttggagtaggatagttggcagttgtcagcatgaacctggaacatgtaatatcagaaaattttgtagttagaagtgggaataggtaagaaggcctagggagggcatgtaaatccagaaagattcagcacacagatggaggcattagaagtgaagagactgttttttcttctaagatgatatggaagtaataaggtattttaaatatatatgtgtatatgtatataaagttataataagtttgaaggtagatggtaaggaagttggtggtgttggcatcc

SEQ ID NO: 76507 - DNA, 2254 bp, Homo sapiens
aaccagagcctccggtgcctgtatagacgctggccgtgctgctgactggctgggtgccgcagctgggcgcctggatggagcccagggaccagtagttggagaaggtggagtgagtggtgaaactcatgctgtctggggaggagagtgagaggacaggactcaggctttgctgatgaccacaattaactttttttttcacatcagtccactgagttaattcttttacaaaatgcatggtagatctggtcatatcaaattaatagaggatcagttgaaaatcctcagtgatgcattcaactaaaagccttgcgtgggttatactacctactgaaagcttggtttagaaacaacactgaagagtgtagagtccagatttggttttgaatcaaagagctagacaccttttccagcgatgaccagaaattgaagacattagaatcaaggcaagaccatggataaagtcatactgaagagaagattcaagataggggagccagatgggtgttattctagctacatctctcaattggataccctcattaagacatttatggacaatctttaacttggcattgttttcagagaatgacttgataaagaagttgtgattctggaatccaaaatcagttacaaaatcaaagatctagagtccctgcccagagtaaaagagaaccttagaaccaaggcaaaccagcgacaagacaagatttccatagtgagaggattcaaggtgtaaaaattacacaagacggcagtagcctcactagcagctatcttattccttaggacccagcactggggcacaaaagcaagctcattgcatttgatatctttacactggaccccccagtctgtcttgctccaaggtcttactcccttaagtaaggttgactgacaacagtattggcatcttttgggaactcgttagaaatgcactatccctactgaataagaatctaattttaacaaggtccccaggtaattcagatgcacattaaaatttgagaagcactgctggagggcaacagtgggcatactttttctgaaaagggccagtgactaaatacttggggtttgtgggcctcgtagtctctgtgacaatgctcaattattgccagagcagccatagataatatgtaaatgattggatgtggctgttttctagtacagctttaccaaaacagtaattgctaaaccctgccttatgggaaaatgtcagattttatttctttttatgagaatctgtttagcagtttgtgtccatagctgtatttataaaccttttttcccactgttttagttatcccactagctgattactatatcattgctggagtgatctatcaggcaccagacttgggatcagttataaactctagagtggtaagtgtcttcacattctttaagcactaaagaaaacttttaattagctaccttgcttccagtaatcaaactagagctcctctgccttgtgtaagttgctataaagtattgactattagaatgtcttgaactttggttactgtgagccaagtcggtgctcaaagtatatttcatagtctcaattatatagtaatttaggttctgaaaaataggttctgtctttgcatatgtaatattttgtgagtatttactttggaaagtttggtcgacctaatgataaatttagagtttattttccttttacaagcttactgcagtgcatggtattcagtcagcttttgatgaagctatgtcatactgtcgatatcatccttccaaagggtattggtggcacttcaaagatcatgaagagcaaggtaagtagaacatccataccctcctaaaacactttttgatcctctgagaatgaagctgttttctttaggaaaatggctgttgatcttttctaagtgtgtttcactttttcatgggatgatggctttgttgcagctgagattcatgtaactagatgtggtaataatagctttcacataggaacagatgcaagttcactctgttagttaactggtagtctttgttaaggtgattcaaggttttaaaatatttggggccaggtgtggtggctcactcctgtaatcccagcactttggaatgccaaggcaggtggatcacctgagcctaggagttcaagatcagcttgggcaacatagtgaaacctggtctctacaaaaaaaaaaaaaaaaaaaaaaaaaaaaaaggaacataggagagacagtggtgtggaatgagcagagatgatattccttactta

SEQ ID NO: 76508 - DNA, 1052 bp, Homo sapiens
tggcaaagactctaaaataagagtgtgtttggtgtgttaaaggaacagcaaggaggtcagtgtggctggagggtagtgagagaggatgtgggaaggagatgaagtcagaaaggtgttgaaagctatgataaggtctttggcttttcctctgagtaaaacgcagagccattggaggggtttccatcagaggaatgatgtgatctgacttttttttaggactacattggctgctgggaacagtgtaggagggcaagggtagaattaggaaaaccagttaggaggccatttctgaaaatgttatttcctggcctgttgtgtatttggttattgcatgatccagttatgatgaactatctaaatggtctatactaattatttggttattaacgcacttcatctgtctcctcctttattttatagcacacaaagtacattttacctttatataatttttctcggttgagtcacttggctcaaaactgcctgtcaccttgaattaggtctgacttctttgaagatgcctgaggtaatgacagtataagagagattgaagtttttcaaccagtattgtataggcattttgatgttcatgatttacacctagtggtgttcagtacagtcagtggtatgaagcatcatgaaagccaatagccaatacaagctcatttattaaaagtatctagctctatcatgtctttttaaaagctatgatttaattctacgctaaatatgaaaccgtgtggctgtagttaagggaactctacttcctgtttatcccttagcttttacatcattatcatctcatctacaataatagcttcctaacttctctatccctaattgagagatctcaaactggtagctatagatgtgttctcttgggcatacatgttatttgaaaattttgaattccttgccagcattaaggatttccaataaaaaaaaaagtcctttctaaattttaaatcttatcacttcttcacctaatgaaattattctctaaagatataatatactttatatttttacacctctgtatatacattctctct

SEQ ID NO: 76509 - DNA, 1052 bp, Homo sapiens
actattctttatgatgtgtggtgccagttttaaatgaacttataggaacactttacttatatgaggaattataaaaattatacaatttatacttctgtagctcatacatgcatatgtatttattcttactagaacagtggaaatgctgcaccaaataaactaaactatttttatttcacttttttatatgtgtactttatatgcatacttcatatgtgcactttccaccaggctttcagatgagccaggaaaggaaaagggaatacacgtgaccctaccctttccttctgtgtcatcattttcagcatgagtggttggctaatatgggaaagcaacataggtaggaaaggatatgatagggttcctagattatttgtgtttctgagaacatttttttttgtccatgtttgaagccatttctagtttgaatggaaagaatggccctttgggactggcagcatattcatttagttatgggcataattaagtcttgatgaactctcacgcatcatggggctcctagaattctttgctcctggggcattgtgaatgctatatgcaaatggggcagcagagagtggtattgtgcccatctcctctgtccctgctcatgctgtgttgtcccatcagacttcacttaaacaaaacacaagtttaaagataaagtgactaagaatttcaagaaggcaatagcagagtattaaatgaagtacaggttccttctgagtgtggggctctatgcaacagcacaagttgcccacccttgaagccagccctcaatgggacaccagaagatggctggatggatacatctgaggtggacaaaattggatacagactctaaggcagagtctaagaacaaagggtattcaacagatgttggtgtaaagatggatgagttacaaatttaaaaactcagtggtgaaaaggaggtcaggggctagagacaagcagtaaccttgcaatcagaggatgaattcctagggtaaggattggtcaaaagaagggaaaagaatataggcctcatgtcaagatgctcagccaagatcttg

SEQ ID NO: 76510 - DNA, 1090 bp, Homo sapiens
gggaggagacaaagagctggggtgcaacaggaggaaaaatgaggagccagaagaagtggggagaaagggacagaatccaggacggggctctctgccaggggatgcctggaagtccccggtcaggcgtgggcgcagctctggagctgcttcctggttacatggcttctttttctctctgggagcatcggctgagtttcatctccgtcagctggatataccgaatcacgttggtgtctgtgaggagagaaataaaccttagggaacaccaggtgagggcaactatcacatttacaaggaattagcaaaggctgtgtctgcagacatccaacaggccaggctcactcaaccaaggtcccttctgcctatccatggtggctgagagggcaactagatgtcgaccctctccttcactgtctccccttagcaaatgtggacaggttggcatgacccaggggatgtgagagagaatgggtgggagaggagagagaatttctctccctctttctatgcagcagcgtatcccagtggtttcccagccggcgcagttagtttagtgagaccccagttggagtttaacatcaggcaagttgccaacttctctgagcctcctgtaccatctgcaagaaacaacctctatttttttttgtttgtttgttttttgagatggagccttgtcctgttcgcccaggctggagtgtagtggtgcaatcttggtttgctgcaaactccacctctcaagttcaagcaattctcctgcctcagtagctgggattacagacacatcccactgcgcccagctaattcttgtatttttagtagagacggggtttcatcatattggccaggctcgtttcaaactcctgactttaggtgatctgcccaccttggcctcccaaagtgctgggatcagaggcgtgagtgagccaccgcgcccagccaacaagctccatttttgaatgccaaccttgtgccaggtttctaaccttcatgatctcatttaatcctcaatacaatcccgcaaggtatgtatccttctcctcactgtgacaaaatggaatagggacctagcgagattgagtcagatgccaag

SEQ ID NO: 76511 - DNA, 1041 bp, Homo sapiens
cccacccagcaggcagctgtgaccgcagaagggcaggatgaagtgggccaaggtttgggacaggttgactgtgtaggtgacagggagggaaagatgatggccaggggaaagagcatcgtataggctaggggattgaactgtggactgattcagtgtaaataaaaacaaattaacaggtagtagttcctgtcagttctgttggaagcagcccactccctcacttttactccttcctccaaccctcaatcagagctacttacagccaggcaggatggggctttccccaaagcaattggccgtttgtccagtggcagacaatggtggctacagcctttgtgcttttaagagtgggctgggattgtggagactgcccaggggcttggctttgtcagaacttgtacaatcttcttttgatgaaattatctgaactcaacatctagcacatagaatgtgttcaacaaatgcttgttgaatgaataaattatgactgcagactggctctcctgccttaaactaatttcatcccagcctagtctcctgatgtctgtgctcgttatgctatgccatgttgcttcagtcaaacaagaaacacttactgagggcatattgtttgcccatcattgtgcaatatgctgtgggacatgggatgtcgtctcagtcttcaaggaaatggaagggttaagaaatgcatatgagattattaccaatgacaccgttaatttatatgatgctttaaaattatcagagcactttcatgtatttttcgtgtgactagtgaaaaagacaatgttgtacaaaattaaaatatatacagatgcaataatgtgaatagttaggatttattaaatgcattatcttcagatctttacatgtataatctcatttctttcatgcagttactctgggatactgttcccatttgatgggtaagaatattgaaaaccagaaaaattaattatcccaaggttgcatggcctttagtggcatagctaggatttgaaccaggcctgcctgactccagagctctggctagtatctatg

SEQ ID NO: 76512 - DNA, 1051 bp, Homo sapiens
tgctcttggcaggtgctaacttcatggaagatggtaataggaacagatactgctctctgcccctgcttcttggattcttcagctcctaccgctgattcggattatccccttttgaccctcttggggatccagactgctgccaggaggctgagtagatacctcagttatctgtatgttatttctgagaggctttggcggatcctcttcacttggcatcctgtggcatccctagggtctggtggtagcagtaatagcaacaatgatatcttacatctggacaactcagaatagtgctaacttttcctcctgacctttgcaaaatgacatcattttccttgtacatttgatacccttgctagtagagaaggggaaatgcttaaagatgaaaattcaagtgaagagaaatgaaaaagtggcttggactaattgctgagtgaggccactgggctcagaactgaacaggttggctgcattccccattctgcttttgctgtgtggccataggcttgtctctttagcccctctcagatttccttcctttaaaagcaatcatcacatgctttcctctcaagggagttgggtgtatgtatcagagaaggtcagtgaaacaccatagctccttgccagctcctagaggaagcttctttcatctatacaggatgaatcgctgaagttgagagtgtggctctcatcacctttgccttgagggaacttgccttttctttcgtcctttggcttctggaagaggagtgatttggaggtggttgagcatgactaatgggggccctggtcgggcccatgcccttctgccgcatttatatagcatctggtgttgacaagcattctttcctaattcccccacttaacttgtctgatgctgtctgccaatgtcatcctcaccacttgtgtcttacagagaaggaaatgggagagggaggttgtgtcttacagagaaggaaatgagagagggaggttggtagcaacatcagagtgacagttggctgtctctcatttcttggggtcatcagtctgatttgtttagagcctggga

SEQ ID NO: 76513 - DNA, 2329 bp, Homo sapiens
agccctgctcccgttccaggcagggccgctgcccccgactgagcggacgctcctggacctggatgcagaggggcagagtcaggacagcaccgtgccgctgtgcagagcggaactgaacacacacaggcctgccccttatgagatccagcaggagttctggtcttagcacgaaaaggattggggcgggcaagggggacagccagcggagatgaggggagctggcgggcacagccctttctcagggttggaccccctgagatccagccctacttcttgcactgataatgcactttgaagatggaagggatggaaacagggccacttcagagggtctcctgccctgcagggcctttctacccgtgtccactggaggggctgtggccatcagctctggctgtgtaggggaggaaggggtgcatgcatgtcccccaccctccacagtcttccttgcctttagagtgaccctgcagagtcactcagccaaatctgtctgctgctccctctcctcagccagttgggtgtgcgcagagctgtcatagggtccctttgtcagccccgagttcagcttcccaaacaccagtgttggatattctgtgattgattttggtcctcctccgctgtcccccaacacccaggaatgggaatctggcttggttcgagataggagcttttctgtgtcctaagccctttcatgctagcaggaagactgaaagcaaggtggcccagtgtggggtcatagggcttgatagacctggcactgcctatctgcacttccaggtgccccacctatttatctgagcccacaggtggaaaggggaactgcctcagtgagaacggggggacggggatgttaggaaaaatacagtaaagttgcaatgaagaggttcatgaagtatgtccttgttctttttggaaactctcggcaaagggcaaaccagcaagtattgagggtacccatctagctacttggggtcaggacctcgtcagaccaggttcggatacaatcatctgctcatcccaggaatagtttcttgggggactcactcactggtgccagttctaagtcagagacaaaattccactgtctgttccttttgctgtctgaactttatgtgttactcccttcctttggtcttcactctaatccctggagtttgtgggcttttggttatgtttggttagtagatatcaccgcaatgccctagaacagctatgaagcagaataccatatggccacctggacattgggacttgggaattcactctcaactgggccatccatgttgtgatgcccttgaagtaaaatggagccagcaggagtaccttctgtaaatgcatgtggcaaagtgctatttatagggtgcccagggagccgctgatgtacaataaccttgaggtcccccatactgaaaactgaccaaggcctgtgcacaggtagcccctcatgctgggctctggaccatgagctgagtaggaaggatagcagaggccaaccctgaccttcctggaagttgtttccttaacttgaatgttgagcttcctctaaagctttctcgtgtatgtcttctccatgccactactctgaggcctcctgtgttatgtgtgaacagttgtctttatgtgggaatgacgacttgattgggagtagagtctcaaggtcattcccctcttccctcaagactctctgaatgctgctccactgtcttttgtcttggaggtcactcagcaggttccttgcatttgctgcctggatgtgcagctggcaacagtgatgaattggtcactgctctttctctataactgggatagatgtcctgccttggggtcactaaaggggtgaccttgttccttgctttatgagcccattagcactttggttcaaggggcccaccaagtcttggacgggaaggcgctactggttttattgcccaaggttttgttattgcttctcttctgtgtccttctctttgttcagtgaagccaatatgtaagatactgtttttgtccccattcccctactcctgagctaggaggaaaaaatgtgaatcttaccagcagttccagccaaccaagtgattcttcttcattcttgatggggagaagtacatacaaagtttgttctgacagggcgcggtggctcacgcctgtaatcccagcgctttgggaggcagaggcaggtggatcacctgaggtcgggagttcgagaccagcctgaccaacatggagatatcctgtctctactaaaaatacaaaaaaattagccaggcatggtggcacgtgcctgtaatcccagctactcgcaaggctgaggcaggagaatcgcttgaac

SEQ ID NO: 76514 - DNA, 1260 bp, Homo sapiens
cctcccttttactgtcctctagggaaaagaccagtgcttctaggcctctggttcccccctcctacaaagtggttggcagggtgcccaggctgtatcctcggagagttaccggctttccatatgggctgatgacagggatttgaaagcgagctcctgtcctctgtctctccacccccagacagaccaagggctctgcttcagcactgtgcactacccacgtaggtctgtcccacagtgcactgggttggtgcagctttgtgggttggttttgccttttaaaaaggggatggctttgaaagttgcctaagcatgccataaagcttggaaggaaagcctgagaaatgccttatgtggagtagcctggtccacctctgctagctcggctgcccggtgcttgcctggcttcgcaggtctttgcatcaccgtaactgtcatgccatgaatgtgttgtgtccagtgtctgcttcgagtgcttctctcttgagatgggctcaggcaagacccccagccagcagggccatccttattctttctgtctgcttgccagcttgcccactagttctttctacagttccacagcagcatgtgagggggatgggtcatgtcattgcccttttcttccctggagcatgtgcatttctgtttgtgaagcaggtgggcttggtaagagtcattgcctgtatgtactccaaggttctttggtagaatgaagcaggcagggagaaacgtctccatagacccatggagctgagggtcaagtaagaaaggtaaccagttctgacagtttcctcttttcctctgattcagcctcaagtccctggtagatggatataagcagtggtcgtccagtgcccccaacctggtgaagggcccaaggagtagcccggccctgccagggttcaccagccttatggagatgggtaagcatagctcctcttgagagtcttggctgtctccctgctccctgggggcattcttgcccaagcttctaggaccatttaaggacccctagcactgcttcatggaggaaacattgggaatgtttttgttctagaatgttcagtgttctagaaactcatactacacttgtattaaggggccggtattagtcagggttctccagagggagagaaccaatagcaaccaaaaggaagtttattagggagaattgtctcacacagttacaaaggcaaagtcccatgacaggccgtctgcaagctggagaatgagaaaagcctgtagtatggctcccagggaaga

SEQ ID NO: 76515 - DNA, 1076 bp, Homo sapiens
tcattttcttcccaaccctttctttccaagattcctgcatttccacgccttccttaccccttgtcttttttccccccttacctgcctccttatttgctcactacccaatcccacccaacaaaacaggtaaagtcagatctgtttggaactctgatgtctggctggcctaagctctagctttacattggatttgtgaaaattgaagaagtgtttccatgtttagtactttgagagagctaaatgattggtggctgagaactccattactttcctggaagggtccacttgggcacagagtttttgataaggtctaacttccctgcagctccaaatgtgtgtgtgtgtgtggtggtatagaggctagtttgggggagccctgtctgtccattttctagatcctatccaacccttgtgattcacagtgacaccaggtgaaagcagcaaaacctggggcaggagctcagtcgtcccaaaggaggaaggggaggaggaggagaagagggccccaaagaagaagggacggacgtgggggccagggacgcttggtcagaaggagcttgcctcgggagatgaagggtaagtgccagatgacatgaaattctttctctcttgaagatggatgtaccatttaaacataggatatgaaataactttttttctctgtcgtgtgtttgattgctttctgagaaattacaagcttcttgatctttacaacagtttttcaccctccaagttcctggaacgtcctagaacaggcatggaaaactttttccataaagagccagataatacatattttaggccttgtgattcctatggccctgtcacaactcttgagcgccactgttggaacacagaagcctccagagaccatggacaacatgtaaatgagcgagtgtggctatgttccagtaaaaccttataaaagcaagtggcgggcagggtttaacccaccagttatagtttgccaacccctgaaggcgttctactcagagtagcaagtagcccaagcagtaaccaaatgtaaaaagttctgccagggtgttctgcttatacctggctcttcttccattttt

SEQ ID NO: 76516 - DNA, 1038 bp, Homo sapiens
tcatttatttatgggaaactgaagcccagggcataattccccattgtctgttcttgaatcaggtagtaacatggtaaattgtgttgtggtggtgctttgtacaagaaaactctttgggctcgcttttcttatccttaattaacagccagaatggaatgagtacagaactgctgcatttcatttccattttcactctttatggttgtaatggtggacagtttgctttacttcctgagccttatttgaggttacctaaattctgatctctgtttctggaagaagtaagaggtagttttctgggaagtgaggccatgtaatagcctaagtcttacatgtttgcttctgtccattcatgctttctgagtattcacatgttctattcagactgctggaatcctgatccccactcacgaccatctttcacgaatatcctggaccagctaaccaccatagaggagtctggtttctttgaaatgcccaaggactccttccactgcctgcaggacaactggaaacacgagattcaggagatgtttgaccaactcagggccaaagaaaaggtaaacaaaacaaaaaaaacaacaaaaaaacgaacgaaaagaaaaaaggcatgcattgaattggtagacctcactcacagggacctctggaccgagtctgactgaccatcttgattctagcatgcccaccttccagcttggtatctacttaattgtccaaaccagagaagaatgcagttgggcaaaatcccagtgcttggattacaggccttttttcttttctcacagtggaatgtctcaccctgccagctggaaatatgagaagttctggaaatgtttcttgattctacaatagacttctagaagaaggttaatttgatatagggatacttcaaccttgaggatagttatcagaacatccttcccatgtcttttgacatcagaatcagaaatagaatatgggcaaaaaataacatgggtctgaaattgtgtggcatttttcatgtttttatgaaaagtatttcaagcccaaaccaac

SEQ ID NO: 76517 - DNA, 1030 bp, Homo sapiens
gagaggtgaacttgcttcctaaaggcacatagctgttaagtgataaaacaggcatttgacccaagtctgtctaaatctttctctggtagcattctgcctacttgggcagtagttctcacattccttttagctgtagaacccctgaagtgggatagaatgcagacaaacaaagaaacaagccaggtaagagcagagctgccctgactggagctaatggggccagtcccagtcccataaccccccacccctgcctcacccccgacatgcttccaggcggtctgagacaccttcacaggacactgagagcttagtgtgaaaactgtcacagaagggatgcagggacacaaacagaacatatttggatctttgaaacactctatgatctttccaggtagttagggcccagataccgtctgtctttgtctggttgggagaaaggggttctgtgggacctttggtttttattctccaggatggaggtgggcatttattccaagagcaagcaatggaggataacagtggctttgacctaggaatctggttggcaatgctgagagttcctggaggtcacttggtagaagctccccagcatgaccactacctggataagtcacatgaaaggtttgtcaggaagtgtaatagtgcaattcttgatgatgtttgggttttcctctagaggacccagggcagcctgcaggactgtctgaccatgcgctcactcccatacccacagacccactcactcacatatctatgagtgcttcctgtgtaccagagcttgggctaggtcctgagaatgcaaagattaaaaacatttctccctgctctttaggagcctataggctagcagacaaacagctacaatacatggcagcccaaatgggctgagtaacatctggggatgtcaagaaggcatcgtaaagtatccaatgctattcccataagcctccaaactaaaatccatctcctgtctagacgagtcaagaccaactggctaccaggctttttgttttttcctggcaagatgcat

SEQ ID NO: 76518 - DNA, 1016 bp, Homo sapiens
aatcataccatttgtggtcttttgtgactaggcttctttcatttagcataatgttttcaagattcatccatgttgtaatacaaaattagctaggcgtggtggcgcatgcctgtaatcccagctactcgggagactgaggcaggagaatcgcttgaacccaggaggcagaggttgcagtgagccaggattgtgccattgcactccagcctgggaaacgagtgaaactccgtctcaaaaaaaaaaaaaagattcatccatgttgtaacttatctcagaatttcattcctttttaaggcttaataatattccattgtatggatagaccacatttgtttatccatttatcagttgatgggcatttgggttgtttttgctttttggctgttataaataatgctgctatggacacttgtgtacaacacaagcttttgtgtaaacatatttttttcagttttcttgggtctatccctaggagtggaattgctgaatcatgtaacagttctatgtttaactttttgaggaaccaccaaactttttcatcatagctataccattttattatattcccgttagcaatgtatgaatgttccaatttcaccacatcttttcaatacttgttattgcctttttttaaaaaaaaagttattattatgtctatccttgtggatatgaaatagtattttgttgtgattttgatttgcatttcactaaatgacttatgatgttgagtatcttttcatgtaattattggccaattatatctctgaacctgaagaaatatctattcaaatcctttgccaatttaaaaattagagtatttgtctttttattgttgagctgaaagagtcctttctattctctcatcagatatatgattagcaaatttttttttccattctgtagattgtttttccactttcttaaggctgttctttgaaacagtgtttttaattttgatgatgtctagtttattttatcatctgtggattgtgcttttggtgtcatatctaaaaaac

SEQ ID NO: 76519 - DNA, 1080 bp, Homo sapiens
tttgaggacatgattattgagagtcactggcgtgcactaccacacctagctaattttttgtatttttagtagagacgggatttcaccatgttggccaggcaggtgtcaaactcctaatctcaggtgatccacccgtctcggcctccccaaatgctgggattacatgcgtgaaccactgtgcccagccaggaatttatttaattgtgacatgtgtattttagtttcttcatcagtaaaactgagatggcaatagtacctgccttgtaagttgttgtgaggattagagatagtggctataaaatgggtggtacaaaaatggatgcactgtaggtgtttaagaaatgatggctctgaccatcaatccatggcagctaaatgctggagcccacaggagaggccaggaggatggcagaagagttctgttctgtggtttccctgtgattaatgcagactctggtttcttctgtattcttttccttgcctagtattgatcctccagaaggtggagaatggagacctgagcaacaagattctgaagatcactgattttggcctggctcgggaatggcaccgaaccaccaagatgagtgcggcagggacgtatgcttggatggcacccgaagtcatccgggcctccatgttttccaaaggcagtgatgtgtggaggtaaggtccaggggggcagggacagcatttcctaggtccatcttggtggcacacacatttcaagacttggagaattgaggttacctaggatcccaggcacctgaagtaggtctaagtgacctcccccaagagtcatctatgccaattcccatattgccaggggacagtttctaatgctttcatctaccaaaaaaatccctgaagtgctatacgcaggccactttttgctggtgattgctccctaggaaaggccagtagattccaggggcaacatgtactcccatctctacgctgtaagatgggaaggacactcggtccttctcggagagcttcgtgaggatcagtctggcttgctcagcaatgctaggctttcgtggctgttactgctgaacttggggaggggattaacccaat

SEQ ID NO: 76520 - DNA, 2382 bp, Homo sapiens
tgggcattcactgaaggcagagaacacggcatttgagcgttttcccagcagtttctgggtatgcctgttatgcccaccttccaggtagcagggaaggaaggaaaggactggctttcacctggaaactgaggtgtaacatctagagaatttgtatagttttgaattttccctaccatggtgagatcctcaactctgtctcatggggaacaggatttgtagagtaatattcagaggtagactaggaagatgctaggaagtctcatcttccccatgcaatggacatggaggtgggaggaaggaattagaaaagcatccatatcatagactgaaagacagtgagtcagagcaaagctagtcttggcctgaggaggtacttgaggttggttcctccctgctcttacatggagaggttgaaaagtgattcataggaaactttaattggtgtttcatagctttccagggctattaaggacttgtggttcacaatggcaactcccagtgtttcgagcctttgtggttgggacttccttgcctgcaaggtgatgggatgaaggtggtatctgtggtggcttgtaccgcttcctcctctgccctcaaatcctttctcctctgcaatgcctggggtgaagtgcaggtcacagagcctggaatgttttctttttgtatagatcatgattctcaaccgatgtgggtaattttattacccaaatgtcctcataagaaattgacgtgcctgctattgcatacatgctgtaagaaatacggtcaatttattatatacataacatagaggtcacttccactgcattctttccatccttaggagttgtgctatgtaaacacatcctaaacaaccagaacagtgtgatgtagtagggggcagcgtgtcaagatacatgagatggggtctggagaaggcagaattccctgggaggccttgatggaacaattaggcctcaaagaaggggtaggattcaagagttggtaatagggcaggtaggccatagctatgacctcccagggaaggcggcctgccccagctcagacagagccaagtgttcactgatgccatgtcccatcacctgggttctttaggcaattcccagacctggaatgttgactaggaaagccatgctcccaagaagttgagtcttccatgtgaaacagctcctctttctaagtggccagagaacctgggctggtacagttgtgggctggtacagttgtgggctctgaatcaggcagacctggctttgggcaaagtcctcgaccctgagcccatttcctcctctgtaaaatggggataattctagtatttactcatggcattataatgaggattaaatgaagttatgtgtgtaaacccttagcataatgcctggcacaaagtaaatgctcagtaaaaggtagtttttcctttttaaaaaattcaagagcagcagcagatatgagactagactcacagtgtatcacctactgtttccattactatttcttcagaacaaacgaccccaaacaagaacattttattaagctcatggagacttgggtcaggaatttggaaagagctcattagggatggcttgtcaatgtctggggcctcacctgggaagacttgaaggctaggggaggctgcagatggaggcaggaaccatctgaaggttgttcacacacatggctcagtgcctgagctgggagaagctggaggccaggactgctgatgggagtgcccatgtgcagtctgtccatgagcatggctctcttagggctcttggccttacatagtggctcaaggctgcagacccaagtgttccagtgaacatggggaagctgtagcatcttttctgatctagcttagaagtcgggcattgtcatttcttctgcattctgttaaagtgagtctcaagaccactcagcttcaagtggagaggacacagacccacctctcagtgggaaaagtgtcaagatcacactggggaaaagcacagaggatgggagatgatggaccactttgaaaatgcaaccttccatgcctgctaagggaactctgctagcagagcttggggatacaaggccctggagagcctgtgcggcggctgcaccccatggccacctgccaagaaagaactgctttctgttgacaaaaccatcgagcatctgataggcttcctcttttttggttatttttatctggtatgtagctgggtacttcagaggtatgacggagatctggcagctcttctcagtcagtttgagctgatacgatgagaaaattcaggggaggcaggtgtttaaggagatgttctttagtaaggaaagtggctgcacaaaagcctctggctttctgtttcctgctggtgatatctgcgcctggatgaggtg

SEQ ID NO: 76521 - DNA, 1059 bp, Homo sapiens
acaataaataagaggaaggagaaaaggactgtgggtagggaaaatagcgatagattttggattctggtcattcttgactttcttttttgcttatagatatgattagagcttactggaaccttacagttgtgaactagagaagctgagtgacttgcctaaggtcatcctgatgctcatgatagtgttccttcttttagcccgacaatggaacactgttactctgccaggctttccagctaggaccaaagtatttcagacaacagtggaaacaggatctgtaccccattcgaggaaccagggggacaatttccttgtaaggtcccaaggtcaaagtttggggtgaagtcagtgtttttcctggttactaacatgaactcggtctttggtatgttatgtagaaggataacagtgttcagtattcttctaggtggtacaatttttaggaagaaaagaataataaaaacattttttatttcttaagcagtagactcctggctccctgtgcttagagataggaatccccgctgagagatagatgggaatcctggagtggattgttaataatctccctgttattggcacagttgtgtgatagagagttgttttcccctctcccctgccttaggagacctacccttactaagtatttggattaaattaataataaaatagcttgctttgcccaaatgcacagcagctagtgacaaggggagatgccacatcacatcccatggatggcaatggaaaatcaactaaggacgtaaaattttcccacataagcttcagatgacttaagattattagtgtaacctgatattatctgatactctccttggcttattattcatggtgacagtaatacatggccctcatttccttcatcccccaaatagtcctagaggtagtagaaagagtatggtagtcccctcttatctgccatttcactctccctgtttttagttactcatagtcaactgtggtccagaaatattacatggaacattctagaaataacgattcataagttttaaattgcacaccattctgagtagcgcaatg

SEQ ID NO: 76522 - DNA, 1024 bp, Homo sapiens
gccagttttatggctctgctggactctcagttgataattaaaatgcttttgccccaggaggaaggcaatatatttatttccctcccttctctgctgcattagtctgcttttttcacatcttctcctggcctccctatgtcaacttagctttcttgttacacagtgtcatttaagactctggagtattcagggtggattgaagagattttattttgagttttgtggtcttgttttggaaggtaaacggagcatgtctggccctttttcatctctgtataagagctttgtttcctacagctactctctaaatctggttgtgtccagcacttagtaggtccttaagaaatgtttatagttttgataatcacagattctagcactgtgtctttcccatacatacctccttcccgcatagacattctccaaacaacaccacacctcttctcctttagagccctcatttaggatgtgaaccctctcttcttttggggatgagcccatgtgaactgtgggtgaaactggatttgagtcttacctggctctgttacttgctagctaaggaccttgagcaaatgatacaccctctgtggcttagcttttgcagatgtaaagcgggaataatgataataccaccgatctcatcttacggggtagaagtgaggattaaataagatcatctaggtgaagttcttaggagtgcctggcacgtaataagcacccagtatattgaccattttaattataattccatctgctacacttattcccttagtatttagatcacaattggtgattatatttttgggtggtatcttttgtcttgtacttgcattttcattgttttagtcatattctttccagttgtactgtagaatttaaaaaattcaaaatgtagtggatacacatgggtaaaaataggacaaaattgaaatacaaagaaaagtctgtctccagaaaaagagagagaaaaaagaaaagtctctgtccttccctcccaaaccctaagtttacttcttagaggcaa

SEQ ID NO: 76523 - DNA, 1381 bp, Homo sapiens
cagtggtctggttgagtcaggagaaaaatgtagcttctatcccaggtccagggagcccaggtctttactgtggagtccccttcaatacccctgacagcctcttgtagaaccacactttgttcctcttataatgtaaagattaacatagggccagggaaccacgcaaaatggttccatgcaaaatgtggatacattcattttggagggaaaaggtcagggctcttattattgtaagactcagagaaggttatgaatcaatatcattacagataacttaaattgggcatctgtgtaagaggtgttctggtgcagtggaaagaacgtgggccccagggctgtccttgacactgactggccgggtggccttgggcacgtctgtgatctctctggacctcagattcttcatctgcaaaatgaggggtttggacaggtggtctctgaggtcctgcccaggacttaaagcatgaatgtctgtgtatttgggaatgttagtgactacacggtttgtctgcctgtgcatgtcaggctgctatgtgctcaggttccccacttcggggcttgttctggcttgggctgaatctactgaaagggaatctttgctgagtggtttagtggagaaaacagttgacaggagcccacaagtggtccccttcccccactgctgctcagggcatgacagatggccttgctgagagaagatgctctggtcacatgaaccatcctggagattcacaataatccaaggacagccttcctcctagaagcaggacacagttagtcgcctgctactctgtccttggagctaagcaaggggcatcctggtgtctcggagctttgctgctgctttgatttacacttgcttcctgctcacttttttgaaacaacatagggcttttccaggtggggctcaaggtcacttaggcgactttaattgtgtgcctcatatatccccactgacctgcagaataacaggaagaacatgtcccctgtgtgatccactatactgtaagagtgagacatatacattagacatattaaaagctgtgggttgcatgtccctttccctcctaacttccctaaagtttttgctctctataggaaacttgaaggttttgatctgagaagaaaacattttccccttaagattggttttgggaaccaccgtggtctaatggaagaaacaccgccttgggagttagatagacttggatttaagctacttcttgagcacttgacattgggcacgtggccaacctcttggagtcacaggaaatctcatccgtaaaatatgaacaacacagaaatgagcagtactgttttaagatgatatgagctattatgtgtcagtatcacacaggcactgcattcagtaaatggcact

SEQ ID NO: 76524 - DNA, 2064 bp, Homo sapiens
cttttcctgatcaccagccctggctaactcactggcccacgtctccactgtagccagttgccggctgctaggagctgctggagccgaccactgcccggtgctgtcgggtctactcccagtctgttctgtccaacctcagtactccctttgttcccaacttggggactgcctgtcacgctcctcatggtgcctgttccagttttgttgaattgttggattggctgctcctgttggaactggaggtccatgtagcatctccctctccaaattctgttcacttgcaccttgtcctcgtctccaaccttctcttggagttcacaaggtcaggaagctgaagacatgctttcaccagtgtgaggatgatagagattttgtcttcccattggcctcagctcagcaggctctaacattctaagccctggagtatacctggaccacacactagccaaagctcctgactggttttcctgtgtgggatttctcatggctggtgagtttgctggctgccagacctgtggcaccctgggacccactggatcccagtctctagtgtcgtcctgcacgcatggtagagcccattctgcctgatggaggaagcagctaaggctcaggcaccctggtcagggatgatgtggcattagacttgcctcgaaaaaggatgaggagtagctgtaaaagcagttttttcctacaagagaatgaaataggcaggaaaacattcccagagtggacctggaaggcagtgaagtatcatctggaaaacccaagtcttggtcctttttgagaggtaagtaaatgactttttgtatgcttcatggaggcctctccaaatgaaatacttctggcattacctggctcaggtacttctgaatttcactccctgtttttttccttagtcaggtcctttggtggtttttgccacatgttccttcttaacagagagttggaggatgatggatgtgttttgaggattttcccaggcaaaagtgtacaagcgctcagagaattggatttatcttttggttgcaggaggctatgccagaggttagctagcagccacctggcgtgtctcagagcatcctgttcagttgatgggtagcgtttcctatgaatacagagatatgttctgcaagccaaaataaatacgtaagtgaataaagctgaaatgaagcaaataaccagccgggtgaacaggactcagcagaagaaaccattgaggccggagatctgacttgcaagtcctgttgcatctttcagttcttgaacgtggtttgggaaccttgcctttcccttttgtcctgtgcctttgtggccatctcctgcacaaagttggttttcttttatgggccagtctaagtcctggtgttaagaatacagcaggaaacaaaaaagacacaggccctcctctccaggagctccctgtggggtcagggggaaagaccttgatcaaaataaagtggcacaaaatgtaaagtcaagactgtggtgagtaccatgagcatggctgataacgggacatgcctcgagaggagtgctggagaattctctgaggaagttttgtttccgacgtgatctgagagaggcaagagtggagacaaagtggaaagggaaggtggggcaaggaggttccaggcagtgaggccagcaggcccagtgccccgtacagtgtggcctcctgggaggcaaattgcgtgcttggattctcttgcctccatcctttcctgtggttggtggagaaggattcgtaaggggaatggatctctttgtgggccacgtgccttcatttcccagcggttgctctagagttctgcctgcctcttcttcctatttcatcaccgtggaggttctctgcagcttactcagtggggcagcaagtagctcaggacaccaggcaacttttaagctctcataatgctgtgctggagttggagcagaagcttgtgctgtatgaagggccttggttggggtttctggaccatgagcttttagttgcagaaaacagccttggtgaggggttgagttcagggcaagaaaggctttgaaaggcgtgtggggtctgatttc

SEQ ID NO: 76525 - DNA, 1020 bp, Homo sapiens
agctgaattttctttattttactttttctaatatttttatcatgttgagagaagtaggcaaagtactgtaaagttacataattgaacccatttagaaagttgggctaggataacaaagttgtaaaagttaatagtttacttgatgaagttttgaatttgagtataattttaagctcttcatacacgtttttacctcttatgagatttgtatttaggagtggaggctcttatgcaggaaaagttaccctgttaaggttctgctgtttgtaggagagggcaagagacctgagtgtcattctgttattcaggagacaaaactctggtcctttctttttccttatgtgggttttaggattgccaaggggagccatcaggattgcagaagttgtataatacttaaacattcggcagtattttaaaggacattctcaatacagttgctgcccagtaatgtttatggtccattggactgcatggttggcgctgatgttgatgctagttgtaaatcttacatgtgtggtggggtagcactttgacgtttgtctgtgggtggatgtttgccaaggattgtatacgtctaatatgagcctcgatgataccaccattcttactccattgcaatgtgtacatgacttgaaaatgattgtattttatttatttattttttttagagacagggtctcactttgtcacccgggctggagtgcagtggtgtgatctttgcaaccgccgcctcccaggttcaagtaattctcctgcctcggcctcctgagtagctgggattacaggagactgccaccacacctggctaatttttgtatttttagtagaggtggggtttcgccatgttggccagcctggtctcgaactcctgacctcaggtgatccacctgcctcagtctctcaaagttctgggactacaggcgtgagccagtgcaccaagcctttttttaaaaaattttattattattattattattattttaatagagatgggagtcttgctttgtggcccaggct

SEQ ID NO: 76526 - DNA, 1007 bp, Homo sapiens
aacacctcaacttgagatacccatcacagaagggactgtaagaagagaatgctattctttaaactgtgagctgattcaggtggtgatgtccatttggagagcatgacttcctggtaatatcaccaacctcctggtagcccaagggtggtattaattaaatgccataattacctagtgtttaatagcagggaactgagaagtaactctttattaaatatccagaatccataaactggatttaaagcaagtgttaaatattaaatggtgagttggtagaagctccagtccttcacgttggctgactcagcagggctaggaatacgcttcttttctgtggtagtttgtgctctctcttgcctaaactgggtggtaaagaggacacaattgcataatggtatgtacttaaaatcacttggagcatcctgtcccagagaggagggcatttgagttgaaggactttgggtgggggaagcatgggcccccagggacttcactctctttgcatccttcagctttgagcctggaaatccttcagactttgttttgctccaggctgttccagatgtggtttatttttctgttgatactatggtgaatctgtttactttaaaaactacattttaaggccaggcgcggtggctcacgcctgtaatcccagcactttgggaggccaaggcgggcagatcatgaggtcaggagatcgagaccatcctggctaacacggtgaaaccccgtctccactaaaaatacaaaaaattagccggacatggtggcgggagcctgtagtcccagctactcgggaggctgaggcaggagaatggtgtgaacccgggaggtggagcttgcagtgagccgagattgtgcctctgcactccagcctgggtgacagagcgagactccatctcaaaaaaacaaacaaaaaaactacattttaaaattatgtaagtagtggtggggtgcagtggctcatgtctgtaatcccagcactttggggaagctgaggcttg

SEQ ID NO: 76527 - DNA, 2106 bp, Homo sapiens
gagggttcaaatatccaaaccatatcaagtagattttttttccattttatttcaaggatctcttggttacctacaaaatgtttggcatggcaagtgcagtggtgaatagggcagacagaatctctgcccttgtgggtctcataatctggcctggacaataggcattgaacaagtaattaagtaattataatcttgatgcctcttgtggaatggaaactgccatggaagtgtttgataggggcctgacctcatttggtcttggtgatggagaagttccactatgaaactgatatttaagacctgaggtatgagtatgaatcagccaggtaaagacaaaagaaaaaagaagatagagaacagggtttcatgcaagaaacaaaacacactttgctcatatagcacttagcaccacatgtagctcgctttataatcactggcagctattattatctacccatgaaagcctttccacacacaacaaaatatataatcaagtaccttaggttcaaattctggatttgggaaggagaatgattggttgggatactgggtgggatactgggatcatcagggcttgaactgaggcacagatgactgctggagtaagatatctcttatgaggctcctttcccatgtttcagtctccaggtccaggtagaaccaagttctgaaagtctcccaaattgactgcgtactccctatattcactgctgctgaggttcagacctctgagctgcaaggcctccttagggggtccttttgctgttgggtctgtgtcctccaggttagtttccagtggctgccagagttgatttcctttctaaattacaggtctaacaacattccttttctgaaagatacatgactcctcttgtttacaatgtgatgttcaagcccctcagaatggctttaaagacatttcctggcctggttaccctcaacaaggctttgagcctcgtctccaatcctgatgcacatgacctggccacagcagactccctggaggtcctaatataccgtatacttcgtactccatgttcttggctcctgtccttccgtctgcctgattgtccttccctgccctgatttccttcatcgcctgagatctctcccactcactctttagggccaatttcaaatgttgccttccctgagaatcctttccccactcacccccttagtgctctgtgctgctgtgggagctagtgattttcctaagcctctaatcatacttctgcagaagctcttctcatcctatggtttggttgttgggtgtctgccttggcactgagttgggtgcttctcaccactgagtacacagtaaagctgagtaagtctcaaagaaaggatctcggccaggtgcagtggctcatgcctgtaatcccagcactttgggaggccgaggctggaggattgcttgagctcaggcattcaagaccagcctgggcaacatggcaaaaccccatctctatatttaaatgtattttaaaggaagaaagaaaagaaaaaaaaggacctctcccatattccctttagtgacaatagttggttttggtacaggattctgcatgattttccaggtgggattttttttcatgaatgtttatagaatgcctaccatgtggtgactgtcactaaggaaaatgcaaaggaaaataagttgattgcagttcctgcccttatggaatttgctttataatggggagacagaaaggcccagtaaacagacaacttgccgtgtttacccactcaggtaaatgaaaggttaaatacgatgttttcaagatgtttttgacttgcttctttttttcttccctttctcagtgttagaaattgattttgcggagctcaccttggaagagattattggcatcgggggctttgggaaggtctatcgtgctttctggataggggatgaggttgctgtgaaagcagctcgccacgaccctgatgaggacatcagccagaccatagagaatgttcgccaagaggccaagctcttcgccatgctgaagcaccccaacatcattgccctaagaggggtatgtctgaaggagcccaacctctgcttggtcatggagtttgctcgtggaggacctttgaata

SEQ ID NO: 76528 - DNA, 1038 bp, Homo sapiens
gggaaggagagccccacatactctgctgcagctgaaggtctagttccttcgttcctatccacagggactgagcagggaaggaaaaagaaggtccttcctccctcccttctttctgggttctgtcttttatctgcttgaaagttgtgttctatacttttcttggagtcaggtcataatatttgcttaactaaatagcaagaacctgagatttttatgttctactcaaagagaggttattgctttcccttccctgcagaggtttttagaggagctgtcctttcagcaccctagtactgaatcatgtcttttaaacctccctgcatttattttttcaatccctcctgcatttaaatgaatatttaacacctactgtgtgtttacaactatgcttaagactggaggaaagaagggagggtacaagagaaagtacaatagttaaaattcccttaaggagaattcagatactcagttgaggaaataagaaaacagatacaaatttgttaagtaatcacacatcttttcatatgtgtaaaagctgctagaaaaacatgaatgttcctccctccatgaccaggaagactcttaacatgtatttctccaagagagtttctaatctttctttataacataggcatatttttctcattcatatagatgacatcaggcacaagttagtaataagtctggattcattctggggctcagaaactctcaagctattttgagcaagaaagagatttagcacaggaaattctgtgcttgcagaattgttggaagggctgagagaagaggctctcagctggacctatgtgaacaactcccagaacatagcagaactggcccaccaggtcagctgctacttctctaattgggaacatacagaatcaggagctgccattgaagctgttggcttcaaaaacaccctgttgtgtctgcagcccagagattaggcaaccacttggctatgaaacattcctctccacatctacagacttagtgattggacaccaacatgctgatgcaaaaaatccctgcagc

SEQ ID NO: 76529 - DNA, 1048 bp, Homo sapiens
gcagcggcgggcaccggctgcgcgagcaggtaccggcggcagaggtgacgaggccgcccccgggggggcgagcgggcaggcggggactcggcccgctgcgcccctaggctgcgcgaagagctcgcgctcggcgctcttctcgtaccgcggtaacagcgccggcgagccggctctcccagccctgccagcccgggccctacctgcggccgccgtcgttgggggggggtcctcccagctctgcggaggcgcatgaacaataggcggcggcggctcctgcgggcggcggcggccccgcaccctatggatcggccgctccatggagccctccagagcgcttctcggctgcctagcgagcgccgccgctgccgccccgccgggggaggatggagcaggggccggggccgaggaggaggaggaggaggaggaggaggcggcggcggcggtgggccccggggagctgggctgcgacgcgccgctgccctactggacggccgtgttcgagtacgaggcggcgggcgaggacgagctgaccctgcggctgggcgacgtggtggaggtgctgtccaaggactcgcaggtgtccggcgacgagggctggtggaccgggcagctgaaccagcgggtgggcatcttccccagcaactacgtgaccccgcgcagcgccttctccagccgctgccagcccggcggcgaggaccccagttgctacccgcccattcagtgtaaggcgaaggcggggccgggcggggagggggaatgacggaggcctggggggcggtcggggaaggggggagcactgcgcgagggctgggatgagggcggggggtggggaggacgattgacctgggtgtgggtggcgcgcgcttaggctgcccgggctttgcttgctggataagctcgagacgcctcaggccctgcccgcacttcagacgcttgggcttcttcaccttcagttggccacctcagcagtggctcccgatttccacatcctgaagtcccagtctgagaatttgccagtttcccagtcccttctcttacccaccccccc

SEQ ID NO: 76530 - DNA, 1107 bp, Homo sapiens
tgctaggattacaggccttagccacctcacctagtcctctgaaatttctaaataagccagtgctgaaggatctagcccaacttctaccaaactttgttaccttttccccttcagtggtaggaatagacatgatttatttagcaagggtgagtgcttttgttgaattttagtttggggtttattattacacaaactaaagacagcggggcaatttggaaagataactaggcagctgcatgacttcaggcaggtgtcctaacactgtactcttaaagtgaggggagtgaactggaagatatcctgtgtcctcatagtttgaacattctgtggttcgctcatcaatatgactacactgtatagtcatagcacacatttgaggtcttgaagaagagagatgaggcttgttctaaaaagcatccagagtaggtcttgaaaaaggatttctgtttaagtaaagacctaaaacaatgctcagattcctattatacataggatccatgaactggaaaagatatggatgagtctgagtaaattatctaggttttgttttagacaaaaccattccactgtcaagcagcagagagcaagggagtggggatggaggtatattgtgtttttttaaaggccataagaaaataattgtcttgataaaattttaacttaggactgggtatggtggctcgtgcctgaaatctcagcagtttgggaggctgaggcaggaggatcacttgagcccaggaaggagaccagcctgagcaacatggcgagacccctatctctacaaaaaatgttaaaatttgccaggcatggtggtgcaagcctgtagtcccagctgtttgagaggctgaggcaggaagattgcttgaacctaggaggtcaaggctgtagtgaacagtgtttgctataccacattccaatctggtgacaaagcaagaccctgtctcaaaaaaaagaattttttttaacttgagggaaaaaaagttttacaaactgtagacacacagcaaaacagaaacaggaaaaaaagtactaaaaagagaaaaatgtcagtagtgggtctctaagtagtcggattatgagtaattgggtaagtttattgtcattttg

SEQ ID NO: 76531 - DNA, 1067 bp, Homo sapiens
gagcgcgggggaccgtgcggctctgctccgagtgtgtgtgggggtcgtccgggctcgtcctccaggggtcctgggtggtggctgaaaacccggctcggaaccctcctgcctctaaaaaaccgttgttgtgcttcgcagcggttcttctctgttcggccccgtggccggtggccgtggtgcttcctggcctccctggggggagggagcggggagataacggggaatctggctggcatttcagcagatttgtttggcttggttcaaggcctttggcggataggagtagggagagagagtactgcctgttgctgaattcggtgcgatcagcttctctgaatcatctgtgtttttaaagcaacattgaaagttgttaagcgcagtttctaaagcacaggttagggtggggcgttagggaaactcgtgtggacagagatgttacttaaggcttcatataaaattttaaagtagtcagaggggaggaaaggatctgaactttttattttaggagaattcctttgaatgtatttctgctaactttgaggttctttgtggagctagagacagggtgctgagttagaaaatcccggaggaccactatgagaagtgcaaaaggtgaggacacccaattcttccctaagtgaagttcagtttcactaattggcaggaaaagtgtctgcttgagggaagatgtgcacattctcaagcagattcacatttttcgttgaaattgttttgaagggacttattgtttgaggttaaaaaaaaaagccattaagaaatgctgatggcttgtggcttgttttattagggggacttgttcagtcttgttgcattctgaaaatttatcgtgaagtattataattttcaattaattttggcctagggagttctatttgcactactataccttccaggaatatgacatcattaatgaacgggttaattactttgggtttaagaatcctcaggctgtcacaaaattttcaaagcaaatttcttctatgtccagaagaattgtagatttaaaactgaaaatgatttttgagaggtaaggattagttgctggg

SEQ ID NO: 76532 - DNA, 1929 bp, Homo sapiens
gtgctagttgctttgtgttacaagaaagaaaagaaaacttagggaaaaggaagtcatttcctttgaggttttaagggggaaaaaaaagttgcattctgtagagctttgaacgagccaaatagaaccctgagcgccaactgccctgagaacaggcaggaagattaatcacaactttgagaagcttgaatcacgtgtctggctgttttccttttcctacccctcctcactccttgtttgagtgttgtctagacatatactcaacagatctaattattgcagttgtcatctttaaaactttacattttgttataattttagatttacagacaagttgcaaagatggagttcctgtatacccttcacccagtgtcctctaatactaaaatgttacataaccatggtttcaaaaaattagaaattaacattagtgcaatgctattaatggactatacactttatttggatttcatcagttgtactttttctgtttcaagatccttcagtccaggccactgtgttgcatttagtatcatctttactatggctttcttcttttcccctcacaggctagaattctgttctttgaggatgtatacaatttgtcaaatgtatcttatgagaaaaatttgcaaaaggttttacatctatgatagatacatttcagatggacaaaagagagggagagtattctgaatatttttgaataacctaatacaggctaaccattaacctatattaggctattttaaaactgaggtattttacatatgacaaatttcgtaaaatgaaataattccaagatgaaaaagactagagctcatttatgacagtatggacacctgtctcttggctctctgtataatgctgtttttactaatttataaattgaggctatgagacaagtacacagccatattataaggtagaatatgactaatgccttgtgtgtcataaagtgctcaggaattggaaggaggatgtaattatttcctagaatgctttatgcagaggatattcatacattcagaaccttcactgtgtgctgggtgctgtggtaggccttatggtgggacctttatgaggttatttgtgctggaatagtgtttccataatcttcccactgggcaaattaatctttgttctggggaaaagattgttccttaaaagaatgtatgttcttggatgtagtgttttgctctgcttaagtattctaatttatctaacacattaagggtttctcagtgagttattttttagcttctgagaatattatttataacattcttggtatgtatctggaatggttaaaagaaatgatataaaaacaaacaattcagaaaacctaaataaaccaatttcattttcactcagcagtatttatgccacaaatatacattacacgtaatttccacaagcctcacagaccctcatgaccctcatgacaaaactgaaatgaacttggatggggaataaagaggaattttgggttgtttttggcattttactaatgaaatcctcaatttcatatgtatttgatttatatatcaagcagtcctcccatctgagtctcctgagtagctaggactacaggtgtgaaccaacatgccaggctaatttttgaatttttgtagagataagatctgcctatgttgcccaggctggtaaagatattttcaaagtgagaataaagatagctaatcttaacaaaaatatgctttgttaccaaaaatcttactttactcccttaatgtcacagtattgaatattgaagaataccaggatgtgttattgaaaaatatacttaaaatactttaaatatacttgaagtgatcttttttcaatttctgtatatgaagattttcaaatgtataagaaaattgaaagaatgcttcatctagattccactattatgaacctttttgaaaaatc

SEQ ID NO: 76533 - DNA, 1149 bp, Homo sapiens
tcatttaatcctcatcatagctttgtgagatgaagatactgtaaatccccttttgcagaggaggaaacagaggctcctaggggttaaatcactggctcatgtttacatagattgcccctgccgttttttccttttgaccgccatagccaccttccatcaccctccaccatcatacaagatgcttctttctgattagtctgcgtttgaaagcctacctgtgattgatttgacatgaactgagcatctcctgatctttttcagtgtattccgggatccaaaactcagagctgtccttcccatctccatctagttatatccttaatcttggctctccttcttgaccaacatattatgtgaatacagtggaagcccatttagtacagtgttttcccagggatttagttatggttcttgcatatacttaaagtgagataatttgtgtcactggtcatttggggccagggttagccttgttctgtggcacacattataaatggatttcattaaacttttatgtgctttcacttactggtctaatgtggggttctttccttgctgtgcttatatcagatactctcttgccattgcccctgccgtctcacctgctccttcactctcgctacagagatgcagcatttacagtctgtgtatatcctgcccattccagttcaatatgaacaaaatttgtactgtagcccttatgaatatgtaaatagcagcaagagaagcacttgctgccaattggctgcatgtttcaaggaatgtaaacctcttttgggagattttaacctaacttgaaacagcagtgctgtaggcctctagtgggtagaaaccaaggggattttaaacctcctataatgcacatgacagcgccccacaccaaaggattgtctggctttaagtgtcaacggtgcccacagcgaggaacattgccccagagtttatgttctcagtgggtgtggtgttaccctcaagggggcagaaattaactcttgagggatgcatgtgtgaaaaaaaaatcttattctttttacatataaagtacagatgtacatgcagcacaaacaagtgtgcagtgtatctggtattaaaatttcacagggagcgtgatgaggaaaagaatgtctgaaaaggctacttaggaggaca

SEQ ID NO: 76534 - DNA, 1683 bp, Homo sapiens
agaattgcagtgtcatgttgacagaatttgttaatgaatgcttacttttacttaattgtgaatcctgaaaaaatgttgcaatagaatatatcaggaacaaatgggagaaacaggataggtaaagctatttaagttggacttgccatgagacagctttggtcctcatatttaccatttagaaattcagtgtttatcaatttactgtgggatttacttagactgataaataaaagagtgatttatacagtaaaatattgttactaatttacaaaaggaaatattaatgaagatagttcttagtgtagggcaccttttcctttttccagaatggttaggtttactaagaaaatcacatataaatcaaaacattgttagtgcctctcaagttatattcctatatagccattctttcagtttttactttgggaattttggggtaaagaatggcatgcagtctccagatgataccatccggataatactgggagacaaatctgtaccagactatttctttaatatgcatacatacctctacctttctgctttattttaataaccagttataattctcagacatagcagtttttaaaaccgttacacttttggcttgctgctacttgatggtttgggaataggtaccttaatctcatcagaaaaccatttcaacacataggataggatgagttagttttgtaaaaggtttttgtgaatcaccatttctatctataaagtttagattgttgggtatgttctattccggggcctctttgttaccttcatttttgaaaaatttcaaagtgtgctatctttaacaaatgcttctagataggaattgtttggatacccttttgggattacatgaaaattattatttcttttgttctctacagtgatctaaagatgcttttggaaactcggggaaagctctgctgtacattcagtgtttttttttttcccctcttaccgtcttgctcttgttttgaagcattctatctctagtctaccatatgactatatatatttgattattaggctaggtgccccctgacccaaaagtatccctcagccaagaaggaattatattatctgacttattacaaagtcttttgtattactttccacttgcccagttactgtttttcatccagttgtttttcttgtgtgtgtttgtagcaacatgacttgatttttaaacagttttttaaaatttagcatagctaatcataactgttactagggttataacttaataatttgcaagtgttggatgtcattaacacttgttggattaagttaaaaagtagcttatggagataagaatatgtacttatgtgatgagtgaaaaaaagaaaagttgtcctaattaagtacaaatggacatttggttacacagaattcctaggaacagcatcatacagaaagtgttagaactcaaacttatactgaaatgatgatgtagatgtgctatgtaaacctgtgttaggtaactcataatgacttctgtgatgaagaaacttctgttgctaaaaatatgtgaataaattggacaaaatcatttcatgaaatagagtagaaaggatatacgtaacattttaattatgaggacattgactttcaccagaatttatagattcaaattgtataaatgattttctttctttaaataaaagtataggaaaaatt

SEQ ID NO: 76535 - DNA, 1044 bp, Homo sapiens
attacccagtcttgggtatttcttcatagcagcatgagagtggactaatacagtgttcagctcatcctacagcccctcttccctccctggaggttgagagttgggacttcagtccaaccctctaatcaggaggttggttcccctggaaaccagccccggctcctgaggctatccaggagtccccaggcaccagtcaagctaatagtgaacaaaaagacaccagtttggagattccaaggattttaagagtttttgccagaaaatggggatgaagaccaaatacatatttcacaatatcatacaggtactcaactcttccaaatctgatatttatgcattttgtaaacttctaaatatatttcccaacttaaaattataagcccaaaccagttattcagtaacattttaagttggaatcagaagtttaattttttagatacattaatatgcaggacttcttaatccaagtatttaaaaataacaaatatttaatatatacctattatgccgacactcaacacaaaattattaatttgtggactttatgtttttccatcctaatttcaacccacactctttccctctcaaaaacttttcttttttttttaaagaaatttgatcatacctgtattctaaacctgtctggcccataaagacctttttatttttgtctcaagtgatttgaggttaacttttttttttttgaaatggagtatcactgtgtcacccaggctggagtgcggtggcatgatcttggctcactagaacctccacctcccaggttcaagtgattctcctgcctcggcctcccaagtagctgggattacaagtgcccaccactacgcctggctagaggttactcttttaaagccaatttggggtcatgttctcagataactgagattgaatcttgtgaaaacatgtgggatctagagctatagatgtctgggtgatttttctcatgaaattgggataagttgagcctagttgtattacctctgccagtagtgactctaggccttgccttcccagtgagctgttctc

SEQ ID NO: 76536 - DNA, 1852 bp, Homo sapiens
aaagaagaaaattggctgggcaaggtggctcctgcctgtaatcccagcactttgggagggagagatgggaggacagcttgaagccaggagttccagatcagtttgggcaacatagtgagaccttgtctttacaaaaaataaaaaataaaaaaaaattttagctaggtatggtggtgtgcacctgtagtgccagatacttgggaggctgaggcaggaggatcacttgagaccaggagttcaagagttcagtgggctttgatcacaccactgcactccagcctgggtggcagagcaagaccctgtcttgaaaaaatttgccattcatgaaatgtaaaaggtgtctcattgtgactttcagttaagctttctgattactactgaggttaaacattttatttttttatatatggtccatttaggttttttcttttttccaatgctcatttatgttttgtttcatttttctttggagctgtctttttcttaatgattaataggaattttttatttttttatatattcatgctattcctttattagttatgtatatattacagtcatctcccacttgtggcttgtcattttgctttccttaaagtttcttatgattatcatatactcttaaatttagaacaatgaaatttaccactttttagtaatcaggttttttgttttttgtgtttttttctttctttttttttttttttttttaatgaattggagtttcacttttgtcgcccaagctggagtgcagtggcacagtctcagctcactgcaacctctgcctcctggattcaagctagtcttttgccttccctcctcagtagctgggattacaggcatgtgccaccacacctggctaattttgtatttttagtagagttggggtctcaccatgttggccaggctggtctcaaactcctgacctcaggtgatccacccgcctcagcctcccaaagtgctgggattacaggcgtgatccacgcgcctggctagcatttttgtgtctgaattattttctacacggagatcagaaaggtattctgtattgtctttttgaagtttcatgtttcttttgttttcacatttcaattctacccaaagctatttaagtctgtagtatcaggtaggttcttaaggcttatttttttctttatgaatctctgatttacccagtatttgttaagtggactatcttttccttagtaatttgcagcagtctctatggcataagctaaattttcatttctggtggcttgtttctgggctctctgttctgttctgttctgttctgttgatctgcttgcctgtgccattaccataccatccttatcagctttaaaacatgactcttgatagccagtgggttaaacctcctaccatattcttttttaggagagacttcgctattcttggctctttgatttttgatgtaaacttcagagtctgctagagaaagtctataggaacttggtatttttattggagctacactaaatttgtaggtccctctgctgagaatttgcatctttacaatattgaatctctccatttatttagtctttttaaatacctttcagtaatagtttttcattttctccattaaaaggaaatttatgattttatagtatttatgctagtataattttgtttttccccctaaaatgtcgcagtttattttgtgtctagcaatcttattaaacccccttattaatgatgttcccttgtctatatgatcacaattatttcttactttctagtccttatacttcttgtttaatttttttcactggctatgatatgtagcacatggttaaattgaagtattattggtgtacatccttgtcttttt

SEQ ID NO: 76537 - DNA, 1055 bp, Homo sapiens
atatttagtatgctataattgtaattaatgccagtttctaatgttggatttgatgtagacagtttggaataagagagttatacatattttcaagtagtgatgtggttataaaatagttccaagtatcagacttgtaaatgaagaatgatcgttgtttaccttttttgctatttgctggattaaaaatcagaacctcttagttttgtggaaaaaagtataacttaaaaaattaacaaaggaaaagcattggagtcagaataatgacagttactctttttctcatttttttctccacagtgatcctggtggagggattgaaatgtctgagttcatccgagaggccacacccccagttggttgcagttccagaaattcttatgccggtctagatccaagcaaccaggtaggaacctgcgctgttttattttgcctttttccctcctcctgatggtggtctccgttattctcgtgtctttaagtcggctgatgttttgtcatatctttctgattattatttttaattgcttattaataacatcttttattaatattctttttaagttacttttcacattgattaattacagatttgttgagcattaccacagactcatctttgggtgtatagttttgattatgacagttgtgaatagccttaggaaatttagcttctagcttgcgctatcttcacatcatgtgtattagagaggtgtagatgtctgtggttacccccagtttaaacgtggccaaaaaataaaaataaatgctgaaaatctctcagtgttcaagatgtttaatggtaaggctaaaagtaaaatacaaatttgcttttatcaattttaatgtctttctactatgtaacttttaaaatggtaactcttgaagttttatttcaaaacttggctggacctttgctgctctagtcctcttattcatcctaaatacccgtacactaatcaaagccccagttactcctgctgtccttctcagcagatgatttcattgggtagagtaaaattctatgaactttgttggaaacgttcatggtcttctct

SEQ ID NO: 76538 - DNA, 1050 bp, Homo sapiens
tgaagacaagggttactatccttgatcctgtttttttgttggccttgtgtttctctgtctctttttatagaatgaaataactcaattcttgaatatggctgcatgtcttgtattcttaattaaccctgggctttcttcttattgacagacgtaggtagtatcagacccccagagagtaagcctacatttctccaatcatcttttggagaccttttttcctttttacaaaaaggaaagatgaaagggccagcagtggccaggcacttttggatcctgtgaccttggcatcgtgtctgttggaacttgcctgtttgttttagggagggagtccctttttgactgtgattaaagcatgtgtgcatgttgttaaacacacagcataccttttacttaataactttttaataaaaatgggcaaatattggaggttattgtgctacttggattttagtgttttcgttttatactgtttatgacaaaataaatggttgacataattattcttacactttagagaagctgaagtgaggaggaagagtctggctttttgcatattgctggagatattaccattatagacatactgttgtttcttgtatgtattttattatataatgtgtaagatactgctacacattatcatattttatataaatttgttgggtactaaacagtgaacccactgaccatagtagctacatcgtggtcattgttactattctttccttcacctctgcctttctccctttcatcttctacccatcatttccattctttcttttcattcctctccttacctccttctctttccttttgtcacttttctaccttcaaatattttagcgcccaatagtattcaaggcattctacttagtgtgggttggggagtgggtcttatactgaaagagattgtgatctcatagtaggtgtgatataagtaaccaaagataaagatgtgatatatgttaccaaggggccaggcacggtggctcacgcctgtaattccagcactttgggaggccgaggtaggtggatcacgaggttgggcga

SEQ ID NO: 76539 - DNA, 1029 bp, Homo sapiens
cctgtattcccagctacccaggaggctgaggcaggagaattgcttgaacccgggaggtggaggttgcagtgagctgagatggcaccactgcactccagcctgggcaacagagtgagactccgtctcaaaaaaaaaaaaaaaaaaaagataacgaagtaaaaattgccataggaatggtagagaagaagagctaatgatttcataggataaaataattgtttccagctggagagacaggcatggcttcttggggcaggtggccttgcctgatatgctctctagttagaagtaacctttcttccctggtatccataatccttcctatggcacttgtcatagagaagaaacagtggaatattttagtttatgcaaagcacttaaataaaaaacttcaccctcaagtgtaaaaagatactgttttttcttaatctttacattttcatttttaggaaatttaatgagtgagggcaaacaggaaaattaaaataatctatgtcataattgattgtatcatgagcattaatatcattaagtgtttttctacagtgacactttggggaatgcattgcatttggatatactatagtttatattctggagccctgttgtttcacttgtaaatagtcatgattctttttgaggggaagcataatgcagaaaagtatgaagaataaaatataaccactctattatacctgttaagaatgtttttgtcaacaagtaatagaatactcaactaatagtgacttaaagaaatagttgtttttcacctaaatctggaggtgattgtgtggcatttgtgttcagcagcctaacgttaggcctctggattggcatctctgcagttctctaggcttttttctcagggttgcaggatgagcacagcagcttcaatcaagaccctgtttgaaaagttaggaagcaagcagtagtgtgggacagagattttccttgatcactttcttctcagacacacaaagacgttttcctgaagccctccagcagattctcccacacgttcattcacca

SEQ ID NO: 76540 - DNA, 1014 bp, Homo sapiens
cccttgagggaaaacagttttgtgggttttagtggggttcatggaaaactaagtaatttgatgtgaaaccttctaatgtgaccacaaatgaaagaacaaaaaagagcaagttattttctgctatttgatctattcagataaattcgtattgttttcaccctatagttttttaggttaataattttccctgggaaggaaattcatgttgggtcaagttatgtaatttgcattcctttttaaattccacttgtttttaaagaaatagttttattagtttacattttgaagctttccacattgtttggtttgtagttctgtgagaataattaagtgctctgatagtccatgatacttcctgctagttcagtgcatcttccattattgtaacctttgatacacaaaaactactttagttgatagacattagtactccttgatgtattaatactccttggttatgccaccctacagccttactgttaatataaggtcctcacatgtttctcttaactttgtaggagatacagacactgctaagacttctgatgatatcagtttaagtctgggccaaagttctagtctttgtaaggaaggaagtgaagaacaaggtaagaacgttatactttaccatgatgtcatatactgtggtgaccagagttaatttgtagaatatgctgcatacaatttggcagaagtttataacaatttaatatgatatttaaggaaacattaacataaaatgttatggtgatagtagtaatacagagttacacatgcttttagcttacttgaactcagttatacatgttctgccagataaacatggagagagaaattctatgagcatatgccccagagtgaatatgagatgggagataagaatctgctattcttttagttggtcagaccaactagcccagcttagggataacctagtatgtaaaactgttactttccattcagtacgatctctaaatgccagctgcttcatctcttgccaactgcaaaaacagc

SEQ ID NO: 76541 - DNA, 1078 bp, Homo sapiens
caccacgcccggctaatttttttgtatttttagtagagacggagtttcacagtgttagccaggatggtcttgatctcctgaccttgtgatccacccaccttggcctcccaaagtgctgggattacaagcgtgagccactgcgcccggcccctttgtttcctcttaattttattgttgatagtctatacaactctttctgaggccagttgaagaactcaaagatttggaagttcagttcatttcgtgagtagaatgctttctttgtgcagctgtgaaacagaaagcagctctttggagaactacttgagaaattatttatacttgatttactgtatgcagtgaattctttccattgttaaacagtagaaaagcagatcatacatttattttaacatttcaaaatatgtgtttgaaacagatttggcagctgatcggaagctctttcgtcttgtctccaatgactccttcatctctattcagccttccttatcctcttgtggacaggacttgccaagggacttcagtgacaaagtgaacctgccaagtcataaccaccaccaccatgttgatcagtctctgtccagcgcctgtgacacagaagtagcttctcttgtacctttacactcacactcttatagaaaagaccaccggccgcgaggtgtaccacggacttctagctctgctgtggcttttccagacacttcactgaatgattttcccctttatcagcaaagacgtggattagatccagttagtgagttagaatcttccaagcctctttctggatccaaagaatccttggtggaaaattctggtttatctggggaatttcagcttgctggtgacttgaaaatcaatacttctcagccacccacaaaaagtgggaagagcaaacctttgaaagcagagaaaagcatggacagcttgaggagcctgagcacacggagtagtgggtcaacagaaagctactgcagtggaacggaccgggacactaacagtactgtcagcagctataaaagtgagcagaccagctcaactcacatagagagcatcctgtcagagcatgaggagtctccta

SEQ ID NO: 76542 - DNA, 1707 bp, Homo sapiens
tttgatacagtaatgttcagtcatttattaaaagttaagctggattttgtttgtacaaacattatgaaacatatgaatatatgctttttctcaaagatgttaatttcacccgaagtattttaaaagtccatattgtggtaaacattttcttagatttttttgggggtcaagtttctagccagattaatttctaatgggaacgtaaagaaattttctagtacctaaagaagaatatagtttatcaaacctaaatattgagaactaattatatctgaagtggttataaccatttggtgacagtagagtaattaaattccctcgagtctttgacctggatatagttctctctttttttttttttttgtaaacaacctgaaatgcttgtagtgatttctcacacaaatcatatcagatatgttcacagtatgcaagaaaccattggattttaaaatatagcttaatttttaaagttatcaaaatgaattttaagtcaacatgctatgatagaaaaatattgctgttctgaatattgtggaaatgtaaatactgaaaaaatgtgtacaaaaatatgtagtaaattcatgcgtttatatttaaaatgtcatttccttttcatggggactgtgaggtgttctgttttttaggaaaagttacctgaaaggtgttatttgcttctcggtgctgttctttaagctatattagcccttgtttttctaggctctagcttttgttttcttttgtttgtactgcttttttttaatttaaataactcaattaaatgttaataagagataatgaaataaaaatatctgctttggtggaagaaatgtaatagtctgtgggctgtttaaaaacatttttttgcctggggcaggcattgcacaggcttttttaatttgagcttcattgggtttagaatacaaataagagcaaaactaaagcacttaaatgtgttgggggttttttaattggtttttatcataactaaatataggggttttgttgggagtttacttgggctttttgaaaggttggaggtggtagaaggggatttgttttggttcttattatttaaaaattacagagactctcaaatactgtttaaagatacttgtttatgttaacattatctgttacagtcctgtctgacaatttagaagaaatgtttctgggctatccttccttacatactgtactactgaaacctgtcaaccatcatgttactgcttggccattcatatacctatgcataaaccataggtagattttatcctaaagaatatgaaggtgtcgataagttctccaacgatttcttttcattttattttaaggtaggtggtggtggtagtgtagagagatggaatttaggaaatagactttaaagtactaaaataaagtatgctaaaataggaggtaatctagtttagtgacatggagtcagatacctttgttagtatgtgggctccactgttgtgactctaggaaagctacttacaaacctcagcttcctcatcttaaaatgagatgattatagtatctatctcatagggttgttgtgaggactaaggagttaagttcctggcacacagtaaatgcttactagtgctgctgtgactgttcaaggccagttagttatgctgcacagtgtagcctgtcgtttaaccttactaattcagtggtataaaattaaagtagaagaaagtgatt

SEQ ID NO: 76543 - DNA, 1991 bp, Homo sapiens
gagccactgcgccaggcctgaaggttcctcttaaacttattatgattgtgaagtcagtctttttaacacaaataaatgattagaaagttgagatttgtacgttagaaaaaatacatttcaaaatatacaactctctggatatatacccttggaagtattttatacttcttgtcattcacggtttttgaattgcttgcatgttttttcttttttacctacacatgcataaagtttagttgtactagagtgctaatttttcactatctgcattttatgctcttactattgaattaatttcattcttctttgccagagatactgggttttaagcagtgtcaaaatgtcaactccaaaaacagtttttaaagtattttctcccttctctctgattccctagttaaaagattaaattttttttttttggttcactatttttcttctataaagttaaacaattcaaaaagagtttattacaattggattctggaagggaatatttatcaagtgtggctataacatatgtgactgtatgtgcttacagcaaattattttaagctttaaagacacattttccctctttggctggaatagaactggacccctactcgactattccaaatagagatgttctgtaagtagcacattcccaggggcatggcttaatcttacatactgtgaccataaattgtaatatagcattttcacttgaatgtgtgatactgttaaagcagttgccatagtcaacattttgaaaattcttgtaacagtaggtgtttaccccctgaatattataagagacagcatagacagtaatcataattccactttaacattgttcactggatgcctaaactttcctcttgatgtgtttccaagactgttaagaaagtaagtgcatcataatatgcagctattttgcagataacaaaatataaatggtgtattactagcaaaaaaaattgttttcttaagaaaccaagaaacattttgactaaaagtggacactgtagtttgtcttttcaccccagtactatggaataattagcttttacttaagattaacaccattaagtcttcagtagaaggaagatagtaaagaaaaccgtctcatgtttctcttcttcctgttctgtatgattacgtactgcttttatcccaaatccttcagaataattttggtacattttatggattaaattatcttctataaattatgtctgggtaaattttactctgctattttggctgaaacagtatctagaactagaaaaaatgtttgaaagtttcttgatgtagttggattgacctgtaaattgagcatagtagtttgttacaaataatgctttataaataatagcataatagtttgtaacaactgtagaatagaaatctttaatataatatttcacaaaataattcttgaattgagttttaaaatagtgatttaaattccataacctgagttaaaccttattggtgtctaagaactgttagcaggtataccaattgttcatctgatttttcatttcttccctcaattggcttgttttcttctctgctttgtttcatccttcatccattgattgcccttccctaatacatgttttctcctttgtggcaatgctgattgcattttcatttcattgaagtcatggttgtcaggaattggcaaagtatgtaatgtgccttgtagctgtggtcacaaaaaggcaaccttatctttctagataagcactgttcaatataactttgtgtgatgatggaaatgttctatatctgcactgtccagtaatggtaaccactagctacatgtagcaacggagcacttgaagtatgattcatcaatctcaggaactgaatttttatttttatttaattttaatttaagtttaaatagccacatatggctaatggctactgcattggacaacagttgtagatgaccggatttaatcagcatcttttgctgtcataggccatatataattttt

SEQ ID NO: 76544 - DNA, 1036 bp, Homo sapiens
gctatgagttcctgtgcttgccaatttgccaatatttgcttcctaaagttgagaggaccagagccaggggcatggagttgaataaagtttgatggtaatgaagtacctttagagtaaaatatattcatgctatgttgaattaacacactggttttgcagcttcacaaccagaggtttcatttaatgctgccaaaattatggcacagggtactgtgagataaacttactgccttactccttgtcatcaacagtgaaatatactgtctttgctgcttttacaatacgaatataagaaactaatgtcctcttcccattagtggaaactaatcaatactgtgcttttaaggttgacttaattaacggggtaatagaggaatatgggaccaaaataaatgaaactttcaggaaaagatttaaacaacagagatcttaaaaataggaaattgaggttgaagagaagatggcaaggctagataataagtcaaaaacattatttttaaagaaacaattttctttaaataaatgacagatactttttgtgtattacctgatatgatagattgacagtatacatgtgaaaacagtttggattaataagttcactttacccatgagggtgggaagtcaagggaaagccaggctcagctgctatttacatctctgacctaggctcttgtttgacctaagtctgtcttgatgcagcagcacaagccagcgaggaggcagtgtcatttcgccgtgaacgcagcacatttaggcgccaggcagtacggcgccggcacaatgcagggagtaaccctacccctcctacattgctcatcggatcacccctaaggtatggtattttcaattccaccaagtttagcatgcatgtaacaacccttctaatctgttccgccagtcccaagaaagcatttgaagagctttgtttttcttttcctttctgtttctttcctatacatttaagccctttttggctttttctgcatgtgaccatgagcctgttgcattatgcatgctttatgttgcactgttt

SEQ ID NO: 76545 - DNA, 1185 bp, Homo sapiens
gctgtgattctgggggctgcccagttcacaaattgttcattgctcaattaaaactcttttaaattaaaaaaaaataataataaaaaggctgggcgctgtggctcatgcctgtaatcccagcactttgggaggctgaggtgggcggatcacctgaggtcaagagttttgagactagccaacatggtgaaacctcgtctctactaaaaataaaaaaaaaaaaattagctgggcctggtggtacgcacctgtagtcccagctactcagggtggctgaggcaggagaattgcctgaacccaggaggtggaggttgcagtgagccaagattgcgtcactgcactccagcctaggtgacagagggagactccatctcaaaaaaaaaaaagaacttcgtctttcatagatcatgttcctaattaattcttcagtaagtcaaaattctataaaaagtaatatggattaattaaaccaatatttaaaatagaaaaatgagaagacaatcaatttaacagaaacacttgttctagaaaccttttctgagccctttgtttttgtgagccttcctgttctttttcctttctactttgccttttcctgcctgaagtaacttttctttctgctgatggatttggagcatagtctcaacatgtagaaagagctcagcgttttattttactttttctattttgtttctaacctcttctttttgccccttgaataatacttgccaaaggcaacttttttgctttcttactccatgtttatataaaacttttttttttaacttttgcttttcagtttttaaaaattatttcattctttgccactaatgagcctgctggataccacttagcaaacatatgcagacaaattagttttttgtcctctactaggtggaatattaaagagctgtgttctaatgttctaactccagccaatcacatacaattttcccatgtttttctagggtttggaatacattaccattcaaatgaggatgttgtgtactacctttttttttttttttttttgagacggagtctcgctctgtcacccaggctggagtgcagtggcgcgatctcggctcactgcaacctccgcctcctgggttcaagccattctcctggctcagcctcctgagtagctgggattacaggtgcccgccaccatgcccagctaattttttg

SEQ ID NO: 76546 - DNA, 1029 bp, Homo sapiens
ctcggctcactgcaagctccgcctcccgggttcacgccattctcctgcctcagcctccctagtagctgggattacaggcgcccgccaccatgcccggctaatttttttttttttgtatgtttagtagagacggggtttcaccgtgttaagccaggatggtctcgatctcctgaccttgtgatccacccgccttggcctcccaaagtgctggaatcacaggtgtgagccaccgtgcctggccaaattgtctaaattaatttaataaaaattaaattgatagtcaaaaccctgatgtttataatcacatggattctggctaattttatttatttatttttaattctggtgttgatttttatgcattgtctaatatcttaaaaacctttttgtatattggatatacattgtgcatctctgtgttgaagatgagcatatactcaaatgcgttcatgccaaaatacatctagctgccatatggcaacttggcttatgatgtcaagtgaaaaaaaatcgatagaaaaatttgttgagtacgtattttgtaaaattctgtgtcttctgaatcggaagggacacagggacgtggtacctgaactactacttaaacatttttttctcagtattttcttccttgtgaaatttgtcctttttggtaaggtttgtggataagtttagatagattctgaggaagagtaacaaattatgtatgtatggaagatgaaaaccttatctgattatattagttcccaagatttatctgttgatttatatctattctacaaatattccagtctgaagaaattattaaataaatacttttatcattatggcttaaaaaataatgccagtaaggactgacaagtccacatttgtagacttagttttttcatatgttgtgtgcattcctatcctctgcctggaatgtgtacttttcattggtgaaatgaagtagtgcaggttaataggacttcctgggatgatggaaatattctataatctgccctgttctatatggtagacactaactac

SEQ ID NO: 76547 - DNA, 1703 bp, Homo sapiens
ttggttgagtcagttattctggttttcttgctagtttgtgattctttttgattcaagattgttattttggttgcatttgataagattatttggttttcaagtgcatataaacttgttttattgtgagtttgagatctcagaatatttgaaagaacaattctagagttattacaaggctataaatgaaagtgcatatttaactgaaacatagggcttatctgttggggccagctgcagcacacatatattgaatgtacttatgattcttttttgctgctttctttttcctcacactagaatttagttggcttgaggtggaaaaaagtcgcagattgaccaatttacatgtacatttaatgttgactgcatttgtctcttcaaatcaaatttgtaaggaccagaagatttaagttggcaatgtaatctgtatattttgcaaagtttgttggcgctttcttaggttatgttgaaaaaaagtgcctttttgaaatcagttttctatgttgacttcattctaggtattgttttctcttttcttccctgtaatgtctccccaatccatgttttttcctagccttcaagatggtcagcaaggccagcagtccacagcccaggtcaaagtccagtcccgccccccttcccaggctgcagtgctcagtgctagtgcctccttgctggtgagaaatgggagtgtccacttagaagcatcacatgacaatgcatctgctgtaggcggtagcagtttgcacgatgaacttggtatgcaggccttatgtaatcttgatgatacaaaaactttaatgcagcagatgatgggtaacaattgcagttcttttttgagatagtttcattttggaactatgcataggagcactttttacataggatttaccctatgtgttaggaaaatgtgactttttgctttttccttttctgtttctctctactcttattctgcattttcttttggtcatgtccatttttaataggtagttaaagtgttaatatatgttcacactcaattctgtttttcccaggcatttgtaccatgtaggagaaaacgttgacttttttaaaaaaaaagtttcttactaaactttaatttctttgaatattttgaatgtgctttaggaaagggaaaagtgctttctaattgtctgccactatagaatctttctttaagatattctatatttcacactatgttcgtcatctgtagtaggttttattttaattcaaaatacagtactctaaggacatcatggctccgtactaatgtcacataataactttataaagtttatttcttgttcttgtcaatatatctataaacatataaattattgaataattaattctcagaagtgtgatatcattaaacatcagtgatacatacctactcagatatctgtcttatgcattatttaagggtgatactttatgttactttggtttctgtgtctctgtataatctagctgtcttgttctcagaatgcaggttagtaatggtttaagtaaatataatgaagaaaatctagttattcagaaataattcacttgaaagcatttactcattgtgattttgtttattcatgttataattgctttttacttataaacatgataatccagttactgtttcaactggaaggatatgaggtataagttgcccaaattaggatttaataaaattttatatgcta

SEQ ID NO: 76548 - DNA, 1050 bp, Homo sapiens
cattcactgacctttcttagatacacttggacacttttcttaagaaacacagctcagaatgcagtcacatgattttgtgggcttgtagtttgagctattccaaatttaagaagctttgcaaatgggtactcaccccctgcaagtagttgtcaggtgatttttaaacattaaattcattcatatgatcacctgaatagagaatgtgccgtgggaaaaagaaaaaagagattggtattgcaaagctgacttaagtcccttccttttaatacctgattatgtatgttgatgttttaccctactgtccaacgttccttttcaactcacatcttgctgaattacatgcagatcattgttttaaaaaaattttttttaaaggttatggtgtattttcttaagatgtagaaacttacgaaatttagtatatcatgaaggaaaaattctgagtattctaatggctttttaaaataatcatttatttgctaggtaagttctcttctacgctgtatgagactggtggctgtgatatgtcacttgtgaattttgaaccagcagcaagaagagcatccaatatctggtatgtgtgaagtcatattaggagtgtgtgtactttcatatgtttgccatatttaatgtttttaagcctagaactataaaagttaatttttttgttttttataatttaatgttgttaattgacaaataaaaatcataaatatttatggcatacaacctgatgttttgaaatatcatatacattggcttaattgagctaaaattaacatgtattatctcacatacttataatcttgtttgcggtgaggacacttaaatctactctcttagtgattttcaagtatacagtatgttgttaattgtagtcaccaggtcagatataaaagttattttgaaaacatctttatatttactctaataatttgtcatagtgcatttgtttctaaaaacttaaggtagaattttttttgctatggaaaaaagaaagtattgtttttaaaacaaaagctattctgtgttttaaaaactaaatcaaga

SEQ ID NO: 76549 - DNA, 1078 bp, Homo sapiens
tgcactttgaagcctattcttgattaattagttttctttcccctcaagagttactgattcttattttaggacttctgtttaatgatggatcacatctgtttaaatgttagacatctgtgggctgtttacttatttttttgttttgagggaccatttaaagcaataaaatcttgcagtcatttagctccacatgctgaaaaagtagaacatatagataaccatgctctttaagctcctttggtctagtttcagaattcaccctctcaaaaaattattaaattgtactgttaccctgattctgtaacaatggaaacagtaggaggagggagggatagaaatgctgttaccatgtttaatgtagttcaagagaacaattccttacactataaatgtggtaaagcctcaagttttgaaatccaaacatgactgaactgtggaaactgacttatgttgtaggttattacattatagcttaagtttattgtgtctttactgattcctggcaatatgtttattgctttctttgcattatctgatttaaacactttcacaagaaccttgtgatacagatactattgtcatatgttactgaagaggaaacgcaagtatgaagagggtaggtaacttgtccaagatctcattcagtggaagagatttgaatgtagtcactgacccagagtctatgtgcttatcacaactctaggaaaatgctattttgcattttgaagttaacatggaaaagtgaagatatgtgaatctcatctgaatgttaaaggatatatttttctttctgcttgacaaactgttccctattttttattttattttagtgacacagattctcatgtatccagttctacctcagttcgattttatccacatgatgtggtaggtttttctttatttttacaacatgataaattttcagattaaatctgaaatatgtatttacatagatagctataaaagccataaaaattgatgaagttacacaaaaattttttgaaaactatggcaaaatcactttgctgccctccagtggctctctttttctaagtcctttgataagaaacaaaag

SEQ ID NO: 76550 - DNA, 1050 bp, Homo sapiens
taatcataacatattcataaagagtaggctgggcgcagtggctcctgcctgtaatcccagcactttgagaggccgaggcgggtggatcacgaggtcaagagttcaagaccagcctggccaagatggtaaaatcccgtctctacaaaaaatagaaaaagaattagccgggcatggtggcaggtgcctgtaatcccagctgcttgggaggctgaggcagagaattgcttgaaccggggaggcagaggttgcagtgagccgagattgcaccactgtacttcagacaagactctgtctcaaaaaaaaaaaaaaaaaaaagtgtatgagagaagaaaattaaagggcttagataactgataagctaattgagtaactgttgaattatgaagatattttattttgaataaacatattaaataaatattgaagatattttaagcctttcaatgctgactttcttttagctctctctcccacagattcgattgaatagactattgaccattgatacagatttgttggagcaacaggacattgatctaagccctgacttggcagctacttacggcccaacagaagaagctgcccaaaaggttaaacactattatcgcttttggatcctaccccagctgtggattggcattaactttgacagactcacacttttggccctgtttgataggtgagattatagtgtgatattaatgatacgtgtggattttatttttaagatgaagtgtctttaattacccactgaggtttttacctggttatcatgttgggaaatgttttctggttttgtcctctggatataaaacttaaggtaatgggtttctaaacagtgactatcttaaatccattaaaaatgttttggttgcaacttcaatatcttttacaaagaaattagttttgttaatcagtgagactcatacaactgctagtcaaaagccaaagaatatgagttttgatgatctttaagttataggtaatatgatgcaaagttctatataacagttataagaggaaacttctgtttccctggttcttaacact

SEQ ID NO: 76551 - DNA, 1037 bp, Homo sapiens
actccacaattcactgtagcatgttttatttgtatataagaattcatgttatgtccacatgaaactagtttgttttcagtatgatctaaaaccttgttcaaactcagtaccaaaaagacatcttggcataccatgaacttcatatttatgtcttcccttcccttttttccatttggttaatttcttatacttaagatatacttacccataagtttttctgtccgtagaaatcgtgagatcctggaaaatgtgttagctgtcatcctggctattctcgtggcctttttgggatctattcttctcatacaaggattcttcagagatatctgggtcttccagttctgcctcgtcatagccagctgtcaatactcactgcttaaggtaccagcatctcttcttttcatgctacggaattatatttgtgttaaaaggcagaggattttgtagcaattactgaattatagtaagataattatttttaggcttacttttcttgcatgtttacataagattgtgtagagagcaaaagggggatataaaccttaaaaataattgtatgtaaattagcacttcctaaaaacaagttttttgtattaaaagaaaactgtgtttgttttgtttgttttattttgttttttggagatggagtattgctctgttgcccaggctgcagtgcaatgatgctatctggctcactgcaaccgtcgcctcccaggttcaagtgattctcctgcctcagcctcctgagtagctgggattacaggcgcatgccaccatggctggctaattttcgtatttttagtagagacggggtttcaccatgttggtcaggctggtctcaaactcctgacctcgtgatccgcctgccttggcttcccaaagtactgggattacaggcatgagccactgcgcctggcctaaaagaaaactgtatttgttaaaataagaacttgcattctttttttttttaatagtagtagttttttttattattatactttaagttctgggatacatgtgcagaatgtgcagattta

SEQ ID NO: 76552 - DNA, 2183 bp, Homo sapiens
cattaggagcaagaataaagaagtaatacctgagtctggtgttaagaccattgaataaaaactttgttattcacttcgtgactttagacaaaaatattatctgcctagcactatttattgtgaaatgggatccaattttagatgtaaattgaggttttaatagaacagaggatattctatttaaagtagttcaaaaatagacttcatgaatagtttatgatttttttccttgaatataatttttttaatcctttcactggaataatgaataatgggaatggatgagcaaaataaaacaaagaggcaagtgtggtttttgtttttgactgattactgttttgtaagaatatttttgaagtgtaatgatatatggaaacattgcttttcaactttttattttgacgtaatttcaaacttaaagttggaagggcagtacaaagaatttcagatactattcatccagatccccaagttaacatttatgatatttgcttaatccctttctagcacatgatcatttttccttctttctctctgctagctgacatgatgcccctttatctctaaatatctcagtgtgtttcttagaaacaaagatattcctttatgttagttaattcaagataattatcaaaattagaacattaacattggtacaatgctgtcttctaatatatagatcttattcaaataggttttgcccattgtcttcattggcaatagaaagtccttgattatgtttagtctcttaaatctcctttaatctggagcaattctttggaagctatctttcatgatattgaaatttttgatagatataggccagttattttatagaccatccctcaatttgagtttgtctgatgttttttctttaaaaaaatttttttttttatttttcaccctgtcttatggtgctgatgatgtttctgatttgataaggccgtgctttttaaagtaggaatactgcaaaagtgcatcatattagaaagcacatactaatttatcctgttactagtgatgttaattttgatcttctggttaagggtattgtcttcaaggtgtctgaaatttctgcagtattaacattttggccagctaattctttgcttgagggtgcggaatgctgtccaatgcattgtaggatgtttggcatcctctacctacaagatgctggtagcaccacttccccaattgtgacaacagaaatgtgtccagatattcacatatgtgcactggggagcaaaaccccctcccactttcttaagaaccattactctactgtaatgttactgtttttctcttacagataataaatacttaaaataaataaataaatacctcatagagagataccctgagattgtatatgtgtccttctccataaatttctatccgattgttttagtatctactgatgtttcttgcctgattcagttatcatttattggttgccaaatggtgatttttctcatcctgtcattccttctacatttattagttgactatttattaatactataaggaagagctttcccttcttatatatgtaggtatgtattggtgtggataaatggatgattttattcaatggactataatgttactaatagtatttattttgatgctcaaattgtccctgatttagccattgggagtccatcacgcagctttctgtgtccttttgacatatctctgtcattctttaagtactttctacctttttgtcacaacaatatgttccagggtcatcttatactttccctgttgtagccagaaaccagtcttttctctatggagcccccccaccttttttggtaggtaatggtatttataaagtaagatctagttgctagtaatcattattgctagaatctcattgcatctaggtcctcttagtggataaagctaggaagtgtatgtatgtatgtacatatatacacacgtatatacatatatattacccattcctatatctatttatatgcatattaaaaataatgagactgtgggagcccaatgtgggcagatcacttgagaccaggagtttgagaccagcctgggcaacatggtgaaactccatctctaaaaaaattaaacaggtgcagcgatgtgcgcctgtagtcccagctacttggaaggctgaggcaggaggatcacttgagctcaggaggctgaggctg

SEQ ID NO: 76553 - DNA, 1648 bp, Homo sapiens
ttatagattacagtattacctttatagatcatgaagtaataaactgaccattaaaatgcttttccagttttcacttcaggcttgaaattagaaaaaaaaaagacattaagtgattgaagactgagaagcaattaatttgtggataggaaaaaatagtcaagtctgctactttagagaaagagccaggtataatgaagcagatgtttaagaagttataaaataatgtctgcaactaaaagttctagtgaatttacatggagcctacatatacttaagaggtattcataaaagatcatctatcctgagtagattgaggtttgatacatagcattatatttggattttaaaccagtatgtgcatttagtaggtcttcatatttggtttcagagccttgttttatccttagaatggtaacaccaaaaccagaatctaaaagtattttagtaataaataagtttttaagaactatctctgttcattgagtagaatatgtggctatgaattgatacacttagaaaatctatttccatattaccctggaatagataatggtttgtagaacttgaaaataatcatatcagcatacaccatggttaaaatataccattatttagtttaaccatttaaaattttactgaaagatgagtttgcaactagagaaaatgaaagggaaagaaattactgtaactttatagttcatttctctacacgtttcacattttcaggcctcatttattttccaagcatatgcattgaaatcctctctgctgataaaatgtcaatattatggctttcattttaaatagaaactgagtttttgctatgttgctgtatatcatactagagaatttttaatgttttgaaaattttttgaaggggtatgaattaagacagaactggtttcatcaatcagcatggcttaatgggtagaagacagtttgaatatttagggactattactggtgttatattactgtaaatactatggggagggcttagtgtaggtaatttatgataatgggcttttgtcatactataatttacaaacttatgcaaggtattaggtttctgatatctcataaggaattatttctgtagatttcttttattattattaaattactactaaagaaaatctgttacccatgttttaaaaataaagtctagatatcttagccatcccctattccttattactaataactcccattggagtattagtaattatctatttcattgttgttgctattgttagcaattagagctacagtgtctaaagtatctgttattagatctaaagtatctattttgttgttgttattgttagcaattagatctacactttttttctgaaaattaacacatgggcatacagatttacttctgggggtaacacaggttctgtttacatagataaatgtttttcagtgaacacttaatacatctccagttcctgttcaggcctctgaaaacttcatttttccacattttttgttaatataagatatattcttgaagcataatatagataaaattttttcttgctacatataaatgtttattgcttccaagatgaacatattttatctcgtaacaaagactcaggatagcaaatctctgttcatgtcaaaatctttttgaaagaaa

SEQ ID NO: 76554 - DNA, 1063 bp, Homo sapiens
tagtttattacatgggcaaaggcatcaagaaagtaacacaccaaatgtcagacttttcttttgcctaatatatcatgtgttgtcttttcctactcttattattgtatctaaaatttactatgccaagatatcttattcttccaaaaggaacacagtttaccacaaacaatagcacttaaaatgtgaaagaattgatagcctcatgcatcaaaagcaaattattcctcatgtatgagtagagctttagtgccctccccccaaaaacatctgtagctttagtaccaaagacatttagtggccagattctaactcatcagaaagtaataaatctaaatttttctggaataaaatgcaattaataacgtggctaaaaacttttgttgaatttaagttcgttgtctttttccaaaatacgtacataaaaggattatgtgatatattacaaattagaagcatattattctgttaaattcatttttccgcaggattcttgggatggccagcatattccagtacttttctccattttttgtggtttattagtggcagtgtcttaccatctcagccgacaaagcagtgatccatctgtacttttgtaagtgaactcaattgttattgaattaaaagaaatttaagtaagttggtgtttttttcaaatacctttgaagatctctttttcccaatgcctttccaaagtgctttggcctaatctatattaagtttcaaaatataataattttgggttattcaaatcaggttggctgagaatattagtgttttccttcccaattattgaaactatgttttaataaaaatattttcactgtatgcttatttatggtatcctaaacattttagaatttctcatttggtaatgattaaatatactcgaatcatttggttttctatcataaacttcattgcccgtttgaattactggttttcagattatctatgtattttctgtttttttttcttcacataaagctctttagtgcaatccaagatttttccaaaaacggaagagaaaaatccagaagaccctctatctgaagtaaaagat

SEQ ID NO: 76555 - DNA, 1137 bp, Homo sapiens
ggaaatcatcattctcagtaaactatcgcaagaacaaaaaaccaaacaccgcatattctcactcataggtgggaattgaacaatgagatcacatggacacaggaaggggaacatcacactctggggactgttgtgggatgggggtagtggggagggatagcattgggagatatacctaatgctagatgacgagttaatgggtacagcacaccagcatggcacatgtatacgtatgtaactaacctgcacaatgtgcacacgtaccctaaaacttaaagtataattaaaaaaaaaaattaaaaaaacaaaaaaaaccaaatacttattttctcatgatttctctgggttatgaatctgggagtggctttgctggatgcttctagctcaggatctttcatgatgctaaaatcatctgaggttcactgtttacatgcctcagttccttctgactattggctggagacctcagttcccctccatgtggtcctcaccataggctgcctaactgtactcacaaaatggcagctggtttcccccagagcaagtggtccttgagagagaaagcccaagacaggagctgtactcttttataacctggtattggaaatgacatgccaccatttcttccatattctgttgtgcacatagactaaccctggtacattgtgagaagagaatatactcaagtacaaaagcaagaggcaaggatcatgggaagcatttcagaagctgactaccacagtccatcagtagacctccatgatcgacatcccttctatatgcaaagtgcacataccctctcctaaaaccccgaaaagtctcattccagtacagttggaagtctagaatgttattatctaaatcaggttcaggtatgggtaaggcttcttaggtgttgttccttaagtacagctcatcaaggactatgtctttcatctgtagggcatgtaattaccatgtttagtgccctgcattattttgtgggtatccatgtttccatttggtgtcatttttcctcctgcttgaaagatttcctaggacatttctcttttatttagggatgaagtctcactatgttgcccaggctggtctagaactcctgagctcaagtgatcctcctgccttggcatcccaaag

SEQ ID NO: 76556 - DNA, 1022 bp, Homo sapiens
ttgatcttattttttaaatcttagaacatgtagtctacaaattttgaatcagcatatcattttgacatttatagtactaacagcaaagttgtttttttttctggtactgattttagcaactgaaagaaaaaatattatttcttagagaacttcctaaagccaggtgatgctattttcagatagccaaagaaccatgttttaaatcttttagtttatcctagacactttccccaatgaaataatattgtagcattggaaaaaaatattattggcaatgaaagctgctcttaagtatgtgaattcaaatcataccatatttttatttattttgggtggaaagagcaatctaatgatcttcagtaatcttttttcaataagttataagcataaatgagaaaagttatggttaaaaactgaggtttcaagaattaaagttggaaactcatctaaatgttaaatcatgtctaagttgcaaatttgtaagtatctcagagctcatagaagttgacagttgattaaagtactggctttttaaaaacagtttatttgtagtttggtactaaatttgttgtaaaatttttctttctcatcacattgacaaactatacatttgatgacatgtagtcttgatttatactgccttgttagatgcagccactatgatgtggtttgagaaacttcatgtgtggcttctttttgtggagaagaatataatctatccattgattgttctcaatgaactgagcagcagtgcagagacaattgctagtccaaagaaactgaatacagagtaagtatagtagtcttctaatattgtctgactactgggggctgttataaacaatgtcttaagttgttgatcaaatattaaataattgtttccttcatgcaaggcactgtgagattaaaaatttaggtgacattttgtccttgacttaccttttttaaacatttgtttctgctgttggcatattctgtactccagacatctcattgtcaattgatattttatgagaggacat

SEQ ID NO: 76557 - DNA, 1034 bp, Homo sapiens
tagcattattttttaataaatgaaggtacaaaacattttttcataatatgattatgaaattgatagaattaaacttctgtaaaaaattttctactcccacgatttcttagaagtattttctaaataatagtaagggttagtaaccacattgatatggaaagacagacttatggtatctgcaagttttagttttacccttgtggaaaattgaactctaacatctcttcccaagattaatatatgaattttaccaaatacatattagcaaatactgatttggctcctttgaaagcagcataccaggttgtactttatgtatgtctttctgttggtgaccccttaatgactgcccagtgatataccttcttttgtattcttctggtgaacctcagttctctaattgaggtaatctaaatgtgtctgctaggtttttgcgagggtttgtttggcatctgtgctcagatgaatgtcagtgtccttaactagttttcccatagattcagccatgctgtttattcaggctgctgtctcggccttcttctctactccactgaacccctttctgggaagtgcaatattcatcacttcatatgtccgacctgtgaaattctgggagagagactataagtgagtaaagtaaaacacttgaaaaacaatttttatctttcctactgggaaaaactattgacagcattattattagaatttatggttcataatttattgtgttgaaatatttatttttgctaaaacttaataaatagtcttaaaatttgaaaagtatataaaagaagaggccagaggaaattactttttatttttctttctttccttttttttttttcatacagggtctcattctgttgcccaggctggagtgcagtggtgcgtctctgctcactgcaacctccacctcctggggggctcaagtgatcctcctgcctcagcctcctgaatagcgaggactacaggcttgagccaccacgtcggttaattttggtattttttgtagagatggagtttgactgtgttgc

SEQ ID NO: 76558 - DNA, 1099 bp, Homo sapiens
tgggtgtggtggcgggcacctgtagtcccagctgaggcatgagagttgcttgaacccaggagatagaggttgcagtgagccgagattatgccatcgcactctagcatgggcgacagagtaagactctgtctctaaataaataaataataaaataaaataaatagaattgttttgaagttgctttgttgaatttatggttgtgattttaaagtattagatgttttttcatccagtaaggcctgaggtatattattatagtattcttaaaatatatatgtagaatattgagggggaataaaatactttttagtcagactaaaaagtgttttactatttatcattataaataattggaatttatttcattgagtaatctgagttaattgaaattgtaatttaatctgaattcttttttttttgtcttgttcatgttagggtatcatttattatgttacgacctcgtctaagctagaggagtggctagctaatgagacaatgcaggaaggacttcgtctgtgtgctgatcgcaattatgtcgatgtggacccgacctttaatccaaacattgatgaagactatgaccaccgactggcaggcatatctagggagagtttctgtgtgatttacctcaactggatagagtactgctcttcccgaagagcaaaggtagagtttatttcatttataactctttgaatccaggtttttccaaagatgcaaagaatgtccctgttagttcttatgaggtcagtttttcaagaccttcctctttctgatcttctggttaagataacctaactggttcattatggttgggccaaaccagctctgccaaaacaggttaaaggaagtggcctccctctttctttcatttgcagtgtcccagtctcactgtccaggtagcacctccttcatcctgggcatgtacaggcatgcacatacattcacattccatgcattaccctccaaaatctagtccttaagaaattctacctctgtctgccacacttaaggataattaaatgtctttgtcccaaatagaaagtctagaccagtgctggctaatggactttctgcagtgttggaaatatgctgtcac

SEQ ID NO: 76559 - DNA, 1048 bp, Homo sapiens
gcagtctttgtccagggtatttatacttctaatatagtaatatattagattcggggattctaaatctaaactgaatttcctaacatatacatccaaatgaatcagaattaagaaataccacatattttaaatttttttctgtgataactacatgttttccgttaagcttttcttagtttattttaacttataggctctttgcctgttgtttattttcatggactcactattacagtggtttataaataagggtcccaggtcggacaggccctgtctcttgtgattctggttcagggttctgacattagttcctggaatctgtattttcaaaacactcccaggtgattctgatgcacacgcagatgtaagaatcagtgtcatggaagacctttgtcaaaacatgtgaacttttatctccaatcttaacagtaatttagagtcattcctctatggattgcatgccctatttaaaggagatttccgtatttcttcaattcgagatgaatggatctttgctgacatggaattgctaagaaaagtagtagtccctgggatccgtatgtccattaaacttcatcaggtaagaagatgagatttttctaattcattactggtgtttactgatccttcttcacatgatttcaatattagtccattctcacgctgctgtaaggaatacccgagactgggtaatttataaaggaaagaggtttaattgactcacagttccacaggggtggggaggcctcaggaaacttacagtcatggcggaaggggaggcaaacacatccttcttcatatggtggcaacaaggagaagtgccaagcaaaagggggagaaccccttataaagccatcagatctcatgagaactcactcgctatcatgagaacagcagcatgggggtaactgctctcatgattcaattacctcccaccagttcccttccaggacacgtggggattatgggaactataattcaagatgagatttgggtgaggacacaaccacaccatatgagcttccaagttatgtttcttaggaacctt

SEQ ID NO: 76560 - DNA, 1092 bp, Homo sapiens
cacaaatgtcataaacattctttcaaccgtaaatatttatctctcatttctataaaagatgtctatagtcttatttatcagtgctttgccaagttaaaaaactaaattgactttattttacttgatactttaaatacagagcatgaagaaagagctgtgtagatacttattatttagcaacctgctaatgacaaagggaaattggctacctcctatttaaatgtgacctacttatatttgttccccgcttttcacaactggttatcataatatcttttgtattcctcccatttctgctcttctgtttctgtgaattttattcttggccccttaacctaattcccttgtgttctggttttcaggtgaataaggaatgtgtccgaggtctttgggcagggcaacagcaggagcttgtttttctacgtaaccgtaacccagagagaggtagcatccaaaatgcaaagcaagccctgagaaacatgataaactcatcttgtgatcaacctattggctacccaatctttgtctcacccctgacaacttcttactctgacagccacgaacagcttaaagacattcttgggggtcctatcagcttgggaaatatcaggaacttcatagtgtcaacctggcacaggtgagccaagggattgtattattcagtgctggtgtattcctgaccctcttaatctaggcagtgtgcatcacctgggaagcttgtagaaaaaattacaggtgccatggtacaatatgaacccattatttctgaacttcaagaagtagaatctgagcattcttatcttcaaaatcttattagataaatctgatgtataactggttaagaaccattgctccattacttggtagaatcttggaaaattccctttatttgtttaatttttttaactttctgttgtatattaccactattagaatatttgaatatttgttctgtacaaacgggaagttaagagaaaaacataacatgcaagttgattactttgtctagtttaccattctgttccaacactagggggagcactctgtacacattgaaacttgatggcaatgcagagatactactgccttttt

SEQ ID NO: 76561 - DNA, 1106 bp, Homo sapiens
gcctggtgacagcgagactccgtctcaaaaaaaaaaaaattccatttccagctgtgatcttaatggtacaactgagttatatacagttctttattatggtgcaggacagataatagagcatatgaaagatttgaggcagtgaatatgacgggtatagttcttaagccactctttgaaaacgtaatgagtttttttgttcctaatattgattgcaccataaagactttaaaaggtgaacattagtagcatttgcagttcagaatagctggaaaaagaataaaatacccattttgaagtgatcttggaataatgcttcctactctggtatttgttcctaggcttaggaaaggttgcggagctggatgtaacagtggtggcaatattgaagattctgatactggaggtgggacttcctgcactggtaacaatgcaacaactgccaacaatccccacagcaacgtgacccagggaagcattggaaatcctgggcagggatcaggaactggactccacccacctgtcacatcttatcctccaacactaggtaatgtgaaacaaagttatatgtctaatgttagcttcttagccatagaggctggttagtatatgtgtataaagaggattacatgtggtccacttggaaattcagaaatagaatttttttttttttttgagatggagtcttgctctggctggagtgcagtgtcacagtctcggctcactgcaagctccgcctcccgggttcatgccattcttctgcctcagcctcctgagtagctgggactaaggcccctgccaccacgcccggctatttttttgcatttttagtagagacagggtttcaccatgttagccaggatgttctccatctcctgacctcatgatctgcccgtctcggcctcccaaagtgctgggattacaggcgtgagccaccacacccagcccagaaatataattttttttattccaagttgtacattattccatttgttcatattattttatatatataaatatatattttatatatttgtatatatacttttaaaacttgataattcaacataaacattttaatatattaaggattctttgaaaatataatt

SEQ ID NO: 76562 - DNA, 2961 bp, Homo sapiens
aggaatttaaaaagtaattcctctctgtgaaaagcattttgtttgagattacataatttttcatcatcaagaaaaaaatgaattggaaatgtttttatttaccatgtagattgtggatcccagtcaaattctggaagggatcaacctgtctaaaaggaaagagctacagtggcctgatgaaggaatccggttaaaagctgggagaaatagctggaaagactggagtccgcaggagggcatggaaggccatgtaagttcttttacaagctggcggtctggggctctgccttttttgaagtccgcctcacttggatgcatggttttagctgatttatacttaaacgtataattttcagacaaaattgctactactaatcctaggtaggggtaagagtttgtgagtatattccaggtctccagtgctaacttcttgttttattctgaatcattaggtgattcaccgatgggtgccttgcagcagagatccaggtaccagatcccacatcgacaaggcagtgcttctggtccagattgatgataaatatgtgactgtaattgaaactggggtactagaacttggggctgaagtgtgagccagtgtttattataaagacatttctttttccctctcaattccaaggcattggaaaaagagaggaacaagcagaagatgcctgcaggtatcactttgatcctatgtgggagcgactgaaaatagaatgagcttggttaagcacctctcctttgcccttcaccctgactcctgtcactgtctccatccccaaataaagctgaaatatttttttaagttagctgccgagaaaacattttgcatgaaggataaagttctgttaaaatacatccttaaaaaaagtttttcctatgcattgcctatgctttaaatcaacaaactcttcatttctaaactatgatctcatatttttctaatttctttgccaaaaataattgccatgttttgtcatagaacatgaaattcatttaccttgatttttaagaacagaccagtgtagaaatgttccttttgacttatagcagtataaaagtttaatgtacagtgaaagagactatgaacagacatagatttatcttattccttgagcgctaaaaactttaataaaaaaaactgcactaattttttacagcaatgcactaaagtctgagatttctcagaacatttatttatatataaaaataaaataccattatttaaattgcctttgggattagccccttccctttccttataaacacaggtagcaggaactgtgctgctcatttttctgttagtagtgtgtacttcatgccaggacattgggtattttctttaaagtgaatatagaatctcaagatatacgtagcttcatcattgacatttcccagagccaatagtcagcggatcggtcttgtgaacaccactgccagctcctgtgtctacatctcagaggagcccatgtgctctgcttctctccaccagagcaagctctgctgggcgtgcttctgggaagaaaacaattttctttaagaagaagatgaatgtccaggaatttaaagaaaggatcgattgccttttatttatgagtttctagctcttgaagttattcacatgcagttcagttagtcaagtaaaattttttttcaaataaaagtatccaagtggtgcagttattattatatccctctttaataattttgctttttatttttcccctcttctttttctgttacttgaattttatttcctgtaatttatagtgtgtagctgtaaattgaaatatttataactgtgaaattgacttaattcatatgttgtctcataactttattttttttaaatgcatattcagggaaatatattactcatatttacaattgggcgatataggaacttcaatttagatttaatttgcaactcttagcattttttaaatccttgataaaattttcccttttggtgtgaaactccaaagaaaattgtacatctcctctgagcatttaggagcagccatctttctaccccttgtgaataaatcattgaaagaaacaggtaaaattaattttaatgatacattttgtttcacccagtatagtcaaagtattactatttcatcatatgtcactagccatatttcaagtactcaatagctacatgtacctagtggctactgtattagacagtacagatttaaagtatcttttgttgaggtgacagaagagagaagctgtttttcctaccaattctgatgtagatctcacattatagcataacattacagtagaaggaatgaaaactaagaaagtaaatagtgaacatacagaacttactgcatttccactttaaaacctatttattttccctttttctaattttaaacttttgtggtcattcagaacctaatgtgccttgtgttgacatttccatagacttcacactttacaaaatttactgtttaaaaatacttgtcaaatgatttactgaacctttatacaaaagtaccctttctaaattgaccatttaaaaatgtatttttgtgataccgtcattatgttctgcatttgcctcattttggcagatctacagtatgccattaaagtttagtgttgtttttggttttggagggtttttttctgaaactgaatttataatctatttctctgtatacgtatatttttaaaatcttctgaaaggaactatgttccctgctgcttcttccctttctgaagtgaatatgatcttttcatggtcattgcctagataaaagtagagccttttcaatcttagatggaagataattcattttcccacacagaaaaaaaatctgacctttacatgatttaatctgaagggctagaattttttaatttctagcccctcctccaaaaaaattttaaacacatcacatactctgaaaagtcagatttcaaatgcaagactagacttta

SEQ ID NO: 76563 - DNA, 1057 bp, Homo sapiens
atgattgaaaactttgctttttcttgtttaattcttccgccaccccctcttttgagagaaaggtaatcgtggaatgagttataaattattgcctttttttcctttatttctttcattcagtggcaaaaaacattttataactcctaagtttttggttaatcttccaacttataccttggtgtgaactctctttttacaccattttcaacactggataaaactttaatgttgactttttgctaaagaactttaatttttccaagaatctagattaacataagatgttgatatttaaggaacttggaagagtaagtggtgaggctgtatgtatattttttaagagattaccttttaggaaattagtgaacaaacttaaccagtgttctgccttctttgactttgttactggaggatgataatctatttctattagattcgaagtattttggaaaatatttcaagtatatctgaactacttataattcttaaaacagaagtagtcagacaatatttgtatcctaagtgagatatggaaaattactctgtatactaaatgtcaggcaatgaaaatgtaagtttttgtgtagaaaacccattaagaagatgtgtttttctttctgaattagtttatttttccatcacataccaaaatataaaaatcagcctcacatttttcagcaagtttagcttatagccttgataaattcctctgtgcttctgagcagcatccttctgcctctgcttagcagctctgcatttggtggattgctgttgtgagtcattcatccagcactgggccttttaagctgaagattcacccagtgtctaaagttgtccttttcttatagctagctttcaagcatctttcctcctaaataaatatgtgacttgagaaaaaggtaataatgattttgtcagaattctttgaatttatatttactagctacttaaccataaactgctgtccagattgttaatttcatttatatttattttaattaatttgtcatgaatatggacaaagccttttctggggtgtgtgtgtgtgtgtatgttt

SEQ ID NO: 76564 - DNA, 1610 bp, Homo sapiens
gtcattattcattcgtattctttttctgtgtaatgtaatcatataaagttactttggacagagacccagttaattttctcttttgataggatacatggtttagataaggtataaagtgtccctttttattctagaggcttttcctttaattcagagattagtggagataataacgtcagtcaaggctaatgtggtacatggaacttgctaatggaggttggacattctgtttcagtcttacatggatattgtttcattggtgttgaggaagaaaaaaattagatactaccatgcattgggacagcataattctaatattacattgaatatggctttttaaaaataagtattaaaaagccaatcgttttctccatttatctatcttttttgtttgtttttaatttggttgattgatatgcacccaggccgtcttatttttacttgttaaatgtctgtctaggaagaactgtgattggaaaggaattaattattatacaaataaatctggtaggatatgagtggagtaagtttgcttgaaacagaagtatattttctactttgaatcacctcaccagagtcatctgtcaagaattatgtataacaatttatctttattgcctacatacaacatactttttctgaattaagataacttctatttgtgagttgaacttcattatctgccattttgtggaatcaaccttacattctttggtggaactagagctgattgtcaccacaaggttatatgacaactctgttctaagacttatacctattatatagggttataccttttttcttatgcctcagctctgtacctgacaatttatgattcagtggagccaagctagaaggaacaaaggtcatctaacactgtgatggggatgaattcctgagttttacctgcacaatgaggtggtgccccggaattcacaacagagtagtgatagagcataagatggctgctccagatgactcttgggtttagtgtacttgtgattgaacaagattttttatctatgaagcttgattctacaaccaaaataatagaaatgggggggggggggggaatcatgtctgcttatgctttttaaaagcttatagtttaagtaaaagtaaaatgtaaaaactgattaaacctatacaagtctggcaatgagctctgcatgaggaaatggaaggaggaatattgaaaatgattctaggaaagtgaacgtaagaaaggaaaatgggttttccttttctgatcatgggctctggaaagtattcatggcctttaccagcattcagtataaaccagagataaggacatatgtacttacgtgtgtctgtgagtgtgtgtgtgtctgagtgttattctgaacagcttgtaaatattgtagttgtttaaaatggaaaataaaagctgagttcttttggcaaatatattgcatcaaaaatacagtattgacagtggataaaacactgaggaaataaattttttttcattttgccttctgtccattttttgtcaaactgagaaaaattagagtacactatattaagttctgtatggcatgttcacacttggttctgaaatcattttaaacaagctttggcctgtaaac

SEQ ID NO: 76565 - DNA, 1021 bp, Homo sapiens
agttcctgcttctgctcctcgagtttgaaattgcaattctggtacagtgaacttttaaaatctgaagtatcagtcagtgatagttgtgatttcattggaggagtctatggcaaggttgacttcaactccaggtaataattgcaaagcacctctctgatactttgtactgagattcatttaactcttcttttgtctctgtccttacactagtattttcaggcttctgcatttgctttgcttttgctttgaagtatgtgtgtaattttggtatagtgcccccatcttcattgtttaggaacttttaaaaaacactttctagtgagtttattgaagtcatagattgaagattgcttgagattagcagttttgtagacttcggggggatcttggttgagttgtgatgtatatatgttctatcttaagttgcaatctgaatttttagataaatgactgtttttctttttttaaaaatctgtttgagctgtgaaatgggagcatgaggagagctgaaatggtatgagagtggaatttgatggaaagtttgtcatgattaataatgtgactatgtgcctcttatcagtccttaccgttgtattatcattgttattggtccgtatcagtgcacaaatgaagtatgaatatcctgaagattttttgttgacatctcagatttgagccttttggttcactgaccatattagattttctctatggaagacaaatagactcattcccataataaagaactagagcgctgatagagcacacttttttttttcccctttggatcaaatcatggaagttcaaatctgaaaataaattcagaaatttctttttttccccatagcatccctatattcctaaccttttgagtggtgagtcaagcaatatttattgaatgctgctatctggcaggtgcacttttggtttctgtgattacagtgatgagcaagagtgtacctggccacatggaacttgtagtccagtgggaccatttgtagtaatattttctggcatggag

SEQ ID NO: 76566 - DNA, 1028 bp, Homo sapiens
agcagagaagaaacttccctgctggttgggtgaatgcccttgaggtgagggggtttccttcttccgggagagataagcattgtggtattctgccattgctcacacagaagtttgggtcttattctacagacagacgcagtaaaataagggtgttccactatcccttgagactgacaatctgaccttctatctgctgcacttctacttttttggtatgggaaatcaattggcctcattgaatttttgcttttagtttttttctatgcctagctaatcaaaaacaaaaacaaaacccacatgctttgatgacaccttgctttcaaaggttatatttaagttaattattcttaaatgatagctcatttatttttattcagtggactgttgatgagctctggagtgagtcttagaagcatgggaaagatttgtggcttctgggtcttttaaacatggatgatttgcataagggacagagcaacacagtgatttggtttgtgatcatgagggtacaaaaaaccatcagggcagatcttttaatggtaggtaatgttcaccagtcaacaaccattttctccttttattctggcctggagagagtaagataaccccatttgcaaatagaacagagtgttttcttaaaggcatagagagatgacaccaaaatgacatggagggatgtcaggagctgctttagctggcccgtagtaagtagtagtgcattggtgggtgtgccacaaagtcaggcgaagccatttctctttgcctctggagtctgggatgagaaatttcaacctgtagatttccaatttgttgcttgtcatgttgcactaagttctccctctaattaggatttagtatgcctaagttgaaattgcgggaagcaggcaattacataatgttagatttccctttttccaattcaggaaaggcaggagaatgtgtgcttgttatgaatgccagcttggggagggagaattgctggttcacacaaactcgggggtcactcaaaggcaacttgagcagaactg

SEQ ID NO: 76567 - DNA, 1076 bp, Homo sapiens
attgttctgaaggccattttcaaggtggtggttaaaagtgctgattttctgtggtttgggtgggatgtgtgtttggggaagcagtgagtgcttgagtagagaatcacatgaaccttgaggcttttctcctgggggagaatgctagatattgaggttgatgggtgatttgaagaagctcagtaggtgattctgttatgcttctcccccacccagttgaaaacacagtggcttttatataatttttagatctatgcttgacaataaggtaaataagtagtggacttaaaccagaatgcagccaactgaggattgtagaaacttcattttggatgggtaaaaaggagagcctctggatcttttgtagaggcccattgattcaaaaagataacttggaataactcctcaaatgactgccaacagtttaaagggtcagactgcttagactcctgcagtggagatgggacatgtacatgcaatttgataattgtatgttggcacttcttttaaaaaaattgtggtaaaaacagaaaaagttgaccatttcaaccatttttaagtatatagttcagtagtgttaagtatattcaccttgtcatgaaacagatttccaggactttttcatcttgcgaatctgaaactctgtaagcattaaacattggcccccatttccacctcccacagactctggcaaccatcattctttctgtttctatgaatctggctactttaggtaacctcatataagtggaatcatgtagtatttgtctgtgtctgaattatttgacttagcataaaatcctcaaggttcatcaatgtttgtagcatgtgacaggatttctatctttttaaaggtttaatagtattccgtcgtatgggtataccacattttgtttatccatttatctgtggatagatatttggcagttgtgattgttgctatgaacgtgggtgtgcagatatctcttcaagatcctgcttttaattattttgtgtatatacccagaagcgggattgctggatcatatgatagttttatttttaattttttgaggaacctccatactgtttttcgtagt

SEQ ID NO: 76568 - DNA, 1095 bp, Homo sapiens
gtcaactgcattttggtttccaaggagatatatcttggcaaaatttattttatcaagtgcttttctaagaaagagtaccaaaggaaactggctgtaatgccttttggttaagattttcctgaggacccagatagggtttttaaatcttggtttcttctactcccacacccaccccaaaagaatctggaaagctagttatgactagtcctgggtttgatattgattgctggagctttgaagagtcatataacccttctgcatcttcattcattcattcatttcttcattcacttaataagtcttcattgtttacctgttatgtatcaaataatccttgtaaaagggagaaaattgagggttgaattcagttttctttaagacctactgtaaaaattctataaatttattactatgatttagtaagatttaggcctttttatagatagtagaaatatttttgaaagaactgaagaaagaaatttagagtatttgtttttaactctaaaatattttagtgagaaaattctataatggtggataattttagtgttagttcattctgagctgaaaccaatcaacatttaaactcagctcagagtttttctttttaattttggtagtagacagttctgaatctaacctttctgttgttacaggtagcaccctggaaacttaatgcctgtttcagatgattggtataatgtgtgtgtaggagatttggaaatgcttgttacctcttctaggtgcttggttctgaatcttttagactatggtcatcttttatgtgtagtcgtcttgggataatggtaacatcatgtcactgaatgcagaacagtcacactgaagatctgagtgccattactgtgataattaagcaggtatttgctcatgctgccaaaaaagtaatattcagagttcctagtgtgagatttcatggctttataaagtgatattttcattttaacttgttggaaattcaacatagtattgactatacatgaaaagattcagttatgcaaagtaaaatgtaagaatttcctcccatgtcgattgttgcttttcgtaaatctggtttcagtgttaccaaagaacagt

SEQ ID NO: 76569 - DNA, 2152 bp, Homo sapiens
gaaatagggggatgttagaggtttctagcaatgctctataggtgagatatgatagcagctgtggaggtgatgagaagtgagtggtttctggatatatctcaaatggggctaaaatgattcactggtgggtgagatgatgtggagtgtgacaaagagtatactcaaggatgacaccgaggtgtttagcctgagcagctggaataatggggatgccatttattgaaatggagatgcctagaggagcaagtttgggtgtggtattaagagttgatctgtgcatgttgggtatgagatgcaagttgacttgccaagtggagcagtcaggtaggcagctgggcaggtctgtcagtcttcatgagctttagttttctcatctgtgaaatggggagagtgtctgcccttctcagaattcttgagatcaaatgagaaaaaaaaagttaaaacttgtaaagctgtgtcttacattatttctggaaagtagactggctaccatcttgtgtcctttgtggtctcctttgcactatttaactcataggccacattgtattgtggaaagttagcatatgccctccaaagcctggtttctttcccagtagatgtgaaagctttctctttgatccctcctgcaattcctgggcagcttctgggagaacttggtatgtatgtatttcagttatctccagggtgtcagagggcttcattttgtgtagaaccatacttgagagtgtggtaccagacttgcctcttaataaacatagctttgggccaaagtaatttatttaggtgggagggtattgtagtagaaaaatggctcttatctttctcaaattctttattttaggctttttccataacttgaatccattaacagatagggtctaataggtcagatgattttgggagaccgctcttcatgtttcttgattcagaaaacttatatattctagtttttttgactgctttactttttttcaggcaggtgaaatacattaagtatgtatttgaatctattgaattaaaatttgcttaggatccaccatgttgaaagcatcagtcttgtatttttatcagtgtcattttgaatttattaaatgtctgtcattagaggtagtagtaaatagttatatatttgaaatgtagtacttttataatctatactttcctaccagttgattgttcctttaagaatgtcttggctgggcgtggtggctcacgcctgtaatcccaagcgctttgggaggctgaggcgggcggatcacgagctcaggagatcaagaccatcctggctagcacggagaaaccccgtctctaccaaaaatacaaaaaattagccgggcgtggtagtgggcgcctgtagttccagctacttggcaggctgaggtaggagaatggagtgtgaacccaggaggcggagcttgcagtgagccaagatcgtgccactgcactctaccctgggcgacagagtgagactgtgtctcaaaagaaaaaaaaatgtctttagccaacagatgtggtggttttgggttcttctaatccacaagcagttttgaacagaaacactatcactcttcactgctgtcctcgtttgattatcagtcagcaaggttccactgggcatcagcagtgtgcgcccattgcaggtcctctgatttagaaaggtcctgacacatgcagtgaatataacttgatgactgccatctaagtaagtatggtaaccgttggaataccatctaagtaagcattctaagtgttcagtggaaagagaatggtaatcgctttaataatgaaggcctcagggaggtaggaaccatgtttttcaggagatatcatgggggcagaagttattttggatagttttcttatatgttttgagcaaaaggacctctctctacatgagggtttttgttaggtcttcagatttataaaataggtttacccatccgcttaataattgttaagttacatagtcttttgcttttcattgaattggcttactgtacattattttgtttcagcctctaagaaactgaaccataggtacccagtatattacttgacataattgttcataattgttgaagagaaacctcaaaccttgtctttcctttttaagtacatattagaaaattttggtcaattgtaacaactaatt

SEQ ID NO: 76570 - DNA, 1636 bp, Homo sapiens
cttatcagtatcttgtctcccttttccctctgggcaccagcccctgaacactagttttatccctgtctttctcatccttcaagacccaccttcttcattgatgtcttgctggttaccataacacaccctgatttctcccttctctgacatgttgttgtattgtgttgcgcacttaaagagcctagcacttaatgattaatgcatagttcatcaagggtgtttagcctggagaaaactcagaggggcatcatcctttgtcgcaggagtcaaaagtccatcaagtggaaggaggagaggttaccttttgtcttctcaggcctcacaggacagaaccaatgagtagagtaaatacagatatttgagtaaacattagaaaggactttgctggtccaggtgcttgcagttgtgataggctgtgtcccatcgttggaggccctaatgcataaggctggatcatttctggacagggtcattgtaaagggcgttcacatgattcacatgggctcagttacactagtgattatctgtctcgagtgtcacagtcatccgggggcatttaaatacacagattctcagcctccaccttgagagtttaggttgagcagtctgtgaagccaggcttggaaagttttgaattaggtggctcttttagtcctgagatcctatgaggctcatttggttactagatttttatttattttatttttatttattattattattttttgagacagagtctcactttgttgcctaggctggagtgcaatggtgtgatctcggctcactgcaacctccgcctcctgggttcaagcaattctccttcctcagcttcccgagtagctaggattacaggtgtgcaccaccacacccggcttctttttgtatttttagcagagatggcgtttcaccatgttggccaggctggtcttgaactcccaacctcaagtgatctgcctgccttggcctcccaaagtgctgggattacaggtgtgagccactgtgcatggccagattaccagatatttattgagtgcctgtattatatggcaatataaagtttttggtttttgccttcatggagcatagagtcaagggagtaatgcagacagagagctgaaaccatgtgatttctcctcaggtaggtatagattctctgaggatagagaccatttctctttttttcatggttctttatttgccccagaggaatgggcactttgggattccttcttgactggcaagatgattaacccgatgtttactgacaagccctccttgtggtagggcttagtactatgttctttatctaagtgttttctttacttttctttctttcttttttttttttttgggacaaagtctcgctctgtaggccaggctggagtgcagtggcatgatctcggctcaccgcaacctccgcctcctgggttcaagtgattctcctgcctcagcctcccgagtagctgggattacaggcactcaccacttcacccggctaattttttgtatttttagtagagacagggtttcaccatgttggccaggctggtcttaaactccggacctcaggtaatccgcctgcctcagcctgtaaaagtgctgggattataggcgtgagccaccgtgccaggcctat

SEQ ID NO: 76571 - DNA, 1037 bp, Homo sapiens
atatacctagtagtgggattgctgggttgaatgtagctctgttttaagctctttgagaaatctccaaactgctttccacagtggctgaactaatatacattcccaccaacagtgtataagagtcccctagaaatatacagatttttaaagagatgttgatggaagtgaagttaattgaaaataccgaaaatacaagtgtaagttcagtcttggcttttccaagtattcatctaggaagcatgttcagttgatcagacagaaatgaaattgctggtaaagttcttgtagttaacttagattatgatgggaaaggagtactttttttatacctgaacttttctattgagttttggactgtgtatgttttttgaatccagtatacccactttaaaccttacgtacagctcatttctccaaaccaaatatttgagatttctctttcatgtttataaatcctcaagatttttgctttggtttattagataaggatttttggtggtataataactaggttgggtggttttatcttaatctctcgtttgctttaatatttagttttatttaatctcctaagaacgaagattaattttaaaaaggattgttaaactttcgtggccaaagaaggccacgatgtgccttctaaatggcagagagctccaaaattatttaatgaattccactcctggtgcactcatttatagcaagatgtgcaaggaccttagcctatttatcatcctgttcttggtttaccattgcaacaataaatcaccttgattggttcaccttgacttcacgttacagacttttcatgttgacctgcttaagagtgtttgaaagctaccttttaaataatgtcctataaccacaataatccaacagtattgaggacatgccaccctcaaaccttggtccacccaccatcaatccacaaagtccgtttctaaatattacctaatattcatcatccactcagcaaatactttttgagctgtttcatgtcaggcgctggctgtggatgagctatgtatttcgtagat

SEQ ID NO: 76572 - DNA, 1329 bp, Homo sapiens
ccagggcccgggggtcactaacattagtgagacttgtcttgaatcactgtgccgagacaatgcatacttgtgctttggcagagcattgagatgcactgaatcattatcagtgtcattaagggccttcagaaacgtgtaagcgatctttataaagttttgcctttgagtattacctgaaaagtaccttgtgtagtttgacagtattagtcaaagatatcaaatgtcctttgtaagattctgttgccactttaaggaccagtattattaaccgctgattactttttccgtctttgccaagtaattgtataggacttaatctttataccaagaagagaattttaacatgcataatcacttctcagtgcttccagtctgcttttagtattagataatagtgtcctattttagttgcctgatgtgtctgtggttttaacgtgattatcttaccctgagggatggaggaaatcagtgaaaagttcactgctgctttgtgaattaagttatgccttggcacgaagtactgatcattttggcattcaaatacggcattagatcaccttgcctgcagttggggaatgttctgaaagtgctacctaacactgcaggattctccataaacttgagctggtatagaaaatgatgtttattgtatcctcttctcaaatatcttgccaagttactgtcatcagactctttattgatagaaaattagttaggcaaaaaccattttcttctccttgcatggcagaggtgatgaaatttatgagaaagtacatataagggaaggttcgaagtgttgattgtgaatataagccctggcttgaaacaaagaattcttggcttgtatggtggaatgttttgtgtgttgttttcttttcaatctcagctcttgtatgtggaaataatgaaatgaatatttgctatgagtgttggttggggttttttgttacagatactaagagttattctagtagtgtaagcagcaagtgatttattaagggtgatagctagtttagcagattgggcaggctgacaaaagagactgtactctgagtttctgggaatggttgccagttctgcactgtggaacaagcctgctgaggagctgctgctactgataaagtcagggtgctgcaaaccaggaacccaagcaagactcaccccccttcttccactttccctacataacaccgttctgaaggagccccatgtggtatgtctggttggtggaacctaattaacatgtctgcttgtatacccccaatttgcttatttgctttctttttttaaattctatattgggaagtgaggtttacacagtaaggaagt

SEQ ID NO: 76573 - DNA, 1090 bp, Homo sapiens
tgttgttgttgttgagacacagttttactctgtcacccacgctgcagtgcagtggtgccatcttggctcactgcaacctctgcctcctgggctcaagcaattcttgtgcctcagccttccaagtagctgggattacaggtgcacaccaccatgcccagctaatttttttttgtattattagtagagacgaggttttgttacattggccaggttggtctcgaactcctgacctcaagtgagtggtccaccttggcctcccaaagtactgggccataagccagtgtgcctggcctctattttttgtatttttgtagagacgggttttgccatgttgcccaggctggtcttgaactactgaactcaaaatgatctacctgcctggacctcccaaagtgctgggattacaggcatgagccactgtgcccggccaacactggtgctcttttatgtttcaaatgaatagtgggacatttatttttgaattttgaggaaaatgaatcacagaagtaagaattttgttcaaaataacacttggggtaaaaacacaccaagcatacctaattgaagttgtaagtttcacttggtaaaataagctgcaaaaatggaggggatttacacacagctctcttctattttagtcctctgggttgtttataaatttgctcatacataactcttttgctaaagcatttgccattacgtgtatagtcggtacaagttaagaattactaggaaacttcagtctggctcacttcatcatctccttcatgtctttgctcagacactgcctttgtagtgagtcttaccctgaccccgtcctgtttaagactgagcccacctgccctccattcattcctgaatccctttttcttaacagcctgtcctttttctttgcaatagcactgtattagtcaattcttgcactagtataaataaatacctgagactgggtaatttataaagaaagagatttaattgattcacggttccacaggctgtacaggaagcatgacagcttctggggaggcctcaggaaacttttagtcatggcagagggaagcaggcacgtcttgcatggctggagcaggag

SEQ ID NO: 76574 - DNA, 1070 bp, Homo sapiens
gtgaataagtctcatgagatctgatggttttataaagggcagttcccctgcacacgctctcttgcctgccgccatgtaagatgtcactttgctcttccttcaccttccgccatgattgtgtggtctccccagccatgtggaactgtgaatccactaaacctctttttctttataaattacccagtctcgggtatgtcattattagcagcatgagaacagactaatacaccttatatgtacatctcctccatataatttgtctattatggtttctatttatggtgtgtcatcttcttcagtagagcatatgaaggcagggacttttgtctgtttatatatccccaggatgaaaaataaaaagtgcctgccacatagtagataataaatgtgttgaatgaatgaacttggcaaaagcagctgctttttgggattcctactggtaaaatgacagattctcagtcctactggttgtttttttaattgacttaattgaggatggcaaaatcatcagttggtatataaagaaagtaagtgcatgagttgtgttgtatacagttttctggaacctccttgcttgtttggcaataaacagggaactcagattcagatgaagagtcatgagattatgcagatattatcaatggaactggttctttagatcttaaaatcgagagtactaaatgataaaaatgcatacagagattctcagatacagacttggacatgtagctgatttttaacataagtggtttaaaaggtttttgttgtcaacattgtggcccaaaaagttgagtttcagggtatgagggtactgtggtgatggaggatggatgaggaaggaagtgaaggcatcaagatctcccatcttgtgagagttgaacagtgcttcggggtcatctagatgtgagagtacatttctactaatctaaactttttacaaaatgctaaaacatgagacaaagcgataacatttaatgaagataaagcttataatgttctaaaggtttcagataagctgatggtagtcttctattgagttctagggcgtaaggtagtttatgaatggttat

SEQ ID NO: 76575 - DNA, 1109 bp, Homo sapiens
ttggtcagtatatactgggtgattgcctgacagaagagaatgagtatgctggctcaccttcctgtgtagacttgtgcactcagaattagtcagcttccaggaagcaattgggtggtaatgacttttagttgctatcagtatgcatagattcaaataaaaccttgggcattctgctctgaacaatacatttaaacaaaattctcaatttctttttttctcccgtatccagattaatttacttgaatagactcagaaacaacattatactttattgccatctacaaggagctgttttttgagatgacattcctcttagaggaatttacttctttttccaaaatttacaattcgctatttctgtctgtgttctacatttacgttttcagtacgtagaatttaaatattcatgtacattctgtcctagtgactaaggagcattatgtaaggaatttttcttcctctttcagtatattgacatcacattccttggcctagtattcattttgtgtttgtatttcagtgtaatcctaacaagtccattcaagcagtagttgaaccgaggttaagtggtattatggttgtttggcaagttatagccataaacacttacttttaaacacagaatggcctggggtgtctgtaatattcagttgcataatcacagattatgctttacaaacacaggaataagtacctgggtcacataaatcttcagtgagaaattgctccagaggatggagcctacatctgtagagttcccttgagtgttttcttaggtatattaacatttttcatttaattgaaatgtttctgattggatggaactgtggatagtattttagaatttccagataatctcctaacaaacatctaaaggaatgggttgaaatgttaccagtgttgggctgggtgcagtggcttatgcctgtaatcccagcactttgggaggccgatgcaggcggatcatgaggtcaggagatcgagaccatcctggctaacacggtgaaaccccatgtctactaaaaatacaaaaaattagccaggcatggtggcacgtgcctgtagtcccggctactcgggaggctgaggcaggagaatcacttgaaccc

SEQ ID NO: 76576 - DNA, 1121 bp, Homo sapiens
gggaggctgaggtgggagaattgcttgaacccaggaggctgaggcaggaaaatcgcttgaacccgggaggcagaggttgcagtgagctgagatcacgtcactggactccaccttgggtgacagagtgagactctgtctccaaaaaaaaaaaaaaaaagttaccagtatttaaaaatgtatatacttttcaaaattttatattttttctcctctcttcttccttcctgatacctttgtgatttgaaagctatttaaaatgaaaccctggttgggctcagtggctcatgcctgtaattctagcactttgggaggctgaggcaggaggattgcttgaggccaggagttcaagaccagcctgggtaacataatgaaatgtccctacaaaaagttaagaaaaaatccttagactcagttcaccctctgcacactggctggagtggagtttagagtcattctgtttgaaatgactggtaaagtgtccattcagggcagctctgctatgaatgcaaggaagtggtctttggagctcttgtgtagtatttgaaagtacttcgtgttactgcagacagccaaagaactgaaatagaatgcctgtgatcatgtttagaagatcccatgggcatattgtatattctttagaatgatgtcagtatttttgacaaaatttttttacttaactgccatttgcagtatttatcaggaaaccggagatatttgatataggactgtttttgtagtattttactaaatgcttttattgaacgattcattcttcaatttatcagtaagagttaattttttgtaattatttatatactcttatatgttttattccaactaattttgtcggtaaacttatttggagaaatcgtattcagttaaaagtattttcttgatagagccttcaaggttgcacactatagatttttatttatagtatttattattttttataaatctatagttttattaagacagaaactgacagtgtggtatgaagtttacatttaaacaaagttttcacagaaatctaaagtatattatttttaatttttaattttagtaaagtggtcatgcctggtttaaattgtaagtaaatagtaatacaaggcttggaaaga

SEQ ID NO: 76577 - DNA, 1148 bp, Homo sapiens
tttttgagatggagtctggcactgtcgcctgggctggagtccagtggcgtgatcttggctcactgcaacctccgcctcccgggttcaagtgattctcctgcctcagccttccgagtagctgggattacaggtgcccaccacggtgcccggctaattttttgtattttcagtagagacggggtttcactgtgttagccaggatggtctcaatctcctgacctcgtgatccgccctccttgtcctcccaaagtgctgggattacaggcatgagccaccatgcctggccccaatatgacttatttaatgagtttggaatccccctcaccccgcccttcatattcgtatatttgaaagaagctagattatagagggaaagataaatttataatgattttgctaattttgtgataatggtgatgggtatattaaaaatagtttaaaaaatggaaaatagagttatataactgaatgtttgtatttgttgacataaagtatagacagctttagcacttgaaaaatcgggtggattcttgttttagaagctgttccagtgaattccctttccttatgatctttttgtcctagaaatattcaaaataatctttatcataaagtaacattattattgaattgaacagacttactttggtcctttgttggcaactgcattgtggtgattttctgtatttctgatagactgtgtgtgctggtcaggttgttaattcttggtgccctcttctctgtgaatatatttctggtatgataaccttactatctttctatgcctaattcctttttgaatccatgatacccattgtgatattatgaaaataactgcatttacagattttagagatggggtagtactgtctgagttctgctttatcctattttctctttttttgtttaaatttttgaggttctttttaaaagtcatcagtactgcatagtaaatgaagaatgtctttgaattccttgagtgtgcttaaatgtgagaatgtttctacttgtaagaggaagccaatccaagttaacatttttttctgctaattaaagtttagaattttaatcaagtaatacttagcaataattatgctgtctagttagaatagtgttagaggacagtggtaatttctggattaggtgct

SEQ ID NO: 76578 - DNA, 1178 bp, Homo sapiens
tgtggtttgaatttaaggtaagtttctaacacatggaatatgaagttcaaatactcaacatgccttttttggtggtaaactgctattgaaatatgggcccatttggtctaaattaaactcattctttggatattctctaaaatcttaaaaccgccagtaatctcacatttaactggcatgtcttctgtagtcagcctgacccgcgtttccttttgactgtctccttcagatcggtagggactttcagcattgctgtaatggacttgtgttgtttaattcagctttttgctctttatctggaagcactctggctgtgatgtggggaatgaaaggtattgaggagagtcagggttaatcggacttgtggagaggacagcgataaaggactcttgtaataaaggaggatgttagaatccaggagagggtgtcattgttaagacacatctttcaacagttggaaaccttttaaaatatttttaaggcacaacccagagtactaaaaaaggatgccttgaaactaccgatgccccagattaaaagctttctccctcagaagttctgattaaaattggtcgtgctctcagaagtgcccaacagggtagagacagtcttcctcaacatggtcaaggtcataactcacaattttactgactctgattattctggggaccataggccttgtctttggtggagtgaggactaaaggaaagtaggtaggtgtgggtatggcctccatcccagagtcttctctgcaacagttgctggtttttagtttttgctgctgattactgaaaaatttagtgctacagatgttaaaacaaaagctcctcgaggatagggacttggttttgttccctaataaaacctctattgaatagctctatccaatagatgtatgctgtgccttcattatatttaaatatttctagttgcattaagacaaagtaaaaagaaaagtgaatttaattttaataatatattttatttcatctgatttatgtgaaatattatctcaacatataatacatataaaaaattatagagatgctttactttcttttgtacattcttttttttttttttttttttgaaacaagtcttgctctgttgcctgggctggagtgcagtggcgcaatctcggctcactgcaacttctgactccctggttcaagtgattc

SEQ ID NO: 76579 - DNA, 1096 bp, Homo sapiens
cactctgcagagcaaggtgtgttgttaactgagatatcagtgcacagcacatacttcatacaaggtgttcaaatatttgaatttgtgagaaatgactctggtgtgcagaaaatggcatttattgagaaggcctaaaatatgatttttaattttccctaagtcagtagatactgcaaaatactttgttcattattgttcattttaggataatgtaccacaagtttgaaaaagtaatgcaaaaattattcaataaaagatacagacgcaggtttttgtcaaagcagaatctaccatctagactttaattgacccaagctacaaagaagttaagtctaatttatcttatgtatttgggagatcattcacaaggaattatctgcaaaaccacatgaatattattatctactgtgtacattaaggatttaagagtgcatagcttctacacatactttagcttttcttttcatagcctggggaaatgctatgaatgcacctaactgagattttaacgtaattgaagcttaccctttccgtgtcaaattccagactctagaggcactttgttggcccacacgtcacacgtgctcttcttttttaataggataacttaggatccgcatggatagagagaatgagaggctaaagatatttcctgcagaaaatggtagaagcttaaatacacgattgcatgagtgacagtctgaaagtctctgaaagtggttgtcagccctggctgaacatcagaatcatctgtggagctttaggatcttaaagctggccagatttatttgtttttaaatcaaaaccctccctagtgctacctacattttagccaggattcaaatttttcattgaagaactttctgaggtttgttgattctgtagtcatagtgtgtcatatgtattttttaccaccttacctatataaataggtttttagtttttgttgttgtttggtagagatagggtcttgctgtgttgcccaggctggtctcgaactcctaggctcaagcattccttctagctcgacctctcgaagtgctgggattacaggcatgagccaccgtgcctgacctgtttattagaattgatttct

SEQ ID NO: 76580 - DNA, 1042 bp, Homo sapiens
tatgagaacagttcatatgaacaagaattaggtgttttatttgacaacagatttaaaatgatccaggtcctgtagttctgtaaaggtcagtgctagccaagaaatagcatgttctgctctgagaacttaatgtgcctatggtactctaccatggttagagaacatgggggttctttttgtcgtcttctgaccaactagagtacattctaaagagtgactctctaaggagagtacattttaaggagagagggagacagtttcagaaaggaattcaagtaatgccaggttgggaggaccgtagcaagtgattctgaggaaagaaggcacagggaggacattgtggttgtccagtgtgtagtagtagatcaaggtgtattgagcagattcttgcagagttgagaagtagactgctgtactggttctctttccattctaagattccacgctgttaaagattatctgaagccattcagcatcaggtgggtataagaggaccctgaggatgattttcagcctatgtccatttaggtttggaggaagagtatccacccattctccttgccctcaagtctcaactctccaagcaagaggaagccagagaggcttggggagcgcaggaaagctataaatcccaatacccattatctcctgaggacagacagtctccggtgcaggcagatgcttcaggagttccccataatctgtaggatggaagctgagtgccttaatatggcagaggccctctggatgtggcttctgccttctctgttgatcgctttcttctcactcgcctgtcaccgagccttgtttgttctagtggtagtgaagtccttgcataatgtgatttcttgcctttcagtgccttgctgtttcttctccctaaacattcctctgatttgctgaatacattcttattttcctctcaggaccagcttaaaagttaacatctgtagagtttttctgctttgctcaagttagttacttcataacacatacctctgttacagtactattgaaacttttttttttgaggagtctcgct

SEQ ID NO: 76581 - DNA, 1037 bp, Homo sapiens
cattcagtaatttttcaatgaatgagtataattctcacttgccttaccatattgatactttattgtggctgtggctttggaatttaacatcatgagatataataaatacatagttgaacttaccgattggttgatttaaacctttgaagtgtgtaagagtgtacttttcttgactcccttattaaatattccaataggatatcgatatatggaggggcattcctagtttctagcaagaccacgttgtattttggattaccttcttttaatagtactccttaaaaattgtcaagttattataatattttcaataagaaacacatcttaggtctaaaaaagggtaaaatgaggctaaggaaaatttaaaataagtaattgtgtaaagaaagatgatattaatatgcatttgaaagtgcaggaaatctgtggtaagaaatgttccaaattaaattgggtgtacactatggacaactaaagaacagattgtgttctgatatggtgtggagctcatagtttgccaaagccgatttgtaaagtcttattggaccacactcatgctagcaggacttgctttagtaatagctttgtggctgggcgtggaggctcatgtctgtaatcccagcactttgggaggctgaggcaggaggatcagatgaggcaagacgttcaagaccagcttgggcaacatagcaaaacctagtctctatcttccccacaccccaccaaaaaaaacttcagctgggattggtggcatgtacctgaagtcccagctacttgggaggctgagatgggaggattacttgagtctgtgaggtcaagactgcagtgagccatgatcatgctactgcatttaagcctgggtgatacagcaagaccccatctctaaaaaaataagaaataatagcttcgtagttcaggtaacaccagtggtctggttatccagggctgatcagatcctggaaaatctgatatgcttaaacagaattttttgaatattgatgtctactagaaagtcacttgttaacaagcaatgagag

SEQ ID NO: 76582 - DNA, 1151 bp, Homo sapiens
ctttcttttgttcaggcagccttttaatcataaaagccactatttcatcttgtttgtacatcttatgtaagtacacaggcatttttagcatcttaggtggcagagtttgtgttctacttttaattgacctttataagatgtgacaaattcccacacagagtttctttttttcttgaaaggttgatggcctaactggaattaaataaccaaaaaaaaaaattttttttttttttttttttttttgagacggagtctcgctcttttgctcaggccggactgcagtggcgctatctctgctcactgcaacctccgcctcctgggttcacgccattctcctgcctcagcctcccgaatggctgggactacaggcgcctgccactgcacccggctaattttttgtatttttagtagagacggggtttcaccgtgttagcataaataaccaaaatttaattgcatttctttagattaattttcaaaggttattatgttccaggtattacttgaaagttctgaactatttttgtgcataaaattatgttttcactacaatcatggcaatattttttgtcaacagcggttcacctagtgaatgttgatactttgggtttgagtgaaaatgaattgtagcattttcttttgcattaataaataccgtactcacttaaactacctgatagaactacaagtcctccaagtttcattcagattaatgtattccctgtatttaaaagtagatagttacacatgagcagtgactccgagtgacacgccttgtgtggctgacactcttgggatgctgagatttgatgatcatctttgtaatctcggaatgactgatagcacacaagttcatggatgccagaaatgatgtagaagtaggcacctgagttccctggctttctgaagggtgaggccaaagctagatgacagacaccagatagatagtaaggacaaagtagaactttgtggtcttttgctgtccttgaagtggtacctatttacactttgtgtccttgctgcttttacatatctttctctgtgaattaggttgtgaacttttcaaaaggaagttcaagatcatcatgatctttggagctccacagctttttgctcagaaccttatacccaatagatgtttcataagtgtt

SEQ ID NO: 76583 - DNA, 1053 bp, Homo sapiens
ccacttcttaatttatcttgggtaaattttttttttttttttgagacaaggtttctctctgtctcccaggctggagtgcagtggtgcaacctcagctctctgtaacctccgcctcccgggttcaagtgattctcttgcctcagcctcctgagtaggtgggattacaggtgtgaaccatcacacctgaccaatttttgtatttttagtagagatagggtttcaccatattggccaggctggtcttgaattcttggccttatgtgatctgcccgccttggcctctcaaagtgctgggattacaggcatgagtcactgttcctggccttgggtaagatttaaaacttcactgattattatactccttcctaaaatagagataatgcccatgtcctaggattgttgtattggttatgtgatgtaaagaatatgtgcctggcatattggagacactatcattattatttataagggaaattacttaattggaagacaattagatatttggtatttaaaattaatatcaaggaggaagtttctagatgtcctagattttatttttactattataatagtatttgtggttattgaggactgtgtgaacagttttataactgccgctgtccccctctccctccacatttggaataggtagccatctttaaaataacatgtaaagatgcacgtttttgagagaccttcacatgaataatgaaaagcttctgaatataattatatatattgaaatatgtgcccctattaatgccacttatatgttcattgtagatcatctgtctccattcttcttaaactgggtatctttcatagcagtgccaaacagacttttcatgtacttctctgcctcaatattttctttttgagtttaagttttagaagtaccaattcatattccttctttttgctagcacagtgtacctattagttatttacatatatgtataatgagtttgaaaaatgttacataaaaagaatcttggcctggcgcggtggctcacgcctgtaatcccagcactttgggaggccaaggcaggtgga

SEQ ID NO: 76584 - DNA, 1388 bp, Homo sapiens
gtaccatgttgcccactttcttgactgtctcatatatttaaaatttgctaatagtggatttgaacaaaagtctaaaggaaggaatcagaaaataaagaagagagaacatgaactatgtggatgtagttggaggtcagggtaggaattgtgcagagctcagccccaccccctactgtccctatttgacttaaaaagttgggtgacatgagcatttttgaagacctggcttctgagacagcaggtcacacggcagaactggagaagaagcttgggagaagcttgcatttgccagttgatcatgaattgctaatgtttctcgaagggcttaggaaacagtgatggggattttattttaaaacctggacttcattttaatgtttgtcaatccctcagcatattttatatataagaggaagttgtaaatgtcttcactagtatttaagtgcctttccccaaaaccatgtatggaaaattaaggccatatggtgggtaaagtcttaaatgtggggaagttcagcatgccacgttctggagcttttggtgctcctgcggggagggctttattgtatctttttggaaaagatttttaataagcaggagaatgtagcgttgaatgtccttggcttgaaggccattactactcacatctgcacaaaatgggccaaggtcttcagtgagtagatgataagggaaacacagtggtatgggtgggcagcccttccgcctgatatcagcctctcagagcaggggtgtttcctgaaccgttgctgtctcagcacatgactagccttgagttctgcctgtaatagtttccttaattaaaacggtctgattggcactctggatgagcgttcagtaggttaaatagtgaatggttgctgtagagctaacggactttgttttctttcagggttttttttttttttaagtctatagcttaattcagtaactgacccttgtctgctaccgaccagtgtttttttccagtcaactgaaaagtaaatgttttgagaaattgactaggtaacatttgataaatatctgtctttgtgtagggactttcagggctgttctggcctgaaatgaaagcttttgggccaggggtgatggcccacacctgtaatcctgtaatttgaaaggctcaaggaggatctctcttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggtgcccgccaccacgcccggctaattttttgtatttttagtagagacggggtttcaccttgttagccagga

SEQ ID NO: 76585 - DNA, 1055 bp, Homo sapiens
atcttttaagaaaataaaaaactgtaatacttattttatcaataaattattttcagaagctttggtttttgaagttatcagtcttcatatgccacttctttctccacaatagttacgtctgttccattttatctctacaatcctctagctggagatctcatcagtattctgagcctcactctattcatctaacaaatggggctaataagccaggagcccagcagggtttttgggagcatgaggttgtcagtgcagtgcctcataggaaacaagctgcacgggaccagagaaatcacttaatccagccttctcctataacagatgagaaaactgaggctgagtgtcacataatgtgtagcttctctcccttttgtttgtgcttaactaatatctttctcagttgtgggatcactttgcgactctgcttcttgagaaaccacaggggcagcttttgcacagggcattttccttgcttgcaatttctctttcttttcaccacctgtcaagtcaccttgccctccctttgaaacacattcaaattcatttcctcagggaggcttttctagttcatccttaaagatgggtatttcaaatcctgatcaactcagttttatccttcactgtggaaatgtgaaggacctattattgatattattataaaggtcctatatagatatacatatacacttatattttttgttatttagggaaaaaaaacttcttgagaacaaatttgttagcagcgcagtgttatttgtgtattttgaaagggacagtttcagttgatgagataattaaatgcacgatatgcttttagcatgttaactcctactcacagatccttgttctgcttttcatacaatcagctttcaagctagtagtccagagctaaggattatgttaaataagttagaagaaaaccacccactgctaattcacatcttttcatatgggtgaatattcttgcaactttcccctactgtgctttcttccacactatgaaaagaggcaaataaagtaaaaatgtcaagtagcagtatacactcctaaagata

SEQ ID NO: 76586 - DNA, 2235 bp, Homo sapiens
gttttttccagtgggtttgtattttgtcgtttatggtaatttttgctatatatgaatttatttttggatcatcaggtttattactattctacttcatggttttggaattttatgtcttacttaggtcttaggctcttcaagattatgaaaaaatatcttgcttttaatactttgtggggttttatgtttaagactttaaatcaatttgggatttattttaatgtgagttggtatcccatcctcttttccatgtggctgtatagttgtgccagcaccatttattgaacaatttatcttttccacactgatgtcacattttatcttatcaaattcctgaagtctttttagaatgtttgttgtatccattgatttgatggcttgttcatgaaccagttttagaccttttaaattattatatatttataacatattttatactatctggcaaatattaaagctggtcccccttattactcttcttttttataattgccctcattgttcttgtttattttccatataaactacagacataccttctgaattttttttttttttttttttttgagacagagtctcactctgtcacccaggctggagtgcagtggcacgatctcggctcactgcaacctctatcgcccgggttcaagtgattctcctgcctcagtctctggagtagctgggactacaggtgcgtgccaccatgcctggctaattttttgtatttttagtagagacggggtttcaccgtcttagacagggtggtctcaatctcttgatctcgtgatctgcctgccttggcctcccaaagtgctgggattacaggcatgagctgctgcacccggccagcttttgaatttctaaaagaatatcctgataatcttattgggattgcgttaaatttacttattaatttaaaatttttaaagcattgatcctctaagaatttgttttgtgtagctcaaatatttctcatctgcttttaaaaaaaagttgattttacaaaatttgctgggagtggtaggggcggctcatgcctgtaatcttagcacttttggaggccgaggcaggaggattgcttgagcccaggagttcaaaaccagcctgggcgatagtgagaccctgtctcttagaaactacatatatattttacaaatttatttttctttgaggcagagtctcgttctgtcacccaggctggagtccagtagcatgatctcgacttgttgcaacctctgcctctgtggttcgaggtatttcggggtgcctcagccacttaagtagctaggattacaggtgtgtttcacttcacttagcaaatttttgtatttttggtagtttcaccatgttggccaggctggtctcgaactcctagcctcaagtgatctgcccgcctggacttcccaaagtgctgggattccaggcgtaagacaccgcgcctggcttattgtacaagcatttcattactgatactacagagagcagttactcatcatactacctctatcacaacaaacatttctgttttccctttacttttagtgatgctgaatcatattttagggcctttattattatatattctgtaattagcaaggcatcatgcatacagtaggtaaaagtttagagagcttgtccataccactgtgggatcctcaataggaagtaatttggaagtatctattgaaatttaaaatatacacaggcatgtaccgtaactctttagttgtttactcagcatctatcctaaagaaaacatgggccgtgactcacatactgtttttttcagtaccttctgtcacccttgttatctccttacattttagccattaaattctgttaaagaagatgtgaaaccttttagaagtggttcatagcccatgctgtgcacttttaatttgattctctaccttactttttagttaaacaaaacaaaacaaaacaaaacaaaactcgtcaccatagtaattctttagatgttagaatcagctaggtatgcttttttttctctcaaacttctttaatcatcacccacatttcaccccagttccgataattccctctttccctgttgaaaatcaccataatgagccttggcccccgattgcacgtccttgatgagtgtgttggggacagaagtactctcaatcccctgtggccttcctgctcttgttcccactcctgaccagcccacataatgaatcctgttctcaaagcaaagatcatctccaccca

SEQ ID NO: 76587 - DNA, 1021 bp, Homo sapiens
tacagaaatactaggagagcaggttttttttttgccctctgctttcctgcttactgttttttgatttgatttaactaatgtggttttagctgaagagagcctttccaagagctcacctgtggtaccctgaggaggagttgagctgtcatcactctaacccaggaagacctcatggagaggagggcaacacaaaggatggctagtttctcagatgaatttctgtttcagcaactggcttctcaggcttcattgaactcaaaattaaacccaagcctctttttatactgttaagaaatgtgctgcagacaggagggggaaagtcagtatttaattctctcttcttcactaccgtcttcttcactaccactcctctccctcttcttcactgccaccaccccttgcaaggaaaaggtaggtggagcattctgtgtttgtcataaatttaatgattctgaaatgttggaaatagaaaacagatgttttaatggggtgatacccacattggaaagcatcaaggtcaaaatatattttatgagtcaactttaatttgattaataacttaaaaccctctaccatagtatatgctactttattttcataactactcatgagtatggaatggaaaacattaatttatctttctaagaaaagtatttggctggaggagaaaagaatattaaagtgtcatggacattataaaatttggtagcacagtcttttttcccctacatttttagtttcagttcactgtttctgttgtttctaaatattttaccactaatgaaaaccttatttaggtaaaacgttttcttttgatttaaaagatttttgttgaattccttgcccagatgtgagagaagtgtctacatctattcaaactttaactttgggtcttagaggtgatgaatcacttggcagaacaaccatgagatgttgaataatctcatgatttggttgacttatttttagaagccactccctattaactcatttaattcctgttatacgggaagagggacag

SEQ ID NO: 76588 - DNA, 1350 bp, Homo sapiens
tcgcgtcactgtactccagcctggatgacagagcaagactctgtctcaaaaaaaaaaaaaaaaaaaaaaaaaaagaagtaacttaaactgtaaaatcttgcgggctaattaaaaaaattcagaacatatagtattgacattctcttccttttgcattagaaagggtcagtatcctaaattatttaataatgtatgtcttttccagccaagatttcatttacttgattcaaagcccagagtatagatggaagcataagaaggtttgccaaagcatggaagagtaatgagatttttcccctggcaacttggaatttatttttttaaattatagtaattaacatgaaaaatgttattttgttaacatctaatgaagagaaagttgaaataaatggagaaatgtctataaatttttttctttgtgttgtactttttttcttttgtctataaatattaagttttttctgatagggcaaaataggaaaataggagaaaacagtgattgtttaaagatttgatgattggctaagtgtggtggctcatgcctgtaatccccacactttgggaggctgaggtgggaggattgcgtaagcttaggactttgagaccagcctgggcaacatagtgagaccttgtctctataaaaaaaataataaaataaaaattagccaagcgtgatggcatgtgcctgtggtcctagccacttgggaggctgagatgggaagatcacttgagcccaggaggtcaaggctgcagtgagctataattatgccattctactccagcctgggtaacaaaacaagactgtgtctcttaaaacaaacaaacaaaaagatttgataatcataaaagagcctatgtttttgtgacgtcttacattttcttaaggataatgtatggcatgttgcacattgagatggttattggaatatcatttagaaacctctggacataattcatgttggaaccagtttacagtattagttagggaggtaaactttgtgcttacagtgcctgtgttcaaaatgtcctgagattcggtttttattctgtaagaaatctcagtgttactctgtctgaaaatatttagcctttcagaattccattttataattttgtagtccagtatctagtgtgaaggaggtaattgttgcatcatacacaagactttagtgatattctaggtacttgtctgttgctgatcatattttttataaaagtaatttttggggctaatcaatacacgaattctggaaactggtaatatttaatcattgataaagaattttatctttttgtgcttgtttgtatttatagttccttgtaatcctttttatgggcttttgaataaat

SEQ ID NO: 76589 - DNA, 1910 bp, Homo sapiens
ttctgttacagaggtgccacactgtcccccactggggacccactgtcatcctcttgctgcaaataacttgcataggaatccccctctccacaggtctgtggagtacattccttggcacctgcctaggtagaagggagaagagcctagagtcacacatgttgtatcttggacccataggagataaatagtatgtgaagtccagacaatcttgtttttcttcatttattagtttctgtccaggcaatcctatcacagccactaaagcaaagcagaacaaaaacatttgtgaaggttagatgtcagcggtgttaggatgttccatgtcttatgttcagttaccctgaagtctagtttctgcatatacctagcaagtacattagccaattcacgttctcgaaagtaataccgattgttgcctcttaggtgctcagagcgtttacaaatagcacggagctacagcccttcccacctctctgtgaacacaaagaatgatttcatttacttcaatgagaacactataaaattctcaatcaaattagcattcactctcaaaaaataaaagtattccattcagtacttttttggggggttataggatagcgttttgaaatcagagcaacttcagaagaaggtaaaaagttcccagactctcctaattcatggttctcagaatagggaatgaatatccaccgaatttttcaatgcctgagaccatttcctatctacagttcccagattggcatttcttttgctcatcctgggagcttggttgtggtttacttttttgtaaagacagtaagtgttctcagtgtgactgtgaaaagcaagactgacctctttccctttggtccctggagaatggtgtcatgaggtgtttttgagccaggcccaggtaggtgtctgctgctccctcttattggcactgagagaacatagttggaccctttagactttctacctgcatactgttgagttggagtttttgtattatgtgaaggagtcacaaaggatactctcagctttggaatgttataaagaagctgatgaagtgctctttgccactaaagcctgtatagggagctactagctagtgcttgttctgtgcctagaagagacagttcctaaacatgggaagatacctccaccccaggaccaggtggttccaggtggttctaggctgagcaaaagctaacagataccacatttaagtataaaatatttgtgatatgaactttagaagcattttatttggagaaagaaaacatgttcatatgaaataattatagttagtggaagacaacatgcaatctaattgcttcattgacagtttctacttatcctggcgtaagaaaaaatccatttattaagctgaaaatcttctgatgtcatagaaagaaggaaaactttgttctttcaaaattgtgacctcctgtatatttcctgatatgtagagaactctcaattgtctgaggccttggtgagagagtaggattagaatcagaattcactttttttgtcttaagatgagagaagttatcagctggagctgaaatttaatcttgtttagctacactgatcactgtttctttctcgggaattttattttaaaataaagtctaagtttttttttttaattcttgtatctagaaacaaagtctgattttagcctggcagaatttgtctgtactaattttagtttttagatgtgcatgggaagagagactggataatctctctcaaatcggttgtactggtggttcacttaagtgcatatgtactatatggagtcatgcatttgatattaatattacacaattatctctcaaatgtaaaacactctcagtgtaaatatttccaacatttgttgattgtaacatttggatgacaaatatttcttactcgaattacta

SEQ ID NO: 76590 - DNA, 2722 bp, Homo sapiens
tggagacagagccttgctctgttgctcaggttggagtgcagtggcccagtcatagctcactgtagccatgacctccttgggctggagtgctctttcgtctcagcctcctgagtagctgggtctacaggcatttgccaccatgcccaactaattttgttatttttgtagaagatggaatctcactgtgttgcccaggctgatcttggacttctgggctaaagtgatcctcccactttggcctcataaagtattgggattacaggcatgagacaccatgcctggctcacactttttgtttattttaaaggaattgttttttgccaactaagtaagtaaaagaagctgattttagctaattcagaaaataggaatcaaaaaagaaaccatgctcatttgggtttctaatatttttttcttatatttcttttactctttttctatgcatatgtattttctaaaacaaaattggaattctattgtatgtatgttttgtattctgctttttatgtttagcataccttttgaattttttatcttatttaaataatttttagaggctggatatggtggctcacacctgtaatcccagctctttgtgaggctgaggcaggaggatcgcttgagcccaggagttccaggctgcagctgagttatgatcatgccactgcacttcagcttgggcgacagagcgagacactgtctctaaaaatataaagaaagaaagaatttactatttcatcttgttatatatttgtgtaatcacttgttacaaatcagtcttcagtgtttttttgtgtgtgtgcatttttatataaatgcttgattgttttcttaggataattatctaggataagaattattaggtcagagtgtctgaatgactttttctgttgcagtcccaaattctccttctgaaacagtaaggggtgaaactcttgccttttcttcatctctccttgacaaaccatatttgaaaatacatttccaattgagttaagtagatcctgcaaataaagagagatgggctctgtttttttttttgtttttttttttttttttttttttgagacaggcccttgctttgtttcccaggctggagtgcagtggcatgatcatggctcactgcaaccttgacctcccaggctcaagtgattctcctatctcggccccctgagtagctgggactacaggcatgcaccaccatgctcagctaattacattttttttttttggtagagatagggtctcactgtgttgcccaggctggtcttgaactcctgggcaagtgatcctcctgccttagcctcccaaagtgttggcattacaggcatgagccaccacgcttatcctctgttagcttttatgttagtattgtagtgaaaggaaaatttgtaggatataataaagaacaaagcttgaaaataactttattcaaatgttcatagcctaaataagaggcagtttagatctactcagctggatttgctgtgggacccctaacaagcctatggtgctatggtgtacttgggtttcacagctcactttagggttgccttttaaaattgatggcagatgcttcctaagagttctgattattctgccagtgcaaaattatggggatgctatttggtgtcactaggtagtggatactttactatggtttacttaatctgattttttaaaagcatgtactgtggatttttttttttttttttttgagacagggtctcactctgttgcccaggctggagtgcagtggcatgatctctgctgactgcagcctctgtcttctgtgcttaagtgatttttgtgcctcaggctcctaagtagctgggactacaggtgtgtgccaccacacctggctaattttttttgtatttttttagtagagacgggattttaccatgttgctcaggctggtctcgaactcctgagctctggcaatccgcctgcctctgcctcccaaaatgctaggattacaggtgtgagccaccatgcctggcctactattgatttttttgttagagtggtatccagaatattcatttaatgtgcatagttatttgactaatggctcattgtgaaagttcatggtattccaaggtttgttgagcccctctggtcagtgacaatgcaagacatttagctttctgttctgtggccagagatattttcttgtggcttccagaacagtcctgtgaggagggtgatggagcaagtggatgtcatctccgttttgtagatgaggaaactgaaggaacttgtctaatgccccttggctattacatggcagctgccattcttctttctcttagttctctttcctttattttgcacttttttttcctacgcttccatcgctttcttggttgtctttctggtagcaataacatcatccacaccaatgattatagtaataactgacctttattgatcaatcagttgccatgtgccacagagtttcctaagtgctctaatgtattgaccttcacctcagtcctatggagtaggtattatcctctttttagagctgaagaaactgaggcccagagaggttaagcaacttgcccaaggtttatggggctagttgtgttcccaggcatctaactctagccactggaattctatattctgaaaaccgtttgacatttataacaagtataacatgaattttcaagttggaataaagaagacatttctgaaatgggctgaaataagtgga

SEQ ID NO: 76591 - DNA, 1789 bp, Homo sapiens
ctaaagactttggcatgtagtatttaatctttaaaatcatcctgtgagatgtcagtggatgttctcatgttactaataagggtaaattggtttctacaaggtcacatagttcgtaagggcctgagctgagatttgaacctacatatgtttgctttcaatgcctgagtcattatgttaaattgttccttcttgttttttccaagtatttatgatgcctttcccttcacatattacggtagcaggatgtattcttacttatatattacttgtttaatatacttttggtggttattgttggttggtttgacatcttaactagtttggacaaaactctttcatttactattgtgtttatggtatttagaaattgtgtgcgattttgtttttacagctaaagggaaaaacgtaaattattttatttcacatgcaatatcattttttaattggcaatttggtctaaacagtttttaacaatcctctgagacagaaccctggtgttgagatatttcttttactaatatgtgtaaaacaacatctcaagttgttgtgtggtataactgcaagagcatagtacatggatagcacaaaagcagccacggtaaaaaagcaaagagacgagcaaatcagatgagagagaacagacacgcattaactgatccatcattcatgatatgcttagatttgtgtttgaaaagcttgcaataaatgtaagaaattcttattgatacaagtattcaacatcttatattaaaaatacaaccctatcaattttatgtactaaaatattacagtggataactgtttattatacattggtctgccagcacttgtgtggtagtgtggtatgttttatgaatccagctgaatagcatgtctaggcagaaccaaatgtacaattatataaaatagcccaggaattacagccaaaaaacattaataattattggcaactctatattactttgtttgcatccttatagtgttggcttattattacagaagagttaaagtttattttcagacaaaacagaatgtctaaagtgtgttatatattaatccagttctaaaaagcttttacatttttaagtttttaatttttcagtctttactcactcatttttcctggtggacgaatccagtttttaaaataaaatatatttttcttccaaacaaccttttgtgtttcttgatctggagaattgaataaatctaaataagaattattgcttccagcattaagtttgtgcagaagttttttgaaaccaacttaataggacatcagtattgccatctgaaatccaaatttctcttatttatttatttttaaaattgaggacaaggccttgctacattgctcaggctggtctcaaacacctagcctcaagcaatcctactgccttggcctcccaaagtgctgggattacagtaaatatcttttaaatggagacttactgacactgtgtagaatatattttttaatacttcaaactgccctagcatccatctgacttttatttcctgccttcttcaaatagtcttctgctctccttgtctagctagcaaccctccattcttccattccttgtaaaagagaaattgtcagcatctgcttttctgttgacctattctctccaaacaggctatatggtaaacaaactgcaatgaacattttttttttttttttgagatggagtctcgctcttttgcccaggctggagtgcagtggcatgatatcggctcactgcaacctccgcctcccggttcaaacggttcttctgcctcagcttcc

SEQ ID NO: 76592 - DNA, 1749 bp, Homo sapiens
gtctgacagaacaccaagaagtaccagtctttaaagaatgctatagcatatacttcaggcttgaaatattgtaataaaagcaggtttgttaaaagcttatctgttcctgcatactgttctccagcaagctaaacacatcaagaagcagtctctcccatttagaaataaccagactttccttatgtttgtaactgatttttttttattaattggtgagaacaatgttgttggaaagtttagtgtatctttccccctcctcctctttgtgatgatggtggtgggggattaggtaataccttcaaacagtaggatttttccttgtatttgaaaaccaatacaagtcactgtcataatttttggcaaattatgtcaggagtagaggaaagggaattcttcacctatcttgatgtttcaatattgggaacatttgaaaaatagagaaaattagaaagaaaaaaattatccgtagcttctccattaaaacaaaaattctgctttcaaaatgtcttccaatgtaacacatttgtggttattttatgaattgaatggccagagctatgtacataggacacagctgaaaaagggaaggcgcagtcagtgaaagtggaatgagggcaacatccaaattgcccttttaatggttattattgtgtttccttgaaaaaggctaaaatgcctccagtggaagactaatagtatttggacagaaagagtgcagtgttaagaaattattttatcatagcattttgaaccaaggctggatcatttttgtttaacagtgtaattgagagctgttcctcactttcatttactccattgaggaaagcatcatttctagcaggaggtttacagtgaggtaggtcatatttgggcacgttgtagaggcaccgcagttgtggtggtcttgatgacacagtgcagatgctcctgctgaaactggtttctgtgaccttttccttttgtatacacactcttcaagttttaaaacaaactgtatgtgtattgggtgcttcctgttgaggaaatgaaggaggtatgtataacccggtggggtagagatgggcctggattgtagtggacaaattttggatgactccgagttcatgcatctgtttcccggatgtttcacctgctttgtaacatcagtgtctcaaaagccagaagccaaatggcaagaactgttgggctctgttgaacattagcgttcttgctgttaaacagtcatatttttgtggctgaacagttaactttggaaagaaatggttttgtggtatctctaaaaatattttataagtacactggtttaaataacacttaatactacattgttccattatctttaaaactcatttctgtggcagttttcagtaccatatttatgtaagttagtcataaaatatgtttttgtaaatttgaggtatttttatgtttttttaaaacttttttgtgcctccgaataacaaatctgtcaatttgttcgttttatttatttatttatttatttatttatttatttatttattttttgagatggagtctagatctgttgcccaggctggagtgcagtggtgtgatctcagcacactgcaagctctgcctcgcgggttcacaccattcccctgcctcagcctcccaagtagctgggactacaggcgcctgccaccatgcccggctaattttttgtatttttttttaagagagacgggttttcaccgtgttagccaggatggtatcaatctaaacacgtat

SEQ ID NO: 76593 - DNA, 1003 bp, Homo sapiens
atttgcaaatttttttccaagtctataccttattttttcatttgcttaatagtgtatttctctgaacaaaatttctctaattttgaagaagtacagtttatcttttttttaaagtacagtgggggtgatttccaagaactctttgactaactaaaggttataaagattttatgttttctcttaaaagttttatagttttacatttagatatatatgatttattttgaattaatatttctgtaagatctgttttaggtcaggtttccttttttagatatggatgtctaattattccagcacctttgttgaaaacacaatctttctccattgaattgccattgtacctttaccaagaatcaattggttatatttgtgtaagtcgatttctccatgacttcctccttccctggggttcccctttttacttttccagccacagagatgagacattagaataggacgtacttcctgtgactgcttgcatttcgggccaagaggcagaaagacagaggaaaaaagcagcagatgtttgctcctacatcttgagatcagagctcctctgatcagagaggaaggttcctttccctcagagtatatgtgactgttgtccccgctgtccaccaccaccttggaattgccttggattgggaagcaagagaattaaaaagaaaaaaaaaaggaaagaaaaatggagtgtttcccccattttctccaggtttaggaattcccttttctgctcctctagctaaaactcagtttgttccctctgtccacatcctggtatgccatgtctagctgccttgagtccaggctggtgatttcttacgaaaaaagtgggacgctcattgccagtttggtagtaccttgagattcattcttcttccctaatcagcctgctatcgtttacttttcagacccctcaaatagctgcttataatctttccaggtattataactgcattcagtagagaaatgagatggagtacccttccttcatcctacc

SEQ ID NO: 76594 - DNA, 1063 bp, Homo sapiens
gcgtgagccaccgtgcccggccagactagtgtttttcacaaattgcacacatcttaaaataatagacattctgtttctcttagtcttaaaaaaaaaaaaaaaaagaagaagtcagccgtgcacagtggctcacgcctgtaatcccagcattttgggaggcctagttgggtggaacacctgaggtcaggagtttgaaaccagcctggccaacatggtgagaccccgtctctactaaaaatacaaaaattagctgggcttggtggtgggtgcctgtaatcccagctactcgggatgctgaggcaggagaatcacttgaacccaggaggcggagtttgaagtgagccaagattgcaccactgttttccagcctgggtgacagagcaagactctgtttccaaaacaaaaaacaaacaaacaaaaaaacaaaggtcattttatcttggctgaattaatatatattgtgtaaaatacaagaacaaactagaaacctttcagttttgtggaaattctgtgctaggatcacagtggactcttttcttgcttttcctttctactaaaaaaattaacaatttaaagtgagcattttaataccatatgtaaatttacatttagtgctatttgattttaggtgcagaaatgcacccaggacacctgtagtcattcactttcctgtttaccttgtggttctcatcttttgttactttaaaaaatgtctaattttaagtcttttatatccaattattgagttgcctttgagatgtgatttgatatgttttcattctgaaccccttgcataagttcaggcgaattagagaatatagggaagtccaggctgggagtggtggctcacgcctgtaaccctagcactttgagaacctgaggtgggtggatagcttgaactcacgagtcagagaccagcctgggcaacatggcaaaaccctacctctacaaaaaatacaaaaatcagccggacatggtagtgcatgcttgtgatcccagctacttgggatgctgaggtgggaggatggcttcagcctgggaggcagaggttgcagtgaactga

SEQ ID NO: 76595 - DNA, 1050 bp, Homo sapiens
tcttttttacgaacaatttcagctgacagctaagcacagatatgatcctttatgatatccagagatttgttttactctctttttgataagagacttcatacttgcaggccaaagacattcaagtctttggagggaaaagtcttaaaagtggtcagaatttgagggctattagaattttattctttacctaaatctaaatatttgttttagatggtagtttacccacaccatgcagaaaaattatagatgtttggggtaccgtttttctttctattaataacagatgattataattagaggcatttgagcatgaaactagtggggaacgtgctctgtggtattttagggtgaagttgcactttgctctttgtgcgcacattgctctttgtgaaaatgtctcctaattcatctttcatgtacagtgttgcttacaacattgtatcatgcattcatgtgagacttcaaaaccagaccacttgattctattcttctggagccactgataattgttgggagactacatttgtataaaacctctgcagaaatcaagagaggcccagctttattgtaattttaacagtttgggcaagtttaaaatttgagttatgtttctgtagccttatccttgctcacctagactactgatttaccatcccatcccacccctgcacccatttcattttctgcattgccaccagagtttctgtacaaaaagcatgtctaaccatgtcactctcctgctgaaaacatttccaaggctcctcacagctcactggagaaagttcaggagtcttcatgtggccttcaagccttgtgatgggaaccttgctcaaccatatcatctatcacttcctgcttggaactaggcccttctgatgcactatgctctctgtcaccggtaaggttttactccttccctctgacatcgctaggttgggctgcatgccccacctctgcactccgtagcaccctgtgttcgcctctttggttgctcatgtctgtacgatgtttgtctgttcatatgaggaagctgtggattcctcaaaagca

SEQ ID NO: 76596 - DNA, 1077 bp, Homo sapiens
gctgctgctcttgcctctgtggaagacgcctgctgctaagagaatctttgtgtgttgtgtataaaatgaactttgtttggaccattccacaagcaacttaaactgcttaggagtccagccagacattcctccccagttgatcatttaaatggaggtcagatttagaacccaacttatattcgtttaaaaatagacattgcctttagaaaactgacctttggtacatttggggcctagggatctgataggctatctcttatgatgcacatcgctctgttttagactctgaaaggcagtatgcctttgaagctagataacgtcagtgtgcttgtaacttgggacccagtctgtgtgctatatgtctgcttcttcagtccacactcattacttccaggaaattcgtgagaagatgagagattattcgttatagaattgagtatggtttctctacactaattttattggatattttccagtttgactaggaaaggttagagaacatggaaagaaaatttaacaggttaattttaaggtaataagaccattgtattgatatattcttcagtgtgatttaggtgagtcaggaatttttcctctggagactgcctaaatcagggatgtccaatcttttggcttccctgggccatactggaagaataagaattgtctcaggccacgcataaagtacactaacactaatgatagctgattagcttaaaaaaaaaaaaagaaaaaaagaaaaattgccaaaaaatctcataatgttttaagaaagtttatgaatttgtgttgtgccgcattcaaagctgtcctgggctgcatgtggcctgcgggctgtgggttggacaggcttgtaaatgttattaaacctacaaatgagaaaggtaagactagtggcagctctcacggggctggaagtcagtttatcatatgttgcaacttaacattattcatttatgcaagtgaataatcagttatcaaaatatggagggattctttcaagcctcatttatcacacacaagtctaaggtttacatagaatgtgttaaacagatatgttaatagggtaagattgga

SEQ ID NO: 76597 - DNA, 1014 bp, Homo sapiens
attgcctaaaatttcaactaaaattgaaacaaagtggtaataagttattttgatttcattaaaaaataaccttgaaggacaatatttttttttcttcatgatttaacagtgttacttaagcatttattttgatgtaggaaaacctgtatttatttctgggcaccacttttcttgtagtcttaatgattatcatcttaaccaacacctttgtgtaatagtttccttgaggctgatgataccttttaatggtgtcagtgcttaacattatgtctttttggtacttttcagcaacacaaaattataaattattttgtgactaactgtgtctaaatttttttttacatcaaaataagtatttttaaaaaagaaaatgtgggtttttaaacttgtattttatttataagaggatgtattgtccatgttattataataattgatgtgtttccaacagaggacctctgtgaatatttttgcattgcccacacaggtgatgtgtgaacatctccaagattgttgtgccattaactagctcctacaaagtgtcatacagcaacattatttgaaacacttgtggaaacatttggaagcatttatcattttttctttgttgtatacccatttgaacaaaagcaaagtaattgcttacaatagttattttttcataataacataaatgctgaatctataaaaagtagaatttctttataaagatgaccttaagttttagctacctgatatcgtacatacatcgtagagaacattttcaaaggtaggggtttaataggaatgaagatgcctgttcctgatactgggaagtttgcttatttaacttagtagcaatgatatttatcatatcctaatattttataatgctctgtatatcactgagtgcttaagtagttaccctttttaatcctcagagtcctcccttcaaacagacaggatgtcgatatttaaaaataaaaagaaattaaattcacctattaatatatttctaactcattggaaaggaaa

SEQ ID NO: 76598 - DNA, 1725 bp, Homo sapiens
acctccttttttgttgtcccggaaggcagaatctgggatctcttttacttatgtaactgttctccaatttccaaatcaatttatatcgaaagaatatatctgtggtgcctgcccctttatccctcccccaaaacataggtatttatttttttagagacagggtcttgctctgtcacccaggctggagtgcagtggtgtgactgtagctctgtagctttctgcagccttgaactcctgggcccaagcaattttcctgcctcagcctcctgagtagctaggactacaggtgcccaaaccctccacgcccccagttttttttatttttggagtgatggggtttcaccatgttacccaggctggtgttgaatcctgggctcaagcagttttccccattcaccctcccaaagtgctgggattacgggtgtgagctattgcacctggcgaaagtagttgttgaagaactacttgggcagatgggaggtcttgttttactgctatgtttgtgaacaatacaaattcaattatttttgtggatgtgacttctagagaaacaattaaattgattaaccagagtgactgaggagactttcattatgtttctccaaggacataatgttgaacaacaaaaaaagtattttgacaaagtatcatcaccaaagtatccctcatcagaatatatagcacaggctggaaacttggattattgtttcttacctaaaagcagtcagtggaacaaaggttatgtatgttctgttagcagtgaagctgatactataaagtctatatgattttattcaaatggattaagaaaattaacgtgtgtttatatttggaaaacgtcagatattttatgaataaattttaattcagcaaatatttgtttttattactccttaaaggatagattcagcattttgtttgttttttaatattatgaaggaactttatactcctgatcactgatgatgtgggcaggccagcccgaagggactccgtggttcagtctttaccatgcaatagcacaggggcttttgcttttaaacatgagttctctgattgggtagtgcttgtgtgagtattgaaaaatctctacaattgaggctttggaaggttatcagttttacaccttcttgtcctattcagatgcctttaatttttgttctgttttattttgttttgccttcttgtaacagttagaatcttcattggattgttgaatagaaatggtgacagtggacgtccttgttttgttcctgatgttagagggaaagctttcagtcttttactgttggtatgatgtttgttcaggctgaggaagttcccttatgttcctggtttactaaggctttttttctttttctttttaaatcattagtggtgttgaattaaatttttcaagtgctttttctgtatatattgatataatcgtgtggctttttgtcctttattaatatgttgtattaaattaattgacttttggaggttataataattgatttttggatgttaaaccatacttgctaagatgaatcccgtttggtcatagtatctaattgagattttcttttcttttctttttttttttttttttgagacagggtcttacttactgtgtcacccaggctggagtgcagtgatatgatcttggcttattgtagcctcatcctcctaggatcaagcgatcctcccgcttcagcctcaatagtagctgggactataggcaca

SEQ ID NO: 76599 - DNA, 1152 bp, Homo sapiens
aaaacaaaaacattaaaaggtgccgagtgcagcggctcaggcctgtaatcccagtactttgggaggccaaggcaagaggattgcttcagctcaggagtttgaaccagcctggggaacatagttagacgtcatctctataaaaaattttaaaaattagctgggtgcagtggtgtgcatctgtggtcccagctacttggggggctgaggtgggaggatcgcttgagcccaggagtcgaggctacagtgagccatgttgaagccactgcactccagcctgggtgacagagcgagaccctgtctcaaaaataaataaataaataaaaataaatatatatgaagaaaaaagataaatggtgaaatcctctgtagtattttgctttccatagcaacaaagatgaagttcacaatgtgaaacaaaagaagacataagaaagtgtacatattctctgaccccatttaaataaattgcttttcccatgttgtaaagtgaccatacaaaaacaggcagaactaatctgtggtgctggaagtcaaaatggttgttagcactggaggttactgaggacttatgagggtggcttctgaggtgttggtaatgttctctttcctgatcgagtagtagttacagtggtcggttcagtttctgaaagttctaaaagatgtacatgtagaatttgtacgtttcagtttttataaaagcttcattaaaaaattaattgaagtctgggcacagtggcctcatgcctgtaatcccagcacattggcaggccaaggtgggaggattgcttgatttccaggagtttgagaccagcctgggtctcaaaccatggcgaaaccccgtctctacaaaataaataaataaataaataatacaaaaattagctgagcatgttggcatgtgcctatagtcccaactgttcgggaggccgcggtgggagggccacttgaacccgggaagtagaggctgctgtgaactgccagtacactctaccctgggcgacatagtaagaccctgtttccaaaaaaaaaaaaaaaaatcttcattgaacatagcttttttttttttttcttctgtgtgtcatattgtagcctggtatgctaacaagtaattagaattcttcagtattagccatggttgttcttaaaaaccat

SEQ ID NO: 76600 - DNA, 1029 bp, Homo sapiens
cagggttttaccatgttgtccaggctggtctcaaactcctggcctcaagcgatctatctgccttggcctcccaaagtgctgggattacaggtatgagccatcgcgcccagtcctaaaagtttaatatttttaataaaaatattcttgtctctgatcttgttcaataaaaaaaaaatttaaagtttttgtgtttaaatgaaagtatgctgttttcattatcctttttccttaaatgtcatttttcctgtgctgtaacatgaccgttactcacatggagtgctgtgaaatgtgtatatgtaagatttatgttctgcatttatgagcatgaataaacgttactgaatcagaaccgtggggatcatttagttatagaatcagaaatctggtgaaatgttcacagtttcctatttttataaaacagagtagtttaaaactgcatatgccagctttcctctctctattctctacctccttttctgttgtagttatatagtaacacgtgagggaagttggtaaggaccaaaagataccatatttttaaaaataaaagataccttctattgtaaggcacaccattatcttatgtattattaaggaaaaaaatgctctgtgaggaattgagttgaatctgggaaaatttttaaaaaagaaaaaaatgcagccttctaaactatggcacattgctaagatgccaggaaatataagatgcgtactgatttcagtgatgttgaagtgaagaaaaatgtgaattttagatccattccaaacattccttgctctaacaaaattattttatttggggtttaacttgggacttctaccttttttagaagtcagtagagaatcattcatttgaactctggctttttgctaaaatgctgttggagacgtgttctaatcagtatgtctgattttaagaagatatgaaaatttttaatgaaggatcacttttgtagacaaatttgagtgctttttgggagcaatgaaaagccatgttgtgcttcatgtaacctgagttcttgtgttatg

SEQ ID NO: 76601 - DNA, 1014 bp, Homo sapiens
atattataatactacagacaggccgggcgcggtggctcatgcctgtaatcccagcactttgggcggctgaggcgggcatatcacctgaggtcaggagttcgagaccagcctgactaacatggagaaacctcgtctctactaaaaatacaaaattagctgggcgtggtggcacacgcctgtaatctcagctactagggaggttgaggcagaagaatcgcttgaacctgggaggtggaggttgtggtgagccaagatcgcaccattgccctctagcctgggcaacaagagtgaaactccatcttaaaaaaaaaaaaagaaagaaatatgataatactagagacatttttctctaatgtctaatttaaaagcaactatttaccttagaaaggctggtttgcctcttctagaacaaagataagacctgtgtaagttatacagctattgtattttagtgaaatttattgtgcacttaaccaggttttttttctaattttatttcaggttataccttattggtgtggacgttgtctaaatttcggtagccatggcacaagaatatagtaagtactatgccatacttcctatgacctacctgctttacaaagtgttgattttctgtgtttaaatttctgattagagaaatgaaaacatagaaacaaaattttaaaaaatctacttttctcaaagagatgaagtcgtttgtcatctgctttttgaatctatagctttatatacaaatacagtgtaatagtgatttatttcgtattctgatacagtattgctcaggctattgcctgtaaatagtactgactgaacattagggttggatccatatcatgcgttgcatctattcctcatgttatggggttgaagaactgactgcagctcgccctgattaggagcagtctcatttctgccttgtccatgattgactcatgaactctggctacatcagtgagtgctgagtgttacctggccagggggatggtttcagagatggtcctgtaatccttt

SEQ ID NO: 76602 - DNA, 1109 bp, Homo sapiens
agattttttcccctttaatttatacatattatatccatgttacaggaaggaaaacattaacatcttttgttgaaattgtttgaagatcttacactttgtgaatgtattggttgttgtgtaatatgttttgtgtgcattttcttttttaaaaaatctgcatgttatagttgggttttaaggggaaaagcctattgaaaattttctttgaaaaatcaattcggtgaactgatattactcttttttgtttgtttcttgtggaatggagtcttcttctttcttatatatgaaaggacttgtatatatattaatggcatacaaaaggacttgtgtaaatatggaaagtggtacaaaaacttggcttgtttttgtaccgccagatgaaatgctgcctttgtggggaacggccccctgggctgagggagcttctagacactgactcagatctgtaattaggtcttgctctccgcacccttgttgacttgaaagcactggccatagaccatttagtctggaaaagcaatactacatgaatcatctaaattggcacaaattatccagaatgctactaaatgttttgtactcctctgtaattgagagaattagaaaaggagacttgttctttaaaagtattatagagggtacgtatacactgatgaaagtaaattttttttccctggatagaatgaaaagcagtggaatatttgacatttgtaagcagttctgatctcatgggtcagttttaggagattcctccatggttcccatactattttcctttgtgagaaggtaggaagtgtggcctgtcttccagctcccgtttatttctccactcagaccttttagacctgtcttgccatctgtagcctctgcttaacctctacagggtggtggaggcaggggaaatcctggaaacatattgtatctgttttgcttcctcctaactagtctcacaaatcagtatctcagtatttagaatggaaatatgatactcctctcttccctttcgaaaatgttgggtcgtagacttattgagacctgttaggtacctggcaatgaagtgggtgaaagtcatttttttggtgtgtttgctaagtagtaagttgacagtg

SEQ ID NO: 76603 - DNA, 1032 bp, Homo sapiens
tctggagaggccaggagaagcatgggatgggaagttgatattttagctatattcataatgtttctttcctttttgatgtgcagcaaacttgacagattaatagttattaaatctggatggctggtatgtttttgcatatgtcaaatattttataatcaatagttttcagttttatcgtgtagcagtttccagttaaatacgttgcattgaacatgtgtagttatttactttccctcatcaagccctatgccagtgttactcaaggaatataaaaaaaatgtatgaagacaggtaagggggaaagacataggagcagatttgaatgatcaacaccatttttgtcaccagagagaggggcatgaattttaatttaactaatttagtgacgtgaaaagagtgtcttgaatggctttactgagggattccaaaaaatgttgactctctgcaaccccaggattggagggtcccaagtagctgggaggattgcactaaggggtggaattagttttaagtagatacttggggtcctttccctaaccatagtgtaattatagaggctctggaaataggaattatttgaaacctttgttgctgagatttgttcccaggatgctggcagtcagacgggaagtggaaccattcttcttcagagacactgaaatgtatcctagaaatgaactacaaatatggcatttgtgggtcccccagtatagaaggggaaaccctctgtctgatttaagaaggaatggaatttatggtaataatatttagtagcttgtagaatcactggaaaggctgtagaactgggttcgaaaaataggaaaaacaagggaggccaggtagccaagacaacactcgttcccacaagtaggctggtgtggtgttgcccatgaacactggatgtctggcttgacattgccactgtcagtacttgcctgaggttgtcagtgtgcagcattggcactgcttctgccaccaccttccatgtaaatggattcgcctctttcctgctttctttagacactactgttg

SEQ ID NO: 76604 - DNA, 1023 bp, Homo sapiens
gaactaatgatggcaacctgtgctctgcgtaggtaccctcatctgattttcctaggtcactacagtcttgggaggggacaaggtgaaggctgctgggcacaagggaacttttatgtcaatattaaatataaggaaagcatctgtaaatgaggagatataagcaattgtgttaatcatctatgtgaaataattattcaaatcctataaatactgctaatcttataatctttagtactctctactttatacagccttctgtgatttcattttaattaggggatttagcacaagaacatcttacaggaaggacctgacatctgttggatttttactttttttggtgatttgaatggctggaggtttaacaaagtatagtatcttagaattagtatttaaacgtgtggtcatcatactgcattcccagatcatattttatatttttagcaacagaaagatggctttttttctcataagttttgtttctgattatgaaggtgacacatgttcatttcagaaaataaaaaatataaataaaaaaacagaaattactcataatcaaaagacaaacattgtcagtcctttggtgaactaactttgcccttttaatctgtctgcctgcctgcctgtctatctgtctatctataacatatcaaaatttgtaatgtattttcagttttttatcctgtattcttctgaaatatgggcctgtttgtccccagttatgttcaataggatgcatgatataaaatgtttgatttttttttttaagtgagtccatggtcaaatcagttaagaaatttcttagtttaataaaattagtggtggtagtggtggtgttttctgctttttaataaaaataatgggaactcactatgttacccaggctggtctcaaactcctgggcttaagaaaccctcccaccttagcctcccaaaatgttgggattacaggcgtgagccactgtggctgcagatttcttggaggctttaatagagcaacatatatcacgatgtcctaagcaag

SEQ ID NO: 76605 - DNA, 1171 bp, Homo sapiens
acaaaatttggagcagaaattaagctctgtaaagtataaactgtacattttaaaaattgttgtttatacttttatatagtataaaacatatctaaacaaacaactctgtcttataatagacaactttgattcactgaaattagcagactaactcatttttcctaatcagaaccttaaagcaagtcttcttgttgaaggagtacatcagtgtcagatgtaatttatcctctagcaccaaggtgtggcagagctgacctggctgtcactcagccgcttatcaccgggtagtttccatttggctgcctaatgcattcctgacttcactgtggctaagtctcaggtggggagggggtggagggggagtactttactaaagtatgctatacagctgatattatatgtaaaaatcatatttggctgatgaagctataatcactttattattatgttgtttttataaacattattttacaaatttagacttcagaggctattttagtccaacatagaagccaggtccattgctggaaaaatactggatcagtagaggaatcccattgtttgtatttagtaaaataagcaacatgccattgatgcttttctttccagtcctttctcatgcccacttctctttgccattttgctagtgagtgtatgtttatattgagaaccaggattaaatgacagtaataatatagctaacatgcatcatgttacttctttgtactttattgagttcctcacttaatgcccattggacattaaggtggatctgtactggtgatagaagtccaagtgatagccacatcctccttatggaggcacagactaggcagtagggctgcattcagattaacctgaattacttatcttcctttgagtatgtatgtgttttgtgttatttatttatttatttatttatttatttatttatttattgagacagagtctcactctctcacctacgctggagttcagtggcacgatctccgctcactgcaatctttgcctcctggattcaagcgattctcgtgcctcagcctcccaggtagctgggattacaggtgtgcagcactgtgccaagctaatttttgtatttttagtagagatggggtttcaccacgttggcaaggctggtctcaaactcctggccttaagtgatctgcctgcc

SEQ ID NO: 76606 - DNA, 1060 bp, Homo sapiens
tcgctgtttcccctcactaagaatgtgaaatttttattataatcattattgtgaaagtatcaaccaaaaataaaactatttacctggaatattttaatgatgacataattatttattgttactctttgtaccatcctggttaaaactcaagaaccagaactaataagaaaacttcacactaaacatttaaatgtgaggaatggagtaggtggaaggaagtcaaccgtatatggatataatgttaatctctccccctttcaacaaaaccttagctaaacagcacatcaagaaataaagcattatgtctcgtctgactagataaatagtttattcctttaggaaccaagttttatttaatgatttttttattcataataaaattttagaaacttatgggaacataatattgtgtgtaatggctaagtaaatgagctgattaattaacattaaatcagcagttaatatgtttaaatctggtactgctatatactacttctgactaagtgacttatcttctttaaatcaaagttgccacatgtataaaaaagaaggaagtacctttttttttttttggttgatatgattattagagtacttggcaaaatgctttgctttgctgcattatatcattctaatatggtgattgctgtattggtttttggcatcccggtatgctggctctaaaatattctaatttctggtggtttaatacctgtatttcagttcatccatcagaagctttatccactctacttgagtttccaattcctcttcccttcccctgacttttctcatcctgaatttgctcatcgaagtcttccttgcctttctttgacacacttcatctgtaactccctcatccttactccccttccctgctaaacttttcacttcagaagaaagagaaagacagttgtggatttgactagaagaacactttgtaattatggatatcttcactagcaaacaatggaagtcgatggctgataggaaaacaaatttaaagtgctacatcacagagcaagtgtagacatactgcccggggactaggggcctgaag

SEQ ID NO: 76607 - DNA, 1113 bp, Homo sapiens
tggtgaatttagcatgggaaattggaccggagtctccatccataccaatggaaccgatactgatgaagactggctggaaaagctatttgggaaataatagcaagagctcttttttaatgaaaaaacttgacacaagttcaaaaatatcttcctagcgttatctaaccagagatgagtttgtttaaagctagagtatgaagaaagtgttggaatttagtttataattatcccatcaccattccccaaattcagaaatatacttcattagcagctgggaaaagttacaaaaaaatgtagtcaggttttgataatgacacaccaaaagtttgaattatcattaattttacagtttttattattaacaaagtaaccttattaacacaatttgtattttgtctaccagtaatactaaaatgattgtttaatatttttagtttataaatttatattttatttacatttttgtaatgtttctatttttgttcttgagatatattaaatatttggttttaataatttgtgttgttatgaattcataacactttaaaataaagttattggtatcaatatccaaagtaaacacttttattttcttccagtattcagtccctcttttcaaagatgtctatgtcatacttcggatgagacctaaaaattagaggacttagacaaataaagaggggttatggaaagaatgttctcagcagatttttttcagatgataaaagactgtgagtttgagcacctgaaagagaagtttagtatcattggttttcaaaatttaagagggtgaaaggtgtgagctgaggctggagtgattgacagtgacaggttatgagaacctttgggtaaccatgaaaagggtacaagaacctaagtgttttaagtttcgtagtagttggtcagatttgcattttagaagggtcatctggcagggtgaattaagttggataaaaacaaaccagttagaagactactacaaacactcaggcaagtgatgataggataaatcagtggcagtcggatgagaaaagatggatttgagagatgtccagaagctggaattcacagagtatggcagtgggcctggcatgagcaactgggtgaatgtgg

SEQ ID NO: 76608 - DNA, 1039 bp, Homo sapiens
attgaggagaaggtagatgaggagtggttaccagagaatagagcatgtttgccacatctgccctggagaaacggagagagttgctgaccagggaaagcttgaggatgaggatgaattgaggttattggtgatgaatttatagtggccctatatctgggaatttctccagcagcagagaactgccatgccacctgcccattgtgagatatgtggggtgtacttgaggggttcctagaagttggtttttattagagtccatgaagtacgaggaccaggtaatgagtgtgactcacactctgatgcatctactgttgatctgtgctgcagcggtacaatatcctctgagggtatcaaagcatgttaagctctttgctccttcagtaaatggccccagactgctgtcttgtttctctttaagttcttgtctgcctttttgtactatttctgtctcctccctttctgttttcttccttgttgtcagttgttctatcacattgctgtctgcatgcaagtctgtatcagccctacaccctggactttgtcaacacctggaattatcacacctctgaaataaagctgtgagcttgaagaccagacaaccaagcttattagaattgtgtgcaaagtaagagtaaataatctgagtgtgtttctcatgtgctgtgctttgaggatatgcataagtgtctgtacatgaattttgtgacatttagtgggttatttcttatatatgagatgtttgttgcttgtattcccattgtgtttttcttcttttgaatttccatggcttatgataatagtcttagagagccctcaacatttatgattgtagcttttgtaattgtgctttagtacctgcaaagtattttcatatgcattacttaaattttaaactacatgattcgatatttatgctattttttcttattattctcatggattttcaaatacttatattttgtatggaaataacatgtattttcaaatgtgtatgcattttgtgtgataatgagatattatgtcacaatccagtcattta

SEQ ID NO: 76609 - DNA, 1048 bp, Homo sapiens
tcttttttaatctggtggaatccccctttcttcaaactctgttctcaatatgtttagaatgtttttgaaaaacaaaaactaaaaagccctggcacaagccttctcttaggcaaggaagtgtgcacaaatgtagcctatttaaatggtgggagatagggagaaaatacaaatttattttgagaaatagtagagtagtaatctgtagagtagtaaaaaactcaacaggccacccgtgttcagtgttatcttctctggaactaaacctgtgtagccaagtctttgtttttataactaactgaagaatattaatatttgttaaatgtttacattttattgataaaatttctgagtgacaaccttaaatactgagcagaatgtaacattttcaaagtgttaggtagattttctaactttgttttgtcttattttacctaagaacactggaactattttggggctgatgagaatcttggtccagtggctgtgagcattcgaagggaaaaaccagatgaaatgaaagaaaatggatctccgtacaactaccgaataatttttagaactagtgaggtaagtcgcaaatgagagaggtttgaggtttaactgaaatggggaagaaagcaaatagtagcagtagcaaagcaattaaatttaatagcacatggttacagctgtctttggagtaagcaaagtcccctttcatttattctggtggagatcgaggtggacaagatggttagatctggacctcttcttttcatcagactctgaatagatgcagtctatgaatgaggagttttgattcagagaaagatatgtccattaagtgtggcccaaggaaattggagccctcagatccccactgggatattgtgtatcctgcttagggctactggaaagcgccaagccaacttgaggagccaggatattagatataagagaaggccactgaagacttaattcactcttccaagctcttgctgagctcatgtcttcgcccaagaagaaggagggaaagagattcttgacttcttccactatctttgggacc

SEQ ID NO: 76610 - DNA, 1072 bp, Homo sapiens
atagtgacatggtatagccatatagagaccttgatctttactgatctctttaaggaaatgttattttttgtctttaaataaatatcctcagaagtcttgattatgtgctcctttggacccaccctggtcttgaaagcattggtttcatttttcatattacagtatcctacatcacttttctcattctttctccctcactggctttacccatcaaaaatcattccctagctctgtgaggagccccacagttcaggcctgcagtgcatgtacatgtgttcaggcatctcacatcccagaagcctcaccacagcacctgtctctcttgcagctcatgacactgagaggttcggtcctggaggacgccattccgtcgacagccaagcactcgacagccagaggcctgcctctcaaagaagtgctggagcacgtggttcctgagctcaatgtccagtgcctgcggttggccttcaacacacccaaggtcacagagcagctcatgaaactggatgaacaaggggtgagtttgcctttctgaggagagcattcttgctcaggtttattgctaggcttccggaatacagaccttaatgtttcttgttttgatggagataattgatactttttattgtgaaagacactctctttgcaattactcattttgttttttcttaactctgaactctgaacatttctcatctgatgaaattctgcatgtcagaatttataaataaggcactttaaactacgttaaattcttttgataatcttccatatgtacggtaagtttttcgagtgtccaagaataaataatagcagtaatcataataatgttgtgttaatgacaatacagtaataacagtaattaataataatgagcatatttgcaagccccttttctaagtgccttaaatatgttatctcatttaatctccctacactgtgagaaaggtactattattattcacattttagagagaaggattctgggacacagagagattaagtaataaatccaatttcacacagttagtaagttttggaaccagggtgcaaacatagtctgcctcaaagt

SEQ ID NO: 76611 - DNA, 1046 bp, Homo sapiens
aaaggacatgaactcatccttttttatggctgcatagtattccatgcatttcacccctttcttatacaagatataacaggctgtagacacttgcttttttcatttaggaatatatttttgagatttttttcgtcagtacatagaaaggtttcccagtatttttactactgcatagtagcatagtattttgttgtactgctgtgccatagtttatttcatcagtttctctattgatgggcatgtatgtgtagatttaagtccttttctcttacaaacagtactgcaatgaagactttttctgtagaattgaaattcatctcaatgtcaaaaaaatcaggtacctttattatcaacttaatacccaatatgaaactttttatctttgtgagaaattttgcacaataacattattaggtaaaattattgtgtgtggattatttcctttacattatgccaaagataaaaataggttagaatatgtctgtgtacttatatataaataattttgaaagcatctgtcaggttttttctttttacaactttactatttagtatccatatgtcatttttttaaaacagttggatttttgttagtaattcccaatgaggatatacattttctaactggcattttttgctctcaatacggaatttttccagtttctttgtcattctttttggaggacagtatagaaatttatcttcaggaagtagttaagagagttatgtatatgaagaacaaatcaaagcaaataatgtgaattagaacaattttttttgttttattttaatgaccaaggtctttactttcagtaatggcaaagttgcttattgcagaccggcccatccattgagaataaccaggaaaattgaacaaaatatttttaaaactaagtttggactctggattctggaaagatggagtagatgtatttctctgcgttcttcctgctaggtacagccaacaaccttggacacatatataaaacaaacataaaatgaatctgaaaggtggagagaagcagcaggctggttagggaccttga

SEQ ID NO: 76612 - DNA, 1051 bp, Homo sapiens
attacgtattcacaggatctagggattaggaagtaggtgggtttgaggagaaattactctgcctgccagtcttctatgaaaaagacacaaagttcatcttgcaactcagttgaacaagtgcttttccttgagaaagctatcataaagcactttagtaggcaacagatgctttatatatacgctgcatttcatcacatggaatattaaaaagcatatactcaagtgtctagatttaatacaagttaatattttactgcttcatcaaggacattcttaactgggtttttatttggggaaggggtgagtgtatagcggagaaaaagaatgcaaggagtgctggtatagtttggagccactgcttgattcatgcaaaagtgccagcagtttgactcaccatgagtgcatatgtccgtggaaaataccagattgactcttaatagtgttttgaagatagttttgatgtcatgatccatcactccccacaagaaggttctcagagatgctcaagagttcacagtccacacttcaagaactgttgcacaatgaaatacctcatagtgactattttaaatttctaaatttaattaggcaatagtagaggtttcataagaatgtaagaattgagttgttctcatcgtttgttctaccccagtggccgctttctggccatgataccagggaagatgaggtaaaatgcaaaacttctgaagaagactgagaacttggttattcacatctctttcttctggtacagggctgtgactttatcgtccatctttccaggaagttatggctgtttaagtcagattgcactgtctgtttctttctttctacttttttttttttttttgagacggagtcttgctccgtctcccaggctggagtgcagtggcgctatctcggctcactgcaagctcagcctcccgggttcacgccattctcctgcctcagcctcccgagtagctgggactacaggtgcccgccaccacgcccggctaattttttgtatttttagtagagacggggtttcaccgtgttagtcaggatgctc

SEQ ID NO: 76613 - DNA, 1035 bp, Homo sapiens
gcctattgtatgagaggaagagcaaatttatgtactgttgtttcccagctgtggaagctcacaacacttttagtaagtgttgaaagacccctttactttgttgagatttaagaccttcatctcaaatatagcccttgtcccattggactgaccaccatcacttttgtatgtacaaacatttattgagtgcccagcacttccctcagtgcttcatatgaacagctgatctgcaggcatgaattatggtaccattgctaaatgacccagaggttatccaaagcaaaatgctaaactgtggataggagggcttctggtgtcatcataactctattttgatcattaccttaaagtattgtatatgtagatccataagcccacgtaggtatgtttgtgtgtttctgagacaataaatactgttttatataacctcaaagcaatccaaaatccccacatcatggctttacaactccatgtacattagctccttctcttagaatgttcctgattacatttacttaacttctgcttgtcaacatctcattctatctgggagcatggctgctaaggattctaggagcctgagttcggagaatgctacctacctttgatctaattggagtagaaatcaagatacagtcacattgtcacctttgaggatacagcaagtgatatttgacacagtttcaaaccagaggaaacttgacattgtaaggaatttcctaatcctcttaaaggatcattcctttcacaactggcaaaaccggtttgttctgtcagcaggtggagctcactagggtatagaattcagtcaaaagaggcacattgtcctgtccttgaattctgcttgtccactactttgggggatgttttcttatcttctttctgcaggaaacttttttttttttaataaatgaatctaaataaattaatccttttgagtgttgcacagtgaaatcttaggcctctatctatgaagttttaaataggcacccacaaattcagtgtcgctgtaatgctttccattagtcagggtga

SEQ ID NO: 76614 - DNA, 1523 bp, Homo sapiens
gataagaattgtcccaatgtcattggagaattcaaagtccaatttttttttttttttttttttgagacagagttttgctctgttgcccaggctggagtatgtggtacagtcatgactcactgcaacatcaatctcccgggctcaaatgatcctcgaacctcaacctcccgagtagctgggactacaagtgtgcaccaccacacctggctaatttttgtacattttgtagagacagggttttgccatgttgcccaggcttgtctggaactcctaggttcaagtgatctgcccccctcagcctcccaaagtgctgggattacaggcattagccactgtgcccagcccaaagtacacatttttatgttgaaaactcattgcttgttaaatgatcagtaacaccttaaaatttctttgcaaaatgactggacttttcaatgatgaataaatgttttgattaatgttataagtaaatctcttaatccttcattttaactgcatttgaggaagaaatatttgccattagctgatttgccattgtgaggcctcttttaaagtttctctgcagacactcatcctttggaaaactatttgaaagagaagttgctctaagtacagtattgatgatagtagtgctgtaacaaagatataggcaaggtttataatttaatatattgggaaaagggtattgggagataagtcttttctaattttacaaaaaaaaaactgcaaaaatattagtggaccttttagtgcaaaacagtttattttaaaatatgttttataaagtagacctctgcttttaaatttgtaaagacctcccttttaaaaggggggacaccataaaaaaagaattgcctttagttaccaggattttttaataacctcattttgtactttgtaattgattaacagaaatttcctatagtaccaacagatctgtttaatggtgcatgatctttacatacaggaaattttcatttatttttctggccttttctcagttcatgaagttcgtagatacttgctccacttaattttggatcaaagacggaaaatacagaaggatttcaagagaagaaaggtgttagctattttctgggcatgtgccctataggaccttttagcatttgactgggacaaagtggatctgcctatatttatatgcatcgtattacctgccttcacagctgaactaccagcagaaagtaggcatcatgtactgcaaagctggacagagcactgaagaagagatgtacaacaatgagtcagctggcccagcctttgaagaatttcttcaactattgggagagcgagttcggctcaaaggatttgagaagtatcgagcacagcttgataccaaaagtaagaaatacttacaccctcctactaggcttattttccccctgttgtgctgttgtgcatctgctaaattatccgtaaagcaacattgccatttatcgcagaacactgctggtgatgggggagagaaagccagagagggaggatgtagcaccagaacagtt

SEQ ID NO: 76615 - DNA, 1982 bp, Homo sapiens
cttgagtagattaataatctttaattattggtatgttctgtagagcaatcaatacacaccagcctttattttcataacgtctgtttgtatatcatatttagaaatgaactcagaaataaattgcttcattagaagacaatttgggatgctttcaaattcctgaggttaaaagtgcatttcctgaacattctaactcccaatttgcaaccctaatctaaaaggctattatttctcccacctggcagccaatactagatcactgattttactggtttgcaatttgtatgccttaatgtcaccagagaatatttttttaaatacaagttttgtaagtacaagcttatgtctaatggatagtttatataaatgtcacacttagttgtttttcttttttaagagcctccgtacagtaagtttgagaaacacaaattttgtttggttttcctttacactattgaattaactgctgaaaggcactgacctaggatgatttggggtgcctgagtttgaaagccacccatccaaaacccagtgaatgtgaaacagagggtgtccctaagcagctttcattgcagttaaagaagctgtttaaacctgaaatttacctgcttttaattgttgcaacattctggaatattattcttttctacatgcccagcttgtgacacaaaacatatatcagaaaacaccttagccacattttctttcaatgaggccagttaaaccagaacataaattacattgtaattatttcagccattctcatctctaaaaatcttccctgtggcacgtgtttttcttatgtgaaaatggaacaacactgttgttatagaaactgagggtttggtgatgttgggacctggcataatatgccagatattgggtagatctatttgaatggctgtatcttttatgcaaatttcagaatgttcgtttctatgttcttccttagagggaataaggcaggtgaaaacattgacagtacctgtgtagattacctaccttcatgtgtactgattaggaatggatgttttaaatacagctatataagggaattggggtggcgggggaagcaaatgattgttatttatgttggttgcttattttttcttgtagctcctgaggaagcggcacattggaaatgatatcgtaacaattgttttccaagagcctggagcacagccattcagcccaaaaaacatccgatcccacttccagcacgttttcgtcatcgtcagggtgcacaatccgtgctctgacagtgtctgttataggtgtgtatgggtgtcacagcaggggctctgtggatgttggctggttatcgcatagaggccccattcagctctgcattctaaagtggcaatgggaagtctattactatttctttttgtctttaaaccatgcatgcggatggctgaattcacatgatgatgtaatctggtggcattgacattacccaagcatgttggttagacacctgccgtttccatttgcacctccttcttaggtgatgtccttcatccataccatctggtcaccaaccaactaattactcatattgctaattatatttttcttttggcatggcaagagcagagaagaacgattataataaatagggaagagaagttaattttttgaaaagcattgttattaaagaagcctaaatccttgcctctgacttacttgattcacgttagcactctgactacaagcttagaaacgcttctatactttatttagcattattgaaattgtttcagtgttacttgttgacgtagtcacatgagtatcagaattcaggcctctatctgcagagacctttcttgtaagaatactagagttaggagttgaaggagatagggacctgtcacgctagctcgataggggtgtagtgccagaatgtgtaagggtaatgttctggcatttgtaagatgtttttaatgtgcatcagttcctttcaaaatatggacatttggcgt

SEQ ID NO: 76616 - DNA, 1039 bp, Homo sapiens
gatggataactatttgcatttagaaaatactctgagcagttaaaacatgctatgtactagattcatgcaaaggatttcataccacttgacaggtagaaagttaagcccattttgaatgggcacttcaaagtttggggagtggaaagctatgcagtttcttttaaagagagtttcttcttttcaagcctttgtctgaatcagtaccgtccaatgggactataatgcaagctacatattaattttacattttttaatagccagatttttttaaaaagtgccaagatatagatgaaattaatgttgacactgtttttgaccaatttatacattttatttactcagtatatctaaatattatttcaacatgaattaacatgtgatttcagcatttaacaattattgtgacatcttacatggttttttggactaagtctttgtaacctgaagtacattttagacttaccgcatatctcaattagaatgctaaattttcattggtgatacttgatgtatatttagatttcataaaatttataatgaaaaggtagatttaatatacctagattcttccaaatggacttttaaaaatctttaaaataacagaattaagtatccatttttaaatcatatattaattaaaatttaatataatttgatattccttggtcacactagacacatttcaagtgctcaatagccacagctggctgtggccactgtaatgaaccacacaagtctaaacagactgctcagggaggtatgttctccttcttcagtgctttgtttttttatttttatcatccctcccctgaaaattaggatttttgctttctctctcttatttttaatctgttgcctggagagcccaccgtttgaaccccatcatttaatgctagaagtctttgcgggaagtgggatactgaacacccctgctcaagacatgtgggcaggtctggaatttcctagttaccaggcttgtttgaaggcccaacacacagcttttaagctgtgaattttggcctgtttataaatccaagaa

SEQ ID NO: 76617 - DNA, 1075 bp, Homo sapiens
attagccaggcgagatggcgggcccctgtagttccagcttctggggaggctgaggcaggagaattgcttgaacccaggaggcagaggttgcagtgagccgagatcgcgccactgcactccagcctgggcaacagagtgagactccgtctcaaaaaaaaaaaaagtctttggaacattttcatgtgtcagcttgaagttggctttgggtatcaacacttgttatttcattcaagctctttgatgccaaccaatgttacatggcccatatcgagtagaaatagcctcatcatctcttaggccatgtgacccatgtgaatggtcccttttagcaggcacctcaggagtaggaggtttgaaagcacttcctcagagggagtaagtgtgggcttgtcgtggagcactctcttggctgtccagaagcttacattccaatcctggctctctctaacaaatctgggtaaatccttttacttctctgtatctgttcctggagaagtgaagaatttgtaccagctgctcaaccggaggttcatgaagatgtcaaaccacagaatacaaacaagacaccttcctggtcgctcagtgtacccaaagattttggagtgagaagatatttttatatgaaaatgaacacaaatatttttcagtagaatgtaaaatcgaggtgaattttcaaatgaaacccaaagattttactgaaagaatttgaggaacattgagttctgttaagttcccttcctgtgataactttccatcactgttttagcctctagctctgtctgtctgtcatctagataaccctgctgagtagaacattccagtcctcaacaatgctgggtaaataaagcatggctatgattttaaagcatgtattatttccaagaagacacagaattgccaactaggctaatatacatacagccaagcagaggccctttggaatctgcttttaaaaataccaagaaccgtttataattaatatatcttaagtaactacatgcagcaaactgagattctagaaaggctttttttctaaatattctgtttagcttaaaccaggccttattatcaagag

SEQ ID NO: 76618 - DNA, 1054 bp, Homo sapiens
aactagactgccttttagggatctccaatgagttcattgtgctcattgaacaggaaacaaagagcgtggtcttcaattgttcctgtagagatgtgatagggtggacttcaactgacaccagcctcaaaatcttctatgaacgaggagaatgtgtttcagtgggtagttttattaacattgaggagatcaaagagattgtcaaaaggttgcaggtgagtctctccttcctcttccttacatgcagtttctctttcataaagttttcaatacagactagagccaagttactgaaccttgtgctctgttattagctcctctgaaaactcccttgatgtgtgaagcaaacagagtttatctcatgcttgtgttttccatggatgtttcggaaaagtagaacaaattggggaagacacatttactctgtgtgtgtgtgtgtgtgtgtgtgtgtgtgtgtgtgtgtgtgcgttcatgttcaaaacccatttgcatgtgacctgttccctggtgctgcagtccagtcatctggtggtggtgttgaaaagaattgcttgagtatctgctgccttgaattttacaaaggctaaatgagtagcagtatatggtttctatttactgccagctccctgtaggtctctggtagaggtttccttgtaacttcagggaagccgttgagctttttggatgcaacaagtatattccttttggcctaatgaataggagattagtgaagaggaaataaccagactgctcttcagctggcaataaggtattcagaactaaccctgcttgcaatgattttccagttccatgtccaccacttaataccctattgctttaaaccacagtatcttttatttccttgtctagtttgtttcaaaaggctgtgaatcggtggagatgactctgcgaagaaatgggctaggacagcttggcttccatgtcaactatgagggcattgtggcggatgtggagccctacggttatgcctggcaggcagggctgaggcagggcagtcgcctggtggagatctgcaaggtggcggtagccactctga

SEQ ID NO: 76619 - DNA, 1058 bp, Homo sapiens
gcagccatctcaagtctactcctccagtgctccccaaatctgcccacttaagtaaccatggatggatccaacacagtccattttgggtgaaaacactaatttactgcttgtagaagcatagtttttctttaatttgtatgtagtatcccagacttaaaggtcattaggaacaaaaaaaataaatctgcataatatttttcctttaatatcaaggtcaggatttttatgacataaaaatgttggtgttttgagttttaataaaaattctttagttggatgatgttctttatacatagttaagagaaactgacacagtaagaattgataatccatttggcatctaaatagaataaagtctaatttctatttggtttaaatatatgagttttatgctctccaggtggctttctgattacagaattttacagtatttgtgagagtagtagttattaacaattaacattcgttcaacagaaataggtaatatgatacggtcactattttggcctcaaatttacctagagcttaagggtaggattgaaataaaaattgctggctgtggcacgctgaacttgatacattactgtgtttaaacataatgcgggatcagcaataaaaccctgatctgtgttaatatgcttataaaagttgagctatttgaggggctttggataaacaacagacatcttagcatgtaaaatgattttcttttctcctttttttaggctggtattaccagcctttatgtaaatatttgatgttagagctcactgaacacttggtacttctgagttttacctggatgtcattgttactccccttgagacccctgcacttaactcttaagaagctggatggggggccttttttgttcacgcagttatggcagctgcgtctgcagcctccctccctccttccttacagacaccagcaccatatagggtgtgaatatggtggaaacaaacttaaaagagttctcctctcagagagcataatagtcacgtgaccattcagtcttgatttttaaggaaatactttttaagtttgttatatcatac

SEQ ID NO: 76620 - DNA, 1074 bp, Homo sapiens
tcacactagttagaacaggcattgtcctaagttctctcaccatcatatgtaagatggatgatactcacatgggtgtctgggcttaggtgtaattctatcacctgtaactccatccctttttcttgcattttagaaggcatattaactttcagtctgttacagttgcttttattaaattattcacaaattttggcacttcattattagtgaccaactgttgttcaagtgatctagccccaccatagttgagaactcctgatttggggcatctgacataactatggtacttgtcctgaatcccccttctcttcttcattttctacaccactgatagggattctccttcattcaaaacacatgttaagcactcagaaatgtaaagataaataaggctcagtcctggccccttaaagacagaatcttaattcacattaagggagacacacataaaataaccattctgtatgacttggtgtaatggtgcaaagaacagattgtcatgggatttgaggagattctaatctatgaattcaaagctatgatgttggcatcaggcctttttatgtgagtagcaaaggaagaaggcattccaggcagagagaaaaagatgaataatagtgtgaatgggcagagtctgagaactgggacaccttgactttctctagaatgtagggtgtgtggagccattaatggggatggagatgaggatggggtttggtcagatggttcaaggccttaaagagggtctcagggatttggtcctctatcctgtaggcaaagggaagctttgaataggcttttagcagtctgttgacttgatggaagagggtgggttggggctgctggaggaatggggtggagagagcctggaagttgagagacctgtcgggacacttggactgacccaggctgcaggtgagagaaatcagaagcccctcagcaggttggaaactagatatcttctttgtctttgtgttatcaggaccagcaccaggtgcctgacacacagtttgtgctcagtaaatagtagttgaacttaattaacccaattgactgtggaaagtaaagacagag

SEQ ID NO: 76621 - DNA, 2709 bp, Homo sapiens
gatgggggttggaacttggccccaggtcttcctattgtttatctcctgcctttctgtgcaccacttcctggttttacccatacatgtatcagcctatagcaagaagacaccccacaagcatcagttcatccaggcccatctcaagccatcctcccacctcagcctcctgagtagctgggactgtagtggccaccacaccaggctaatttttttttttttttttgtggagcctggggtctctgttgcccaggcaggtcttgactcttgtcttcaagtgatcctcctgtatctgcctcccaaaatgctgggattacaggcgtgagccactgctcctggcccctatttggtcttttattatatggattatgcataaagttcattagtaaccacatatatattagtaaatttccatatgaatgtttaaattctacactctggcactttttcatgggctcagtcagtatttactttgttgatattgctagtcaaggcatatgctttaattaagcatgtattattattttacaaagggaaaaataaaactggctcactaaatagctaaatgttctttccagaaataaacatttgcctttattttttgccagtttacctgcttccaaattgcccttcccaaaggcagtttaaaatttatacagtttgaacgtggtttctacatgatctaaatgatagtaatctttgtatttcagaccacaaagcaagtactcagaaaatacttgttccaagaaccactgacttaatgatttagtaaactaccaagttaagagaaacaaacctccacagtataccatttggaagatatatatggaatattaatatttagtttgtgaactttttcttttggctgtgagtaagtctgaacttggctgtacgagggcttagaaaattttggtttcttatactacataccttaggttagctcagtcctaatggcttccgccctcattgttacaagtttgtttacatagcatgcatacctttttgagcagagtggtgtatattgaccacaacatacacatttccacacccacgtaaacacgaaccagggtgtgtatacaagtacagacacataagcaaaaaccagtagtgcctgtcattaaaatttagttcattacacccaggactgccttcccctcatgggtaaggtccctgatgttgtctttgcctttgcggaaatcaccacaggtttggagtgagccgtagatccccagcctccattgacaggcagaacacccagtcagatattggtggcagcggaaaatccacgcctagctggcaaagaagtgaggatagcattgctgaccagatgggtaagtaatcaatttctacaagaagaaagttgcttttacaaggtgacttaggtcacctcttgatgatgttatcaaaacattgttataaaaggtagccctagttaataaatatgaattagaattaagtctctgttagattatgtataagtgaaaacaataaataagacctaagagaaaaggaattctaagtgaccccaaattcaaaactggaaaggcgataggaattattttgagcacctagattaaaacaccagactaccagactaagtaccttcctcccccttgtttatttgtttttgcctagaataagtgccttgagagattgcttggtatacttaatgtcaatttgaaaaacaaaactactaacaaagtggaaaagagatacaattattgtttagtcacatccgtagcttgcttagaatctctttcctccctgatgtgcttttaaaaaaaattcttctcactctgctattaagctgtcagctaaggaaatgtcttagcagtatgaaacagctgggtggaagagatttgcattggtgagcttgtgcccggatttctactgcatagccctttctttctatatatatgttgtttcacagtgacaccataacactagttgatacaataacattttgccatgaaacaagattttcaacacaggagcctcagggatttggtaccaacacagttggtgcatcattaacttgaatctagattgttagactgttggattttttcctcctttgtttaatctctagttgcatcagtgtaggataaaaaggtgtacatttcagggctgaaaaagataatcttataagacaagacccatctgttaatcttctctgcaaattcattgttttgtcctgttttaatgactttgcccaagtaagtgtactaaccatggacatagaaaggagtggagatgtgttccactaagacaggggttgaggaagagaaatggagttcctaggttctgaagatatgctttgttccagtagcttcagtgagatgtgccttgttattgaagccatctgtcattctccactcttatcctacccacccctacacagaaaacctgagcatattctgatctgcttttctactcttgacagaatgttttaaatcccatatgttttgatactgttgagatggtaacgacacatgtgaaaaggatcccttcttcagcatgactttagcggctttttttggctcctagtgcaggctttgaacaaggctgccagcaagccctttgtgaggcatgcagtgtcatgcctcccactctcgggaagtcacacggagtgagaagggatggaaagggtaattacaaggttcttcctagacccctgttcattctctcacacaaacctccctctagtctttt

SEQ ID NO: 76622 - DNA, 1036 bp, Homo sapiens
tgctattagctatagtggtgttatggaggataaattctttatctctcacttttggaaccccatcttgaacgccagcttggagtccaaaaggaagcaattgttttaagtaaactagttgctgtgtgtcttttctgttgtgctcagcttacagttatagaggacctcaggatttcaattcttttgtcctcgagcagcatgaatatacaggtaaaatatttccaaagtgtcatggtaagtaacacgtgattgcatccatgcctgtctaggtaatgtagaccaagctaggttagccacacttggcaatgaatgaatttcataaatttaattcatataatctaaatttttcccccaaaccaaaagttgattctgaactttgctgcgttgttcatggcctttggtttggtggtacttggctatgctaatgtgtatgacgtgacaagttgtcaccagctgcaagctttatccatcagccacttaagtttctgacctgctgtctatcaaatagactcttaacaagcttactgctgaaatgcagagtttgctggtcagtgaactgaaagatgcaatggcaagccatcttcatttgtcaccatgtgcttgtttctgcttagtgcctgcaccataatgtcctatgctgtattccagagccaacatgccatctcccagcagtatcaaaggtactgccagctttccgagagagccccagtgggagattaatgcggcaggatccagtggttcatttgtctccaaacaaacaagggcatgtaagttaactgtaaacttaaaaaagtattagattcctagcagtgtaccttccttgcactatgaaaatgctctgctctttcctctgcatggccaaagaggaaatcattctggcaaagagtggtcgtttgctgccatggccttgcagtttctgctgccatggcctttagattgctttgagataaattgtaactcctcattgctgtgcttctgccacccccacaggtctggtcatctgattcagtcactaacaatcctgaaatgttaggagtgg

SEQ ID NO: 76623 - DNA, 1042 bp, Homo sapiens
ctttttttttttttttgagacagggtatcactctgtcaccaaggctggaatgccgtgcagtggcacaatctcggctcactgtagcctcaacctcctgggctcaagcgatcctcccacctcagcctcctatataactgggactataggcaggcaccaccatgcctggctaatttttgtattttttgtagaaatggggttttgctgtgttacccagactgggcttgaactcctgagctgaagcaatccacctgccttggcctcccaaagtgctgggactataggtgtgagccactgccccagttccaactttattcttttttgcatgtgaatattcagttgtctcaccatcatttcatgataaacctaattttttccccattgaattgccttggtacctctgtataaatttcacctcaaagcatgtcttagaaggctgtctcctaaacagaggctaattggggaaggaggtctctctagacataagtcttatattcagccttctatttactctgaacaaatagggcttttagaattaacatgctttctaattataatccctttggaaatgtcatttcctttctcttttaagatactaaaacttcaatgacaatttaaatttcttcctgactaaaataatctcaatagtattgatactttagcataaatcaaataatgaaaaatagattaaaaaaaaaaaacacgtttctagtaccctttaccatggatacttctgaatggaccatagtgacataggttccctgtcttactgtgactagtcattattggaacttttaggccttcagagccctataactagaaattaatcacagtgtcatttctgttattctcttgttcaggaagcaaaactttgcactcaaataaattctgcttctcttgcagtctgatagccactactcgagccactccagtagcaatactctctccagcaatgcgtcaagtgcccatagtgatgagaagtggtacgatggggaccgcacagaatccgaactcaacagctataactatctgcaaggcacctctg

SEQ ID NO: 76624 - DNA, 1032 bp, Homo sapiens
gacagagagccacggcctggaccggaaaacagagtcttccctgagcttagacatacacagcaagagccaagccggctcgacccctctgacaagggagaacagcaccttcagtataaacgatgctgcttcccacacaaggtaaccacccttccccgctgtctgattcccagcccagacctaagcccagttccctggcctcagcccactttactttgctcaatagtgtataaggaaaggaggtttttctgcagtgacaattatttttatatgtttaatgccctttatttgccttcaaaatactttaatcctgcaattttagtgcattattttaaactgtgagaaaattttgcagatttattctttttaaagttggatttgatttttaaaataatgttcctggctactacaatttgagaggaaatttgtaattttgtaatgttggctttcggtgagtaatagggaatgtatactgggacaagcttttgaagactatgtttttaaaatattgaccatattgttaaaagacagaggtcttttctgagtaacagagcatcgtttgcgatgccaagcacgtcctttacgtgcctctcaagccgagaacctcacttacctgatatttacattgtaactttttttcagtaattggctcctggcagcaatgggttgagagtgggggatgtccaatagaaacgtgtagctaaaattagacatacctttcagaataggaaagtacacattcccctgtatccttggagatcacacctctagataaaataaatactatttgtcgtttcctcttgattggagcctaaaatccccaatgtgacaagatccacatagggaagaagcattccatcactgtctttttaggcctgttgatctctgtgtggtttctccttttatcttcgattgttgtcagtcattgatcaatgtgtgagaccatctaaccttgctgtcttctgggtctgctatgattatgaccgcaagaaaaatagtagaggctgggcgtggtggctcacgcctgtaatccca

SEQ ID NO: 76625 - DNA, 1334 bp, Homo sapiens
gcactccagcctgggcaacagagtgagattctgtctcaaaaaaaaaaaaaaaaaagaaagaaagaaagaaaaagaaaagtaatagagaggcttaatttagtttttatttttcaaatggaaatctaggcacataatctgtcagtaaaccccagataaccttaaggagagaggacatcctctacttaatttggattgctttcacttgaccagctaagtattttgttttctcatggagtctctatcgctacttatcattgagcttcccttcatttaaaatgtcaggccccatggaatgaagcctttcactagttttgtttctgtttaccactaccacattgcagatctcaaaatgatggtgataggtctggaaactccatggcttccaagcaaaaggaaattgggaaagtagtctcagtattcttgagtactatgtattccgttccacaattcagaaagtagattgtttgattcaaatggtataagagatgtgtttgccaaagtagaacaggaagtgggcatcagatgccataaccatatagacagaatcacacaagacagaatgatgacactcgctggctgttcttggcacatccccatctcagtagactgtgcattgacttagaacattttgcatatctgaatagtttctctctggtttttaagtttagtttgactcctatttctttggttttcaatttgtcattttgaaaggaggatgcctttttttaagaatgtcttccatctgaaaatatttctctggtccaatgtgatggcagaagaaagttggttatagagatcttgtctcaaatggcatcaccatggagtgagattggaaagagctgggcccctgaaaccaaagcacagaatgtgcggctgtgccattatctaacaaatcccaggggatcaacaaagctccctgaaaaaagcatctgggtttgcattatctgaatgtgctgactggagctgcctgaaggcctcaaaggattatctaaattttctgcttctaactggaagaatgcagaatcattgaaatcatcctttagaaataactctcctattgaaagtcaaacttactagagaagagaagaatgtggccattcagggagggtggcagagcttctcacccactcatttgagtcacattcatttctagactctggtaagtagggatgttttgagactttggtatgttgatcttggcagagtgagttggataatcagagctttagcagcctgccttttctggaggaaaggggacttagccaccaaatgcacattgctatagaaaaactaaaatcacagcaaattagagtgtttgtgtcctcagaagacag

SEQ ID NO: 76626 - DNA, 1697 bp, Homo sapiens
tggtttcatttgagcatcaggtcaagatgagaagtttggacagattcaggctgtcccagatcctcggtgacctcactacctctcttctttttgaaacagtctggctctcttgccaggctggagtgcagtagcacgatcttggctcactgcaacctctgccgcccaggttcaagtgattcccttgcctcagcctcccgagtagctgggactacaggtgcatgccttcacgcccggctaatttcttgtattttagtagagacggggttttaccttgttggccaggatggtctcaatttcctgacctcatgatccacccacctcggcctcccaaagtgctgggattacaggtgtgagccactgcgcccgacctcttttatatggggtatcatgtacttgtgtatcctctcttccttttcaaaattaatatcctgacatgaccagacagaatctaaggttgttcctttttaggaaaggagaaatgccctatagcttatagaaaaattaaagttagtagtttcttcatgtagaatttagagacaacttgagtaaatttctagtgattccaatttggccatactcagttaaactcacttcttatacattgagaaaagtaacatattgcagttattatttcctgttacatctaatgctcttttccttttgttagatattattggttcattcccttcttacgtaattcctatgacaagatttaactctctgtgagtaaaatgaaattgcagcctattaaattaacatgaaatttccaggataatgaaagagcccagccacacagctccccttaaaaattatgaagctgatagcttcatggtagttgtattgtaatttaatctacttcagagattcttaggtgaagtgtatgggtgcacatcccttgacgcagtctcaggccagtgggttggtcagctgcaaggagcccacccacagctgtgcccagagacagactcattttagagtgggaggagttgaggggctaatgcagtatttcttcaacccaaaaaaacatgagaatactttggaagtgtgttaaaatacagatttctggggctctggaagatctaacacaagcccaggattccccagttacatcagtacctacaggtggccatgttctgtggcttgagaaacactgctgccgcgacttcaccttcttcacctagacaatatggaactggattttgaccgtcataacaatgtgtgtaattcaactggatgagagtgagcagtaggcctcagttggtgtgaacacttggaggacattttacctaatcttccaggcatcattcctcctttactaaattaaatatctaggattgggacacaagaaagtatgctttagaagagctcccaggtgacgctcacaggcccactgaattagaggccctgtgtactgaagtgcacagcttcatgctgtgagttgtgtgcattaaagaagaaagccataccagtgaattgttcatttgtttctctcataacctttgtgcctaaatctaatcaattaaatggggctgtctcaattagaaccactagtgaaaagaagtgcactggcatttcacacctgggagctagtgtcagcccattgtgttcatagataaaaccaaggatcggggttgatcttatttaaccagttatccttttaagaatacatgtgaaagccaggtgtggcagtgagcact

SEQ ID NO: 76627 - DNA, 1065 bp, Homo sapiens
ttgccacacccccaaaagtaaatgtacagctgctgcttcaatccagcaatctaagtctacccacacaccttcagaactttccaaactctcttgacttcataaagccttctattttatgctcagaattccagactgtaaatgtcttctctaaaacccagtctctctgcaccaagtcctgaatacctgtccagtgtgtacgtttttgtgttgtccagacctttatgtgaccacatggaaaggtttgtgtactcgtctcagcttgtaagacctttggaaactcacttaaggctctctcctttcttgttctataaagtgtggagtctcacgcccccggggattggaatgggtgtttattgagctgggcctgaagttacgtcactctgagtataggtatttctgtctgaggtcttctgggtctcctaggagaagggagtgcacccccagaaaggtcatggctgcaaactttgaagtcttctgttctctaggttcttaggtggatgatttgtagtctatttgaagagactagaaagctttaagaagaaccttgagaattgaattgattgaaatggaagctagaatatttcctaaaccacacaccagcttcagactgtgatcagagtgcaagaggcatggcgggtggagcagctgtgtggggctgccgccctcaggcttccctagcaccatgctagcgtgtgtgtgcgtgtgcatgcatctccccagataggccagataaaccccctaaacctaaaaaatcaacattcataggaactgaatgtacccccaaggaccactttagagttttgtcgagaaataaatgatttgttaacatgatttatgttaataaatcattgtacagatgtagccattcttgatttctgtaatttccgtctcataagccagcacttaacagttctgactcatcattcagggcacaaatggtttccttagcaaccttgcgaaagacagtgcttgaaacttctttctttatccatcaaaacccaaagaggtatattaaaatgttcaagtaccagttcaaaataaaaattatttcagatttttcctttg

SEQ ID NO: 76628 - DNA, 1071 bp, Homo sapiens
ttatctacctcgataggttcagttggtgtaagttagtagttaatcaagagctacctgctatgtgagttaaaatattttgatgatcaaatacccttgttgcccagcaagcatgttatcatccgacaagcttgtcaggataccctcttggcactgtggctctctcttcccccaggggccataacaccatttcatcatgccactgacacctgccattgtgctcagtccagcgttttgtttaatccctgtggtaatcctgagaggttttgtgctcccgttgtacaaatgaggaattagactcagagagattgtatgatttggtcagagacacaggattcaaataaaacccacatttgtctgatcctaaagtcttgtttttaaccacacacgatcttgataggtccacttaatcacatacctgaatcacatagggagcactgatagactgcaggcagcatgccaggctaaggaataatgaccaggaattcttgggttagctccttgaggttgtagaaatagacaatgagccctgaagcttccttgctaggggtgtgtctggagcagtaacttggttatcccaccctcccccaaccttggtctcagggatctgaaccagaaaattgactttcttttgtcttgatcctgtttttcagttccacgcactctcctctcctcagtctcctttccccagcacccccacctcacggcgggccttgcacagaacactgtcggacgagagcatttacaatagccagagggagcactttttcacctccagggcgtcacttctggaccaagccctgcccaacgacgtcctcttcagtagcacgtacccttctctccccaagtcgctcccgttgaggaggccttcttacaccttaggaatgaaatcgctgcatggtaagtggtctttcagctgcagcctggatggccctgttgatgatggtcagtgtccccagacgtggctgccactcatgtgctcagagaggggtcctgtatccatgctcagatggtctcagctcacccgccccttcctcatttgccctctctctcctgtaatcccagaccaccata

SEQ ID NO: 76629 - DNA, 1052 bp, Homo sapiens
tgtttcttaaagggaaattacatggctacaatcctcttatagctaaaacagtcatatttttccctgtgagggttgggaaataagatttccagtgcatcctgcactggaaatactagacatgactgccaactagaccacttgttgactttgatagatagggccagggatgtggttccaaaatactaaatggtttcttctctcctttccagtccagagagcctcattttttgctgctagtgatgaaaaccatcgccccttgagtgctgcatccaacagtgatcagctggaggaccaggctctggcccagatgaagccttacagcaggttggtcccagtgcaagggcagtactctgcaccttgtgtcacatctgccactgactgcatctgtggggagaagagatggaagccacacggagtagctgagtgaagctgatcactgcagggctagacactttacattttagtcagaacgctttgtaactgaatactgtagacataattaaactattcttgatgacttatacggccataatgatgaatattcattattatttaatgtcataatacatttatgccctcagggccagttggggcaggtaggagagaccatttgctctaagtattcctgtgctctgtgctgtgtagtcctgcagtctgggttttcagtctctttcgcagtgttgctgatggtcatgcttatacatgcgcttgctgagtcctagtggctcccagtgtgctgcttcacgtctgtgtgttggaaagctaaatcaccaggatggttaagatggtatgaaggtgaaaagtaggcaataactgaggtcctaagggcttctcagtcaggagcagggactttacaacttctatttatgcagagaccgacttttctgttttccccttagtttcaaaatggtgaggttgctagatttatgtgtgctaatttctgtatgttaaagcatcccatcagtcaggtatggaacatttagtaagcacttcttgttgcagaataatttcattcatttgaaatctcttcccttaaaaccctttgaggctgg

SEQ ID NO: 76630 - DNA, 1058 bp, Homo sapiens
gtgaggacttccttgacaggcactgccaacaagcaattcacttaaagaaagacaagacctggtgcatgttggagagcaggggtgtggactcactgctcactaaggatttgaaaaaccgtggtgtgaaagacaaactggcggccgggcatggtggctcacacctgtaattccagcactttcggaaaccgaggcgggcagatcacaaggtcaggagttcaagaccagcctggccaagatggtgaaaccccatctctactaaaaaataccaaaaaaattagctgggcatagtcgtgggcacctgtaatccgagctactcaggaggctgaggcagagaattgcttgaacacaggagacggaggttgcagtgagctgagatggtgccgctgcactccagcctaggcgacagagtgagactccatctcagaaaaaaaaaaaaaaaaaaaaagacaaactggccttgacctttgtggcccaagaagcaaaatagggaccagtgaatgcaagttataggaaacagatttttgtctccaaggtagttgatcaatggtgattgggtggtgtcctgagcttgaagtaaaaaccagctttaagaatcactttgcaaagaacctatctcttcattttagtggacacttgctgtctttaaataaacttagaatcacgaatcacagaatcaagatggaaaggatctttaaagtttatttattgcatctcccagcccaggttccaagctccgcttcactgtcccgccacatgttcagccacctgtctttggttacaccagtgatgggggaactctctacttcctgaggctgcacacttgatctttcaacttctcttttaagtccttccttttattcaggagaaatccattttcctttagtgtttgtatttgagacagggtctctctgtggcccaggctggagtacaatggtttgatcatggttcactgtgaccttgaactcctgggctcaagccatcctcctgccctggcctcccaaagtgctgagattacaggtgtaagccaccacgcccgacctccctttaatttttacaac

SEQ ID NO: 76631 - DNA, 1065 bp, Homo sapiens
gattgagcccaggaagtcaaggctgcagtgagccattaactgtgccactgaactcccgcctaggtgacagagtgagaccccccaccccaaactctaaaaaaaaacagacaaaaacattgagcactaagtctgtgataagcttccctggtagacagcattttccacttgtcacaatacgatgctggaggaattaagcccatgctgtgtgattccacagcgagagaactcttggaaacttgcatttggttccttgtctggcaaagagaaaaggtgctgattttgctttatattcttttgctataataaatcctagctatgaataatattatatgagtcctgtgaatcctcttagccatcactgaatctgggggtggtcttgaggacctccaacccagagctcctgagctaggagcacctagatcttcctagaccctcagaaaccataggataataaatatttgttatgttgaggcactgagttttggagtagtttgcttcacagcaataggtaactaattctggaagccagtcatttctctcttcccagcatttagtttagtgtcttggaacataggtgttaaagaaatatttgttgagtgacttgacactatttctgcctttgaagaagttcatagtccatttggttcctttgctggaggaatctaaatcctggcttggtattatgaagcaggcttactctcttttttctgtggcctagaagaatcaatcgcagtggcagcagcctgccttaacgttgtcaggttctgccatcttccctgttgaatgagatccatgggtataagaattagtgtatgaccatgcctcttctcttttactcacttcttaggtcctttgatttttattttctctcccttctatgtcatggcagtggtagctattcttactattgaaataaaaacttcttcctgctgaaaaattaattaccaaatgtttcagggccttataagatattaatatttccatatcgagtcttgcctcttactctatcatatgattgccttgaggaaagttcagacaaattaactttccattttacattgcacc

SEQ ID NO: 76632 - DNA, 1079 bp, Homo sapiens
ctacccacagattggaagggacttggtgcagggatatggcttcgggtgacaacccacctatcagagctattcaaccattgaacagcatggctgtcagtctgaggtcgcagtgatgtcaggaggtggcagttttggcagctgacagccctcacagatgcccttgtgcagaatgaacctatcaagcattttctctactggctatgaaatggaaagtgaggcaagacattcagttgctgcacaggaaggaaagcagtcagggtggttgcctgagcgtccaggtcccagacaggtctgttctccatggaatacattaagggattgatttacctgtcttggagctgcttcacattgcagtagagggactgtgccgagtgtcatgcaatggccagttatcttgcagaacttgtttgtttctgcaattattaaaagttttcctggcagtttttttgttttgaccgagagtctttcctccaaaaatcattctctccatcctctcagaaccctggataattctctcctgtttgtcgtttgcataccatgtacctggaactcttatgttctggttaagtattctagcataagagagaggaagcaaaataagtcagcagaggatactttcagcatactgtgacttttagaatgttcagttagtgatactaacgtttcatagcctgtaccaataatcaacttttctttcccctgaagacaaagtagcatggttgtgacctatctatactgacttgttttcttcatgcatgcattcaacaaatcttaattgagtgcatgttatgttctaggcgtggggctgggctgaccctctgggaaatgacaagatgaaatgagacacattcctcctttcaagaaagtttgtgtggaatgtagaagatcattcattggttgaggagattgtaaactatcctggaacacagtggtttaggatgaaacaaagcagtgcacaaatgaacgctctagtcagtgaggctccattagaggttcctcaagggtggggactgcgttgagtgtcacgagactcctagggtcagcacagtgcccagcggctggtacgtgctttctaagta

SEQ ID NO: 76633 - DNA, 1083 bp, Homo sapiens
cgttaagtcaggatccctgctgtgacactagggattatagaagtgttgaaagcttcattctcatccagtcattcattcagtgcctggctggggttgtgataagcaaaagcaaacccatccctctccacatgtagcttccagtctcgtggtggcatttcctcagaggatgaagccatccaggtagcatagcaggcatgaggtggttccagtaaatggaggtgggacagtctccttgggctgccaccctgcttggggctattcctggtagggcctggagctctgcctagagaagcccacatgccctctcctggagtcacaagggcaggccaagtattctgtcctattccagtctttgctagaatgtgtcaagtgctgtgggcttgagtccttggcaatttttgcatgggacttagtttgggggtaagttttctggaaacttgaaatgtttcacttaaaaagaaaaatgcaggattcaaagaagtaaagagtaacaaataaatagaggcttttttagttcaggggtcagcaaactgagggcattgcagctgttctggaattaatgcgtgtccgggcaagggtcagtaattctgagatgccgttctgttgctttcaggccttttttggtgaaaactcttaaaggaggtataattcttcccttgctgggagtctttgtttcagaggggttgtaaaaaaagattcccagaggataaatcatatctgtattaacttcctaatgaaatgaaaaattatatcattgctgattattcctccttggctgatatggaaaaaaatactattaatactttttagtgtgattttaatcctttgcattcacggatatttgcattagtattttctggacatcatcttgtttatatggattttattcattgtaagatgccatcagatccaggcatctgagttctgggggggcaatgctataatccctgcccagaaccaaaactttccctgtgcagatggtctttcaatagagtggaatgtgtttggggtttctgcatatttcagtttacaaacccttcagtgatggttgtcttcatcctgagtttggctccatgcttcaga

SEQ ID NO: 76634 - DNA, 1021 bp, Homo sapiens
aggtggtcttggtggggtttctactagaaggaaatggcaggaactctgacctgcttgctgtcaagtaagcagacagagaggctcggaatcccctcccgcgtcacgtttccttgaggtgcctgcttgtttaatctgccgtttgccttgcttcccccaacgcccttttatagctccttttgttcaaggatcttgccacctcctttttctgtccctggcccgcctccaggttaaatatccaagaaggacagcagtagcctgaagatgctgatgacatgggggacgttcatggctggccctgaagaaaggctctcataggtgggggcgattgatacggcttccacagtgctcccacccacagagcccagggcagaggcccgaggtgcgccaggcttattttacagctttaattcccatgagcaggattggagaaagggttagtaaaggagaaaaggactcagatgtgtcgggtttcagggaaggaactagtgagatcggggtgacaaggggttcatttgtccatttggtaagtgtttattgaaagtccactatattatgtgtaaggtccttttgacccagaaagtctgaaatttgggtagcagtcattaatttgtattagataccacatatgttatagaagtggtagaaataatgttaataatgtcatacttccgttcccgatggtcacatgctaagtgcgtcacatctattccattgaatcctccccacaactgggatggggtggtattgtcctcgctgtgcaggggaggaaagggaggcttggaacagtgccttgctcaaggtcagggaatgaggagaggtggaactgggatttgagttcaagtctgatttcaaattccacattcttcacctctgagtctcttgttcccaaaagctgtttatggactggtggcagtctgtgatagttttcactgatccaaaatataaggacagtgtaactggatttttaagaaagcgtactttaaaaaattcagtggttctgaactggtgcaattttgcccac

SEQ ID NO: 76635 - DNA, 1013 bp, Homo sapiens
ttcaaccttttcttctggtaagtgggtttgaagatattgtcctttcttgacgtggtacattgtagatggtgacatgagggttggcagtactgcagtgaaagtttgcaattattttgtgtatgtaaaaaaggtagcaggccgggcatggtggctcatgcctgtaatcccaggtctttgggagcctaaggcaggcagatcacaaggtcaggagtttgagaccatcctggccaacatagtgaaaccccgtctctactaaaaattagccaggcatggtggtccgcgcctgtagtaccagctacttgggaggctgaggcaggagaatcacttgaatctgggaggcagaggttgtgttgagccaagatcgtgccactgcactgcagcctggttaatagagcaagcttctatctcaaaaaaaaaaaaaaaaaaaaaaaggcagcaagctatttctaaattctactggcttactttgcacaggcatggggacaaaataccacacctggggaaaaaatagatgatcttagagtaactttttcattttgtgatttgaaacatttaaaaagcaacatggtggctagtctgagggtagtgagttatctcaattgattgttcacagttacagattgaactccttgttctttccttccccctttctcactgctgctcttgactagtcttaaaaaaaaaaacaacaacatgctgattgtaaacaatgcacagtaaagaacataaaacaagaaaaaaagaggttttctctctgtctgtccattctgttccccaaagctaaggagtttttgtaaatccttccagatattttctatgcctcagcaagcatgcatacacacacacacacatacacacacacacacgcaaggctatggcagaatagttgttggtagtttaattaaaaaaaaatcagctgtagggtaattttctttatttctttgactattggtaaattgagagaactcccattcagattctttagaaaagtcctttctataaacacttaaatg

SEQ ID NO: 76636 - DNA, 1290 bp, Homo sapiens
gggaggtggaggctgcagtgagccgagatggtgccactgcattgcagcctgggcgacaagagcgaaactccgtctcaaaaacaaacaaaaaaaactccgtctcaaaaaaaaaaaagaaaaagctacacaaatagccaactggcacatgaaaagatacccaacatcattagtccttaggtagatgcaaatcaaaaccacagtgagataccactttatttatttaattttatttacttattccctcctaccccccttttggctgaagtgcagtggcgcgatctccgctcccggcaacctccatctccccggctcaagccgtcctcctgcctcaacctcggagtagccggaattacaggcacgagccacaacaccaggctaatttaaaaaatatttttggccttccgccacggccgccatggagagcagcagccatggctctgcgctaccttatggccgtgggcctcaacaagggccacaaggtgaccaagaacgtgagcaagcccaggcacagccgccgccgcgggcgtctgagcaaacgcaccaagtttgtagcgggacatgatccgggaggtgtgtggcttcgcttcgtacgagctgcgcgccatggagtcactgaaggtcttcaaggagaaatgggccctcaagttcatcaagaaaagggtggggacgcacatccgtgccaagaggaagcgggaggagctgagcaaggtactggctgccatgaggaaagccgctgccaagaaagactgagccccctcccctgccctcttcctgaaataaagaacagcttgacggaaaaataaaataaaaataaaaaatatttttgtagagacggggtctcgctttgttgccgcccaggctggtctcgaatttctggcctccagcgatcctcctgccttggcgcagcgttgggatgacaggcgtgagccaccacgcgcggcagcaaatctgagatttaacacagagagccagtatgtgcccagcgtatgtgtatgtagtgcacagaatatgtggaccaccctctataaaggttcatgcatgaggaggtcggctctctctcacagtctagcagttttccacacaaaagcggcacacatttttgcaccggtctccaaaatggtgtctggtttgggagcccgcagcttccggaattacaggctctttcctgcttccagggcaccattccaggcctggcctcaataggcccaaggcgcaggcccagaggaggccgggcggggtggggggcggggtgcgctacacccagtagggagcagccccgggcgtccgtgc

SEQ ID NO: 76637 - DNA, 1052 bp, Homo sapiens
acacatttgggctgcaggggcagggatattgctttcagagaagagaggtatagacaggcaaaagagcagatcgggggttagagagaaatcatgaactcacttttgaacctgttgggtctgtggagatagacacgaagcagcataggaacttggtgctcagtagcgatattagggttggagctgcatctgcattggtagatgaggtggtgttaagtctgaaaagaaaaggatctaggacagaacaatggaaagcacatacagggtgtgtgacccaggagaaatgagcaaaggatttatttagcaagaagaaaaccaagagaaagatattacagaagccaaaggaagaatgtagcctcctggtgccacatgttgcaggaataagggctaaaaagagaccactcactttggcaagtaggtaatcaatagcaagagcattttagtagaaaggcgaggagagaggaagctcaactgcagtgggttgaggaatatcgggagatgaagacattgaattcgtagatgtagaccattctttcagaatatgcccatttttttggattagaaatggaacacttacaaatgaaaaacctgggcatgtttttaaaagctgagataaggagaaggagacattaacatatgggggaacagatagatgtctgcagttcctgggaaggaatgaaatcaacagccaggtgggatgggtctcccttgaaaaggagcagtgatacctgttgtccaagacaaggaagaagacaattagtaaaggcaggtatttgtggagcagaagggagtgaagttaggggtttcatgcctggcaatttttcttttcttttttttttttttttttttgagatggtgtcttgctctgtcgcccaggctagagtgcagtttacagtgagcacaatctcagctcactgtaaactccacctcccgggttcaagcgattctcctgactcagcctcctgagtagctgggattacaggtgcacgttacaactcccggctaatttttgtatttttagtagagatggggtttcaccatgttggtcaggctgg

SEQ ID NO: 76638 - DNA, 1068 bp, Homo sapiens
ctcatactggtgagtgggagggggacacctgcctagggtgtggctgccaccctctggacactttgtggcttagcgttgccagtcatcaaacctggctctggagaagccaactgcaatgaaagtaggtggcatcttcttggttgtacgattttaacctgcctgctggctacccgctgggagacgctgagctggcaggcaggctgtggggcgaccatcatcaccccccacttcagctccgtcgtttaacgtcagagtctggacccagccacaccttgactactgaactttacacaataacttctccttggctgtgttgtatatgcaattaaaaaggctcacagtggacctggggacatctgcttcttcctgaactggggcaggacttggtggctaaacctgcagcccagtgtgcctttggtcactagagggtaggactccttgcttgccgcccctggcttcagtggcacctcccatcaacacacctccattacatcatttgcagggggtgaaaggccttctctggtttgggttggacccaagctggaagccaaggtcagccgcttaaacccaggggccagggaaaggttggcagagagctagaaggaccactgcaaacaaaggtccctgacctttcgatggaccacgtaagagcagggcctgcccggcaagccctatccttcctggaggctgagggaaagccagggagagtgagaggaggatacagaggcaggagcatctggactcggtcatctgctggtgggactggaggccgatgctagagattgaccctggaggttgatactgcatcctcctgccccaggagaccgccacagcagggcccttccatgtaaggggtgttggggaccgggcccacattctcccatgtggcttttctctccatgtgtgcttgggggtatggtttgactgaatgagtagaatcgtctcttgtggttggttcccctcagcagccccttccctggggtaaagtgggtggggacggtgggggtcattggtgtgtggggtctggtgatgcacaggccactgttcacaagcctggacatctcgacc

SEQ ID NO: 76639 - DNA, 1193 bp, Homo sapiens
taagacttgattttttacttgagcctaggagtttcagaccaacctgggcagcataacatgcatggtgaaaccttgtctctacaaaaaaaaaaaaaaaaaattatttgagtgtggtggcgcgcacctgtagtcccagctgcttgggggctcggggggaggtgaggtgggaagatcacctgagcccaggagatcaaggctgcagtgagccatgatcgtgccactgcactccaacctgggtaacagagcgagaccctgtctcaaaaaaatggatttatggttgctgagaacccatagggaaagaaaaggactccaggagtttcttgtcttggaaaagaaagtgaaatgagatggttggggtaggttgaagcagcgcttgtttaactggtcctcaggaccgtccctccaggggtccaggagttgatctggaagggcccacaccagggcacagagttccttggaaatgggcgacagtgactgtggcctgcatgggaggggtcctgccctgtgtgtcagagtgatgcgtcatccagccaggccgcagccagcactgaggcttaaacaaataagaggagcttgctgtctagggagcaacctttaagttgcagtggggtgatggcggcatccgtgagaagctgtgacttgctattcagttgaagcataagctgcaagatggatacaggttgaaaatggcttctgggtgaagtgagatacaccttcagagttcggcttatctcctgccattgtagaaaattcagccctgcccagagggtatgccagatagaccagatgtctccctgtgggtctgttgaaggactcaggcttgaggttacttcctgtcctgcttaagccccaccctcagaatgcttgttccagcccatttgaagaggagcaggacgtgaagagagaagtcacacgtctgtgtccccacatgttattccacaggaaagcatattactgtagaataactttccatctcgctgtgtgcttcctcaccaggtgaattcggtgtgctgggcctcgctgaatcacttggattcccacattctgtatcctttggcagaggaagaggtttggtgggcaggccacaccctgacgttggacctgggtatctgtgggcttcatgacatggcatcttagtgaccagaggactagacccttgtgcacttacatctcacgctttagaaaaaaaagca

SEQ ID NO: 76640 - DNA, 1047 bp, Homo sapiens
ggcctgattttttaaacatataaaatatataacctgggagctgtgaagaattggtgtttggcttatacattttaaaaatggtttgtcctactgggtaaatccaagtacccaagaactgctcacaatacctttccatgagaggttgtgtagagcaactcaggccagcctttctggatcaaccaactttcactcggctcagacacccttacaaaggaacccactgatcctttctgatgctctttctcccctgtcaaagagtactagatggcacacagaggagtccaatttcaatctggccaaatttctacatggggcaaacttttatattctgcctgtcccaatccaaccaaccatgagagcaaactgctgggccaagacatcactgttggtcccaaaggactgccggtgtcccgtcaccacgttggtcaacaggacccgccgagacaagcctggcggagacagagatgggctggtaagattatgtcacatgtagtctggggagagggacaactacatggggttttaaggcctgttaaggcctcttctctgggcacctggggagccaggctcacctgtactgaagcagttatttgcttggatattcagggaccaggcacaggaccaggcaccagggatccggaaactgcagagcatgccaggccggtctattcctgctaaggggataggagaatgtaaagtgtggctgccttctaggcaggccagggaccactgggttcggaaaacatccaaatatgcccatagctgctcagagggtctatacctttggccccattctgggttttgtggttgcaagagagactcagctgggatgcctggctcacaagtggttattccgaaaatgcatctttgttaacgttcccagtagtcgtgtttacagtacgaatagtactgatatcagggaggtagtatactgttggaggtaaggtggctccgatcctcgatcacctaccagctatgtgatctcaggcaagtgtgtgtgtatatacacacacacacacacacacacacacacacacacacacacac

SEQ ID NO: 76641 - DNA, 1014 bp, Homo sapiens
gggagaaggaagaggtcagagccttagataactggggcggacggattaaatatatttaagaatcgggccaggtgcggtggctcaggcctataatcccagcactttgggaggctgaggcgggcagatcacctgaggtcaggagtttgaggccagcctgaccaacatgtagaaacccccatctctactaaaaatacaaaattagccaggcgtggtggcacgcgcctataatccaacctactcgggaggctgaggcaggagaatcactagaacccaggaggtggagggtgcggtgagagcgccattgcactccagcctgggcaacaagtataaaacaccatctcaaaaaaaaaaaaaaaatttggttctttatagaatatgctgtattagtcagggtactggcaggaaacattcaagtgggtaactgcgagtctacctagtgaggcattctgggccagcaacagtgaggtgtgatgaccagctgtaggtctgaagggacaaatgaagagttgctggaacccggctctctctgagcgctttccaatagaagtggtgggttttggttacagccacccacagcccaaccagaagggagccggggaaccactccctctcctcttgccctctgtgttctactgctgcttcccactggctgaacctacctagctgctgggagccagggaaccctgacctagtccagaggtgagtcttttgggcatgcacagagcagggtggagatggacagatgatgagggcagagtgggtctggaggggcccagggaagctctccaggaaggctatgaaagctggtcccagcagcccaagctcatgatctcctaagtcattcacagaagtgcatgtcacaccatgattcttctcttggttttattgtttggtagaaaaacaggctctttaacactgaataaacatctcacgaactgtcgctcctagattacaaaaagtcaaaaccaatttcctttgacgccgggcccttgaatctgacattcaagtcaccgt

SEQ ID NO: 76642 - DNA, 1052 bp, Homo sapiens
gaaggttctagttttcgctcctagaacctttctgccttactttaaaagaagggttataaaggagccccagaaggttgcagctaaaggactaacagatgtcatctaatttcagagtctgggctgacctgacccacagcacagacccttgcagtagttgcaggacagcacagtggtgtctgggatcagaatccagaagcgttctgctattggtccctgagttttccatttgggagaggacttagaggtgacagcatttcctttattactgtctacagctgttaccgaggcacaagtggacgatgaaggtggaacgctcattgctcggaaggtgggcgaggccgtgcagaacactctgggagccgtggtgacagccattgacataccactaggtgggcctggcagtgcttctcttgggggtagtggatgcgggttgaggggtttcaggtgccctgggctgtcactttgtaaaggcttgccaacctagattgagatgggtggtaaaggaatcaattacacaatgccacacatttgcttgcttctgctgaatgccttagtagtttcatgtttattgctggaagccattctcttacagcatctagtgctgtgtaacgagctaccttaaaatgtaaaggcttaaaacagccatctttgatgtctttgcaggtctagaagtcaggaagggtaattattcagctccaagtggcattggctctagttactacctgatattccagggtggtagctggagtggtctcaagggtccaagctgacctcacttacaagctgggtgccttggcagggacagttaggaggctgtgtgtagcagagcctcactcggtctttgtattctccaggcctcttcagtggtttctttggcacttcttaaatgatgtcagggttccaggagttaatgttccaagagacaggaagtggatgctgcccatctctttttttttgtttgtttgtttgtttgtttttttgagatggagtcttactctgtcacccaggctggagtacagtggtgcgatcttggctcactgcaacctccgcct

SEQ ID NO: 76643 - DNA, 1795 bp, Homo sapiens
tatttgagtgccccccctgtgcaaaacactatgggtcggtattgattccaggtgattcctttcactattaggggaaatgtttagagcacattagaattttctggggagctttcaaaattatttatgccagggcaccaccttctgggattctaattaacgggtcgtgtgtaggacctctgcattgctatgtttaagatgctcctcagaggattctaaagtgcagcccgagctgaggacattgagttgggacagtgcttccgaaacttcaattgtgtatgcatcaccttgagattctgttagaatgcagattcggaatcaggtctgggtgaaacctgagattctgcatttctgtcaagctcccgggcaatggctgtgcctttggtttgtggaccgcactttgttatggttagagcagtgatccgcaaattttagcatgcatcagaaaaacctgaagggcaggatcactgggtgccccctccacagtttctaattcagtaggtctgagatagggcctgggagtttgcattttaataaatttaataaattctcggccgggcacggtggcttacgcctgtaatcccagcacttggggaggccgaggcaggtggatcacgaggtcagcagatcgagactatggtgaaaccctgtctctactaaaaatacaaaaaaattagcctggcacggtggccggcgcctgtagtcccagctactcgggaggctgaggcaggagaatggcgtgaacccgggaggcggagcccgcagtgagctgagattgcgccactgcactccagcctgggcgacagagtgagactctttctcaaaataaataaataaataaataaataaataaataaataaataaataaattaattaattctcaggtgatgctgatgttcatggggaccaccctttgaggatcactggattagtttgaactgttgatggctgttaaatcagtgtggtgacttgtctgatgggccccaggggatttaaatgcagtgtgtcgaggtcagatggcagcctccatgtcctgtagacaatcccttccactcttcactaccaaattgtctttgcttctaccagaaccaccctgtcctgcacacttctccttttacaggagtagacctgacctacatctgttatgaatggtcatttcactttgagtcctgtaggccacctgctgcatgcagaaccacctctgaccttgccgagaaaaagacctgcttcttggattatacagcctgggcaagggagaactaaggattatcttggagagttcagtttggaaaggggagagggatgttagttgacagtgtgacttaccttcctttttgcatgccccatgagcccagcacaagagacttaagcactgttggatcattgctttcccattgtgagcctccccaggatttctggaactttcccttttatcatagtgaaattctaaagtcctgatctctgtttttgcattatcaggatggcagagctcattgttcatttggaaggcttgttcagcctaagcctccccttaatgcattgccaaattttggggttggttttcattttgcatcttggcagcctgttctgggtaaacgttccatttcatcttgtttggattttttgagtcttctgagagacgttcaggtttcctctctggtcaagttggtatcttatggctcctccatttctgctgaggggacaggtagtttttccaacaagggatttctgggtgtatttttttttttttttttaaagacagagtctcgctgttgcccaggctggagtatagcggtg

SEQ ID NO: 76644 - DNA, 1831 bp, Homo sapiens
gttgggagaaccatttcatagttgaatttgtataggttttatgtaattttgtcttaatttttttttttaagacagggtctggctctgtgtcccctaggcaccatctagactcattgcaacctctgcctcctgggcccaagccatcatcccaccgcagcctctcaagtagctaggactaacaggcacacgccaccacacctggctaatttttgtattttttgtagagacagggtttttgcctgttgcccaggctggtcttgaactcctgagcttgaggtatctgtctgccttggcctcccaaagtgatgggattaccaggagtgatccactgtgcccagcctttatgtaccttctttaacctctgagctctaaatgtagaaactcttgacgttccaattctgtcacatcgggaagcatttatgaagtatttataaagttatgttttgttggggtgtgatgtcactgatgacagaagtgtgtcccttttgagtcaggaaattcattgctagcccttgatgactggggccagccctatagatacaatagaaagagccacactgttgtcaaggcaactaaagttcaagatcatctggtctccaggcaaccttttccagacttgcctcaaatgctttcccaagctttcttggggtaggtgggcccttccctgcctttctcttctagctttgggatctcaggaggaggagaacccaagaaactgtggaatgatgtgaggtttggaatttttgaacctgctaataagtatatggatcaggtggtatgtaaagaaaaatcagggccgggcgcagtggctcacgcctgtaatcccaacatttttgcaggctgaggcaggtggatcacttgaggtcaggagtttgagaccagcctggccaacatggtgaaaccctgtctctattaaaaatacaaaaaatcagctgggcatggtggcacgcgcctgtagtcccagctacttgggaggcggagattgcagtgagccaagatcacgccactgcacccagcctgggtgatagagcgagactctgtctcaaaaaaaaaaaaaaaaggaaaagctgattagattctaaaagaggagtttctccctactcttgcatctaaaacatgctaacgttggattttttttttttttttttaacagttactgttattttcccacactcttgattcttgtaaagcctcctgaaacttgtcaaggtctgattcattagtcaggctgtgacttgtgaacgagtgagatgcttgttcttacctcatatgcaagagtgtcagtggccagcatctgaaggctggcttgcctggagtctctttcttatgtcataagtggttacctgttaccttggacaacataagccaacagttcatttgtctagggcagggaatgatggcatatgtactgtggcaaatcaggctgcagattgtttcacaccaagccttgagatacttacaaatgcccccatttctctgaagaactttcagagaagtgaaccaggtcacttgggttgaaacagtaagaaccttacgctgtattggatcctaatttcccatttactgggagttggcatcctctgtgaattcaacccagctgttgcactcatgccagatttatatcatttgtccttaggaaaaccaatacttaggctagcctttcagttacctgtttaaaagaaaaactctgcggctaaaaattgctattcttggctgggcacagtggctcacgcctataatcccagcagtttggaaggctgaggcaggagaatggcttgagtccaggagaccagcctgggcaacatagtaagaccctgtctcattttaaaaa

SEQ ID NO: 76645 - DNA, 1076 bp, Homo sapiens
ctcccataatgctgggattacaggtgtgagccaccgcacccagcctcgtatcttacttttataatgaaagatttttgttgttgttgtttgagatagagtcacttttgtctcccaggctatagtgcagtggtgcgatttcagcttactgcaaccttcgcctcctgggttcaagcgattctcctgcctcagcctctggactagtagggattacaggcatgcgccaccacgccctgctaatttttttgtattattagtagagacagggtttcaccatgttggccaggctgaactcctgacctcgggtgatccacccaccttggcctcccaaagtgctagggttacaggtgtgggccaccgtgcctggcctacttttttttttttttttaaatgtcactcactacccatgtgcctgtgtttctgcttgtatagatcatccctcagaggtgccagagaagctcatccaggaccggttccggaagctgggccgtttccctgaagcctttagttccattcactacaagggaacgaggacttacaaccctcccacggacttttctgggcttcggcgtgctttggagcagctactagagaataacaccacccgttctccccggcacccgggagtcatcttcaaagccctgaaggtcagttggcttgtgccccaagggcttctcattggggtgccagtgggtggtgagaacactcagttcgccagcttttgtggtgctggtgattggaaatctgggtggaaagaggttataagaagcggaagcacatgaatggagtccgcacctgtcagatgctttcatcttgccaggagtgcaaatatggggaagtcatatgtgatagtaaaaaaagtgcccggtcctcagctaggagaaaaaccaggcactcatttctggctggtgtggctcagccctggtgagttggtgtcatgttgagtctcacttaatctggacagcctttatgcttttcttaacattgactcactgtttttttcttatttaaattaatttattcatagaggaaactttttgttatcactataagcggaaaactagtatcacaggtagaaa

SEQ ID NO: 76646 - DNA, 1315 bp, Homo sapiens
tcatagctcactgcagcctcaaacttctgggctcaagggatcctccctcctcagcctcctgaagtgccactgttacatgcgtgaaccaccacacctggccttatctgttttttcttttgttacttgtgcttgtgttgtcctatctaaggaactatagactaatccaaagtcacaaaggttaattactttgttttcctctaagagttttacggttttagctccttttttttgtttttttcttttcttttcttttctttttctttttatagttttagctcttttggccactaagttatttccctgactaaagcttcagaggttcctttgagctgtttgctaagggtggaggtggggagctattatcctgtgacttcctttctttgacaattcaatcaagttccttgtccttgggaagcacttcttcttgtaggtgtttctagtgcttttacagtttctgtatttcatggtctttttttttttttttgcaggtaacaaatgaagaagactttattagaaaattggactgcaaacctgatcagcatctgaaagtggtttccatttttggaaatactggtgatggaaagtctcatactctcaaccacactttcttttatggtcgtgaagtctttaaaacctccccgacccaggagtcctgcactgtgggagtgtgggcagcctatgacccagttcacaaagtagcagtgatcgatacggaagggctcctgggggccaccgtgaatctaagccagagaacacggctgctgcttaaggtcctggccatctcagacctcgtcatctatcgaactcatgcagaccggctgcataacgacctcttcaaattccttggggatgcctcagaagcttatctgaagcacttcaccaaggagctcaaggccaccactgctcgctgtggcctggatgtccctttatccacactgggccctgcagttatcatcttccatgagaccgtgcacacccagctactgggctctggtgagagatggggtacagtgtcacagctcaacctttatgggtacaaggaggcagctatttggtctgcaatagcaacttgttggtagtggattgcccagaaagatttctgtccaaagaagacatagaaagtgtttcaaggaggatggagtgatcaaacatgtcaatctgcttataggtcaactagcataaggattgagaattgccaattggctttggcaatatataagtccttagtgatctggataagacctgttccctgagatggtggggggtaaaagcttgatcagagtgagatcaagagaaaataggaggaagccaggta

SEQ ID NO: 76647 - DNA, 1063 bp, Homo sapiens
tacatgcttttctcattctttcagtctaaggttaagtatgtgaaacttaaagactactgtggattttaggaaaatctgctatcgtaatagtttttctccactaaaaagctaattgaaatgattcaggacacaatttccaatagaatctttcagatgtatgattcccttcaaatttgctagtttatctattttctgaccaatctaacaagtcaatagggaaatagtatagtgaaaaaaagaaaaaaacaaccaatactaggtcagtagatattacttcaataaataaacaacattttgcaacagcaggaatatgcagtcttgcgtagcattcaaagccccctctgaagtttaagaagcaaaggtttaggaagactgaaaggaggaagtggcacagtcatgacagaaaacaatcaaggcatagataggaatttctgccaagtcaggtcaaagtaagagcacgtgtaagaaatgccccaaaggtgagaataaccgacgcatattgaagcaaggggtggaagtggctccttcctttttatggctgcgtggtaactcagtgtgtggatataccacattttatcagtggatgggtattgggctgttttcacttttttggctgttatggataatgctgctgtgaacattgatgtacttagaagatttgtgtggacatgtgttttcagttctcttgggtatatagctagatgtggacaagctgttttccggactggctatgtgattttacgttcccaccagaagtgcatgaacattgtgattctgtacatccttgccaatgcttgttgtcttttttttttttttctttagagacagagcttctctctgtcacccatcctggagtggagtggtgcagtcatggttcactgtagcctcgaactcctgagctcaaacgatcctcttgcttcagcctcctgagtagctaggattacaggcgcataccaccatgcccagctaatttttaattttttttatagagacagaggtcgcaccatgttggccaggctggtctcaaactcctggcctcaagctatcctctcttttttgcctc

SEQ ID NO: 76648 - DNA, 1879 bp, Homo sapiens
tgatgactctggcttggggcaaagcagcaatgatgtcagtcagcatgcctctagcatttactacaagttattctgggcctccactgtgctaagtgcctgatgtacatcatcttatttaatttttgcagaaatcctatgaagtagattgtgttgttatcttcattttagaggtgaataacagagccccagaggggttgaataaagttatcctaaagtcagtggatgatagagtgaggttggttgaacctttaatggtgatactataccattccctcccccagaggatatagcgtctagacattttgtgctgtgttcattcatttattgatcaattgtgtcttgatttcctattttgcgtcaggcactgtgctaaggttacggtagtgaacaacacagaccatatctctgccagcctggagtacattctagttggggtgtttagcgctggaagagtgggaaaatgttaacagaggtggtgggtgggaatggaggctttgagcaagagaagggttgagtcagttgcccagggtatgatttaaacctaactctcttttctagcctggtttgtgtagcttagcttttactgttaagtcctttcttagccctcagaatcattccagaatgaaagaccattctgcttactgacaggcctttactggagcttacatctgttttcacagctggccaaatatggatatgctatgccacttaaaaaggcagctgcatctcccatccagaagctcctcagaaagttcccttgaggatgaggtggggcttggggatgactcggtatttccagtgtgtcctcagaattcatctttgccttggaaagctttttattcagatataaatggattgctgaactgggtgtgttggatgtggtcaaagaaactgatcagggagctaaaaatgactttttttaaaaaaagaatttttgtggaccatctctgcatagaaacacttttattaggccaggcatggtggcttacgcctgtaatcccagcactttgggaggctgagacggacggatcactgaggtcaggagttcgagaccagcctgaccaacatggagaaaccccgtctctactaaaaatacaaaattagctgggtgtggtggcacatgcctgtaatcccagctacttaggaagctgaggcaggagaatcacttgcacccgggaggcagaggttgcggtgagccgagatcgtgccattgcactccagcctgggcaacaagagtgaaactccgtctcacacacaaaaaaataaaaaaagaaacacttttatttctgctaggataggagaggagctgcaggcagtctctgtgaagcatagtgtcagaagcaccactggtagttataagacatggagaggaattcctgacctctcaagtaatggaacactttggggacactagagtggaagaaagtgatctttgcccctgccaaatgtgctcagtgtgtttgtgagaccaaccccgtgacttcagtgtcttcagaaaacatttgattgagaaatgattgtgtttttatgtgaaactctagcaacatgtacgtggatagacatgaggtatacataccctttaggatagaatgaaaagaaattttctaaacttgctgtgttgaggaaacagatttaatagaacttaaaccttgctattggaagaaatctaatcatttggactttaaaatagactggttactgatctgtttgacatagtttaggtaaaatcctgtttgaaatttaggccatggggttgggctcagtggctcacacctataatcccaagtgctttgggaggccaaggaaggagtattgcctgaggccaggagttcaagaccagcctgggcaacatagagagaccctgtctctacaaaaaata

SEQ ID NO: 76649 - DNA, 1599 bp, Homo sapiens
tccttccccccttccttcccctcttcctttcccccttccttcccctttccttcccccctttccttcccccttccctccctccctccctcccttctttccttccttccttccttccttccttccttccttccttccttccttccttccttccttccttccttcagatggagtctcactctgtcacccagctggagtgcagtggcaccatcttgactcactgcaacctctgcttcccgggttcgtgcaattctcctgcctcagcctcctgagtagctgggactataggcgcctgccaccatgcctgactgatttttgtatttttagtagagacggggtttcaccatgttgaccaggctggtctcaaactccagacctcaagtgatctgcctcagcctcccaaagtgctgggattacaggcatgagccactgcacccggccctgtatgggaattctttaccacaaactgggtgtactggtctgccacatgtctgtgccacttctatttcaggcttgtctgctgttcattttcttggccctgttcttggctttctggtctagggtagcttcatggggcttgttctttccagctcctcttgtttgagattagctggtagataacataacagaaggaaatccttcaggacttcattctggtcagtagatcatgagccagagggatcataatctttcaaattgttgaattttcccatttttctcttccaatggccagagtattataatgtaaggactaattttggtgcagtagctggttagccctttggcaagttctggtcagaatatgaatatatctattattggtttcttaggtgtcatataaatataacaaaaaaatagatcttcgtaggagctgtcaaaataataaccaatagttgggttggtagtagggcctcctcctccatcattgcctttaacacaaagaaactcaagtaaaagccccttttgtttagtgatattggtagaggggaaggcattatatggtgtttactgggaaacacagggttgaggatgactcagaccaaaagaaagatgaaagaaaccctattatgtgccttcagtttctgcccagtgtcttgtgagctttttcagcctggggatcattcagttacaacagactcctggcatttaacttggtacgctattttgttttagtacaaggatgtttcaaatttgacccatgtaagccatcgaaaccactgtgagtcagctttctagagaacctgtctttaactactttaagacaccttcagtttgcatgattctcttttttcttctggcctgtcaattccttgaagtgattgatttttctggaattgagcaggcatttggctttttgagccaggattaacataatagacatatttcttattaatttgaccttcagtgttttcctgtgggtgcatctactggctgaaccacccttgagtttatccaggagattatataggcagatgcacttctgatggctggtcagacttttctggggagtcttccctacttcgggaggagctctcatgagatcatttctatctgaggttagaactgctaaatgtatcgaacacatttgcttgatgggaaatc

SEQ ID NO: 76650 - DNA, 1082 bp, Homo sapiens
tgcatctggccgtattcattgatttttctaggcctcggtggaactgtactaggaaaaccaaaggacttacagatcctttatttatttatttatttatttgagacggaatcttgcactgttgcccaggctggagtgcagtggcacgatctcaagctcactacaagctccacctcctgggttcacgccattctcttgcctcagcctcctgagtagctgggactataggcgcccgccaccacgcctggctaattttttgtacttttagtagagacggggtttcaccgtgttatccaggatggtcttgatcacctgaccttgtgatccgcctgccttggcctcccaaagtgatgggattacaggcgtgaacaccgtgcccggcccagatccattatttagaggtcataataaataaatgattcatgctgacgagtcatctataatctcttgaagccagaggcaacaccttagcaaataagttaaaggtcagaagaataagatttctggtagttagagttcttagtgggggaagaggatagaattttcccatctcttgggtcttgtatgggagtcagacatcttgttgtattagaatgttaacctgtcaggagaagaaaggtgaaacagtaaaaggcatttgtttttcttcgttcttgtgtttttattttttatttatttatttatttttgagatggagtcttgctctgttgccaggctggagggcagtggcgcgatctcagctcactgcaatctccacctcttgggtacaggcgtgagccaccgtgcccaacaagactgcttctttaagaagacccatcgtgtggcttggcggcctcacttgtttacagtcccagaatagtgttgctcagaatactgggacttgactaaaagagatgttattctagtggagttcaggaatggaaaatagcaggccgggcgtggtggctcacgcctgtaatcccagcgctttgggaggctgaggcgggcggatcacttgaggtcaggaattcgagagcagcctggctaacatggcaaaaccccgtgtctactaaaaatacagaaatcagctgggcaggcacctgtag

SEQ ID NO: 76651 - DNA, 1031 bp, Homo sapiens
ggcttgagtctgagttggggagatggtagtgttgtgacagctaggtgagattggggaaggggtagtataatgtttatacttttgaatgaaggtagtgtaatgtctatacttttcttttgagtgggctttcaagtgaagtttgcttgaattcacatacttgtttaccaatcactatatagccaagggtaagtgataaaaatcctttccattcctaatctttttgagtcctatcaacaatcctgtgaagtaccagtgaaactgaggcacagcttaaatgatttttatcacagtctggcacatagtatccagtaccagtttgttgtagtcagtatcactggagtatctgtggtccactgactcagtacttttgatggtggtgactccttaggtttccagtttggaggggagtacctatgtaagttaccatttgagaggctgcctaattacccacctaatatttttcttctgtacttttttccttcttggataaagctgatggaaatgagttacatcatgattcctgtatacttccattgtcatgttaatactttgctaacacagattttctttattggtttgagaggatcgaatagagttatggaagagtgacctagatcccattccatgtcccttgtcagcgataatgtctttgttatggattacgctgtaattgggcgacattgtggactgaatcttttataaatggaacacttggattttgggtgattcttgatggttttgctcagttctctgtaatgtcagcttttggaaagtcatagtttggttgttgccacttttgtcaaatgaggggaagctttgggatgaactagtaaccctcatggattgcattggcacctttaaaaagaatgtttttttggggaggagaatgtgtatttttttttctttttgtagcattgatatgtgttccttagttgagaattaagagcatataaagaagtgtaatgaagaagataaatctaactacccagagatgatattggtccttcatctttttttttcttgaatgtaat

SEQ ID NO: 76652 - DNA, 3480 bp, Homo sapiens
cggagatggagatgaggatggatctgccggtgtcctgaggaatagcctctgcccccactggcgccctgcggccccccgacgccgccttgctgcggccgagcttctcagtggtgggatccccgggccgcggcgggcagggcagggcggggagggcacggcccagcgcggggcgagtgatcgtcctggggctcaggctgccctcgggaggaagggggggcgggtgcggcgggggtgggggtggggtggtataaacaatggattcggctccgggttttgccggcgtgggggggattttgggggaccttctttgttcttaggctccgctcctgcccctcgggttgtggcggtggtgtccgggtggaaggaagggtgaggaacccccggctggggagaggtgtcgaggtgggggcccgagtgggcaaaatgtttggttgacatggccgggcgtgaggtgtacttttgaaggttgattttatatttttctcaattgtgacaagtttgatttttgtttctgttttgggagctggctgggcatgtctgaggttagattgtagtaaataagatcccctagtcactcccttcgccttccttgtttatctgaaaataaggttgatagattgattactgtaggggaggagtgactatcagaaaggcagggctttacaccttgtcggggccttggaatgcgggtcaaggctagggggaattaggaatataattgtcaaagtgacaaaagcccctttcttgccccagttatcttttttcgtattttgaagttatttttaagttagtttttaagtgacaaagagaaaaattatttgttttgattcactgcaggcctggctttgccatgggtcaaagtagaggaattgtctcctgttgctccttttttttttttttttcagttagtgaaagaagggacagaagaattacagtgtaaaaaaattgtttttaaagatgaaattgttactattgtttctaagttttgagtctttaatatacatctagctagagttgaaacaatccagttacaaggctaaccaggtcggcccaggtatttgatagatctaaagtttattattacattttcattagctttgtgaaggcctctccactcctcccaattgtgggatgcatgtgggggtgcagagggctgtccttccaaggactactcacttagtgatttagattctgaatttaatatctgaatgaacagaaaattccagtctgggaaatagagcagcaaagtctcttaaatgccttgggcctagaggtggcgtttgttgtcaagaggaggagctttagccacaattttgagatttttttttttttttttttttttgagggagtcttgccctgtcttccaggctggagtgcagtggcaagatcttggctcactgcaacctccgcctcctgggttcaagtgattctcctgcctcagcctccctagtagcttggattacacgtgcctgccaccatgcccagctaatatttgtatttttagtagagatgggatttcaccatgttggacagggtagtctcgaactcctgacctcaagtgatctgcccacctcggcctcccaaagtgatggaattacaggtgtgagccactgcgcctggctatacaacaagccagtgtaagtgttaagatagaaaatgagatttctggccaggtgcggtgactcacgcctgtaatcccagcactttgggaggccaaggcgggcagatcacctggggtcaagagttcaagaccagcctggccaacatggtgaaaccccgtctctactaaaaatacaaaaattagctgggcattgtggctagcgcgtgtaatcccagctccttgggaggctgaggcaggagaatcgcttgaacccgggaggcggaggttgcagtgagccgagactgtcccattgcactccagcttgggcagcaagagcaaaactctgtctcaaaaaaaaaaaaaagaaaaaaaagaggaatgagatttctctcagcagttctgggctaatatttaatttagtcaaaaaaaatttttttaaaggtgcacttctgttttttagatgagtgaaatccttttccttcctctattctaggtatcccctgaaatactgacttcaggtcgaattatattgaaaagctcctgaccactttctttcattaccaaaactttgtagctgatgtccaaccgatgaacccaccaccgtgaacccatcagacctctctcagatagccataaaagacccttccaagtcaattttgaccacatctttgcttgcactttatggaggatgaaaccatcaaaccaaatcaacgttgctgctaatacaagagtcttagaggcagcaaattaaaaatttgaacatttgtttgtgaagaactataacaggacatgaaaggtgttcttttttaaagtgttcagaaccctgtggaagtttcgtgcagtcttcagactcaaatcttcgtcttcacccccggggcaagctcagtgactattatatggtgggtgtgtttccttaccagcgtgagtatgagtgcccagacttccccagcagagaagggcctgaatccggggctgatgtgccaggaaagttacgcttgcagcgggactgatgaagctatctttgagtgtgatgagtgctgcagtctgcagtgtctccgctgcgaggaggagctccatcggcaggagcgcctgagaaaccatgagcggataagactcaaacctggccatgtcccttactgtgacctctgcaagggtctcagtgggcatttaccaggtgttaggcagagggcaatagtgaggtgccagacctgcaaaattaacttgtgcctggagtgccagaagaggactcattctgggggtaacaaaaggagacaccctgttactgtgtacaatgtcagtaatctccaggagtcactggaggcagaagagatggatgaggagaccaagaggaagaagatgactgagaaggttgtgagtttcctcctagtagacgaaaatgaagaaattcaggtaagcacacgggtatagtgggattcatgtgtagtggagcagatctgttgttggaagccagctctcaaaaaacgatgtccaagaagagatcacattttaatcattaaaaggcaagacctctggaggctttagttgcatggagtcagatttagttaccagctgcatgacctctggccgaattactttacttttctgagccttagctttttcatctataaaatgggggacagcctacttcatcgagttgtgaggttgaaatgagacagtgtttgtagagcctgtcgcataataaatggtcagtgtatacggtagctgttgttagtattaattgtagcattattattagaacaaactgatttaaaacatttcagaatgagagcaccctggcaagctgtgagtaaatgttagtgatgcgggactgcacctatccagggaaacacacactaacagtgggtcccatgggagtgcta

SEQ ID NO: 76653 - DNA, 1039 bp, Homo sapiens
agagatgaggtttcactatgttggccatgctggtcttgaactcctgagctcatgatccgctctccttggcctcccaaagtgctgggattacaggcatgagccaccgtgcctggccctcaaagataatttcaaattgagaagttctgaaagtataatagcttttttttttttttttttttgagacagagtttccctcttgttgcccaggctggagtgccatggcgtgatctcggcttactgcaacctctgcctcccaggttcaagcaattctcctgcctcagcctaccgagtagctgggattacaggcatgcatcatcacgcccggctaattttgtatctgttagtagagatggagtttctccatgttggtcaggctggtctcgaacgcccgacctcaggtgatccgtccacctcgacctcccaaagtgctgggattacaggcatgcgctaccgcgcccagcctgagaagttctgaaactatagaaggaaagatcagaaaaataataggtaggaaaaaaaattcatggttggcttggagaatacccttgaagggtgttaagtaaaaatgataggaggcctttgttttggactaaactcctgcaccaggccccaatagacctggctaaaataaaaatggagtcacccatgctaaagtttcacctcaccaaatccaaactaagttgttaccaaacccaagctaagttgttatctgaccttcagagaaatcaggaaagagggataaggacagccagtttcccaaacaggcttgttttaatgttgcatgataatgaagctccctctgttgtaatccttacacaaaagaagtagcctgaagtaactgatgtcaactaatcagttatttttctattgttctgtctctctgtcctcaccttccaaggaaagtagcttagaagtgaccaatatgtcaaggtcccatgagaagactgaaaaaaagagaagaaagaggaaagaaaagaatgacaagaaagagaaagaaagaaaccaatatgctctttgttctttgcttttgcttcctcaa

SEQ ID NO: 76654 - DNA, 1014 bp, Homo sapiens
taataaaatactgaactgtctctttagtttttggagcttaacttcgttttacacggaaggccgcatttctatagtttgctaactgttcactagaataaaagcctttttcctccaaattccttttcagatatatatatattttcagagacagagtcttgctctgtcgcccaggctggagtgtatgatctcagctcattgcaacctccgtctcccagattcaagcgattctcatgcctcagcctccagagtagctgggattacaggtgtgtgtaaatagccacaaagcttggctaatttttgtatttttagtagaaacagggtttcactatgttggcccagctggtctcgaactcctggcctcaattgctccacctgccttggcctcccaaagtggtgggattacaggcatgagccactgcccctgaccaaagcttgatttttctagacatcctgaggcaagtgggacagaagacaaagcccaggacctgggggaagagggaaatctaaatctaggaactcagtctacagtttcagtgagggaaaatgggaagtaattatatctttccccaacagagtgaaaagaaagatgtcttggaagagagagtttgtggaggtgtgtgtgggtggcactagacccataagctagccctcccagggatatgtagcccaaatatacatctcctggtggtcaaaaatacaaacctcaaatggtgaattgtttcaagtgtccttctttgcagaagcaaaagcaaatcctctctggaggaataaacctttatcctaggcctccaagaattcccacaaatattttccaaggaaaatgtggctcatggtaaaaaataacttagtgtgcaaagaatgagaatgagtaaagaaaactgacatgagaaacagatctgctaatttcaacgatctggtaaaagaataaaagtaggccaggcatggtggttcatgcctgtaatcccagcactttgggaggccgaggcgggtggatcacctgaggttaggagttcg

SEQ ID NO: 76655 - DNA, 1050 bp, Homo sapiens
tcccccacccccgcctccgcgctcccccttacctctaccccaccctggcgctttcgcagccaccccggcttttcctcctccaccagctgaggcacccggtctcccggtttccacacgcgttcagagacacaaactcacccgccgctgaggaaacggtactgccttcgcgaccttctgggatccaggttacgagtgcgctccactggttcgagatttctgcccgtcgctcgccagggagactgagtgcccaagcgcctactcgcacaggccgcaaatacagccgcgctgcgcggcgagctgatggaggtcttcctcttgcccggcgtgcactgcggccgggggcggggagcgcggaaccatagagaagaacgtatatagatcgtctccgctgttggctctgactcaccaagccgagacgaataaccatagagaagcagcgtctagcggttactagaaaggcccgaactgtaaattatgacccaccatgtttgattggagccgactgaatcttacgactacgggacgccatcttgaggtcaaggttccggctgggcacggcgcgaggagtgttagaggctttctcacttttcgtagtttttcggggggtggaaccttgctttgtgattccttgaggttcgaggaactgataactgggcgcgatctgcaaccttagtgttaaaccccaagtgctgttataacaactactcgagatcaacaaataattggcaaaggctgtggaggttttttgaaaagcaaaagcttatgcgtagttgtagggccaaagaggtggctagaagatgtttggaaaaacgtgaaaagtcctgtaatactagttaacacagctttcgttctgtaatctaaacgtgctaaaagaacttagcttaagttaatggaaatgaataaaattaatcataaatgattacgttattccaattgtggaccttataggcaatatctagttacacgcctttctcaactgcttgcctctaggaaggcataaaacggattcagtataaagttattgcctccctgagttcctggtgctgtgtt

SEQ ID NO: 76656 - DNA, 2034 bp, Homo sapiens
tacaactacgcataagcttttgcttttcaaaaaacctccacagcctttgccaattatttgttgatctcgagtagttgttataacagcacttggggtttaacactaaggttgcagatcgcgcccagttatcagttcctcgaacctcaaggaatcacaaagcaaggttccaccccccgaaaaactacgaaaagtgagaaagcctctaacactcctcgcgccgtgcccagccggaaccttgacctcaagatggcgtcccgtagtcgtaagattcagtcggctccaatcaaacatggtgggtcataatttacagttcgggcctttctagtaaccgctagacgctgcttctctatggttattcgtctcggcttggtgagtcagagccaacagcggagacgatctatatacgttcttctctatggttccgcgctccccgcccccggccgcagtgcacgccgggcaagaggaagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcgggtgagtttgtgtctctgaacgcgtgtggaaaccgggagaccgggtgcctcagctggtggaggaggaaaagccggggtggctgcgaaagcgccagggtggggtagaggtaagggggagcgcggaggcgggggtgggggaggggtcggcacgaggcttggtttcttctcttctctaaggcctggaaaagctgtgggcccagccgtagctggtggaggccagacctacggcttgagctttccgtcttgcattgtcgcccactttccctttcccttccacgttccgccgcggagtgaatcgtctctgccccccctgggctccacgttagatacaaaacgatcgatctgccccaggggagcccttccctgagcccccttacttaccggagccccacagtaggttttcgggcctgggacactctcgccccagccgttgccttgaagttagcctctacccaccctttttagcgaggtgctggccaccaacggatatctttcccttcctctttggccatctagagcccgccaccaagtgaactgggccccacccccttggaattgagctaatacctacctttttagcagtctcctggcttgcttaagatagtcatgaattttgccatcctgcctcttttgcgcattggagggtgcagtaaactgtatatcgccattcattctaggcgattactaagctccacattaaaatgttactttctcatttttctttggtcgtcaatcctgcttttaaatacggttttccggaatagacgtaggactatgaagatttttcggaggttatgtaatatggatttgtattgccatggaaatgccattttgatactgggcagagtggagccaagagaagggaagagattggacctctgttgcaccctactgctgtattagtgtgaagtactctgtgtattaggccgtgggcagtaatgtataaataatttttgtatagtctttggagcttttaatttttttaaaggctatttccaaaaacattcagaggacttgaaagggattaagttggtcataagttactcatgattcaagtgaatcttatagtattctaattcatttaacttaaagccttggtttttctttttcttttttcttttaagctttggtttttgttcctctgtaaaatgaatttatagtagtatctatacgttattggggttggggattgagaaaaacgtatgtaaaatccttcgtgcagtatccaggtaacacacataagcatttaaatctatattgacataatttgttatttaaggattttcaatgaaatgtaagagtccaaccctgactctgtaatttttttttttgttttgtgttgttgttttttttaagacggagtcttgctgtgttgcccaggctggagtgcggtggcgc

SEQ ID NO: 76657 - DNA, 1813 bp, Homo sapiens
ctcgatttcctgacctcgtgatccgcccgcctaggccccaaagcgctgggattacaggcgtgagccaccgtgcccggccttctgaatgtatttttaaagtaaaactagtccatgttaacattgggtaactacttcagacctaacaggaatttggaattttcaagttatgtttttgtccacagacaaattagcagtttacttttcttatttacacatgatttagtgaaaatttacattattttatagctttggaagcaaaggaatcatttatcaatcttaacatcttgctaaaacagtctgtattttagagatctcttgattgacttttcaaacactatcactgccattcacaaaaggggatttttgattcttcttaaatagcttttctacctttttttgaaaattgaaagttgctgaaactagaagaacaaaattccactacccagaattattggtattggcttttaactttttatttagacataatttcagatttacaaaaaaagttgcaagaatagtacaaaagaaatctcagctatctttcaccagattcctcaaatgttaacattttgccaatttgctttatccttctcttcataggtttcttctgaaatgttttgctagtaagttgcagatgtgatgccccttaacccataaatacttaagtgtattttctaaaaattaggactagtcttacctaacaacagtacgacaatcaaaatcaggaaactaacactgataaaatacctaatctacagttcttaaatagattttgccgatttttctgagttggtgtacttttttttttttttcctttttggagatggagtctcgctctgtcacccaggctggagtgtagtggcgcgatctcacctcactgtaacctccgcctcccgggttcaagcaattctcttgcctcatcctccatagaagctggaattataggtgcctgccaccatgcctggctaatttttgtatttttagtagagacggggtttgaccatgttgtccaggctggtcttggaacttctgacctcaggtgatccacccgccttggcctcccaaagtgttgggattgcgtgagccaccgcacttggccaatatgccttttttaaaatggcagctatatgaactatattgacatagaaaattcacctgtaagtgcacaattcaatgatttttggtaaatatacaaagttatgcatccattaccccaaaaggattccttctgtctgtttgcaagtcaccctgttccaccccagtttcaggcaagccctcatttttctgtatagatagtagtagatagcgctgcttttttgttttatttggtttttgagatggggtctctttcacccaggtggagggcagtgctgcgatcttggctcactgcaacttccgcatttcaggcttaagcaatcctcccaccccagcctcccaagtagctgggaccacaggtgcacgccaccatgcctggctatttttttgtatttttggtagagatggggtttcaccatgttgcccaggcgggtctggaactcaggctcaaaggatccacctgcctcgtcctcccaaagtgctgggattacaggtatgagccactgtgcccagccttgtttttgtttttaaaaagatgaattcttcctgtgttgctcaggctggagtgcagtggctattcacaggcgtaatcccactattgatcagtttgggagttttgcccttctctgttggcaacctggtggttctctctcatcccaggaggtcaccatattaatgctgaatggacttagcatgaacacctgatcagtagcgtgct

SEQ ID NO: 76658 - DNA, 1584 bp, Homo sapiens
ccgcctcccgggttcacgccattctcctgcctcagcctcccgagtagctgggactacaggcgcctgccactatgcccggctaaatttttgtatttttagtagagacgagatttcactgtgttagccaggatggtctcgatctcctgacttcgtgatccacccacctcggcctcccaaagtgctgggattacaggcttgagccaccgcgcccggcccggagtttcatacttagcaggaaaaggtgctttgaaccttctaaaatgtgaggtactttcaatattttaaaaaatgctatggaaatgatttcagtgccataagataactctgcatttctctcttttaaatcccacatattatacaatccctcagcaaatcctattggctgccttcaaaatatatccaggatccaacaacttgatagcactttcaccactaccacctgttccaggccaccatctctccaggctaccatctcttatatggattattgtaccagtctcttgcttgtatcctgttcccttccaggcttaacacagtggccagtgatactgttaaaatgtgacaagtcagaaactcttcaaatgattttcacctcattcagagttaaaactaaaatgtttatttacattgtgttacatagccctacactctactcataatactcagtatttatttctgattttcttcatttattctgctccagtcatactgttggccttgctattcctccctcaaatacaccattcctgcttcagcctctttgtatttgtcttttcctttgcttggaagtctctttcccccagatatgaatagggcttcctgcctctgcctcttttaaatctttgttctaatcttcaccttcttggtgaggcctaatcgctgtatttaaaataaactactccatagctctcttccctaatttatttttctacaaagtacataccatctttcaatgtattataatttattttgtttatcatctataggtaacagataagctttgcttatgattatgaaagttaattctcaatcagtttcacatggcaaaacacataaacctgtgttgaaataagtagttggtaatcttttaggctgcttaaagtggacattagtatttatcaaagatgagaaatgttttctgattttccatgagagaccaatcttttttatttttgttttgaaatggagtctcgctctgtcacccaggttggagtgcagtggcgcggtcccagctcactgcaacctctgcctcccaggtttaagcaattctcctgcctcagtctcccgagtagctgggactacgggcgcctaccaccattcctggctaatttttgtatttttaatagagacgggctttcaccatgttggccagtctggcctcgaactcctgaccttgtgatccgcccgcctcagcctcccaaagtgctgggattacagatgtgagccaccgcgcccaggagaggccagttatcttaaaggaatatccataaaaattagctgttaactggtatttttgccttcacctttgaagtccagcctatcaacaagcaagttttggcagctccaaataaaggggaatatgtt

SEQ ID NO: 76659 - DNA, 1218 bp, Homo sapiens
ctgggattacaggggtgagccactgtgcccagctaattttttttttttttgaaactgagtcttgctctgtcgccaaggtggagtgcagtggcgcagtcttggctcactgcaacccctgccacccaggttcaagcaattcccctgcctcagcctcctgagtagctgggactacaggcgcacactaccatgcctggataactttttgtattagatacggggtttcgccgtgttggccaggatggtcttgatctcctgaccttgtgatctgcctgccttggcctcccaaagtgctgggattacaggcatgagccacctcacccagcccagtgtttatatttttagtggagacaggggtttcaccattttggccaggctggtctcgaactcctgacctccagtgatctgcccgccttggcctcccaaagtgctgggattacaggtgtgagccaccgcccctgaccgagagttttagtttttaagcattatttatatctaatattattgggggaaaagtggttttaaaaatgagttcatggcccagtcttgtaaccattgtgaggctaggcactgggccattgctagaatatagtatgcggcatgagatagcataataaatttgtttattgaagtcctcagagtttgtttactgatttattcattaatcagtttattcaacaggtatgaaaaccaactatcctaagaaagcactgagataggctattataatgataatagaagagcttctgtaagtaggacagtagccctttctgttttaaaaagagataccacccccagtttttggttttggtcaaaaagttttacagaaagtttattttaaaactcaacacatttacagtcttgcaatcttgtgtttttcattgttaatatgtactgataacctacctactgtttaaaacatttctaatacctcatttgccaagtatattaaatcctcctaagggctgggcgcagtggcttatacctgtaatcccagcactttgggaggccgaggccgacggatcacttgaggccaggagtttgagaccagcctggccatacatggtgaaaccccgtctctactaaaaatacaaaaattagctgagcttggtcgtgcgtgccttgtggtgtgcacctgtaatcctagctacttgggaggctgaggcaggagaatcgcttgaacccgacaggcggaggtttcagtgagctgagatggtgcct

SEQ ID NO: 76660 - DNA, 1059 bp, Homo sapiens
taggtcatgcttttctgttttaaagaaatgtctagtaaacaggtaaacgcatactcaacctcattagtcatgagggaaatgtaaattgaaataagagtatattttacttatgaaattgtgagaattttgacactgatctattctaccaatgatgaggatatgaggaaagggcatacccatattctggtggtgggaatatacatttatatgctagttttcagggatgattttggaggtaaagtttggatacatataattttttttttttttttttttgatgtggattcttgctctgtcgcccaggctgacgtgcaatggcaccgtctcggctcactgcaacctccgcctcccaggttcaagcgattctcctgcctcagcctcctgagtagctgggactacaggcacctgccatcacacccagctaatcagatacatatagttctaacctgtattagagaattacctgtacagatgcatacagttatatgtctattatctccaggaatgttcaacattatttgtgagagctgaaagtggagccaactgttaatgttggttaaataaatatgtccgtattataataatttactgcattattattattttattatttttgaggcagtcttgctctgtcaccaggctggagtgcagtggcttgatctcgggtcactgcagcctccacctcccgggttcaagcaattctcctgccttagcctcccaagagctgggactacaggcatgtgccaccacgcctggataatttttgtatttttttcatgttttattgcctgtatttttttttttttttttgaaacagagtctcgctctgttgcccaggctggagtgcagtggcgcgatcttggctcactgcaagctccgcctcccaggttcacgccattctcctgcctcagcctccctagtagctgggactacaggcgcctgccaccgcacccagctaattttttttttttttgtatttttagtagagacggggtttcaccgtggtctcgatgtcctgacctcgtgatccacccgcttcggcctcccaaagtgctggga

SEQ ID NO: 76661 - DNA, 1998 bp, Homo sapiens
taatgtttaaatattaacattaaatggcaatacttaataaaatgacaaagttttctttaacatgacaaactaagtgaaacagttaaatgtgttcttttttttctttttctttttcttcccaccccgagacagagtcttcccctgtcacccacgctggagtgcagtggattacaagtgattctcctgcctcagcctcccgagtagctgggattacaggcgcacaccaccataccctgctaatttttttttgtttgtttgttttagtggggacggggtttcgccatgttggtgaggctggtctcgaactcctgacctcaggttttccacccgctttgacctcccaaagtgttgggattacaggcgtgagccactgcaaccaacctgttcttaaactttaaaaaatcaaatgctagcttctgattcttcagttttgattcaagaatggttacaaagtttacttttaagtttaaaaaaaaaaactatgacttttttttctcttgtcaaaagttgtatgttctctttatatttgaatggttactatctgactggaagtcaggagtttatttccccctgctgagatgtatggttcatgagcacatttgtctcttaggtagtggccagcattgaagcaacaaatactgtgtaacttggtacctttagtttttaggattctgatagatataagaaaaatgggccgggcgcggtggctcaggcctgtaatcctagcgctttgggaagctgagtcaggcagatcgtgagatcaggagaccgagaccatcttggccaacatggtgaaaccccgtctctactaaaaagataaaaattagctgggcgtggtggcgcgcacatgtaatcccagctactcaggaagctgaggcaggagaattgcttgaacccaggaggtggagattgcagtaagccaagattgcaccactgcactccagcctggcgatagagcgagactccatctcaaaaaaaaaaaaaaggccaggcatggtggctcacgcctgtaatcccagcactttgggaggccgaggagggtggatcacttgaggtcaagagatggagaccatcctggccaacatggtgaaaccccgtctctactgaaaatacaaaaattagctgggcgtggtggtacgctcctgtagtcccagctacttgggaggctcaggcaggagaatcgcttgaacccgggaggcggaggttgcaatgagcagagattgcgccactgcactctagcctgtccacagagtgagactctgtctcaaaaaaaaaaaaaaaaaaaaatcagaacacttaaaaactattagatacccatctgaattctcagtttggtctaaaaagattcgtttatgtgtggtatttaatttttggatattaactgaacctcaaaatttttttcttcctttatatgtattcctacatgattgtaggagtctgtcctgaacttcgatcatgtacattttggaaacttattttagaaaaaatctaagtcgtaagaattctcaatgaaaagagggtctttgccaatttctttgggtaagaaaagttcagaattttgcagatactctaaaaatgaaagtcaacaaagaaggcatataaaattgtgacgttttcaaataaaatgatttgtcatgtccttttttctttagactgctgcagtaagaatgtcttttccacctcatttgaatcgccctcccatgggaatcccagcactcccaccagggatcccacccccgcagtttccaggatttcctccacctgtacctccaggtaagtttgttgatactgttttttgtcgttaaacttgtacttttgtctttgtgatactaacttcaggaaaatgttagatatgtgactgtgttagtgaagatgcctctcagcgttgtttgggaaatgtggatgtctctttttcctatagcagtagcttttatatctggctgagtatcaaactcatctggaaatttttttttttcttctcatctggaaagtttttaa

SEQ ID NO: 76662 - DNA, 1050 bp, Homo sapiens
tggagaacggggtctcactattttgcccaggcagatctcgatctcctgggctcaatctgtcctcctgcctgtgcctccctaagagctggaattacaggcgtgagccaccgtgcccagctgtttttacttttaaaggattctttaatagcattgttcacctataagtcagtctgtatttgtgaaaggcattggttttgaggatcaccgaaccacatgaacccgaatggataactatccaggattttatgctctttaagtcaaaagcatattgaggtggccattttgttttcaggatagtcttttttgtaagtttatatggaccaacctgataccacattccttttgaaaataagatagtatttatcagtatttcactttcatttgtcttatatttccacttatgttaattatgagtaaggatacttaattgtgtggcatgttgttgatagagaatgcagtcatgtaaaatcagtgtggtttttcttttcttagggaccccaatgattcctgtaccaatgagcattatggctcctgctccaactgtaagtataacttaaaggaggaatcatgagttatggtagtgctagtgcttttaagctgaacagcatgataaacttagataaattatgagtatttaaaagaataacaaggacagaatgacagcacccctgtagagcatatcatttatttgaataagtatcattttcacttaggtgtgcatatatgcagttgcccttgcaatgtgctccctaagtagataattctatgattttcctgttactatctagactcttcatatacttgttattacaaatttaggactttggctcttcattgccttctcatcttggtcctgggagatgggagaaggatgtgacatgtctgatctcttaaaagaacataggaatccttgtaaaaattaaaattttgaaatgaaatttgtgtggactaccttttacatgtttcctcctaccttcctaaggtatatggcctaaggcataaattttaaatgttcaagacataggccaggatcacctgaggccaggagtt

SEQ ID NO: 76663 - DNA, 1053 bp, Homo sapiens
gccgaggcaggagagtcccttgaacccaggaggcggaggttgcagtgagccgagattatgccactgcactccagcctgggcgacagagcgaaattccgtttcagaaaataaaagtaaaaattatgtcttaaacataacaaagttttcttggttatttttgtttcttttttaagaagaaaggtaatctagtagtagaagtttacttgtcacaaataagtttgcattaatgaaatgtgctatgcactttaggagctttagaagtatacaagcatgcagagcttaaataatgtgctatatatatttatttaatcctgatgtttttagcctaatgttaattgtggtaggaaatttaattgctggatcaatttttattttgtttcttcaccttaggtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctgtaagttaaactgtttatttttcattaaaaatttttttatcattctacatttcaaacttaagcagaaagaagactttcagtgattgctttttattttaaaaaatttcagtcctgcagcaaaggtgaaaaagtacagtgaacacgtttgtattcttttcctagattcaccaatgaacatgtttagatattttatgtacacatgtgtaccacacacacttttttcttggataatttgaaagtaaattgtggcataacatttcacctgtgaatccttcatttatctcctaagagcaaggacattctgcgacataatcacaatgccactatcacacatgaaatttggccgggtgcagtggcttttgcctgtggttgtcatcctagtcctttgcaaggctgaggcaggaggatctcttaagctaggagttcgagaccagcctgggcaacatatcgagacacatctttacaaaaaattaaaaaataatagggccagatgca

SEQ ID NO: 76664 - DNA, 1357 bp, Homo sapiens
gcttgaatctgggaggcagaggttgcagtgacccaagatcacgccactgcactccagcctgggtgacagagcgagactccgtctcaaaagaaaaaaaaatcctttataaatacatacatattgtttcaaaacatttctttatagattcataatatttacttaaatttattatagtttgttttaaccattctaattttaggcatttaggtttacgtgtttattttgttaggataagtagtgatgcgaaacttttaataaaaggtaaacaatgttctgcaaatgaagaatcagtaagaatttatatttttctttaaatgatttgttgttcatttctttcatgtgataagtttgtgggaattgcaaaaattttcgcaaatgtagttgctggttttttattttatgttttttatccctagtagaaatataattttgcttttagttacattaaaaattattttgttaaatggtagcaatctgtttgttttgttttctttttaagaaatgtggtttggttttgagctggaagagagtacaaggtgcttccggaaagcttcaaggtatgtcatttttttccttatttgctgaaatcactttaactaacctgtgtgcttaaatcactttgcatgacttaactctcattgtctttatcagtaagacttattttattagcactctttgtcctcttttttattgaaatagggttaaaaggcagtttgggaaaatattggctgagaattgagatcagaaggaggaaaaaggtgtaagaggaaaggaaaaaattaaaattgctcaatttaactggtttcttgttctttcaaaagtctcttttgtctcaagaaatgactgcatgatcaaaatggaacaattagtaagggagaagaagagacaatcatggcctgttaactttttttttttttttttgagacctagtctcactctgtcacccaggctggagtgcagtggcgtgatcttggctcactgcaacctctgcctcctgggttggagcagttctcctgcttcagcctcctgagtagctgggattacaggtgtgcgccaccatgcccggctaatttttgtatttttagtagagacggggtttcaccatgttggccaggctggtctcaaactcctgacctcagatgatccacccgccttgacctcctaaaatgctggcattacaggcaggagccaccacacctgacctcaaatgttaattttttaaatagttgatttgattcaggttctatatgaagtccacacattgcaactagttggcaatttgttttaagtctcctaattttttttattagcaccatcctctaaccaactgagctaactggccagactcttaatattt

SEQ ID NO: 76665 - DNA, 2324 bp, Homo sapiens
cctgcctcagcctcccaagtagctgggactacaggcgcccgccaccgcgcccggctaattttttgtatttttagtagagacggggtttcactgtgttggccagaatggtctcgatctcctgacctcgtgatccacccgcctcggcctcccaaagtgctgggattacaggcatgagccaccgcgcccggccaattgactccttttaatcatgaatttcattgactctgctaaatattttattagagcttctaatgagtagcagtttgtctgatttgaatttttcttcctctctgtttttccctttttttcccctttggttgtttgaggatactaaaagtgaaatggttatcaaagggaattggtggacaggggtggaattatgaattgagtggtctttgtattaaaacatttggactctagtgattctacttttccataattttttttcttttgtaagtgaattggtatttcactaattgttttcatccattgctagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatggggtatgttttctgtcgtgttatcttttctaggccagactgtgctatttcagtgtagtgcttctcattataaatgaatctaatatggggcttcaaaagatcatcatgtatgtgcttgtggcttaatgtaggagggtattttatagtttgtagttattttaagtcttatctgcccatagtgggtggatgactgttggtttgcttgttccaggttgggatgaaagtagtaagggaggctggacaaggttaacttgccagagaaagcactggtacagactattccaaacagagctaattcattaaggcagctttgtaagtaagtacaaaatatatttcaacctacacaatttttattagtttccctctcttttagaagtacaccgactctaaaatgaatgaaagtctgattacttgccttaggttgggggctttatccaagctctactaagtgaagctaaaataaaggacattgttgtatattgtattttaatgtatacattattacctcctcagcaaagtgaaacatagctaaaacttgagtatatatttccttcatttctcttcttagttcctttttggcatctcatgctgaacaaatccaaaatagatttattaatgccttcccccaacacaaacaaaaccagaagagtctttcgctgtcgtcaaatttttattatctttcaaaatagaaatcgctttttgctgggcacggtggctcacgcctgtaatcccagaactttgggaggcagaggcgggcagatcacctgaggtcaggagttcgagaccagcctggccaacgtggcgaaaccctgtctctactaaaaatacaaaaaattagcctagcgttgtggtgggtgcctgtaatcccagcaactcagaggctgaggcaggagaatcgcttgaactgcagaggcggaggttgcagtgagctgggatctagccattgtactccagcctgggcaactagagtgaaactctgtctccctgctgccaaaaaagaaaaaagaaatacctttcatgttccctccaagttctttgttaaaaaaaaataaaaaccaaacccaaaaaactcacaaaatgaagcaaagtataaataatcaattaaataccacctgtaatcccatcatcataagcaacactgtaggcggtttggatgtatgttcttccagacatttttctgtgtatgaatgtggttcatttgttttttgttttttttgagacagagtctctctgtcgttcaggctagagtgcagtggtgcgatcttggctcactgcaacctctgcctcccgtgttcaggtgattctcctgcctcagcctcctgagtagctgggattacaggcatccaccaccacgttcagcaaatttttgtatttttagtagagatggggtttcatcatgttggccaggctggtctcgaactcctgacttcaggtaatctgttctccttggcctcccaaagtgctgggattacaggtgtgagccaccacacctggccaaatgtagggttttgtttgtttgtttgtttgaaatggagtttccctctcttgcccaggctggagtgcagtggtgcgaccttagctcactgcaacctccacctcccaggttcaagtgattctccctcctcagcctcccaagtagctgggattacaggtgtccgccaccaggctcg

SEQ ID NO: 76666 - DNA, 1001 bp, Homo sapiens
agtctgtggagtggtctttctaacctgatcatctaccatgatcaggttttgttttttttttttttttttcttgagacagagtctcactctgtcgcccaggctggagtgcagtggcgcgatctcagctcactgcaagctccgcctcccgggttcacgccattctcctgcctcagcctcccgagtagctgggactacaggtgcccgccaccacgcctggctaattttttttgtatttttggtagagacggggtttcactgtgttagccaggatggtctcgatctcctgaccttgtgatctgcctgcctcggcctcccaaagtgctgggattataggtgtgagccactgcatccggcctaggttttttgttgttgttgttattgttttttttttaaatattagcaatcagttaagatttttgggttaataaacttttcttctaaaaatgtgaattagttaattccaaatgctttatctctaatagtaaaatagccatattgatatttaaattttggtttacagtggaaacaataatcaatttagggtctataaggattttttttgtcttttgagacggagtcttgctctgtcgcccaggctggagtgcagtggcgtgatattggctcactgcaatctctgcctcccgggttcaagccattctcctgcctcggcctcccaagtagctgggaccatgcccggctaattttttgtgtttttagtagagacggggtttcaccatgttagccaggatggtctccatctcctgacttagtgagccgctgcacgcggctggggaatttttgtatttttttagtagagacggggtttcaccatgttggtcaggctggtctcgaactcctgaccttgtgatccgcccgcctcagcctcccaaaatgctgggattacaggagcgaggtgtgtgtgtgtgtgtgtgtgtgtgtgtgtgtctgtgtgtgtgtgtgtgtttttgatgggggtggagacagagtctcgctctgtctcc

SEQ ID NO: 76667 - DNA, 1177 bp, Homo sapiens
actcccgattcttgcagtttggtatatttagcaatctgatgtttttgtttgtttgtttaatctacatacaattttgctttttctgagtggtagctatcacaattaacttaaaattgtattttgcctttactacgtaactgaattttcaactgtttaaaagagtcgttactatttgtgtacctattgagcaaaacagtctgaaaacttgtgaatggtttgcagatgtgtcgtatagtgtgctagtcctgaaatttagggaccagaattttttagctattaagaaaaagaaaatgaaaatgaagtagtatctcaggaatagttaaataaaaaaatgaagcttttctgatgttaagaacaaaaccaattctgtgtttaataggactacagagatgtttttgagaaaacatgtatgtttattaactcttgttgtagagtgattttgattttcttgcttgatttttctttcccctgaatttgctgttttgtttaagaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacgtatgtgttctgacaacaacatatcatttctaccgtttgttttttatgatatcactcttatactttgattacatgtcagttttcttttttcttttcttttttttttttttttttttttgagatggaggctcactttgtctcccaggctggaatgcagtggtgcaatctcagttcactgtaacctccgcctccggggttcgagcgattctactgcctcagcctcctgagtagctgggactacaggcatccgccaccatgcccggctaattttttggtttttagtagagacggggtttcaccgtgttagccaggatggtctcaatctcgtgacctcgtggtcgacccgcctcggcctcccacagtgctgggattacaggcgtgagccaccgtgcccggccacattttaaacttttttacagagacaaggtctcactatgttttctaggctggtctccaactcctgggttcaggttatcctcctgcctccgcttcctaaagtg

SEQ ID NO: 76668 - DNA, 5004 bp, Homo sapiens
attgaggcctgtagaattcattcttcctctttcttcattagtgggaaaggagaaaaataacatatttgtttgatgtggattgggaggagataataaattcttcctctgtggcaggagttatgggtaaatattgttggtatgattagaaagccctgctactatgagagcaccttctatatttccatttcttgggggtgttggagtatccagagaggagggtagtgtgtgatcagttattgtaaaaagagtgaaatcacttctattcccaagtaatttgaaatcaagaaagcatcacagaagtgtactgtattgttcacgtcataaatgtatagggcattgctttgcagattagtatgagctctgtttttcttttttaaaaaagattcttggtggattttttcacagattttccgcagatttccagtggccccactgatcccttatccactcatcactaaggttagtttaaattgtaggctttgacaatacctgtgtttactgctgattgttgatttgtcattcttgtctatctgatttttcactatttaactttagattgttagatttgttattgtggatattctgtttacttatttactctttgagacctatacagaatatctaacctttaactgtttatattgaagtagggtgttctttattcattccctcctgtgcccgttttcttttaggaggatataaatgctatagaaatggaagaagacaaaagagacctgatatctcgagagatcagcaaattcagagacacacataaggtagtattcttgtcttttcacttgataccaatctagactttttacagaatccaaagcaaagagacaaaaaaaatcaaccttaaattagaatataattttaaatgttttttataggtttaattgatatttagatagaaaaaagaaacagaagaccaataccatattaaagtggtccttgacatgttgtgcttagttttttcagttactgactattctgcagtcatctcactttaatatgaatagaagctaattttatttttagatttcaacataaacatcaaggtcagacttaaattagattcagggggcagcaggataacatacactgtagtgtatttctgggggcagttatttaacttgatcttaggaataccttttctttagagctgagattaaaatttacattttatatttgtatagatttaagttgagtgggggagattttaaacagtaggtcagtggttaccagacttaccaaattttagatgcatggaagaactgtaaattcccataaagctaatctattcattgacccccaccattatgatagagatcatatggtgactaatgcaagatgaaactctcagcttggaaagtaacaaggaataggatgtaagtatgagcttctgttttttattatatttatggatgccccctcagaaaaatatgcaaaggggtaactggcttggaaatgggtatttatgcatagtaaatcccactcacgagttttgcctatttgaagcttctctcaatgacagtgcatctgtgaatgttcgctggtgttgaaaatgatgcttttgaacggtgcaatgcaaacactgcatgaaatgtattttgatggtcgagataataaggtgttgctggttcttactgatagactgagagatctttaactcagtgaaatgttaaatgttcattttctcttttattcttactttttcccattgctttcaaaatctgcagttcacaaataatgccaatgaatcagtgctgctgaacacttactatccagatgcccagcccttgctcacaaacacaatgctttttcaagaattaaatgtgtctaagagcacaaacataattctcccaaaattaattttgagagttgaaaaggtggtctatgggaaatcattttagatgaataattttggttaggtataatactgaaattcaggaccgagtaagcttaaaaatggtatatggttgtgtgtgtggtttaccccctttttgtttttatttatttgttaaaccctgtcatgttattggtaaattatgaggaaatcatgttttaagaaaaattcaaaaatatatttgctttaaagtttgggaatctgttaggcattttactgccttagtattatttcactggagggaatgttttgaattttcagaatgtcttttcaaaataaaaagaaatcaaaatgaaaaaccaaaacagttgttttttattgggtggtttggctaaaagggttgtttgaaactccagtaacaaaaaatgagctcagtgaacctttgcatgttttggtatgagtttattaaataaccacagactgtcagggtatcagcgtggcagggggcgtccatttacagcacggatgagtctgaagagagaataaggtaagatttatgattttttaatctgtcctttcctcttcatgactttcttacataattttagactcacctcatttcccttctccagtctttctttaaaaatatacatgtatgtttacatgtatacctgtatttgtatacatgtgtgtatatatatatatatatatatctcatatataaacttcaggaaacatttagtatggactagattcactcactttttcatttacttagaaccaaacttttgaaatgagttctgaaacaaatggttatttatataactgaatataaggagcacagtgaaataagcaagaattaaaaattgaggaattctacaggaaaaattagtattggaacagctaaaatattctgtaagtatctatttcagaaataaacaaatttctttataagtgtatgccattgaggtaagttttatatagtctagcctcattttacaatataaatttttatattcattggaactgtttcagaaatgagatttttccccctttaatagctgttagtttctgtcctctttctatcatatcttatttcatccctttgtaatttcaatgtattcagttttgactttgcccgtattctacttcgatatagactggcacagcaactgaatatattgctcatacattagctttcctttcataacctgctataagttctctgatccatgaggaagagaaaaagagtatctgacaggtaagattgctttttaaagttgttttaaatgcattacatgactgagaaaagaaaaatgcacattttattgttgcagtttaaaatttcattttggtgaaactaaacgtgaaacaaaagggataaatgtgttttgttttgttttgttttacctgtttggggtatttttttctgagtttgtgtagaaaccgtgtggtacactggtaatcttgtcagggtacaaacttggtctgactttgttatttggtttatttgtgaaccatgtacttgctcttcctcccagaaacatagcttgtaggcaaggttaatccagtgttggcgatccatgtcctagcacagcatctgtaagttaatgcacaatcgttccttccaaggatggatttatcattgtaaatatattttcattgtcttacaggcataatgggcataagtatgttgcttttaaatattttaaattaaactattacagttacatatattttgcttgaagtgagtgattttcaaactttttgtatttggtgggctgtccatcttgtaatggtgggagtaaatgtttccatagatgataaggcagttcttggctgaattcagcttgtgtttcttttggagggtgggcaaatcagagggcagagattatttagttgcattataggtattcttctataccacttgccctttgaaaccctcaacttgaggtaatgtgcagtctggggttttaattagtattaataatcttgtggatttacagaaatctataatgcacagagttgagttttaaccaatgatcgtattcatagaaaatatttcgaaccaccacattcttcatggtcattttagttagtacatagtcattgagtggccagccacacctgacacaatctcccagcatccaagattggagattcctggtctgtgtagagtatatggttttgcacgaaatctttctagtcttgtgattgcttcagtttaatttgtcacataaaaccacaagtatttaatattaatgtatcagtggtttggtgtttttgttcccagtactgggctttgcgccgggaaaaatctgaatactggagctacagagttaactctaaaagtgcttttattggtttctagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaaggtaaggctttacagaagttactgtttcctgatagctttaagaaaactatcgggtagtcctccagagtaccatttgcattcatggaatgagaacttttgtgtgtgtgtgagacattctcactctgtcactcagcctggactgcagtggctgagcaatctccgcctcctgggttcaagtgattctcattcctcagcctcccaagtagctgggattacaggttcataccaccatgcccagctaattttttgtatttttggtagagatggggttttgccatgttaatcagcctggttttgaactcctggcctcaagtgatccgcctgcctcagcctccctaagtgctgggattataagcgtgagtcactgtgcccagcctgagaatttttttagagacaacatggtctttgtctgtctgtctgtctgtctgtctctctctctctctctctctctctctctctctctctctctctcacacacacacacacacacacacacacaca

SEQ ID NO: 76669 - DNA, 1342 bp, Homo sapiens
agtaagctaaactatctcttaacatattcattagtccttcatatttcttttgggaattaagttttccttttttctgttttacaccatcaggggattgactattatttcagtatatgatgggcattaactaaccattcattttaatgatttataactattttatattcagattgtatttgttttctgacataccagtaagcattaggtattagaatgcattttaggatttgggactgcaatttatgtctttctgatgagtgtagaggaggttacatagttttatggaaatcaagtgctagattctggcctgtgagattttatattatttcataatgtatgttgtcctcctttactttggtcttgaaaacagaaagtagactgacagatttgtaaaatattttgtttacattagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagaggtaagttgagaaaatgcctttattcttaaatcttggtatcccttaataggttaatcaatatttatagaatgctatgtataaatttttaaagctttgaaaatttaatttttttagcgccttaagaattgggaaatcagagaacgaaagaaaacccgggaatatgagaaagaagctgaaagagaagaagaaagaagaagagaaatggtaagattctaggctaaaataagtgatttttcaggtaaaaagtcagattgtatctttactgctaactacaagtaacttaataattgaaatgcacaagcttctctattcatgtataatttaatttttatgtattttgagtaattttgagccaatttaagtacaccaaaatcttttttcctcttcaaatttttgctgcatctaaagttatctttttgtataccatcaaagtaaatttgtcatatagtaatatttaagtcaagaatttattaacttatttttaagaatctgcatatttttaaaattgttgaactgttgttattagatataatagttgcatttgaaattccgtaagttaagagattcattttatctcatggattgtttactattggtttagagttggggggcattacctttaaattgattgatgaacatgatttaaatttctgcgtttcttaaaaactatttcttatagtatcatctaccttaaaaatggaattaaa

SEQ ID NO: 76670 - DNA, 1077 bp, Homo sapiens
cctatacttaatatatggagtatatgaaaactaaaatttaagaggacaagaaaaatcttttttttaaccaaagtattattatatttattatggcatagagtggtattttatacatatctcattttacagtaaaaacattttatgtacaactgtagagagatagctgcacagatagctccaacttaaattagaaaatattttctctatagaaaataataaaaacaccgtttcccaggctagcccaacaagtttatttaaaccaaatagctgaatacatatacatttataaatatggtttgaattctgggatccaggagaaactttagtttcatttattgaaacggccatgtttgtcttaaaattatgtgaagagaaattcctataagtctccctcttactcttggtttatgtctgggtcagaaaaatctgtttacacaaaaaagggaagagtaatctttattacttgtatgttaattttatacattgtccttatttcctcaaaggccaaagaagctaaacgactaaaagaattcttagaagactatgatgatgatagagatgaccccaaatattacaggtaaagaaggcttgttctgtggattcatacttggttttttattagctgtgtttttccatctgcacagttgataatgcatgttcactaagtggaataagaaaaacaaactttcacattctgagtaattattaattctatagctaatacactgttttcgttgggagaaaagagctatcagaaaaggataaacatttctatgcatcttttgtgcagtgggggagcccatgatagtattatatcaaacaatactatttttttctttgtgtgttgtaaataggtctgatttttaaaattttttcttgattcttttagagacagggtcttacctcggctggaatgcaggggcatgatcatagttcactgtaaccttgaactcttgggctcaagcagtcctccctctgcagtctcttgagtaggttggactataggtgtgggctaccacacctgtgtgctaggtccaatttttatagcaagttacaacgaatctctgtaactatctg

SEQ ID NO: 76671 - DNA, 1088 bp, Homo sapiens
ataacgtcaacattctgagaagtaatgaactgctagataggagagaacctctgctttctgttgattctacactactttctgagataatttttacaagtgaataaattgaggatacagaactctcagtgctactaatgctacttgatatatttttttaggttggtatctaggaaaacgaaaattatttgttgggtattccttgtgaaataggcacaaagtgtgagctctctttctgaaagtgactattttacttgtttagacacttattagaatgactttaagaatgaagggaacatagtgataaatgacaagataatgcttgttatacatttacatgtagagagcacactctggtgtgttccgtagatacagaacattaagacattctttaacctcttagcatgcaggttgtaatgttgaaaagaggtgctgttggagatgtcatgtttacttctcaatgatcggagtattaaatgaagccttttatcattcacttttacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagagggtaagatactgtaccatctggtcgggcgcggtggctcacgcctgtaatcccagctctttgggaggccgaggcgggcggatcacgaggtcgggagatcgagatcatcctggctaacacggtgaaaccccgtctctattaaaaatacaaaagattagccgggtgtagtggtgggcgcctgtagtcccagctactcgggaggccgaggcaggagaatggcgtgaacccgggaggcggagcttgcagtgagccgagatcgcgccactgcactccagcctgggcgacagagcccctgactcctgggttcaagcgattctcctgcctcaggtacccgagtagtagtacggattacaggtgtgtgccacctcgcctggctaatttttgtatttttatttttatttatttatttttttgagatggggtctcgctgtgtcgccc

SEQ ID NO: 76672 - DNA, 2007 bp, Homo sapiens
atgtccttttttttttctttttctttttctttttttttgagatggagtcttgctttgttgcccaggctgtagtgcgattctgcaaggctcactgcaacctccacctcccaggttcaagcgattctcctgcctcagcctcctgagtagctgggattacaggcgtgcaccaccacacctggctaatttttgtattttcagtaaagacagcgtttcaccatgttggccaagctggtctcaaactcctgacctcagatgatctgcccaccgcggcctcccaaagtgctgggattacaggcatgagccaccatacctggccttttctcttttcataaagatattttacaagaggtaatgtaaaacaaaaatcaagttgaatggtgtagagttgtagttaatcagattattgtttgggttttagatggaacaagaggctgagaggcgcaggcagccacaaataaagcaagagccagaatcagaagaggaggaagaagaaaagcaagaaaaagaagaaaaacgagaagaacccatggaagaggaagaggagccagagcaaaagccttgtctgaaacctactctgaggcccatcagctctgctccatctgtttcctctgccagtggcaatgcaacacctaacactcctggggatgagtctccctgtggtattattattcctcatgaaaactcaccagatcaacagcaacctgaggagcataggccaaaaataggactaagtcttaaactgggtacgttagcatttccttccttctttattttcttcccttcacccctgcaaatacctgtattgtgctttaaagaaaaaaatttatatttgtgcttggttaggtagatagaagattactaaaaaatgcctttctagctcacgattgttttcatagttttactagtgctcctatatctgcagctgcctcgagttctgagaagaagtgaaaagtttaattttctagcacttgtgagtagtgagttattttttacagttgggatctttctctaagatttgtggaagtatattttgcattgcttttgagggatggtgggttataaaatgaaacatttggaaattaagtcatcttgctaagagagtgtttttactgtaggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctgtgagtaggaaattatatttcatcatattattgggaacagttggaatatgccatacaaattcatttgaagaaaaaaaaacctcatttgattctattaatgacaaataagtagggatgatcatcttgacaccaactcaatgccatggtcaagaaattagtaataatggaaattttttttgtgctacttgaagacttactaaaagcagatgattgtatcttgatacatatctgtcttagttcaacttgtgaaataacattatattttagtctcaggaaaaatcatgaagctttaataactgttatagcaagttacaattctttaattcagtaaccgtggtttgttttgcagatactgatggaacgtcgaattagaccatggattaataagaaaatcatagaatatataggtgaagaagaagctacattagttgattttgtttgttctaaggttagtcttctattctcttccatgccagcatttattttatatattaaaatattagacacttcttaaaagagcagaaattttacagagtcaagttccatgatggtttaggttcagttaagtgatttatatctgcttttttaaagttatttttatttttggtgtgtttttt

SEQ ID NO: 76673 - DNA, 1052 bp, Homo sapiens
tttcatcacccaggtgttaagcctagtactcattagttatttttcctgatcctctccctcctcccaccctctgccctacgataggccccattgtgtgttgttcccctctcttcgttcatgttttttcatcatttagctcccgcttataagtgaaaacatactgtatttggttttctgttcctgtgttagtttgctaaggatagtggcctccagctccatccatgtccctgtaaaggacactatttcgttttttatggccacaagattgtacatatgtgctgctttttggacaggtatccaaacacctgttgtattgacagtaaacatcaaatccccgttgcatttaatttgggattacagtcagtggtagcatgtagttaacactgtgattttgtgagacaaggaaaggagaagaaaattgatggtaaaggttgagcaagagattgaactatgatctccaagttaggaagagaagaaaatagtatctgaatagagctggtggtttgaatgaattaaggactagtggttccagtgaagttgtggaaggcgaattgtaataaaacaactgaaaggagaggttatggtcagagtgtagaaagttcaagtctatatgtgataggtcagcccagacgatggcaaggtgcatagtatgactatgggaaattcctgggtattgggagtcagattggagagaaatactggaaatagttgccagagcactcatttaagtggggggaaagactagatacttgccagatagctgctcttacagtggataaggtggtgagagctcatgaacgtccatggagttgtttttttttttaccaagaaagaaacagtgaagacccacaagtcattcctgtggagattaagacattgagagtgagagactgcctgagaagtgccggggctctaggagatagaggagggtttctgttaagaggaaaaacctaatttagttgttgatgtgtagtataaaatggaatagcggtccaaagggcagagcgggaagacagcaatgggaagatgagtaaggaaggaaaaatcatcaa

SEQ ID NO: 76674 - DNA, 2366 bp, Homo sapiens
ctcagcctccccagcagctgggaatacaggcgcacgctgccatgcccagctagttttttgtatttttagtagagatggggtttcaccatgttagtcaggatggtcttgatctcctgaccttgtgatccgctcgcttcggcctcccaaaatgctgggattacaggcgtgagccaccacacccggccactaaaacaaccttaaaatcttaactagcatttaagtaataagtgcttattgtcagtggatgaaaaacttttttatactggccactgtttttggcagatgttgatgattgcttctcttacatgtgttgctgttttgtttcctctttaggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaattattttgcagaattgcacttaatattgaaatgtactgtataggaaccaacatgaacaattttaattgaaaacaccagtcataaactattaccacccccactctcttttgatcagaaatggcaagcccttgtgaaggcatggagtttaaaattggaatgcaaaaattagcagacaatccattcctactgtatttctgtatgaatgtgtttgtgaatgtatgtgtaaaagtctttcttttccctaatttgctttggtggggtccttaaaacatttcccaactaaagaatagaattgtaaaggaaaagtggtactgttccaacctgaaatgtctgttataattaggttattagtttcccagagcatggtgttctcgtgtcgtgagcaatgtggtttgctaactggatggggttttcttattaataagatggctgcttcagcttctcttttaaaggaatgtggatcatagtgatttttccttttaattttattgctcagaaatgaggcatatcctaaaaatcctggagagctgtatttaatgcatttttgcactaattggtccttagtttaattctattgtatctgtttatttaacaaaaaattcatcataccaaaaagtgtaagtgaaaaccccctttaaaacaaaacaaaaaaatgaaataaaattaggcaaattgacagacagtgagagttttacaaacatgataggtattctgctcggcaatttgtaagtttacatgttatttaaggataaaggtaaatcattcaaggcagttaccaaccactaactatttgttttcatttttgtcttgtagaaggtttatatcttgttttaccttggctcattagtgtttaaaaatgtactgatgatgtgcttagagaaattcctggggctttcttcgttgtagatcagaatttcaccagggagtaaaattacctgaaaacgtaagaagttttaaacagcttttcacacaaattagatgcaactgttcccatgtctgagtacttatttaaaagaaaggtaaagattggcctgttagaaaaagcataatgtgagctttggattactggattttttttttttttaaacacacctggagaggacatttgaaaacactgttcttaccctcgaaccctgatgtggttccattatgtaaatatttcaaatattaaaaatgtatatatttgatcctggggactcatattctttcagaatcatgtaaataaatggcatcatgttgtaattgtgtggtgcatactagaaaagttaaaaatatgggctgaactttttatggacttgatttttatgactattggtatctaaaggtcaaggaagccatttacattattttggatgaatctactatacatctatggaaatgtctcttttattttaaattctggtttctcaacggaaaatttcagaaaagatgccccttgccattttcgttaatttttcagtcttttcttagacacacccccagcctaagaccttgttcgaggagtttattgtgtctgtcttttcttaacatactgcactgttcttaagcatcatattgtgttgtttttatttagccactattaacatgaaggtttattcaggtagatttgatttcctttg

SEQ ID NO: 76675 - DNA, 2755 bp, Homo sapiens
tttattttttaattttaatttttattttttgagatggagtcttgctctgtctcccaggctggagtgcagtggtgtgatctcagctcacgggttcaagcgattctcctgctgcagcctcccgagtagctgggattacaggagcgcgccaccacacccggctaatttttttgtatttttagtagagacggggtttcaccatgttggttaggctggtctagaactcccaacctcatgatccgcctgcttcggcctcccaaagtgccggaattacaggcgtgagcgactgcacccggccgcttgggggtggatttttaaagaaactttagaagaatgtaacttgcccagataccatgtaccgttaatttcattttcggttttttgaatacccatgtttgacatttctccgttcaccttgattaaataaggtagtattcattttttagttttagcttttggatatatgtgtaagtgtggtatgctgtctaatgaattagacattggtactgtctttaccaaaactggacaaagagcaggcagatgcaaaaatcaagtgacccagcaaaccagacacattttctgctctcagctagcttgccacctagaaagactggttgtcaaagttggagtccaagaatcgcggaggatgtttaaaatgcagtttctcaggttctcgccacccaccagaagttttgattcattgagtggtgggagagggcagagatatttgcgattttaacagcattctcttgattgtgatgcagctggttcgcaaataggtaccctaaagaaatgacaggtgttaaatttaggatggccatcgcttgtatgccgggagaagcacacgctgggcccaatttatataggggctttcgtcctcagctcgagcagcctcagaaccccgacaacccacgccagcgctctgggcggattccgtcaggtggggaaggccaggtggagctctgggttctccccgcaatcgtttctccaggccggaggccccgcccccttcctcctggctcctcccctcctccgtgggccggccgccaacgacgccagagccggaaatgacgacaacggtgagggttctcgggcggggcctgggacaggcagctccggggtccgcggtttcacatcggaaacaaaacagcggctggtctggaaggaacctgagctacgagccgcggcggcagcggggcggcggggaagcgtatgtgcgtgatggggagtccgggcaagccaggaaggcaccgcggacatgggcggccgcgggcagggcccggccctttgtggccgcccgggccgcgaagccggtgtcctaaaagatgaggggcggggcgcggccggttggggctggggaaccccgtgtgggaaaccaggaggggcggcccgtttctcgggcttcgggcgcggccgggtggagagagattccggggagccttggtccggaaatgctgtttgctcgaagacgtctcagggcgcaggtgccttgggccgggattagtagccgtctgaactggagtggagtaggagaaagaggaagcgtcttgggctgggtctgcttgagcaactggtgaaactccgcgcctcacgccccgggtgtgtccttgtccaggggcgacgagcattctgggcgaagtccgcacgcctcttgttcgaggcggaagacggggtctgatgctttctccttggtcgggactgtctcgaggcatgcatgtccagtgactcttgtgtttgctgctgcttccctctcagattcttctcaccgttgtggtcagctctgctttaggcatattaatccatagtggaggctgggatgggtgagagaattgaggtgacttttccataattcaggtgagatgtgattagagttcgatctgcggtggtggcagaggcttacaagaaacactaacgggacatgggaaccaattgaggatcagggaataaagtgtgaagttgactaggaggttttcagtttagaacatggcagagacattctcagaaataaggaagttaggaagaaagacctggtttagagaggagggcgaggaagtggtttggaagtgtcactttggaagtgccagcaggtgaaaatgccctgtgaacaggactggagctgaaaacaggaatcaattccatagatttccagttgatgttggagcagtggagaagtctaagctaaggaaggggaagaggaggccaaggcaaacacttaggaacacttgcaacgagggggtggaagaagagcaaggagccagctgaggagaatgagtgtggttggagaaccaccacagcgcagggtcgccagagctgaggaaggggagggaagcttcaggaaggaaaaggttggcagggattttgagtgttaggcctggtgtagcagaaggaacagaagatttagagcagcgctagccaatagaaataaaatgtgaggcccggggcggtggctcacgcctgtaatcccagcactttgggaggccgcggggcggatccttgagctgaggagttcgagaccagacaacacggcgaaaccccggctctacaaaaaattagctgggcgtgggggcgcgcgcctgtagtcccagctgctcccaagcgaggctgaggcaggagaatcacttgaacccgggagaaggaggttgcagtaagccaagattatgccactgcactgcagcctgggcaaaagagtgagactgtctcaaaaaaaaaaaaaacctgttttgtttttcttttggagaaaaggcatacaaatttatta

SEQ ID NO: 76676 - DNA, 1288 bp, Homo sapiens
aatttggtcagcatagaaaaaggaatgttgagaacattccttaagattactcagctccctttgctggaaatcagaagtcattaagtatctttgtggttgaaaatgtttggtgtctcaggcggttctacttattgctaaagaggtctaccttgagcttatagtaaatttgtcagttagttgaaagtcgtgacaaattaatacattcctggtttacaaattggtcttataagtatttgattggtttaaatgaatttactaggatttaactaacaatggatgacctggtgaaatcctatttcagacctaatctgggagcctgcaagtgacaacagcctttgcggtccttagacagcttggcctggaggagaacacatgaaagaaaggtttgtttctgcttaatgtaatctatgaaagtgttttttataacagtataattgtagtgcacaaagttctgtttttctttcccttttcagaacctcaagaggctttgttttctgtgaaacagtatttctatacagttgctccaatgacagagttacctgcaccgttgtcctacttccagaatgcacagatgtctgaggacaaccacctgagcaatactgtacgtagccaggtacagtgtcagtctctgaaactgcctttgccagactggattcacttatcatctcccctcacctctgagaaatgctgagggggctaggcaggctttctctactttaccacatttataatatatttggtgaacttcagctgattgctggaggacacagggctgtttaacacataggtgttgatacagttcctacctaattcacatatcaccacctcagttgaagccttctccagcttcccaaggtgtgcagcgcctcatagttcatgttgtttattattttacctatcttgctcttattcttctacggctgagtccattttatttactgtattcattacctaacagttccttttagtgctcagtaaatattcattatgattgtacaatgcaaggataagtgtagaagttctaagggttcaaaggagggattcaggaaaagaacgtaatctgtgctgtcggacaaagagattcctcaccagctacatacacagacatgaaatttgactgcaactctactagctaatcatcataaagtgagagcagaggccaggcacggtggctcatgcctgtaatcccagcactttgggaggctgaggcgggcagatcacctgaggttaggagttcaataccagcttggccaacatggagaaaccccatctctactaacaatacaaa

SEQ ID NO: 76677 - DNA, 1027 bp, Homo sapiens
attttaaagtcttattaattaaggtaagatagttccttgcatatgtggtctgaaatcacagaaagctgaatttgaaaaaggtgcttggagctgcagccagtaaacaagttttcatgcaggtgtcagtatttaaggtacatctcaaaggataagtacaattgtgtatgttgggatgaacagagagaatggagcaagccaagacccaggtaaaagagaggacctgaatgccttcagtgaacaatgatagataatctagacttttaaactgcatacttcctgtacattgttttttcttgcttcaggtttttagaactcatagtgacgggtctgttgttaatcccaggtctaaccgttaccttgattctgctgagaatctgatttactgaaaatgtttttcttgtgcttatagaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctgtacgtatgagttttgttttattattctcaaagccagtgtggcttttctttacagcatgtcatcatcaccttgaaggcctctgcattgaaggggcatgacttagctggagagcccatcctctgtgatggtcaggagcagttgagagagcgaggggttattacttcatgttttaagtggagaaaaggaacactgcagaagtatgtttcctgtatggtattactggatagggctgaagttatgctgaattgaacacataaattcttttccacctcagggccattgggcgcccattgctcttctgcctagaatattctttccttttctaactttggtggattaaattcctgtcatccccctcctcttggt

SEQ ID NO: 76678 - DNA, 1054 bp, Homo sapiens
gccctgcactcaattctgaatgctgccatcatgatcagtgtcattgttgtcatgactatcctcctggtggttctgtataaatacaggtgctataaggtgagcatgagacacagatctttgctttccaccctgttcttcttatggttgggtattcttgtcacagtaacttaactgatctaggaaagaaaaaatgttttgtcttctagagataagttaatttttagttttcttcctcctcactgtggaacattcaaaaaatacaaaaaggaagccaggtgcatgtgtaatgccaggctcagaggctgaggcaggaggatcacttgggcccaggagttcacaagcagcttgggcaacgtagcaagaccctgcctctattaaagaaaacaaaaaacaaatattggaagtattttatatgcatggaatctatatgtcatgaaaaaattagtgtaaaatatatatattatgattagttatcaagatttagtgataatttatgttattttggatttcaatgcctttttaggccattgtctcaaaaaataaaagcagaaaacaaaaaaagttgtaactgaaaaataaacatttccatataatagcacaatctaagtgggtttttgtttgtttgtttgtttgttgaagcagggccttgccctgtcacccaggctggagtgaagtgcagtggcacgattttggctcactgcagactcaacccaccagtttcaagcgattctcctgcctctgcctcccaaatagctgggattacaggtgtgtgccaccacactcggctaatttttgtatttttagtagagacagggtttcaccatgttgaccacactggtctcgaactcctggcctcaagtgatctgcccaccttggtctcccaaagtgctgggattacaggcatgagccactgcgcccggccctaagtggttttaatattttgattgacagtatactgaagaaatatactctaagacctttatgaatctcctcattcacaaataacactgtaggatataatggtccctataaaatacggtataactaaaatcag

SEQ ID NO: 76679 - DNA, 1035 bp, Homo sapiens
ctgtcgtaccccaccagtgctgaatttcttttttaaaactgtgctggtttttataggtaaagaaaatgtcttaatttgcatttagttggttactagtaatatcacataccttttcaatgcttgtgaactttaagcttatacagagtttaaccttgcatgttgaacatttgagtgagtggaagtgttaagtgatggccatctgtataatctattagtaatgtatggagaccattaaagatgacaggtatgtgtgatgatgacaggttgttaccaacactcagaaggccaaaaagcaagtgatataaacccatgctgggaagcattcacctcccccactttaaaaatgctagtttcttaattccttttctttatccctttttttgtctgcacgtgtttacttgcctttagtttccctgctttagtaggctgaccttgtgacttttaccaggatcccattatacttttgttcttctgtttatttctcagattttattggagggtggaattctactttttctttcttataatctagaatttacattcagatttcctgcctttcccttacaaaatacctgtgtagttggataggtggagctctggactcagagttctttcttctagtaatcttaggaaattatttaatttttctgtgttttcatattttcacacataaaagagaaaacaccatttctaaactacctcttcttttctctgcttttaagcatgtaaaggttttcccaatcttgggcagtgacatgtacaggacagtatagctttacatctgccttgttttaattaaacactagttctttgaggtaacccctactattatcccagttttatggatgaggcactgaggcaggggtcacacagctagtgtgggtcagaacctaatgggtcagaatggacatttgagtccagagtttggcctggattgacacacatagctattacgtaagattcctctcaaattcagtcctcagctccctgaagtgtgggttctcttttcatgcctccatggaaactgcgtatcat

SEQ ID NO: 76680 - DNA, 1053 bp, Homo sapiens
acgcctgtaatcctaacactttgggaggccaaggcgggcagattgcctgagctcatgagtttatgaccagcctgggcaacacagtgaaaacctgtctctactaaaatacaaaaaattagccaggcatggtggtgggcacctgtagttccagttactcaggaggctgaggcaggagtattgcttgaacccgggaggcagaggttgcagtgagccaagatcgtgccactgcactccagcctgagctacagtgcgagactctgtctccaaaaaaaaggaagaaaaactggatttttacactgtctgggtgttaggagacctctttcctgatcctcaagccagaactagaggtcttctggagctcccattgtcttgctaatgcccactcatgttgtaatgagcacaggtggaggaaaaaaagtggtcagctcactgctagtacttctaattccccagcccacctacctctcattacttttcatcttttgcaaccagctgctgcctgctttctgcccaggttttgtaactgtattcagtgggatagagagagtggaaggtacttactccatcttatctggaacctttcttaatatattttttgtcgcatttgtacatcttttatccatccttcattttattttatttttttttttgagacggagtctcagtctctcgcccaggctggagtgtagtggcatgatcttggctcactgcaacctccgcctcctgggttcaagtgattctcctgcctcagcctcccaagtagttgggattactgggacacgccaccatgcctgggtaatttttgcatttttagtagagatgagggttccccatgttgcccaggctggtctcgaacttctgacctcaggtgatccactggtttcggcctcccaaagtgctgggactacaggcctgagccaccacgcccagccttatccttcattttagacagtttaagaggtttgtattcagccagatctccacatttacttgttcatttgtgttgtgatgttttttaatgttcaagtcttagcacacacaaacaattatata

SEQ ID NO: 76681 - DNA, 1056 bp, Homo sapiens
ctaggtaaagccattctgttggcctttgccaaattgtactattttataaagttgttttaaagagagatgtgggccgggcatagtggtgcacatctgtaatctcagcactttgggagtctgaggcgggcggatcacttgaggtcaggaatttgagaccagcctgggcaacatggcgaaaccctgtctctactaaaaatacaaaaattagcctagcgtggtggcgcgcacgcgtggttccacctactcaggaggcttaagcacgagaattgcttgaacccaggaggcagaggttgtggtgagctgagatcgtgccactgcactccagtctgggcgacaaagtgagaccctgtctcaaaaaagaaaaaaaaaatctgtactttttaagggttgtgggacctgttaattatattgaaatgctttcttttctaggtcatccatgcctggcttattatatcatctctattgttgctgttctttttttcattcatttacttggggtaagttgtgaaatttttggtctgtctttcagaattaactacctttgtgctgtgtagctatcatttaaagccatgtactttgttgatgaattactctgaagttttaattgtttccacatataggtcatacttggtatataaaagactagtcagtattactaattgagacattcttctgttgctccttgcttataataagtagaactgaaagaacttaagactacagttaattctaagcctttttgaagattatatagtcttctagtagaagtctgtgcatcagaatgttttaagaaagggttttaagaatgtataaaaaccaaaataattgattttcatacttctatattgttttttatcagtgactcttttttctttcaaatgaaatcttatatgaaattttcatatataatatagaaaaaagtggatctagtctgtcaaagagaatagtgaagctcagagatgtgccagcctggcctttttctcagctcaagtggcagaatacagtttgtaaacaattgcactagctcttaaattcgaagaggcagtcaaactaata

SEQ ID NO: 76682 - DNA, 1090 bp, Homo sapiens
actcctatgtcagttatgaagattaaattaaatgatccatttaatacaataatacacttagaacaatgtctatcagtaaatttttttctgttttaagaaacaggatctcactctgtctcccaggctggagtgaagtggcacgattatagctcactgtagcttcaaaagcctgggctcaagcagtcctcctgtctcagcctcccgagtagataagactacaggcacaggttggtgttgacctcctagcttcaagcagcctcccaaagtgctgagattacaggtgtgagccactatacccagcccagtgttatatttttgtataatcctatgaagtatcaaggcagttattatccctgttttactgctaagaaacttgaagtttacagaggtaaattatttgcctaagcctaaactctgatctcgaatctgaatcccaagtccaatattcttttcaccgtattacaatatttttaccatcaaccctccattctgtctgcacatcatacaaatgagtatctctacagagctttgagttgcttttaaacaaaagagatttttgtacccaatgtttagagtagtgattctcggctccatttttacaagatttcaagatttaatttgtcaaaaaagttctgaaattttcaaagcaaaagcaattttaatttaattgctctaaaaaataagcagatttatcatttagcaattctttaagggagagtgtatcataaaactgaaatagtactgaatgtggcagaatcaaacaagttgaaaatctcatcacttcagagcagggcagacttctcattcaaacaaattgaggtagaagtggtgagagtagagatttctttgtgtatgtgtgttttattactgtactatattatattatagttctatatatactatattatattgtacatatatattattatatgaagagacatgaccactttgaggcatgaaatttttttttttttttttttttttttgaggcacggtcttactttgtcacctaggcagtggcgccatcttggctcactgcagcctccacctccagggctcaagcaatcctcccacctcagcttcctgagta

SEQ ID NO: 76683 - DNA, 1046 bp, Homo sapiens
tcactagtttataggcttggtcttcagcccactgctcttcgtggtcatgacagctgtagttctaggcatcatgtctagataaggcaacattcaggggtagaaggggactgtttattttttcctttagtctctcttaaagagtgagaaaaattttcccaggaatcccggtggactttgcttcaccactcataggttcataccaagttacaaccccacaaccttagagcttttgttaggaagaggcttggtgggattaccgtgcttggcttggcttggtcaggattcaccaccagagtcatgtgggagggggtgggaacccaaacaattcaggattctgccctcaggaaataaaggagaaaatagctgttggataaactaccagcaggcactgctacagcccatgctttgtggtttaagggccagctagttacaatgacagctagttactgtttccatgtaattttcttaaaggtattaaatttttctaaatattagagctgtaacttccactttctcttgaaggcacagaaagggagtcacaagacactgttgcagagaatgatgatggcgggttcagtgaggaatgggaagcccagagggacagtcatctagggcctcatcgctctacacctgagtcacgagctgctgtccaggaactttccagcagtatcctcgctggtgaagacccagaggaaagtatgtgcatttctctatgttgcaaagtcatggattcctttaggtagctacattatcaacctttttgagaataaaatgaattgagagtgttacagtctaattctatatcacatgtaacttttatttggatatatcagtaatagtgctttttttttttttttttttttttttttttttttttttttttgagacagagtctcgctctgtcgccaggttggagtgcaatggtgcgatcttggctcactgcaagctccacctcccgggttcaagtgattctcctgcctcagcctcccaagtagctgggactacaggcgtgcgccaccacgcctggataatttttgtatttttag

SEQ ID NO: 76684 - DNA, 1581 bp, Homo sapiens
gagacaggaaagtcgcttgaacctgggcggcagagtctgcagtgagccgagatcatgctgctgtactccagcctgggccacagagcaaaactccatctcaaaaaaaaaaaaaatattaattaatatgataaaatgatgcctatctcagaattcttgtaaggatttcttagtacaagtgctgggtataaactatatattcaatagatgacgattattacttattattgttattgataaataacagcagcatctacagttaagactccagagtcagtcacatagaatctggaactcctattgtagaaaaccaaaaaagaaagaaaacacagctgaagcctaattttgtatatcatttactgacttctctcattcattgtggggttgagtagggcagtgatatttttgaattgtgaaatcatagcaaagagtgaccaactttttaatatttgtaacctttcctttttagggggagtaaaacttggattgggagatttcattttctacagtgttctggttggtaaagcctcagcaacagccagtggagactggaacacaaccatagcctgtttcgtagccatattaattgtaagtatacactaataagaatgtgtcagagctcttaatgtcaaaactttgattacacagtccctttaaggcagttctgttttaaccccaggtgggttaaatattccagctatctgaggagctttttgataattggacctcaccttagtagttctctaccctggccacacattagaatcacttgggagcttttaaaactgtaagctctgccctgagatattcttactcaatttaattgtgtagtttttaaaattccccaggaaattctggtatttctgtttaggaaccgctgcctcaagcctagcagcacagatatgtaggaaattagctctgtaaggttggtcttacagggataaacagatccttccttagtccctggacttaatcactgagagtttggtggtggttttgcatttaatgacacaacctgtagcatgcagtgttacttaagacagcaagcatctagtgagaggagctggtgccatgcatgaccccacatagatcttgctgatagtgctacagcatgaaccctgaagctttcaaaactatgattttttttttttttttttttgagacggagtctctgtcacccaggctggagtggtgcaatctcggctcattgcaacctctgcctcccagatttaagtgattctctgcctcagcctcccgagtagctgggattacaggtgcctgccaccacgcccggctaatttttgtatttttagtagaaacagggtttcaccatgttggccaggctcctcttgaactcctgacctcaagtgatgtgcctgcctcggcctcccaaagtgctgggattacaggcgtgagccaccgcacctggcttttttttttttttttttttttggagacagagtcttgctctgtcgcccaaactagagtgcagtgacattagctcactgcaacttctgcctcctaggttcaagcgatcctcctgtctcagcctcccaagtagctggaattacatgtgtgcaccac

SEQ ID NO: 76685 - DNA, 1926 bp, Homo sapiens
agaatgctcccgcacagcatagagaatgcccccgcacagcatagagaagcccccgcacagcatagagaatgcccccgcacagcatagagaagcccccgcacagcatagagaatgctcttcacctctgggtttttaaccagccaaactaaaatcacagaggccaacacatcatttaagatagaaatttctgtatcttttaatttttttcaaagtagttttacttattttcagattctatttctttactagaattaagggataaaataacaatgtgtgcataatgaaccctatgaaacaaacaaaagctaggtttttttcatagctcttcttccagattgaatgaacgtctgttctaaaatttaaccccaaaaggaaaatattcagttaactatgttaaaaaccaagacttgtgattgagttttgcctgaaaatgctttcataattatgtgtgaatgtgtgtctttcccatcttctccacagggtttgtgccttacattattactccttgccattttcaagaaagcattgccagctcttccaatctccatcacctttgggcttgttttctactttgccacagattatcttgtacagccttttatggaccaattagcattccatcaattttatatctagcatatttgcggttagaatcccatggatgtttcttctttgactataacaaaatctggggaggacaaaggtgattttcctgtgtccacatctaacaaagtcaagattcccggctggacttttgcagcttccttccaagtcttcctgaccaccttgcactattggactttggaaggaggtgcctatagaaaacgattttgaacatacttcatcgcagtggactgtgtccctcggtgcagaaactaccagatttgagggacgaggtcaaggagatatgataggcccggaagttgctgtgccccatcagcagcttgacgcgtggtcacaggacgatttcactgacactgcgaactctcaggactaccgttaccaagaggttaggtgaagtggtttaaaccaaacggaactcttcatcttaaactacacgttgaaaatcaacccaataattctgtattaactgaattctgaacttttcaggaggtactgtgaggaagagcaggcaccagcagcagaatggggaatggagaggtgggcaggggttccagcttccctttgattttttgctgcagactcatcctttttaaatgagacttgttttcccctctctttgagtcaagtcaaatatgtagattgcctttggcaattcttcttctcaagcactgacactcattaccgtctgtgattgccatttcttcccaaggccagtctgaacctgaggttgctttatcctaaaagttttaacctcaggttccaaattcagtaaattttggaaacagtacagctatttctcatcaattctctatcatgttgaagtcaaatttggattttccaccaaattctgaatttgtagacatacttgtacgctcacttgccccagatgcctcctctgtcctcattcttctctcccacacaagcagtctttttctacagccagtaaggcagctctgtcgtggtagcagatggtcccattattctagggtcttactctttgtatgatgaaaagaatgtgttatgaatcggtgctgtcagccctgctgtcagaccttcttccacagcaaatgagatgtatgcccaaagacggtagaattaaagaagagtaaaatggctgttgaagcactttctgtcctggtattttgtttttgcttttgccacacagtagctcagaatttgaacaaatagccaaaagctggtggttgatgaattatgaactagttgtatcaacacaaagcaagagttggggaaagccatatttaacttggtgagctgtgggagaacctggtggcagaaggagaa

SEQ ID NO: 76686 - DNA, 2448 bp, Homo sapiens
tagacttgaactcctgggctcaagtaatccacctcagcctgagtagctgagactacagcccatcttatttctttaaatcattcatctcaggcagagaacttttccctcaaacattctttttagaattagttcagtcattcctaaaacatccaaatgctagtcttccaccatgaaaaatagattgtcactggaaagaacagtagcaatttccataaggatgtgccttcactcacacgggacaggcggtggttatagagtcgggcaaaaccagcagtagagtatgaccagccaagccaatctgcttaataaaaagatggaagacagtaaggaaggaaagtagccactaagagtctgagtctgactgggctacagaataaagggtatttatggacagaatgtcattacatgcctatgggaataccaatcatatttggaagatttgcagattttttttcagagaggaaagactcaccttcctgtttttggttctcagtaggttcgtgtgtgttcctagaatcacagctctgactccaaatgactcaatttctcaattagaaaaagtagaagctttctaagcaacttggaagaaaacagtcataagtaagcaatttgttgattttactacagaagcaacaactgaagaggcagtgtttttactttcagactccgggattcccattctgtagtctctctgcttttaaaaaccctccttttgcaatagatgcccaaacagatgatgtttattacttgttatttacgtggcctcagacagtgtatgtattctcgatataacttgtagagtgtgaaatataagtttaactaccaaataaggtctcccagggttagatgactgcgggaagcctttgatcccaacccccaaggctttgtatatttgatcatttgtgatctaaccctggaagaaaaagagctcagaaaccactatgaaaaaatttgttcagtgttttctgtgttcccgtaggttctggagtctgaggatgcaaagatgaataagataaattctcagaatgtagttataatctcttgttttctggtatatgccatctttctttaacttctctaaaatattgggtatttgtcaaataaccacttttaacagttaccattactgagggcttatacattggtgttataaaagtgacttgattcagaaatcaatccattcagtaaagtactccttctctaaatttgctgttatgtctataaggaacagtttgacctgcccttctcctcacctcctcacctgccttccaacattgaatttggaaggagacgtgaaaattggacatttggttttgcccttgggctggaaactatcatataatcataagtttgagcctagaagtgatccttgtgatcttctcacctctttaaattcccacaacacaagagattaaaaacagaggtttcagctcttcatagtgcgttgtgaaatggctggccagagtgtaccaacaaagctgtcatcgggctcacagctcagagacatctgcatgtgatcatctgcatagtcctctcctctaacgggaaacacctcagatttgcatataaaaaagcaccctggtgctgaaatgaacccctttcttgaacatcaaagctgtctcccacagccttgggcagcagggtgcctcttagtggatgtgctgggtccaccctgagccctgacatgtggtggcagcattgccagttggtctgtgtgtctgtgtagcagggacgatttcccagaaagcaattttccttttgaaatacgtaattgttgagactaggcagtttcaaagtcagctgcatatagtagcaagtacaggactgtcttgtttttggtgtccttggaggtgctggggtgagggtttcagtgggatcatttactctcacatgttgtctgccttctgcttctgtggacactgctttgtacttaattcagacagactgtgaatacaccttttttataaatacctttcaaattcttggtaagatataattttgatagctgattgcagattttctgtatttgtcagattaataaagactgcatgaatccagctgtgctagtgttttttacatgaaagtatcataatgtataactgtaactcacagaactgtctagcacttatcaagaaacagtttagaatacaaaaattagccaggcgtggtggtgggcgcctgtagtcccagctactcggaaggctgaggcatgagaatcgcttgaacccaggaggcagaggttgcagtgagccgagatctcaccactgcactccagcctgggcgacagagcaagactctgtctcaaaaaaaaaaaagtttagaaacaaatgcattgtttctattcttaactcataagaaagtggtatggattatagcacaccacagctctgaagagtgtaatattaaatctgtttataaaagccccaaagcagctatccttaatacatc

SEQ ID NO: 76687 - DNA, 1053 bp, Homo sapiens
aatctactggggaatgtccttcccatccccggatatagacctttcctacctggtgagaccaccttcacctcggtgctgcggctgactgcctggctcccctggtaggcactgcacgtgtaggagccctcatccctggcccgcaagttgtaaatgagcagcgtgccatctggggactggtggacacggtggccatcagcctgcacaggtagcccgttcctggaggagagaggacactgggagagccatcaagggcctctggaggtctgggagacagagggaagaggtaatcaaaggccattccagagccaaccgttcccaccccttgagagcaaacaggtggaggacagggagaaatcaagaatgaccaaggtttctaggttgggttactgggtgatgatggtgcccctccaaccttgggagatccaaggctggggtgaatggcgaggttgttttctgctatttcaaatttggggtgcctgtgagatagcaggaggcctcagatttgaagtctggagctcaagagtccagacccagatagtgtgtcagcatcgcactgacgcagcgaagtgcatgtctatgaggtggtccaagtcacacggggagaaaccaaggacaggccctgaggcacagcagaagacagtagttcctggagcagagggaagggagaatttcaagaaggagcatacggcaagcagaacgacactacaggtcacgtaaagactgcaaggtgtccagtggagttagggagagaggcagtgaccttggccaggacagtgtcctggaacaggggctgacatgcggccccactgcaggccctgagaagtgagtagggagatgaacaggcagaggcaaccaacatggacagctgtaaaggggacactatgtcagcatagggtctgcagggacatagaggctcaatggaaggtggttgtgaagaggggagttctatgcatgtttgctgctggaaagatccaggagaggccaacatggagaagcaggcctgacaggctgatcaggggatggctggactgagcacaccagtggggacacctc

SEQ ID NO: 76688 - DNA, 1859 bp, Homo sapiens
taccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgaaaatttataatctgctttaacaaaaataaatgttcatggtagaagcttttgcccatgaagggctgttctttcccctttcctttattagtaaatgaatttatttttcgttcttttggtcttactctccattctactgctgctgtaaatccctagtttagtgactagaaaaatacccttaagattcatattttcattcatactttaatcctgagtgtatctctaaagtcagattcttgctgctcaaagtgtggtctgtaacagcagcatggacttcacctaggagctggttagaaa

SEQ ID NO: 76689 - DNA, 1064 bp, Homo sapiens
ctctgattgcttctttgcctaatggtatgtacatccaatgcaagatatcatggttttcccaaacatcaactcttctctcttatccattccaccagtattgtacattcacctgactgacacagctccaaggggtcacttgtacaccctgcatgaattaactccattgatgttgtctgctcccgttgtagctaatggcactgactcagccttccatgtgcttgctaagccagcccatactgctctagcacccgtagcaatgcctgtgcgtgaaaccaacccttgggcccatgcccctgatgctgctaacaaggaaattgcagccacatgttcgggtaaggtggccacagatggtgttgaggattctgggatcagataagtgaccctggttctaaaactcagccagttagctgagtgggaactagggaggaatcctttcaggaaaactatgttccctcctagaaataagttgcttacataagaaaggatggtgaaggagaacaaaagagatcagactgatagtcattaggactgtggaacaggactgtggaacagagccccacccatagagcttttataaaatacagattccggctgggtgtgttggcacatgcctgtaatcccagcactttgggaggctgaggtgggtggatcacgaggtcaggagatggagaccatcctggccaacatggtgaaaccatctctactaaaaatacaaaaattagccaggcgcggtggcatgcgcatatagtcccagctactcaggaggccgaggcaggagaatcgcttgaacctgggagacagagtttgccgtgagccaagattgcgccactgcactccagcctgggcaacagagcaatactctgtctcaaaaaaaaaaaaaaaaaaaaaaaagattccagggccccacctcagagaatccatcaccggatttggtgatgtgcagacattcctgtagaaagagggggccctgctcctacaataggaggcctacaaaaagtgctagaaaaagcacttcatttttgcttttttgtactttctagttttgtataaaaaacatctattaa

SEQ ID NO: 76690 - DNA, 1049 bp, Homo sapiens
catcacttcccatgaagacactaatcccattaaactaggcattcctctttccctgaggttcgttgatagttgtatcttttgtcatttcccatagtgggaaaactaaggtccgtggagggggatgtgaatccataatttctcttcaacaaacaggcagcagagccattgtggaatttctagcctaagccataagatttgtggtttgtcctgatgtaagtgcattcactgcctttcagccaacctgctcccaaacatcaagggtctcaagtttctattcttattctgccattgggacccagcagggaattaattaaagaggccttagaaacacatagcattaccagcagaagaaatggatatgtgctcattgtccttctggctggttggctccataaggaggaaactctagacaggtctttcgtgtacatctaagatctgttgttcatcacagacagtggacttgttcacaagtattcattacctttcagaaccgtctcacaggcctttgtgtggcctctgtacagctatgccagcctctataggtctatcctcgtcataaaatctgtagctaaagtattagatctggtcagtgcttttgttgggctctattttacttccctctgagacatgtcaagccattgctataacaaaatatgaggaaactgtctcaataggccattcctactgatggtataaaagtacagagagttaagttcatctgacagatgaaactaggcctaaagaatagttggactagatgattacggagggtcttttcagttctcagctgaggtacctcatttcagttcagtctccttctagggcagacagggaataaaaactattattctctttacagatgagcaaacagagctttagcacacataattagcttcctcagtgatacagaagtatcctagagtcagtattaagaataaaggccctagcgtcctacacctctgctcactttttcatgttatcatagatcatatgcttagtactggagactttggagaaaaatgagattgatgacattgtcatagtttgtt

SEQ ID NO: 76691 - DNA, 2420 bp, Homo sapiens
ccgggcatggtggcaggtgcctgtaatcccagctagtcgggaggctgaggcaggagaatcacttaaacccgggatggggaggttgcagtgagccaatatcgcatcactgctctccagcctgggcgacagagtgagactctgtctcaagaaaaaaaaaaaattattaggaaaaatgtctgtgttaactctgagagaacaaataatggctttttaaagactgttaatagaataatgaagacttactgtgtttttaacgtgaaaattttaggtgaccaagggtcctgctataacatactgggggtcataggatagtagaatggtcaacatctcaatttagacatgttacttcctgctctaaatacacttgtggacgctacttgtggtgtaactccttatgtatttaataattatctgactctggttttcttggttgatttttttaaatgggtgaagaatctagttatgaattctttgccctttatggaatgtgatatcttggtttttattccatctgttacttcccttttacttaattttatcttattgttttgcgttgtgtttctaaaataatggctttggcttgttttttcctgaatgtttctgcagtttggtttgagtatctgggtttgggcaccactcctgaacttggactccatctgtacttgtgacttttggaaggcagagtcagtgttttctgtggaagatgacatttttttaatattatatatgtgtatctccccctcccctttttggtttctcttaaaagactggaaagaaagcagttaaagcagttctgtgggtctcagcagatggactcagagttgtggatgaaaaaactaaggtaagattctttatttttattttgatttattttattttttttggagatggagtttcactcttgtcacccaggctggagtgcaatggcacgatctcggcccaccgcaacctccacctcccaggttcaagcgattctcctgcctcagcctccctagtagctgggattacaggcatgtgccaccatgcccagctaattttgtatttttagtagaaatggggtttctccatgttggtcaggctggtctcgaactcctgacctcaggtgatccgcccacctcggcctcccaaagtgctgggattacaggtgtgagccactgcgcccggcctcgcctggctaatttttgtattattagtagatacggggtttcaccatgttggccaggctgatctcgaactcctgacctcaggtgatccaccggcagcctcctaaagtgctgggattacaggagtgagccaccacgcctggcctaaggtaagattcttataagcttaaatgggactgctcatatgttttttaaaatctctaatgatcaaatataatacccttaagctgttgaagggtattatattgttgaagctttatccttccacttagtccaaagtacaatctcctgagagactatttaacgttcaggaaaccactttagttactcatttactttatgagaaatagtattctctcaacatattgttctacatgacatagcatgtctaaggtactaagcattagcatttagtgttaagatctgagttcttttttttttttttttgagatggagtttcactcttgttgcccaggctggagtgcagtggcacgatcccagctcactgcaacctccacctcctgggttcaaacgattctcctgccttaacctcccaagtagctgattacaaacacagaccaccatgccccgctaatttttgtatttttggtacagatgaggtttcaccatgttggtcaggctggtcttgaacttccgacctcaagtgatccacccgccttggcctcccaaagtgctgggattacaggcatgagccaccgctcgtggcctatttttgttcttatatattttttaataagtttccactctcacaaatttgatacaatagatgatagactatccttttaccatgttttaaaattaaaaaaagatggactccacatctgaaatttcttcttgctctgaagaaaacactattttaagaaaatgatatttgaactaattaacctggcttttgactcaaaactcaatttaagtgacatcttaaggactagtgaatggctctttggttaacatttacttagaatccaaataatatctcaaatcataggtaccattttgcatttgagagacagtgatcctaaatgcctaaataagaatagacacacagctctacccctagaaagcatagggtgttatataagtacatttaattgttaattaaaatttcctagaatacctaaagtcaggaagaaatttaacaagaagataattaaaaaaaaaaaattcaaatgccactgaaaggggagaaagtctggcaggtaaaaagcagttttgataggcaacttgcctggtaaa

SEQ ID NO: 76692 - DNA, 1017 bp, Homo sapiens
cacagtcatgcccatttgtgtacatattgttatggctgcttttgtgcaatgatagagttgagtagttgcaatagagatcatatgtcctgaaaagcctaaaatattttgttgtctggtccttcacaaaaaacggttgctaatccctaatttcaacaatttaaaaactcatttcggccaggcgcggtagctcacacctgtaatcccagcattttgggaggctgaggtgggcggatcacctgaggtcagcagttcaagaccagcctggccaacatggtgaaaccccttctctattaaaaatacaaaaattagccatagctgggcgtggtggcaggcacctgtaatcccagccatttgagaggctgaggcaggagaatcgcttgaacgcaggaggtggaggttgcaatgagccgagatcgcaccaccgcactccaagcatgggcgacagagcaagactctgcctcaaaaaaaacaaaacaaaactcattcctccaactccaactcatttctcctaaggataacattaattatactgatgaaataaaagagcagtgtaagaatctttccacctaccatgtatatcaccaacttgtcattttcatcctttttcaatttatttttaaaaagtggtttcagctgggcatagtggctcacatctgtaatcctaatactttgggaggctgaggtgggaggatcacttgaagccagaacttgagaccagcctgggcaacatagcaagaccatctctataaaaataaaaaagtagccaggtgtggtggtacttacttgtggtctcccagctactcaggaggctgaggtgggtagatgacttgagcccaggagtttgaggctgcagtgagctgtgatcacaccactgtgctccagcctgggtgtcagaataagaccctgtctctaatgaaaaaagaaagaaagaaagaaagaaacagtggtttctacttaaagaaacaaagcctggagataggtagatagcaattggttatttcagttgccttttactgt

SEQ ID NO: 76693 - DNA, 1008 bp, Homo sapiens
tcgaattcctgacctcaagtgatcagcctgccttggcctcccaaggtgctgggattacaggcatgagccacagcacccagaattcttttcttatgttattggggaaaatttttttttatgtcatggtgattttatactaatatataattttttacagtgagtcatttaaagagtttggaaaacagagaggggcaagtattacccatgatcttacccagaatgtgcttttaaatgataattttttctttaatttggaatcttttgaatctttcaagttgccatcacttaattcatctccaccctaatctacgagaaatagactggtgagagagacttgatttattgagtttgctaggtcaattgtggtttgatgaaacctcaaaatgaagcatcttacagaacagtatatgttacggagtttttatccagtacagttcctcataaattttgatactttgttattctttgaatcatgtatgatttgatgatccaggataaatagaacaacagtaatcaagaagtgtttttattaaacacttttacgtgaaagtaagtagatagaagaattgtttgccccgattctgaatttatgactcatagccaggaaaaccttcttttccggaagttgcctcttggacctgaccaccatcacttccctattgttgcatcaccagctgacaggagcagtgtctccagaaactttagcagtagggaacagataaacctgggtctgttacaggcctgtaatccattgtaagcttacaaacattgtaaaagaggggcaaaaaaacgaagacctgaaataactttttccaaactaattaaattgctcattgccgtggccgggcacggtggctcatgcctgtaatcccagcactttgggaggctgaggcaggtggatcacgaggtcaggagttcaagacgagtctggccaggatggtgaaaccccgtctctactaaaaatacaaaaattagccaggcgtgatggcaggcgcctgtaatcccagc

SEQ ID NO: 76694 - DNA, 3246 bp, Homo sapiens
atccacccacctcagtctcccaaagtgctgggattacaggcatgagctgctgcacctggcctcccctttcttttaaatactctttctagagctatactgagaatcttgcagaaaatcggaagtctttaggatactgttcttctcatatcatagtgtgccacatgtattcctgatttttgtcttcttttcatatttttactatgcagaaatttctcgttgccttttgatttctctgagcaaacattcatctaaaaatcatccactggggatctacaacctactttgccagatacttatattgtgccaaatgctatgtttctggagactttttgtttgttttttttatagattataaagcttccttttagagtttcaaataagtgggagcaaatataaggatgcataagcctgcagaggattaaagaagaaataggatatctttgaaattagtttgaatgccagagtttaaaattttaaagaatagctcagatgtaccagttaagtaacaaaacaagcattttaaacctaccatgtgaatgatctttggaaggcagctatgctcatcactgtaccaccaacacatctagtgaataatctttgaactaaaaatgtaatatttctggtgctttttatttattcattttttttggagtggagtttcgctctgtcacccaggctggagtgcagtggcacgatcttgggtcgctgcaacctccgcctcccgggttcacgcgattctcctgcctcagcctccagagtagctgggattacaggcgcccaccaccacactcagctaattgtatgagacggggtttcaccatgttggccaggctgatctccaactcctgaccttaggtgatccaccagcctgggcctcccaaagtgctgggattacaggcatgagccactgcgcccagccttctagcgctttttaaatttgtgaacaattgaggaaagagataatttgcaagtgtttttcaccaaaatactctcttacaatttagaattacattaacttcaattggaagtcatctgcatacttgatatgctcaaatgaaaaaaatattataactaaacaagatagtgttttaaaaatatgctcctcagagcataaatatgttaattttttaactttctgggcataaagttattgacagctattttcaactcatttactttgtcatataacctcactgattagctactttgggacttagcttctataggataaatgacagaaatcactattgcccattgttactgcctttatggcatatcagctacagggtgaggaatattgtcatatatcagccaattccataaaaaagtgtataaggcctttggttatcttgcttaactctagtccaagatgcccttcgtttaaggtcatttcttcccattgtttcttaaatgtctctccctctgtcttagttttagactagtttcattatactaccagtttctaatatgttggttttttattcactatttgatatatttgttttaatatatgttcttgttttagcaggtaaaagaatcataacaaatgtttttaaaagaacattattattctttaataactgtctttttatgcattttgcatgccaacttttttcattaacatcttgggtattttataaaaagagggaaagctcaatgtttaacagtagcttttctaggagctaaattaaatattaacaatctccttccttcaccttcccatccctcaagaatggtgaatatcttaactttggccgcatccttgaaagcttatggttattcatagtctaacaaaactagggtcaccaaacttggcagcagaaataatctagtcttactgtgataactacccaattactttattatttttccagttgcagttcaaaatgttttgtggaaatattttttgctgtttgtgattttcaaagcttagaggggaaaacaaactttccagtgttggagagcactgaatagtttatgaattgtgtaaaagagtcagatttcaatgcaattatcttttcctagacatttatccaacattaaaaacctatgattataaaaagtaaaggcttaaagtatatttcaaccacagctaggaaatgtaaagttaaatctagcttgtgtgagttcaaacccatctaatttgtgtaaattctacagattttaattggtggccagttttcataaatggtgcttaaaaattggtgctgatagcatagatagttatgcctctgttatccagatagtttcagaattgtttccttataaatgtcaatgcaagtttctttattttaaaataacagcttttaggttgggcgcagtggcccatgtctgtaattccagcactttaggaggcttaggcaggtggatcacttgaggtcaggagttcgagaccagcctggccaacacggtgaaaccctgtctctactaaaaatacaaaaattagctggatgtggtggcgcacacctgtagtcctagctactcgggaggccgaggcatgagcattgcttgaacccaggaggcagaggttgcagtgacctgagatcgtgccactgcactccatcctgagtgacagagtgagactctgactcaacaaacaaacaaacaaacaaaaaccaaataataataagcaatagcttttataaagaaaacaaaaccctgtttcttaaatttcagttgtggcccacagacatcatttggttcttaggatacttgttttctcagctcttgtataaacattagccttgtaaccttaatagataatttattctgtgtctggaataaaacatacatgttatttccttatgtgtgttgtgaaattgatcagcacacctgtacatatagattgatactaatgtaagtaaatggaaagccaatggtcaagctccccttaagtggtatggagtttctaagtgacatcttgaactcactaagaaaaaagtatgacaaggacctttgatgcatactcatttaattttacgtattacatttttaatgtgattatgtggtcatttgaatgtggacttttttaaaattggtgactttcacatagttgaccgccaattttaaacttaaaaaatgtatatggaaccagtcttctattttctattcactattataaaatttaaaatgcaaatctcaccaaaccagtatgccctattgttttctctgctgccaaatttggaagatctctgttttaaatgtaaatagcgattactaaactaactggttgctctgcatggatac

SEQ ID NO: 76695 - DNA, 1003 bp, Homo sapiens
tttttaaaagatatgtatatatactttgtcttaggattacttttatgtgtagagacatagtaactgtgtctagcgcaggctattatgcttcagatccagtagattcaggtaatgtttagtgcctactgtgtacttcttcacttactcacctgtaacacctttttgaaataattattctaaatcttattcctatgaggacactgagaatatgtaaagttacattatctgaactctttttcactggctgtgtatttcttgagtgtaggaatttcaatacaggttgtgtgtctcttatccaacatgcttgacacccagaagtgtttcagatttcaaattttttcagatttggaatgttcaacctgtattcaattttcacctaatgcttactgtatagtagctacttggtaaacatagcaatagccctaacttttccttctttctacagtaccttggccatgtagaagttgatgaatcaagaggaatgcacatctgtgaagatgctgtaaaaagattgaaagctgtatgtatttgatggttgccagtgttgatctatatgctatcaatattttcttaaaagattttgctcagtacattttagtgacccagtaaaaactgtgtttctgttaaaaagatgtgggcttgctaataaggagcatctcagccaagcgcggtggctcactcctgtaatcctagcactttgggaggctgaggcaggaggattacatgaggccaggagtttgagaccagcctgggcaacatttcaagaccctgtctctattaatttcaaaaattttttcttaaataataaaataataattaaaaaatttaaaagcatctcatgttgcccatccagaggtataaattattagatgagccgtttaaatttaggccagatattatcctaaaggtacttttgatttataacccatatgaaacaaatgttgtgaaatctgatagaagaatagtattctaagactaggattaaactgttacagttaacatc

SEQ ID NO: 76696 - DNA, 1087 bp, Homo sapiens
attcattaagggttgcaaaataactgtactccaattctgtcatcttctctttgttttaaagaagaataatgataagttaatatatgtaataacagtaaactgtaaaccatgacttaaataggagagttgcaggtaagctttaacagagaggttgtatgaggtagttgaaagaagatagatctagaaatcaaaagagcagagttctgttcctggctctgttaatttactaagttatatgaccttgtataactcactttttggacaccttatgtcacgtttgaaaagtaaagttttgggatctcacatttttttcagttctaaacttacatgattaaacacatctgcttaggtcatacagtctattcagatggaattgtagtccaaatttatagttaaagaatagcccattttaatttaactattcctctttggttaaagactcaaaacaagttttgctactgtattgtgcgcatctgcatactatgtttgctatatagcataggctatgtatgtatgtgttaagatgctgtaaagctccttataacttgatgaatattatgtcacttttgttaatgttgggaactgctgactatagagtctctcacatcagaggtctgcatttcttgtgatggataaatcacgaaagcagggggagggaatctattttttaaataattttttcaagaaagggaaaaatgacttaattcatctaagaatgaaattccacatactagtttttctaaagtacatttttgtgaataaaagtttcttactcagaaggagtttggaaaaggcatacaaacaaaagaagtcccagtgtcaaatattttagccattaagcataaatcagctgcaattcttcagcgagatagtgtctcagagaagaaaagggatctctttaataatgtttatttcagtgggcatgtttttctcatagtctaataagacacaaagcttatttctatttccacgtttctataatagttcataaatgaaataattttgttcccttctaccaagtcttcctttttttttttttttttttttgtctttttggctggcataaatagctatatgtgaccaattg

SEQ ID NO: 76697 - DNA, 1056 bp, Homo sapiens
gtttaattgactcacagttccacatggctggggaggcctcaggaaacttataatcatgatggaaggcaaagggaaagcaaggaccatcttcacatggcatcaggagagagcagctcagtgtgagcacaggaaaaagactgccacttttaaaaccatcagctctcatgagactcactatcacgagaacagcatgggggaaactgcccccataatccagtcacctcccatcaggttcctcccgtgacacatggcgattacaattcaagatgagatttcagtggggacacagagccaaaccatatcagtcatttgcattctgtcctatagccattaattaaatctcctattctgtgtcttgagtttattgtaaaagttttcattattatgacttttaatattgtttagtatagagctaagtaatgtgctacattttcttctctatgagaccgataattcattgatgtatttagcagatatttatggagtctgctgtgtaccaggcaatgttctaagtactgcaaatacagcaaacaacaaagcagagaacagacaaaatccttgcactacgcttacatcctagtgggtattagactatgaataagtaaatatgtaaagtatctggtatgttcaaagggaattagggttgtgagacaaggcatgtgagacaggcacactgggggaggggaaagcctgaggtaaacagccactgggccagatggcgcagtttgcctggggtggggttggtttttgggcatcagtggatgtccccactgctcgtttgtcaggtggggaagctgaggcccatgggacatgaggtcactgggctactgttggccatccaaagtaagtctctgtcttcgtaatctactattctcaaggttggaaagctcgtttacacataggaggcagcaaggaactgcagaaactggcagccagggcccagcatcctgccagtgagaggccaagtgtgtagtcagatggctaaacaatcacttctataacatttggcctcaaatggccagagcctaatcagtaactgctagcttccctaatctc

SEQ ID NO: 76698 - DNA, 1035 bp, Homo sapiens
aaagattcctaaattttagtgtttcagaatgatttttttcttaataactataaaagtttttagaaactgttagcagtctataatttggtctacatgtacaaatttccattttcaggggttggaatgaatttgagaggtagatgggtaggcagaatttctcattgctttgttataactaaagttcttgaaatttcttaggataatatgtctttaaatcctactagaagttattgttcttacaaggactagtattgtagttgtcttttcaaaaagtaaaatgatttgtttgtttgaacttagtgttactctaagaggaaatgttctattcattttccctttacactgtgcttacatgataattatatattgcttaaataaaacccaaaacctttaattttggacatcagatttttggttagtatggtaatccaaagtttaaatatgtaagaaggtaatatttcttttaaatattttttttcctctgtcttcaggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaaggtaagagctgatgtttctataagtctgtatgtggaaaagaactgacaatctagtgtatgtgaaatctcattaataaggacaattaagagagtcttccaaaaaacaaatcccttcacattctgcttcaatgatagaattaaaagagaaagaaaggaaaataatgagaaagaaaacagatagattttaattagggagttttctttttatatttaaatatgaatttctctatataatgtggagtcagtacaaatattctgataagaatactaatcctgaaatacctaaagaccctaaattatcaggactcaaattttcagtggaatatgcttactaactggtgaagctgagggagtggaagtcagctctcttaaatacaagtcttgtttattttagaaatccttaa

SEQ ID NO: 76699 - DNA, 1060 bp, Homo sapiens
gcacacttacttttttttggtgaatatctttgacaaaggcaaatttgcagattgatagtaaatatcttagtaaaagattgtgtgttttattactacttatggatccagatttattctcatttgtaagagcagagatgggagatggatttataattaaaaataaaatgaaataattattccaaatagaagatttctcagaactttcatatagtgataattcatgttgattttttggagtaaatatttgctattggttaatattggtgggaactttgataagttgaatgattcaaaagaaagacttcaggctgtgttttgtagagagctatggttttttcattttttttttctattacaaaatttaaaaataaagatgaagtctcgctatgttgtctaggctggtctcgaactcctcacctcaagcagttctcccacctcatcctcccagagtgctgggattacaggtgtgagccactgcacccagcctagaggtactttctgaatttgattcactgattgaatcactgattcaagaatgttaaaatagtgtgatctggttaggaaactattctatatttgggccacttgtgagaactgatagcctagtaaagtatcggataataatgataatattagtactagcagcagccaatgctacattccaagaagcgttctaagtgctttacatgcactaactaatttaatcctcatgataactcctgtgagggcagctactattataatctttatgttactggtagggaatctgagatagagaaggtaagtgatttgcccaatatcatagagtaagtggtagaactgggattcaaacctagatagtttggctccagagctcatactcttaactttcagtgctaaatggattaaattaaatgtagtcagttttactttgttgttgagcatatcattgtgcagtagtagtggcccaagtttaaattgggatttctttttttttgagacagagtctccctatgtcacccaggctggagtgcagtggcacgatcttggctcactgtgacctccgcctcccaggttctaa

SEQ ID NO: 76700 - DNA, 1042 bp, Homo sapiens
aactgaaggttagaaatggcatattttccttttaattttcaaaataacaaaaatataattattttacaatttgtaaggtttgcttagcattttgaaagaaacttactgtttttagaatgtttaactctaaattgggtctttttccccctgtttttaatagtcattaattattcacttttagagatcttaagagcaaagggaaaagcatacatttttttacagagtgttcgagttttatgtgtctcatctctatttgtagagttgtgcttctttagaggctggtactttgccaagtaaaaactaatttcctaggaaatcaggttgctggcttgacttctggcagtctctttcccttcttttgttgctttgtaaaagagctgagctcagttctgtggaaaatcactaaatcatctaattattttccccagtttggattaaacatggttggtatatatttgcattgaactgagttctgtaactttttcttgattatagatttgttaagataccgtgaaggactttgacttcatttgataagttgcgtattcatatctgaaataatgctaatggttttttcctttaatgaatgttcttattcttttagtctttttgttctcccctccactagacctacttagtgagggatatcacttgtgttcttataatgaaacccagacacttgtgaaatataatcatagtttctatgatgttggcccctaattcattttaaaaaattacattaacatttattgtctgtttctgttttttcttcgtgcatattttactatatagataattttggaggctgctttttaaacaacatcatataatatgtgtttattatttttattacaattatttgaaaactttttttttttttttttttttgaggcagagtcttgctgtcttgcccaggctggagtgcagtgtcgcaatctcggctcactgtaatctctgcctcccggggtcaagcgattcccgtgccttggcctcccatgtagctgggattacagatgtgcgtcagcacacctggctaattttt

SEQ ID NO: 76701 - DNA, 1547 bp, Homo sapiens
ttttccctccctcattttatgttttcctgatagggctggggagaaataaaacaatatactccttaaattaaaaaaaaatttttttgctatcttatttttttaatcttgacattatagtgcatcctttagtggcaaagaaaatttgtttaaggggccgggtgcggcggctcatgcctttaatcccagcactttgggaggccgaggcagacggatcacgaggtcaggagatcgagaccatcctggctaacacagtgaaaccccatctctactaaaaacacaaaaaattagctgggcatggtggcacgcgactgtagtcccagctactcgggaggctgaggcaggagaatggcttgaacctaggaggcggaggttgcagtgagctgagatcgcgccactgcactccatcctgggcgacaaagcgagactttgttttgaaaaaaaaaaaaaaggaaaatttgttttagtaatgtaacatattataaattttattataagaggtagaaatacaatacagggctttaggatgtatgttcagctgcaacacacaggtagtgataaataagatatcattaaatactaggtacaatattgccatatattttggagattattaaacgtgcactttgaggctaggcgtggtggctcatgcctgtaatcccagcactttgggaggctgaggcgggtggatcacctgaggtcaggagtttgagaccagcctgaccaacatggagaaatcccgtctctactaaaaatacaaaattagccgggcgtggtggcacatacctgtaatcccagctactcaggaggctgaggcaggagaatcacttgaacccaggaggcggaggttacagtgagccaatagcacgccattgtactccagcctgggcaacaagagagaaactccgtctcaaacaaaacaaaacaaaacaaaaagaaaccataaaaaaaagtgcacttcgaaatcttgaggcaaaaggaggattgaaatgaagggagaataaggagaatactgacgtgcttaagggaggagtctggaggatctacaggaagtgtatctagaggaatgagtggttcttggcagttttcctggagtgacatatgtaaaggaggatgattctatttgcaacattctcctatggacttatttttcattctctgcagtttctgctgcttgttattactcttcctttgttttcttcccctcaagaaagcatgtcagaagacaagtaagtagactgagaagtggtagtcctagaggatgagagccttggaaggaccatgtggatttagaagaaggctcttcttatctctgcttctgcagctcttgggaggtccccagcaaccttaactagaccaacctttcccacttgtcctctccagtggagtatgggattaggaagagacccccagtcatcttaaatgcattaaccaaggagttgctatattagtaattaacgttcagtgacttccccctctctacccacgaaaaccctgtttctccccacttgtttgctgataagttacgttccttttttttgagacggtgt

SEQ ID NO: 76702 - DNA, 2252 bp, Homo sapiens
ggaaaagtattgttttgggaaacttttctcctacatgtatgtactaggtcacaatgtaaagtgtatttctttttttgagttcctggccaaaggataaaatatatttcttacagttaaaaaagtctgaaagctgggtgcggtggctcacgcctataatcccagcactttgggaggccaaggcgggcggatcacttgaggtcaggagttcaagatcagcctgaccaacatggtgagacccccatctttaaaaaaaatacaaaattagctgggcgtggtggcgcgtgcctgtaatcccagctacttggaaggctgaggctggagaattgcttgaaccccggaggtggaggttgcagtgagccgagatcatgccattgcattccagtctgggcaacaagagtgaaactccatcttaaaaaaaaaaaaaaaggtttttttgggagtattatattccattaaatttcttcagtttctgatttggttcctcctgtgtttgtcttgtcacatattgtgttatgcctctgactctggaacttttttggatattgagaatctttggcatgagaacttaagggaatctgaggcagagaaattgaatggtgtttctcagatgttgtccgcttttgtttcacttgtgccctcttgttcaccctttcttttttatcactgtaccgtaaagcattgtttgtaaaagcctgagtatacacagacatattgacagtaaacaacactgaaatggactgacttgagaaaatttcatgtatagaaaataagcaaaaacaaagtaagaaacactgcaaaagagaaaaatgaaaagatatttcctttttagagagtaaaaatattaagtatttcttatccttacactaatataaaacatatacagatatttttaaaggaactagatatacagtttctaggtctttgtagagaaaagaaatagtggtaatatgtgacagcaaaatgcacctgggatagaggcttaactacaaagtaaatcatttattaagagggagcttttgtttaatggttttctcccttgagaataaactggatgtggtacatgttgtaaacttaacttgtttgaggaacctaaatgtaatttacagcgtgtttttaaaaagaatatgtatgttttatctgtacgtggtttgatttttcttccattgaaagctagatggtttatatttaggagttgatttagatctgtttttatggctgttaagaacaggaagcagtattgaaaactgaaagagatccttgcagctttctttaaaatctttaatccaggggattatgtaacctcttcattaatgttttatgaaattgtgaagaaactgttggtatagctttgcatcaggatttttggtttatttttttctctctcaaaaataatttttagttttatttcagattatatttccttaaaatttttattttcatttggaagactgcaaggcatataaccattgcatatctgagttctaaagcagatgcagacttttcacaaaataaatttactgctttttttctgtgacataagtttcgagaaggaaagcttttgatttcttgcattgagttcagtggattattcttagcactagagttgttgttgaagtcatggtacatttatatagatcattcagttctacaccaaatgatggaagaatgagaaatcctatatgacaaatagaaaagttcattcttcataattgagaacattgagcagtttgattacctggttttaataagtggacttattattcatctgattatacttatctaggaatagctttgattgcccaaataattttacagtgggatttggttgtctgtagttgaataaatggtggtttttaaatcccaaaatcctaactgtgctatttagtgagactcagtttcacatactgaagttttatttaggtaagtgattttaaaaagtagaagttcaattaacactagttaattaggtttattttctatttcagagaagccttgtcttgttttataagtctctgatctacttttctgcttcctgctctccaactcgctgtacaataaattctaatagaaatgtgggtaactgaaaatctagttctctaaaagtataaaacccctatatctagttttttagtttgcttcgaaacttcctaaactaattacctttaaaaaagtattttatataatagagtacttgaaaagctacattttactttggacttgccaaaacacatctgttgtgtgtaacaggtttt

SEQ ID NO: 76703 - DNA, 2007 bp, Homo sapiens
ctaatgttggtgttttgtaagtactacccctatgaataaagctagcagagataagcttctccttgcaggaagtgagctggagaagtggaaaagtttacagagaaaactctacaacaaagacttaacccttcccgggtaaccacgaatgtgagcgtctgcccctcctttgctttctactgcgcaaccaaactgtgcacaagcgtgaatcaaccttaaccgtcacgtctcttgccagttagcttaacagacacttttagcagcctatcataacttcgaattgcccaaccctcaaccaattacaactaaagcttgggctaggacgctccaggtccgggcgggggcgaataccgggtttaggaaaaggggcggtaaagagcgatgacgggcgggtatactaaaccaatcagagaggagagctgccgccccactatccaatggataggttagaagtatgaaagagggtgggcctgttgtcatgggggaggtggtggcgcttggtggccactggcggccgaggtagaggcagtggcgcttgagttggtcgggggcagcggcaggtgagtgccggtaacgcgggtcagagatctgggggccgtcgcggggcggaatctccagctcagcactccggaggcggaggccggaggaagggggcctggacttcgggtcggggcccgggccggggccggggccagggcggaggcggcgggggcggcggcgagttcgcgctgactgggctagggggagaggggctgggcttctggctgcggagttctcccgaggaaggtaggctacggccggacccgcgcgggtcaggccaggaggtcccttgggacgtccagctgctccggtctagcgcgctgaccggcggccactgtgtgaggagtaggtatctgaggaaacggaagcggccagggtcccagagagggggtgacctgtaacgacctgcttcaagggcggggtgtcttgggaatacccaggacggcttgggtgccagggagaaaaggaatccgggaagcccgcagcggccggtgaggagagagcggggtggggggcaggggaactgggagtggccccggtccgagggaggtaggaaggccgagggtggccagggtcccgggtgacagggagcagacttgctccaagtaggggcgtctgaggaaacgctcggagggggttggggaccctcctgagaaaagcggctgtccaagggagggggctcctggagagatgaggagcagcaggtcttcggagggtcggacgagtagagatcttgcaccgcctgggggaagaaccggagctccctgcgcccccatagctgagctgggatgggagacccaactggcctggccgctccggctctgaggatccctaagggaccaggaaagaagtcctcgaggagtggctcgcgtttgagaccggggtgaggagccagcaggggagtggaagttccctcggtcggagaggagtcatgcaaaatgggacggagatgggcggaggtgggagagaatccctataggaggggataaggtagagaaagaaagttgcccgaggagagagtaatggtttcgtggaactggctaggacagtagatatatgagaaattaacagtggagccatgtaggttcacaggtcttcacaaatagaagaaacttcagtttcgtaattaatatcaagatgacatctaggaccaaagcaaagctcctaaaagcaaggttaagtgacttgttttagaaaagaaatttgttttaggatgatggcagtaatattaggaaataggttcattgacagggtggggaatttgggagggaaaaggggaggagtagctgaactaaaggagtagaagtaaatacttatcagaaagagggtaggcatactcggctaaagtgaaaagaagttttgagttctagttccaccacttagctaagtttctgtgcagtttcctcatcagaatactaatagtaatagttcctactttataaggtggtggtggtgttttttttttcatgt

SEQ ID NO: 76704 - DNA, 1734 bp, Homo sapiens
agctgaatgccaggatggagtccactctctgcacctcaccttgtccacgtaccagcgcaatacctggggtgacttcttagaggccatactgcctctggcagtgcaggctgcaatggaagaaaatgtggagtttcggaggggtctgccccgagacttcatggattacatgggggcccagcattcagattctaaggatccgcgaagaaccgctttcatggagaaggtgcgggtcttggttgcccgcctgggacactttgctcctgttgatgctgtggccgaccagcgagccaaagacttcattcacgattctctgccccctgttttgactgatagggagagggcactaagtgtttacgggcttccaattcgctgggaggctggagaacctgtaaacgtgggggcccagttgacaacagaaacagaagtccatatgcttcaggatgggatagctcggctggtgggtgaggggggccatttgtttctctattacacagtggaaaactcccgtgtgtatcatctggaagaacccaagtgcttggaaatatacccccagcaagctgatgccatggaactgttgcttggttcttatccagagtttgtgagagtgggggacctgccctgtgacagtgtggaggaccagctgtccttggcaaccacgttgtatgataaggggctgctgctcactaagatgcctctagccctaaattagtttcttgttgattgctggaaacaaggcagtagtgattctccgctgccactgctaccttttttttttttttttccttaaactcacgttcttaccttgataagcatcagtgtgctcacatttacctttatcactgcttcagtgtcacaaacctcggaaggtcttctaggaagaaccatctcatctaggtacaaaaggaaaaggagaagttggaggtggaaaaaaaacccttgatccgtgatcatttcagagcaccaacttcatcaccttcaggcttcagtgtactgggtaacactgaccatgtcgttctgcttgagacagatattagattttttttggaatttggatctttcatctgagttctttttcatgggcgggtcggggtcagtatcctgtttgttattgttaaatttgtatgaaccttagaaaagttattaaagtgccaaagaatgtttccctttcctaaggctagattattatgtgggatggttcgaagaaatgcaggagcgggaggaagatagggaaaatctataatggctgaagtgaaaagcaacctggggtggttgtagcatgtaaaaggagcatgttaatcaacctcttaaggaagagactctcaggctgggtgcggtactcatgcctgtaatcctagcactttaggaggccgaggcgggtggatcacctgaggtcagcagtttgagaccagcctggccaacatggcaaaaccccatctctagtgagaatacaaaaattagccaggcatagtggtgcgtgcctgtaatcccagctactaggggggctgaggcaggaggatcacttgaacctgggaggtggaggttgcagtgagctgagatcatgccactgcattccagcctgggcaacagagcgagactccgtctcaaaaacaaaaacaaaaacaaaaaagaatcttatctgattgggaccagttcactaactttggggataatttatgctatttaattatgcaacccaattctagtagaaaaattattttctaccagcttgttcag

SEQ ID NO: 76705 - DNA, 1080 bp, Homo sapiens
tgagatgatgtacttgttgatgatgactcagtttagttatgacagtgggaatgggtggctcaggtgggagacagaaaaagatcatgggagatacgagattaaggaactgagaaaccagagaataattgatagatcttccacatggttatcaccaagagtggtgatggacaaattgtggaaaggaagagatagaggggaggtaaattctcaaagttgcaaatctgggtaaatggtagaacctagattcagactcaggttcaactaacttccagggtggacacaactcaccatattccactgtttgtggaatcattcttcttctttttcctttgtccctttctcaggtaaaaggtccaggagttgggctgcttggaatttccaaagggggtgagctctgcctttccatggcctctttcctgaagggcatcacggctgctgtcgtcatcaacggctctgtggccaatgttgggggaaccttacactacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattcttttgtttttaataactaaagttttttcccctcattattaaaatga

SEQ ID NO: 76706 - DNA, 1084 bp, Homo sapiens
tcttttttggttccatatgaattttaggatttttttctattctgtgaaaaatgacattggtattttgataggaattacattgaatctgtagcttgcattgggaagtatggtcattttaattatattaattgttctgatccatgaatatgagatatctttgcatttgtttgtgtcattttcaaattttaaataccacaaaaataaaagtttttttattttctcctcattttcatttggtagggacctaatagttatctgattcagccacatataaatctgattatcagggtgagtaggtaaatgttttcaataagttaatggtaaagaattattaaacagtttgctaaattctagcaattgtcttgaaataaacatggaaaagccttaggaaattctggcctcttttgtttccacattgcaatcatgggttatttcttccaaatgtatttttctcataggaagagaaaactggccagaggccatctgaagccaaagagataaaactttatgcccagattccccctatagagaagatggatgcatccttgtccatgcttgctaattgcgagtaagttctcttttcatccttccagtattgctgttaggtttccctttcttttcttaaacacacaaagtaggaaaatatgtttgttttctgtggtcttcatttattttttgtttgcttagtgtaattctctctttggcaaggtcaaacatgaaaaatgactggtttataggattattaatagaaaatattgaacagtatagtacaattttttttttttttttttgagatggggtctggctctgtcgcccaggctggagtgcaatggcatgatctcggctcactgcaacctacgcctcccgggttcgagcagttctcctgcctcagcctcccgggtagctgagactacaaggcacatgccaccacgcccagcaatttttttgtatttttagtagagatagggtttcaccatgttagccaggatgatcttgatctcctgacattgtgatccgcccacctcggcctcccaaagtgctgagattaccagcatgagccaccacgcccagccaaacagtacaa

SEQ ID NO: 76707 - DNA, 1009 bp, Homo sapiens
ccacatttttttttttctttttgagacggagacttactctgtcacccaggctggagtacagtcacactatttcggctcactgaagcctctgcctcccgggttcaagcaattctcctgcctcagcctcccgagtagctgggattacaggcatgcgccaccacgcccggctatctttttatatttttggtagacatggggtttcaccacgttggccaggctggcctcgaactcctgacctcaagtgatctgcccaccacggcctcccaaagtgctgggattacaggcatgagccacagtgcccaatcaggaaacacatttaagtgccttatactaccatatgtggaatgaatccagtagccataccaagttattgaccagttatcttaagcagacattcttctgatcacatccaaaattgatgtctacatcagctaactttcctacaagattatcaaattttacacagtatttttctgtatttaatgactgccatggtctgcaaaattatgtgattagacaatgaatgacgcttaaagaatgatgacctattttctaaagtacactcaaaatattaaactttagagacaaagcaaaatctatcataaagttggcttctgttgatagaaacagagaggtaggttaataatcactgtcctaagataagcaagaatgcttagaaataaaagttgagaccctgcttcaaaaaagagaagttgaaccttccagccctgagtttctaatattacatgaaaattatgaaaatgagcattaagccagtcgcagtggctcacgtctgtaatcccagcactttgggaggctgaggcaggcggatcacgaggtcaggagtttgagaccagcctggccaatatggtgaaacgccgtctgtactaaaaatacaaaaattagccaggcatggtggcgcgtgcctgtagtcccagctacttgggaggcggaggcagaagaattgcttgaacccgggagacggaggttgcagtgagctgagattgcg

SEQ ID NO: 76708 - DNA, 1038 bp, Homo sapiens
tgagccgaaatagtgtgactgtactccagcctgggtgacagagtaagtctccgtctcaaaaagaaaaaaaaaaatgtggttcttttgtggaaagaggaatttgaacttgaataaacacttcttttgacaccttttaccagtggtctgaagcagaataaggaagaataagaaatgaatcttgactgttgacttattctgagaattggtgatgtgtaaagagagttggaatcttctacctgggtttttctcagggctaaatggaaaagcacagggcccagaaaggttggagttaatcattcacttaaaagcattaggaggaagtgtcaaagcatcagtcatgaatagattatgtctctctgactacagtcagaccatcaattcactaagaccttatactctgtaagtgttggtaaaggaagaaaactgctaaattgcatgttaccctttactagaaattcattcctttggcacagattttatttatttggggctgtttaatgtgtctgtaaatcatgaaatataaaagcaagattcagtgtagcagagttggtgcttcttctgacaagctaacttgaccatatttctttatctgtgctctaacatgtgtcatattgttttctttttgtaaaccataaaatgggtgaacttccaaaaatcaagggtcatgttttaaaatcatggaacttttagaaataccatatctgtatctctattcctgcattttataaatctgtaaaggaagaaaactgaaaggaagaactagactgagtcttacctttctctgacctaagataaactgataaaactttttacttgatatttggagaagtcattaactggattctagttaatttcccatattgggcagtttagaggagacccagccaaccaaattatgatctagcaaatttaacataggggaagagggatagtaaactatttttcagtagatttgcactttaaacttaggaactggatgttggtggaaaggacttccatagggcagatgggtaaatatctagcctgcacttggatgtt

SEQ ID NO: 76709 - DNA, 1068 bp, Homo sapiens
attttgaaacaaatcacaaaataacattcagaaactcaacatttctaaataacttaattcacaataagtttagtcataaagtcatgctacaaaactcctgtgtataaaagattattaccaaggtattcatagatgttaaaatgttcttcagaatggagttggttctagaagccaaagattctggaatgatgctcgtaatcatgactgccagcctgggagaggagctggctatgcgcatgtgctcttagcttccaactcaccagtcttttgatgggagtgatccctccaggcagtagcacctcagaggcaggtaccctactgatcacagaggcaaagagcctcccacccatataatgttagacaactctacattcatttaaaatctagaggtgggaatgataattcgcaaagcttctattctgagtaggagaactacttgacacatcccccagagggatgatcttggatgtaacagacatggaagacgactcaagtagggaaaaagggaaatcctgactctgattatgtcaaaagacagttaactactcatgtgggtttagaacgagcaagggtgaggtttgattctctaacatccaagtgcaggctagatatttacccatctgccctatggaagtcctttccaccaacatccagttcctaagtttaaagtgcaaatctactgaaaaatagtttactatccctcttcccctatgttaaatttgctagatcataatttggttggctgggtctcctctaaactgcccaatatgggaaattaactagaatccagttaatgacttctccaaatatcaagtaaaaagttttatcagtttatcttaggtcagagaaaggtaagactcagtctagttcttcctttcagttttcttcctttacagatttataaaatgcaggaatagagatacagatatggtatttctaaaagttccatgattttaaaacatgacccttgatttttggaagttcacccattttatggtttacaaaaagaaaacaatatgacacatgttagagcacagataaagaaatatggtcaagttagcttgtcag

SEQ ID NO: 76710 - DNA, 1497 bp, Homo sapiens
tctgcattcagctaagggcgggaaactgacctagtgcctgtgttgcagaccatttctgaggtctccaccatccaaggaggcacagccgtcattactgtcctccatgccttcagcagcccccctcacagctaaggtacataccaccccttctgccgcgcctccacccctggcaccaaggtcttctgctgcttatgtctaaagggatcacctatatttaactgcctcagtgacctaacctctttcttctcatgtgccagatgttaagatgaaggaggaatacaacacatactcaagcctcagcctgtttagttgttttcactggggctcgcttttctgggacggtatttattatcagactggcaagcctaactccataggtttacaggaagtagggatatttttataaaacaattgtgtcctccccacattttgctatgttaatatttgcttctaacaatttgcagctgtttcactttttcctcatttgtctctaagttgaaggctttgttggaggggacagagcacaggaacagccttgacagtctgtaattattgtacagatattttaatagcatataaataagtatattccttttattttgaaacaaaaatgatcagacactgccttttgtgtgtttgctgcctgtggcatccttttttaaaaagactgttacatattaaaatagtgtacatatataaatattacctcttttgctgtacagttgtgatagagactgaagattttattttttgtgtgctttttataagaaaaaaattaatacactaaagaatcttgctgatgtgattgtaatgtacctatgtaacttatttacttttgaatgttcttctgtatctttaaaccttttattaaataaggttttaaaaattcagagttgaatgctttgttctcttgggattttcaccatctggggttgatgtaagtgcgccttgtcttgcttgcagggagattactcgacatttttgaaccataaggattctcttttagcagcctattgtcaatgatgccagccaggaaaaggaaaataatacactaatgtttgcctggctaaaagatgactcagtagacacagacagatttttacaaaattttagacaagaaaaagtctaaactcagtgtctcacacaaatacacagaaatggcgcactccgacattttggcttcattgggatgaaatatgcagggtgcacagtgtggtcaggggcaacgggaagccagggttctgaggagagtattttcacgtgcagggtggactggctgagcaacccgagtagacaagtccaccatgagggatgcatttccaacaatatcatcttaaatccactccaggattgggttattatttttaaaacacggtgcttagtagtagttgtttactgttaaaatgctaaattatgaaaaaggaaatgcgccatcagagaaacaaatgcccgagcccctcgctggctccacggcaaccgctcgacccccgcgagccg

SEQ ID NO: 76711 - DNA, 1697 bp, Homo sapiens
ctccccagaggacctcgaaggctgcaacggccctgccccaagccccagaaaaagaaactcttggagggagtctgcgggcttctctgagaaggggcgcagcctgacacctgtgctgtccctgcagtctctaggcctgtctgagctgctcccgtgaccgtgtcctgagtggccacctcctccttgggagggaggccgcggcaggtactctccctttgctgcttgctggcggccttgctagggctagaaagttttctcagcgttgggggaggggctagcgttcttgtccaaagcactcatcctgctgcagggaagggagctgtacggaggctggaagctgcagggttaggcccgagagagcttttgacaagcctggctcttcctgcttcccacctttttggctgaatacctttgggtcctggaggctgccaagggcgcttcgccttgagcaggtcccggagaggctcagcctgcccctcctggggccagcctccttgcctctgctctgacctcagcagctacacctaaccccaccgcaccctacccagtgtcgatatccacaacccagcccccaggcctgcactttggagatttctggatccttccctgggagggagaggtctcctaactcgattggacaggagccttcattccttgactcgtgtcatttgggagctatttatttattcttagtatttaatttttaacatcctctcagggaccaggggcctcctgcttttcagaggcccgagtgcatttatcccaaaacgaggcatcttgacatcccctatccccaccccctaaattcccaaggccctaaggtccctcacctggttgctctggaagctcttgctgataggaatgatagcaacactgaaagagcgtgggaaggtggagggtgtcaccagacccacacagagcaagggagattaaggcagttcttgctgccccttctctggctgtgctttgcctgagggaagagttggcaagaggccagaattctagtttggtttatggggcctggattctggcttgaagaagccatatttggcatgggtgaagtgaaagggccaggaggttctggaggccccttcacttccagtcccatagcggggctcagctatttttctgatcttattcaactttagttgtgcaaaagaaattctaagtgaatgcgcgtatgacaggtcaacgtattaggaaggagccagaaagtattcatactgctactccttatgagatagccaagaagcatcatgtcagtaactgggagtggagagggagttttgttttgaaactatgcaggtatttttcagcatccatttgtacattagtatggttctacaggaccccagctgtggaagtaacaaatttcttctccctccagactcttggatgactacctagatccccagcttaccggttagtttcctccacaggcttccatgagctcagtgtcccaagacagcaaaaatctggtataccctgtagaagcaggggggtagcaaatttaggctctcttcgaaattacttgtacaatacgagtgccttcgcagcttagccccaaagtgctacttatgtttcccaaggtcttttctattcaaatcatatttggtttcaggcccctttatgggcatacggtaacagaaacctccatcattcatatgagacccttttgtcagtggtaacatcttgtactt

SEQ ID NO: 76712 - DNA, 1950 bp, Homo sapiens
agaatctgtgctacagcagtgagacagagctctaggctcactgcccttgttcttgttccccatagacttcccaaaagttcccaagggtgcctcttcccagaagagagtccccaagtgaagagaggctggagcccaagagggaggtgaaggagcccaggaaggagggggaggaggaggtgccagagatccaagagaaggaggagcaggaagaggggcgagagcgcagcaggcgggcagcggcagtcaaagccacgcagacactacaggccaatgagtcggtgagtgtgaccaccatgggctgagcccagggcaagcagggtggagctgggcctgggggcgtgggagggagggtagagcaggactgtgatcctcattataatcataatagcaggaaatgtgtgaagtactttgtgctgttaactcatttaatcctcactaccctatgtggttaggtattactgttattcccattttatagatggggaaattgtggcccaagataacacagctagtaggcagcctgaatccagagtctgcgattaatttttatactctactgcttctgtatctgagattcagagggaaaaaggttttgtgaaaacccagtaggtatgtgggtcactgagggagcattggtggtttgcagacagggctcccctaagagagccagagtccctgacaagaatgagactgagctgagaccatgggaatgacaatcataggccctcaggcatgatctctgcaaagtgctttcatttccattatctcattagttcctcacactgcagagttaacctctactctgcagatgggggaaagcagttcagagatgctaagtgacttgccccaggtccttggactcctagtgcagtgctctgtccaccatatcacaggccaagaaacaagactactggccatagttgctccttgccagggagagttctcccagaaaggggtaaggaggggaaggggtttattggggagctgctgcttttttagagtctttttttttagaaatgtatgtagtaggccgggcgcagtggctcacacctgtaatcccagcactttgggaggccaaggtgagtggatcacctgaggtcaggagtcgagaccagcctggccaacaaggtgaaacctcatctctattaaaaatacaaaaactagctgggcatggtggtgcacgcctgtaatcccagctactccagaggctgaggcaggagaatcacttgaacccaggaggtggaggaggcggaggttgcagtgagccaagatcatgccactgcactccagcctgggtgacatagcaagactccatctcaaaaaaaaaaaaaaaaaaaaggaatgtgtgtagtacactcatgcttacagagctcccataaactgtaaacacacggctgtgtgcccacttctgagcctcgaccacctgcaccaagagctgtgctctgtgtagcgctctacagagttctgttgacttttgtgaactttcccatgagggtgccacttctgatggccacccggggcttccccagccgaggtcacctctgctccctctgctctgcactctgacccctgcccttgccctgtttggtgtccctgcagtgcgctgtcctgaagtagctacctgcgcatctgtcccttccaccagatcctcagctctgagggcagggatgcctgtgtcaacctctttgtccctagcatctggcccatcacaggggcctgaatctcatttatagaacagggcatgagcggactaaatgacagaaaacatcaacaggtaggtgcttcattaacccagagaccaagatcccctgtcaggcgcatcaaggcctctagcagctcgggctgccccacagaattactctagcagcaactttgtaaacgatagagctgaccagagatgcagagttggaggaggcaatggtcgtcatatccctggaaggacccaagtgc

SEQ ID NO: 76713 - DNA, 1014 bp, Homo sapiens
tgcattattttatccagttctcacattaaccgtaggagacaggtagtgatagccccttttggtgagtgtgaaaactgaggcacccaaatatttagtgaagggcctgcgttttcgtaggtgacaggctgcagagccaggactcaggtgcctgtgttccctgcgtgagctctgtgtgtcaccactgtgactcttgcacatacagggcagccactaggattgggggtgctttgctgaaaggggggtgctatttatcaacctgctctttgtcccatagacagtgctgaagtaaccccgcctgtcctctctgtgatgggggaggccaccccagtgagcatcgagccgtaagtgcagccctgcccctggccgaggggtgtgggtggccacactggtgcagtgtgtgcaggtgggccctgggagcaacaggagggttccgtggggcctgcagagggctgagagggcctccttgagcttctgtatgtggccctgggctttgctgtccccgccctgcctctgtgtggaagttgcagggaagggcaaggaccggctcagcttgaacttatctctaggagagttgaaaggggggtccagaggctctttcccatctgtaaacctgcagctgcttctcccctctccagcctctggaccttgcctttctggtggtgccaggtcaggctgtcctcccaagcccctagaagccagactccctacacctagctgaggccttgctctgccggctccccctcatcttcttcccaccctgagggatcatcaagttctccgtccccgcaaggtgaggcctcacttcctgcccttttcactcctctagacggatcaacgtgggctcccggttccaggcagaaatccccttgatgagggaccgtgccctggcagctgcagatccccacaaggctgacttggtgtggcagccatgggaggacctagagagcagccgggagaagcagaggcaaggtgaggaggggcctgggggcagcaagtgagggcaggcacatgggt

SEQ ID NO: 76714 - DNA, 1195 bp, Homo sapiens
cgagtccagattttctggttattctcagctggagagttggcctgcatgcctctaataggcaggggagcgtcacagtctctgctctctgggttcttgttctctggttgaggaaaagtttgtggtagaggctggaggcctgggcagcttgttctgagacaggaaggagcctgagcagctccacagctcaatgcctctattttatagatgaggagctaggtccagaaaagacaagagactgacctaaggtcatacagccaagtaatggtagagctagccctagaatttggatctcctcaatccctgcctgtgagtacttgtactacaccaggctttggggggaggtttgtgttttgttatttgtttatttcattcattatttattattctttgtactacagatactttctttcatgcataaaagtagagaggagtataatgaatgccagtgtttagccatcacccagatttcacagttatcaaaacatagccaatcttgtttcacctgtgcctctgcttctccatgccactgggttattttgaagcacatcctgagacatcgtgtcattccatccgtgtatacttcagtttgtatctgaaatacgtcaggactctttcttctccaacattatctcaatagcattaccacacctaaaaaatgaacatgactatttttgtcagatattcagaatagtttaaatcccttattataaaattacaaatcattacagctagctgattttttgttagatttcttgtcaagaaagtttggggggcctttggctcctgcatttttttttttttctgtgcaatcatattgttttcctaagggaagaagaacgaacagtttcatttcatcccaatttgtagaagggaaaagagggcacagatgggtgaaggacatggccagagcctcagagggagtcagggccctctgctggaatgtgtttatgggagccagaaccttggcagggagacagctcattattttaaggcccactctgtcaacatggccaaccttacctgttgtactgagtacgcagagggataaactgggtgctgctcaccctgtagggctccattctctgcctttgagattataggaatcgagcaagggaaggcctctgttctcttatagtcctgctttctattctagatagaggcccatgaggcgtacctagcagggagaagtaggagg

SEQ ID NO: 76715 - DNA, 2768 bp, Homo sapiens
atgacaaagcaggcacctgggatttagtgtgccatatacagtgtgttataggggcttgtagttcagctcctgtctcagctctggggtcaggtttcccagtggaagcagtgtctgcaacctgaaggattaataggacctggcctgatgaaaagagtgagaaggtgtcctaggaaggggtacagcctggccaaagacctggaagcaaagcgagaagaacacgttggaggccctggctcaagcacagactgtcgagagaggtggcaggagccaaggtctgcagggacttgtggacagggcagggagtttagactttgtcctaagacagctcagagaactgactcgcctggagactcagtttgggcctgtcttgcccttgggtgacagacccatgatctttgactcccctcttcctagtgctgagcttgtggggcctgcccaggctataagagtgggagcttggagcattagcctccaagggcagggggccctcgggtcagctgttatccccaggtcagagctgagcccccgcagctgctgagatcaacttggcatctcctccctggtctgtgtggccttgactcacaatagtcttttttctcaaatggacacactgattgccccaagcagactggtgagtggccctggtcccacagtggccacagtctggccccttgccctgtggtgatggctctctggcttctcctggggtcagccagccagtgttgggtgtgcagctgggctgccgatggcatttggggagcagtgtgtgtttgagctgacatcccaggagagctggtgtcaccatcagcattgaacacccaaaggcctttccagcaccttcccctcatgtgtctgcaaaacatatatgtggggtcagcactgttttttatttttttttcctggtgcacactgctttcttctatagagagtaagtgctactcaccatagaacttcctgaaagcctgctaggtcccaggccttggtcttgattgttgccttgtctttggcccaggggtacctgtgggtctggtcaaggattggttgctgcagagaggagcctggaggaagggaaaagtgaatagagcgtgacagtcaaacagactgacagggcgggttgccgtgtctggggccccgtggtgactgtgggtttccttttgcagtgttcctgcatccgttgtcagaggccctgcagctggtcccagggctgagctgctggcaggagttcctcatgacatcctcttccctgcaatctcagggactaggcccacaggtcagcagcctttggaggtgtcgtccttcctcttcctcactgtgaggaagggcagtttgatttccatctgagggacagggcagcgggggtggggtagaagaaatgagaggaagtggcgcagtcctgaccccgagttgcaggctgggagaagcccatggggtctgagagctggaggcaccaccagcagcaactgagcccggggtggggttgcaggagctggagagtccaggcctagatcgggggctagagtggccagtgcaggaggaagtgtttcaggcctccctgcaggtagacctcacacatctgctgacccctctgtggtgagaccttttcctgctctcccttcctggaaggccaagggtctcagctgtatttggggagaatgggagagagtacctgccaaaggttcaggcaggggtaaggggcttcccagtgccaatgagaagggatatctgatatctgtgtctagaaaatccttgcttggaggtggtgtagagtgtgctgtggaagggaggtgtatgaagaggggtctggggtcttagtggcatatcttggggataaggaagaagagcttgatcttagagtcagacagatctgggttccagtcttggctctgcaacataatgactgtgtgaccgtaggcaacttacttagctcctctgagcctcatctagctaacctgtaaatagaggttaaaatcgcaactcctgccttataaggccatggtgggaatttaaaggatataaagcacgtaggatctgcctggcacgggtgcaccatcaccatcatcattactcctatgactacttagtgccctgctgcctaggtgtgcctcttcacccttcctcccaggctgccagtatcttccactcttctccccacccccagccgatgacctttcttctctgagggtcccaggcctgactgtctgtgcccctggcacccttagctcttcggtgagggtgacagggaggcctctgcagcaagaagtttctggggtgattcagccttccccaaaccaggccccctgatttcttcaaagcaagtccctgtctgagcttcagaggctgctgtggtatcctgaatgatggccctccttgatgtgcagggtgggagtgggaggcttcccagctgagctcagctcctccagggctgaccatacagctgtgggtaagcccctgtaagacctgcatctggcctctggcccctgccctgggcagaagcaggcttgtcctggagccgcaggccccgcctcatctccttctgagcagccatccccatggagggggcgcacccctccatcaggttcacactggcacgtgcatccaggcccacccgccacgtggaccttcccttgctccaggcctcaagcccgtgctgtggctcacaaggagacagggctgtgatgaagggaggcgtgagtgtgtgtgagcgcccactggaggggctcgcagccccctggaggcacgtgggcttgccaggctggcgcacattcttc

SEQ ID NO: 76716 - DNA, 1024 bp, Homo sapiens
gcctccagctcacctctgcagtcccccatacctcaacaccctttgggctctcttggcttccaggggcttttacagatacccccagtctggaggggaaactgtttctggctgactggggctaggataatttcttaagaggagtgttaatagaccatgctgtgcttggaaatgcccccagggaagagcagcagctccggagctggctttgtgaagttctcaagtgtagcattccttctgaggcccaccggtgtagatttcagatttttctgggagggtggtggaaagagcaaggacttggaagacacaagataaagatttgaatcttgcttctggctctgtaacagcagagcctcaacttccctctggagaatgaggacataagactcctccataggaggtttataagcatggattcgaatttgtagaggacccagcccagcgaagtactcgttagctcccttcttttgggaaggatctgtcttttggatattttgtagattggccatggaagtggaaatatttgcctgtggccatttttcctagggaaaagcagggctgcctgacaagctgttgcaatcccaaaggcctctccatcccctagttgttttgatgtcgggatcaagcttggggtcaggttcaatgtgtgtctgggagaggggatacccaggcctttgcaagtctgagctctgcggctgcctaggactgtgacaccgaaggtgtggagaacatgggctgaggagggaggggcctttctgagctgagagaacttggcaagttacttttaaccttcgtttcctgtaagtttcccaaatttccttcggttattgatttccaatttcaacccgttttgattggagaacatactttgagtgatttcagtccctttaaatttgttgagacttgtcttatggcctaatgatgatctattgtagagagtgttccttgtgctataaatatacatatatatattttatatatatattatattatataatatataaaaaagtatgtattttttattttt

SEQ ID NO: 76717 - DNA, 2920 bp, Homo sapiens
acactggagtcccttctacttcctgcagcccttcctcagcctccctctggccatcgcaccttcccctttattgctcttcttagagtgaatccaggaggtggcggctcatcctttgggcctggaagctctgccggtattatctgggaaataccctcatccccctgtatccctgtaggcaggccctgctggcatagctgagtttaaaggaggcctgtgctgggtgccctctggactttctggccagacctctctctcctgggtctgtaggccggaagctctgcgtgcctgcagagccccacactgttgctaggactttgagtctccctgtcccgcccttgcctggccagccttgctctcagccagctgtggaactggaagagttggactattcatttcctccaaggtgttaaagactgataacgatgtctgagccacccctacccagcaagggagacaggaaacacatttattgagtgcgtaccctgtgccaggcggcgcttcatctatgtattacctcattgaatcccacaataactgagatgaaactgttgtgcccattcaccaatagggaaccccaggctcacagaggctggtgattggagaagccagcacacattgcccctgactacttttaccctgcagctcccacacttcctccggctattttcatgtgcacaaggaacaatgctttgatccttggtatgaagtgctgatagtaggaattcaggcaccattagactggctggtaggggagatatcttgggctgggaagggtggggaagacctccctgctgcctccctctccagatgcttcacagggcagccaggagcccagccttgagccctgaggcccttctgtggaggactcagctgtgggcctggggactgctcggccaggcacatgcacaggaagaggggaaaggcttggtttcagcttagtgtgggcttcctggggacctcccaagtgtgtcctcccccttaaaggtatcccagcctctgaggtactgagaacagctctggggaatcaaaggctggggctaggtggaatctttggtctcccttcttggctgctgggtctgacctggggcccatcattccagctggcttggcccaggtcccagagagtctggttggtgtgtacttggggcttgggctggatgctctgctgtgcccgcatgctgtgccaaaggcctctgggtgtatttcaggaacaataaagaataaatcaacataggagaaaaggccctgcagcagctgctcagagactggagaaatgcaaagaatgtgtgagcctttggcaaaagtcttgcatcttgaccagggcctgaggaagggcgtgaggctgatgtgatggctctggagtcaaatgggcgtctgtctgtgcccagtttgcagcccttctaggaggccccaggcagccacactgagactcccctccctctgctggtggcaaatttttttgcttcctggtcgctagcatgtactagggagccatattgcccccgttctttactctcacactacactgccagacaccgacccatccaacccccaagcaccaggtgggtcttggccctttccagccctgaccagtcaggagagcctgggttgatgaagacttggtaggcttgacacacatgctacaccccctgctttacctcccccagacgaatgtcaaggacctggcaatgccaggtctaggggtgctaagtgtgagaacatctacctgggaggccgtcactatagctctgctcaggtagtcagccatgtgtccttaggcaggtcattttacctttgaggtcttggttctatgagccatgaaattgaggtttggacaaatgatctttggagtgagtgggcacctctgtctcctctactcgggatgtgcgatgaatatattttatttaggaagttaagttattgggagaagcaacactctgagagcaccatgtggagatatgggtggctgtggctgggggctaatgctcagtgtcctgagtgggggaacccaagcagagacctgatttgacccagagctcagggtgccaggagaagggacaggagcctagactccatggggacttgagttatctgacaagcaggggagagccaagactttatttatttttttgagacagagttttgctcttgtcgcccaggctggagtgcagtggtacgatcttggctcactgcaacctctgcctcctgggttcaagcgattcttctgcctcagcctcccgagtagctgggattacaggtgtgcgccacgatgcctggataattttgtatttttagtagagacagagtttctccatgttggtcaggctggtctcataaactcctgacctcaggtggtccagctgctttggcctcccaaagtgttgggattacaaacgggagccgctgcatccggcctggctttatttttaaagagctgttggctaacctcagttgtggggttggagggtgtggaaggggtgtgacttcctcttaggcaaagatgccgagccctccacaggttggcccactggaggtaatcacctgtagcctcttcaccttcaaagccactcacctgcccggcctctcccacccactttacccgaccagccacatctcagaacatcatggtggttttcaggggctgaagctgctctccagggagcagacgtgagcaacccagaggctgctgctgtctatcccaggcagcctggtgtgacctccaagtctgaaactcttgggggaggaagtttgcagaacaggcaggcctaggtgccagtcctggctttgcctctatactgctgtgaccttaggcaagtgatttgacctaaggtcttctcagatttcttgtttagaaaggaggagtaataatacctaccttgatggcctggtgtggtggctcacgcctgtaatctcagcactt

SEQ ID NO: 76718 - DNA, 2147 bp, Homo sapiens
ctggagtgcagtagtgcgatctcaggtcgctgcaatctcagcctcctgggctcaagcaatcttcccacctcagcctcccaagtagctgggactacgggtacacatcaccacacctggctaatttttctatttttgtagatatggggttttgccatgttgcccaggctggtcttgaactcttgggctcaagaaatccacccactttggcctcccaaagtgctgggattacagtcttgaactacctcacctggtcttagtgcatgttagttgaacaaattagtgaaagatctccatcaaaaaaaatgtgtacttgtcatgtgttgggcccagtgagtccctgctcctggaacctcctcagattgcatcactggtttcaaaaatgtcagtccaccgtgggtgattctggggctggtgaacccagtttcctggcactgccctgtagctggccttgtggagtgcatgtgtcggtcatcctgaccctaaggggacctcagggtgaaagagttgtggagccatctccctagggatctgctagcctgggcacttcctttggtcagcccagattggcacccttcctgtgtgtgtgcaggcgtgcatgcatcagtacagaagcagcctggggctccattcttccctgactcactgcaggtggcaggaagcagagccagtggccgcattctgttggaggaattgcttctttctgcacatgagaactcttgactctgggactgaaaaattgcatgctgggccggggctagggtggagtaggctgaaatccccaattcttactaagggacctgcatttgcattcgaagcaacattcaggatactgtgagactatgagctcattttatgaatcagaagcattacagcataactttaatgttggaaactgcaatttggaatccagatcaccctccctccacctcagcgcgcacgcgcgcgcgcacacacacacacacacacacacacacactgacatgggctctcgcagtcacacacttgggagcaataatagttggagcatcagttcagattctggaggcctccagcaaaattcatccacaccgacttctgcttccacactcagaacgccgttcctggatggtgtgtggacagtcacttgggcagtgactgaaggaagtctgatgggtgcgtgggaatgaggcctgggcagacctgagttcataccccagcatctcctcttgctgtgtggctttgggcattgcttaacttcttgggcctcagttgcctcacctgtaaaatgtggatgatactagtacttcataggctgtgaagattagacaggattatgcatgcagagtgaatgacacatactaggtattcaacagatggcaactctcatttcaccagttcccactggatccagtgtgtttgcctttgactcctatcaaggaagagaaaatgaagggtgtcctgtttatagtaggaaagcaatctaccaggccactgaagcttgtataaatgaagtttattgtgccctgggaacaacagcttgatccactccaccctagacatgtggcccagacccagtgtctgtgtgcctttgagagggactgtggccctgcagccgagggttgagggcccagcttcccagagatcagattgtgctctcaggaacctacccgcccaggccccaggctgagctgctcacgtgggtgggcaggaggaaggctgctttctcagccaaggaaaaaaagtcccctgtttgcttcacctgaagcctcgcagtgtgacctcgcaggaggtttgggtagagccaagggtgggagtttttccttaaagactgctttggctcttttacccattaaaattatgtgcaacggtgaaggaaacaccaagaattatataagaagaaagttgccactgtcagaggagagccggagttgtgctggggtggggctgggggtctccctgagggctgcagttgctggctgtcattctcggctggtggggaagagctggtggggaagagccggggcttggggctgaggcttccctggcagccgcccttgctgttgctcttcctggaacacagcctcgtgctgtggccagccagggaaggtgctccctgttccctctgcctttctcccagccgcagggagctttcgtggtgagagcatttt

SEQ ID NO: 76719 - DNA, 1290 bp, Homo sapiens
ctgctcctcctccgctggagagaaacgtggtgtccgtggggaccggctgacgtgacggagcccaggcccggaaggcgcggcgaggggctagccagctgagggaacttggcgcgggagccccttcccctgccagcgtgcacgggaaagtgggcctggacgcggcgtccacgccaggagtttgggggacagaggtgcaggggcgttggggaactggggcaaatgcagtcagcagaggcctaggctggagcgcttcgcgcgggcgggcgcacctcagacctgtcatcctcccgcgcgcccccgcacgcccgcgccgccgcagccctcccagcccgcgcggtgcctcgcggggagctgtgttccctggtgcctggcggcagcgccgaaacccgggattcggccgggccctgcatatggccggcttggtggagctggtcacgtcgcctcccaagtcgcacatgcaggaccatgtgtgtcaggttgcccccaaggcctctgggtaaaggtctaggggaggaaggggaacttcgtgtgccctggggccttcaggcttcagccccaaggcgggccgacatggaggaggtacctgccacagaaagtggaggccgggtgtccgtcccagcccagcctccagcgagagctggtgagaagatgaaaggggaagttatatgccccatttaaaactttgttggtcacaactacggtggctgcttcctgtttccaccatcccacgtgggacctgtgtgccagcctgtggagcctcgcgcggggggcggtgggatgggggaagagaggctggccacggaggccccggtggcccgcgtatgcaggggatccctgttggcagctgcggctgggggagggaggggatgtctggcttgctccagcagggggagcctggccaggtgatctgggatcttcttgttcctgtagcttcagggttgagactgaaggcctagtgaaggtggaccgagaagccagtcctccctagggggcctcagctgaggggagaaaccacctgtcttgctctagagcctcccaccaaaggtgtggcacacgccccttttggatcagagaaatgcaccctttccttgggtgttaagtggcttcagaacccagggaaaaggagaagccttcccgggttgagaattcgtaggtcttccttttccaactgctctggacagtgaataataggagcgtaaacattcaattactgtgataaaccatctcgttgcatggccctggtccagtctccactctaattggattggcctctggctggttactctggtc

SEQ ID NO: 76720 - DNA, 1032 bp, Homo sapiens
attttcctcacctaagcgatggagatggtgggtcctttctagggactgaggccagtttctcaataacctttacacgcaccaggacgcttttgagccagaaagtgaaactcggagagtctgttaataaaatgccatggagaggattgtgcatgatttaccgtatccaaaaccagagagagtttctttgtggaagaaagcgacttgtgccttccccagcatcacacacacactttcctggcaggctcaatgggtttccaaacatttcgtcaccgtctcctcctgaccttggtgtgaaaggaactagcagcgtggcccgccagcaaagccatcgggggcgccagcctgggcgggggatggggacggcgaccgactcgtgagtggaggtgaggtctgctggaaatccccagccccggccgccgcctgaggtttaaggacgccttccccggccttatttggtcgcaggaagtgggcggcgccgggcctgctggctgaggccgccccgagacagttgtgctgatgaagtggtagagctggttcctgctcgccgcggtgccgcgcgcgccggccggccgctgggcgctccgcgctcccagcctcgagttgtgcaatcctttgtagcacgccagagtcctcctcctccgctgttgcctctcgccctctctctttttttttttttcaagctgtgagctcaaccgatgagtcagagccgtgcaatcctgacactgcatcgcaggactgggggtgacacggagggaggcagagcgctcgcgaggcggacggcacgggtgcggggcgcgccgaggctcctgcatcgcaagcggggggtgacagcccgcgcgtcccgcccgggccctgccagcaaacttctcagcctcgggaggcgcgggctggcggaagccccgcgagcgccgcggggaggcgacggcgcctgtttgtttttaaaatcgggagtgcgtgcaggcggctggagtcccggaggcgaccgaaggcggcgacccgcggcggaagggggacagccgagcccggagcccg

SEQ ID NO: 76721 - DNA, 1282 bp, Homo sapiens
gagtagctgggaccacaggcatgtgccaccacacctggctaatttttgtatttttttgtagagactgggttttgccacgttgcctaggctggtctctaaactcctgcgctcaagcactcctcctgcctcagccttctaaagttctggggttacaggtgtgaaccactgtgcctggcctcatccttggaagattttaatggtctagatactgctgatgaaacacagggcagtgacagaccgctctgagtggagtccagagagctgatgtggccctaggaagcctctcaaatttgccatattctacctttattgggaatcagagtttaggattctgtctagggtgctttatttcctggagtgtttctctcttgtcacactccctggtaactggagctctgtactcctttttcgtgcagtttgtaaagagggttgagggtggagaaaatccaactctgtggataaggtctctggaacacctccccatttccctgaaaggtcaaccttcttggttgccccagagacttgtagcaggggctggagcttctaaaaccaaaactttcacttcacacgtcagtgattctgcaccgtcatatctgcagcaaaactgacctccagggctttcccggaagcgctgcagctttctttacatagcctcatctgcccgcctttttgaggtagacttctcctgccaagggggggctatttggtatagtcttgagccctcctcccctgcacacatgtgtgccccttttcttctctctcctttcttaggtggcctgaatttggaagtttagctgtagtgaagggcggtgccgctccaaggtgagcaaggctccttcagggccactgacttctctgtttcccctgccacctgcctccactatgtatgctgcttcctgggccactcctttggagtggctttcacctgttccctgaaggctgggccctggctccatgatggcaggctcttctagcaatgtgcttcccagtcaggttttctggttggttgggaacatccctgggctggtctgcacaagctcttaggggctcactctgggctggcctaaggccaactgcaggggctgggctctcaggggaggtgaggatggccacaggtctgcagaggaacttggcagcagtgggcactggagaccaaatggctttgcttttgcttccctcacttggatgtgttgtcagtgggagggaagaaatcaggcaaatgaaaaaagtaaaaaggctctaccctgatcctttgccaggagccctgagagtctggcctctg

SEQ ID NO: 76722 - DNA, 1518 bp, Homo sapiens
cagctctcggtctgtgaagaaagggcgtttcagtcctgtggctctgctggcctgccctccctggcagccacacctgttttgtccttctccctacacccggccagacgtctctcccagagtgacagcagcaactggggacatgtacagaggctccttctcaggcctgacaaaggcactcagaacctggcccaggcctgcagggcagggaggctggggagggggcaggtgggagggccagggacacagacagctgtgggctggtgtggcaagcatggccctgccccagaacaggtgaagtcaatgtgagcggaggaggagggtcccctggggttttttccaaggataaaagagaagacagtgcagagacatctcagcacacagtggcttaacttcatgactggggtggttgtgagctcgcggtttgctcagaaaagacctggcaaaaagggctgagaagacacagctggtggaggggtgttcctactcaggctgggaggacagccctgtggaaaagtgtggtggaaaggacacaaagaacaggctgggagagaagcgttggaggacacccctgatgagacattgagtcaatgccagaaaaagtctctctaggcagtgcccatgagagggttacctgaggcccatggggtcttttcagggaaaagaactaggtggtttttttttgttttgttttgttttttttttttttttttttttttgagacagggtctccctctgttgcccaggctagagtacagtggggcaatctgggctcactgcaacctccatcacctgggttcaagcaattctcatgtctcagcctcccgagtagctgggactacagacgtgcgccatcacacctggctaacttttgtatttttggtggagacagggttttaccatgttagccaggctggtctcgaactcctggactcagatgatccgcccgctttggcctcccaaagtgctaggattacaggcgtgagccatgacgctggggctggaactaggttcttaagaagggataacctaggttggggaggagatacagggtaaaacagtaaaaataattaattgtagcctcttatatgtacatagcatgattgagttataaagcagttttttgtccttttgatcctctcaagcccctggaaggtgggcatcctttcgttgttcatgcaatgaacacttaaacagtgcatctgttatgggcctaaaaagtgaggttcagggaaggtcagtgacagttttcctaagtccctgtgttttctacacccttcttttttttctgttgtaattgtaggtaatgaggtcctggaggttgtactttagttctctagagggaaacgacaatagggacacaagaacacaagggacatagggacctggctggcattgtggacttgggatgccctcaacaatatttgtactcccagttccccaggctctggtaaaggttggttgtttacttaaacacaccacgtgtgctggcctcattgggggaggaacagtgggaaaagg

SEQ ID NO: 76723 - DNA, 1352 bp, Homo sapiens
tttgagacaggctttctctctgtcacccaggctagagtgctgagtgcggcggtgtgatctcgtctcactgcaacctctgcctcctgggctcaagcgattctccccactcagccccccaagtagctgggactacaggcacacaccaccatgcccggctaatttttgtattttttgtggagatgggggtttcaccatgtggcccaggctggtcttgaagtcctgagctcaagcaatccacccaccttggcctcccagagtgttgggattacaggcgtgagccactgtgccaggccaatgtcaggcatttagtagctgcctcacagatgtgagaaaaatcctgtgtaggtcatccagaaaattagaggaagaaataggcttagaacttttctctcatgactcccagtgcagagcttgttccacattacatgggcctactttcatgggagtttccagaggtgtctggacacaggggtccttcttaactctgggaaattgtaggttattttatgagagcctttttccccccacccttgagacagagtttccttctgttgctcaggctggagtgcagtggtgcagtcatagctcactgcagcctcaaactcctgggctcaagcaatcctcccacctcagcctcccaagtagctgggactagaagtgcataccaccacacctggctaattttctttatttttttttcgagacaggtcttgccgtgttgcccaggctggtctcaaactcctggcatcaagcacaatcctcctgccttagcctcccaaagcgctgggattataggcatgagccaccatgcccagcccctatgacagcttgtttgcccaacagctactgagctcagataatgggcatcatagctctgtgggctttgcagtgcaggcctcagaatttaggagactgagcctcaatagttattgataatactaataccatacaccactgaacctaagaagccattgattagaagatgtagtgttattttatatacagctaagaaagaggccaggagtggtggctcacgcctgtaatccctgcactttgggaggctgaggccagcggatcacttgaggtcaggagtttgcgaccagcctagccaacataacgaaaccccatctctactaaaaatacaaaaattagctgggtgtggtggcgaggcctgtaatcccagctacttgggaggctgaggcagaagaatcacttgaacccagaagtcggaggttgcagtgagctgagatcatgacgctgcactccagcctgggtgacagagtgagactccatctcaaaaaaaaaaaaaaaaaaaaaatggccgggcagtggcacacgcctgtaaacccagc

SEQ ID NO: 76724 - DNA, 1508 bp, Homo sapiens
gtctttatcagctaccggcactgcatgcaggggctggaggattcagatgggcctgacttcatagactggctgagtaactcgggttcacagcgtggactctgcctccagcccccagctggctcagggccccagacgattttcacacctgcgttttcatggaaccagcccagtgagcacgtgaggctttgagccacccgcccactcacctctgggctgcctcttacttcaggcccctgccacagcaggaggaagctgagtctttcttctgcagttccaactggcagcagggagggtgtgctttgctaattgacctcctgcagccttttctaacccaggtggggccctagtgaggtagcgtcttgctcacttacattgttgcacatattaattgaagtgttgaatttagttgctctttaatgctagccacatccatccagttcacatctgacctagcaggcagggccgtctgaccccacgtcttgccgtgagatctgctgggacgcgcagctgcaggtttgggtgtggcgctgagcagctgactgtcttctgagcaccttctcatatctctgtggcatctcagaatctctggacatctggtgaatggccttctcacccaccactcccctcgtgtgtagtagccttttcttctgagtggagagccttattttcttaacacgtggagtgtctatttggagggtccatgatcatcccgttgctgtgaccagcccaggaatgtgaccagggcaggacagggagactccttggtgttgtgcagagtccccaggtgggtggcagctggagagcccccggcgtaccttgagttcgcaggttggagcctgctgaagctctgcccgacagaatgcgtgtggagggaggcccagacccagctggggccctggttatctccagtgtatatttgctaaaaccaaatttcagaactgtcaaagactggagtttgttcttctgtgatcagattgaagtaggaccttgtggctggaggtgtgccagggtcagagagaaaatggagagtatgggctcagggcacgcctggatgctcattaggggtactcaggccagcttcatgtgttccatggcaagtgatggctgtgtgtgtgtgtgtttggaggtggggctggtgactgtctctgtgcttttctagaatatcgtgtttattcctagatgccccaacctcatcttcacgccctacagtggcattgagcctggttctgatcattgctggtcatgtgaatattaagtgccatagtgtctaaggaacaagctgccttctcgagcccaggccccagcaataactgttcctctcagttccctaatttagagaccacgtgtgtgccccagggttgtcagcagctcggttttttgaagcttgaaacacatttccatagaaacaatgctataaatggtggttgggtacctaggctagcccacaaagagccctggtgtcacctcagaagttgctgaaataaggtattagtgaaattgagagccca

SEQ ID NO: 76725 - DNA, 1056 bp, Homo sapiens
actgtgtgcttggtgagctggctgtctgcatgacatccccagcctcccttagtgcttgctggtggggctgccaccttggtgtctctgctatttgcttgggcctgtcagcaagaccctggtgagagtaggaaggggatttgggggtataaaacctgtatcggggccccactcaccctgaggaagcctttgaggggacactgaggagatgtctgtggtgaggagctggtttagaggtggcagaagcatctcttcctactggccctccttgaagaaggataaatattaataccagctgccattagaggatcctttcgtttctcatgctcagcactgtcttttggcttcacacagagacagagctggggaaagcaagtctgcagaccatagtagcagagactggggctctttaaaatgaaagtcctgtcccacctggtcatgaggcagtcaggacaggctgtggcacttcctgttcctgcgaggaagaatgcatcctcctgacagtaattgcagggtgcagtgggagccccaaagcagggattgcagtctccgtttgtctatgaaatgaggggattagactacaggggtacctttcctgttcgaaaattcctgtgaatggagcctggcaggcggtgtctttatggtgcctcatagtgggacccagggttgtcactcagaggcttcctgtcattatcccaggtctgcgtgccactcagagagacctgtggaggagtggctttctcgccatggctgattagttggacttgcttttcttttttctttttttttttttttttgagattcagtctcaccctgtcacctaggctggagtgcagtggtgtgatatcagctcactgcagcctctgcctcccaggttcaagtgattgtcctgcttcagcctcctaagtagctgggactacaggcgcccaccaccatgcccagctcatttttgtatttcagtagagacagggttttaccatattggccaggctggtctcgaactcgtgacctcaagtgatccacccgcctcagcctcccaaagtgctgagattacaggcg

SEQ ID NO: 76726 - DNA, 1115 bp, Homo sapiens
ctcggcctcccaaagtgcaggggttacaggcgtgagcctgaggctgatgttacggttctgaagagcaaggctctggaggctgcagcctccccagcagagtggaactctgcctcctctcaggactcacaaccacaggtgcctgaaaccaggggagggctgcatatgccaggtggacaggtgtctctcatagagcttggagcccattctagccttcaaactgggatgatggggctgttctggatgtgggaagaggagacagggcatccctcttgggccactgaaaacatccacatcttttttttttttttttttgtaatttaaacagagatggggttttgccatgttgcccaggctggtcttgaattcccgggcttaagccagcctcccaccctggcctcccaaaatgttgggatgacaggcatgagccaccatacctggccaacatccacatcttgagcttaatctgtttggacatccttctgaatccttagcctcccgctgagctttaggaatgttatgtgcccagaagatctgagtgtttcattagtaattggaattctcctctggaatctgaccatcccagtggaaaagggagatcatcccggcatctggatcctccctgcacatttgattccacttggaaaactttggtgctgcctttcgaggacagaggccgagggttggctctctccaacaggcagttacagcttgaattctgcttcttccccaaggttgggtgagactcttggggccacagggtgtttgcgaggtgccactttgcttttcagactagaagttggagttctggtttcaggcttggtttgtggaacagttgaggcgcctggtgtctaagctgcccaggtgatctctccagttctaaagatgtcaccctggttgagatgttctaccctatctcctttctgagagcgctaaaggagctacagctttgtttgcctggggctgtcagcatcacctgtcacatcctgcccagtttcctcatccagaaaaaacaagaggtgtcagataaggtgagctccagctcccgtcttgccctcagatcttctgggtataactctttgaagcaagggcaccttgactggaatcttggtcattca

SEQ ID NO: 76727 - DNA, 1023 bp, Homo sapiens
agctgggactacaggcacccgccaccacacccggctaattttttaattgttttatttttagtagacacagggtttcaccatgttggccaggctggtctcgaactcctaacctcaagtactccacctgcctcagcctcccaaagagctgggattacaggcatgcgccaaccatgcccggctatttcttcttgttctattttgtttttttgtttgtttgttttccttttcctcctacctccctaacttcctccttcctcctgtcttcctttgtcttctgtcttctgctaagcttgaccatttgaatttgcataagttaaatgaacatgtgaacagattccattgtcctgtgtctcatgagaaggtcatgggtgctgtaagttaggaaatcatcatatgagattaagcatgaaaggctcttagactaaatgggcagagtgcgatggagaggagatccatggagtaggttttaaactgcagttatatcatccaggattgcagatgaaaaacttgtgcttgggttgacccagccctggtgtggggctgggagagggcagtgcccatgtgcagcagacactttacagtaagggcctagccctccatgtcccctcctcagcctccccattgcaggccactataagaagcttgcaaggaatcgaccagcaagatgtgtctgcttcctctgtggcctccccatagcacatgctctggaacaacttagaagccaatagccactcggtgaccccctcttccacttgcactagaggtggtggaaaggctcaacaagatttcttctaccatctctccaaggaggctgtgctgacacgtggcatttaggatctgacttctccagttatggaggaaaagaaaagtagctgtaaccacaacagtcgtgaccttccccatcacgttttttttttttttgagacagagtctcgctctgtcgcccaggctggagtgcagtggcgcaatctcagctcactgcaacctccgcctcccaggttcaagtgattctcctgttctcct

SEQ ID NO: 76728 - DNA, 1045 bp, Homo sapiens
acctcccatgcttccccagaggactggaatgcctctttcctctcatccgcttggctcagtcctgctccccttccagtcctgtttgtgtcctcctccttgagaatttctccctgtcccaccctgtgggcctcccccgggactccagcaacatcaccctgggccctgtgctgaggaaaaccttgagtcctggtctaagaattttcactttctcttttgggccatgactttgatcatatcccctgttcagcaaattaaatgagcctttgggtgaataaatactacaattcttcaactaaactggaagccctgttttatatatctttgtatccccaggtctggtgccccactcatagcaagtctcaataaatgttttgtgatgctgatacaaagagcagtggccatcagatttcgtccacttggacacccaagccaagcaccaaaggccgtggttcctggtctcaattctgagcattaagccaagcctgcctcctctgcctgttagctgccctcaggctcctcctggctttgcacctcattgttttgctccatttccagcatctctttcctgactgtcagtatcttcccagctttggccctggctccttttgtcccagtcagcctgccctgtgatgccctacacctctgctctggctctgaggtgagatagtttgttacttgggttggcctgaccttctgaggaaccaatctgatagaaggaggtaggaccaacttgcaggcaagacttgtgaagacagccaggtgcggtggcttatgccaataatcccagcactttgggaggctgaggcggaaggatcacttgagcctagaagttcaagaccagcctaggcaatgtggcaagaccccttctctgtaaaaaaatgcaaaaaattagtcaggcacggtggcacgtgcctgtagtcccagttacttgggaggctgaggtaggaggattgcatgccactgcactccagcttgggtgacagagattctctctctctcttcatatatctatatatatatatagactgtgaggagggcaaagtga

SEQ ID NO: 76729 - DNA, 1011 bp, Homo sapiens
actactgtcatgtggactctttgaaatgttttgcttttaaaaataagtcttcatgttggaaggttgcaaacccttaacatcgtcccaacactgctttccaaagtggagaaatggaggcccgaggggtgaagtgactatgcaagtccacacagttggtttagtagcaggactgggcctcgtgtcgcagttctcaatgttgcctcattgctgtgctgccagcagccagctcaggaacaggcccagccctccagccccacagccacctccttctcaaagcaggtcttgacaggaacccaaagctgctctggaatactggcctgtggctgctgctgctgctttcctcacctttatcttctgggatgggaagtcctgagtggctttctctctgccttctagctcctccctggagacaggaagaaaaaaaaaaagaacaaggctgacaacaacccctgcactgggagcgctctccttcctgatggtgctgggcctgggaggacctcgcctaatagactctgacctctgctaggctccactcagcctcctctcagagctgctcacctcctgccctcacctttgacttgctccagatcctacaaaccagagttcctggtcctgccttcctgccctagttcccggtcccatgctttggttacatcctgacatgggctgtgtgtgcccagcaccggaactgcctgtctccttgcctggccagcccgatctggagccagccactcctcaggaagttccggaaacagggctcataccctaccttccctggcatcctcagcaccccacaggcctggccctgcaaaccctcgttgaaaggaggaatgacctgttctgtgtgagtgctgcccatgcctcatcatgacaaattagagcaaagggaggtggaggtgctgagagggcatttctaccaaactatgagcgacttctcttatacactacctggggggatgtctgtcttgtgttgagaccagttatttagatctgaaatcaaaatgtcataaa

SEQ ID NO: 76730 - DNA, 1024 bp, Homo sapiens
tgtgaactcactggtcaaggctgcaagatttgctctttgggtcaaggcagtaggggcggccacaaggaaccaatctcagttaagttattaatgcactttgcccagactagtaactctcccctgacgttccgcatttcccttgcttctcccggaaacgtggggcgcccaggaatcctaaacttccaatccctaagcttccaaaccccgcccctgggaggggagggggcgcggagccgggcctagtcgcgcgcctgcgtactgcggtcagagggccgaggcctgggggcgagctggggtcgtgcagtacagcctctttccggcaaatcacgcgagatttcgttcacccgggctccacagggtcagtgacgcgcgagcggctcccgcgactgtggctcccgaagctgcttcgggccccagcggtgaggaagaagactctcaaccagggtgacttctaggcgtcctcccggagctaccggggacactggcgttattgcccgcaacactgagatagggaatgctcgagaaacagaagcaggttttggggttttttttgaattactgggggaaagcaacctgaggttttgacgtaattgtgtttgaggtgcctctgaaactttcatttaacacagatttgttgagcacgtaccatgcgccgggcataggggattggactcacatttttttgtgtgtgtgacggagtctcgctctgtctgtcgcccaggttggagtgcagtggcgcgatctcggctcactgcagcctccatctctcgggttcaagcgattctcctgcctcagcctcccgagtagctgggattactactgcgcccggataattttttgtatttttggtagagacgagatttcaccgtgttagccaggatggtcttgatctcctgacctcgtgatctgcctgcctcggcctctcagagtgctgggattacaggcgtgagccatcgcgcccggcctggattcacatcattgaacaaagcagacgagtccttatcctcttagcgctgacgagctg

SEQ ID NO: 76731 - DNA, 1051 bp, Homo sapiens
tggtggcaggcgcctgtcgtcccatctactcgggaggctgaggcaggagaatggcgtgaacccaggaggcagagcttgcagtcagcagagatcacaccactgcactccagactgggcaacagagcgagactccgtctttaaaataaataaataaataaacaaacattttgccccacttaatcttcaatgaacttgttcctattagttaaaaattctaactagatttagtctttcttcatatatttgctttaggaggcaaactctgacaggcgagtttatctttttggatcctaaatgtgatttttctccctcttcattgggaaacacaaatggacttcttttttatttttaaattgttgaatacttcaaatcttgtgatttaaaaatttttttatttataggagtattttatacagaaatcttgtgaaaccactgcccaaccagagcaatgattgttcaaagagtggtattgaattctcgacctggtatgtatttgcgatgaatgaacaactctgatctttgataagtattaatgcaaatggaggaataaaaactaatgtgatgttcatgtggtaaattaaggtagtaagatattgacactagtaaagatattagaagaaactctttaaacgatgtaataattttcaagtgttagcttatcaagaccatttttaaacagtgtgctagtttttcaagtgataacttatccaggcatttgttgatgaaataaggtattttggaatcataatgtctgaaaggttacattacaaatatatgtggcttttgtttctttagagtatgttattattggtccttaaaatttgcttttcttttttatgtgaaatgtactaacatatcagtgctgacatgtaaactgcatcataaaaacagatatggaaagaacctgagagatttgggtcactgctgcccacttgaggaagtcacttaacttttctgaactcaattttagtaaaatgagcagttagattaagatctttatgtactattcccaccttataaatttaacaattctatgaagagtaaatttgca

SEQ ID NO: 76732 - DNA, 1784 bp, Homo sapiens
ttaggtatattaaatgcattttttgcttaggatattttcaactaatgatggttttattgggacatatccctatcataagttgaggaacataagtctacctttgttcaattttaataatttttttttaggatgacattgtctgccctcagttcttttagtttcaaattacttttcattaaaagcagcgtaatctaaccttaattgtaatgaacactgtcatatacctgtaatatcttgtatactggtacatttttacatttaaatgtgacaatataaagccatttaatcttcaaatttcccccctagattggccatttcttaggttgttccagagtggtgggaatttgtggaacacatgagaaatgcatcctcttgacctcagaactgggctttgatgctgcaattaattataaaaaagacaatgtggcagaacagctccgtgaatcatgcccagctggagtggatgtttattttgacaatgttggtggtaacatcagtgatacagtgataagtcaggttgtttgctgatttctataacaaatttgaatactgcactttatatgttgtgatatctttttacctaatactgagaaaaaaatttataaaattggagggattattgtgacttaatgtgatgatcagtattgtatttaagtgatacaaaagagcttgctgatacctacttccatttacttgcagatttgtactatgaacttcaatttcagttatttgctaccaatattatatttttcacttttggtttatttttgtgaaaaattacagttgcattgttgaaatgctgaagcactgatccctaactcaccactgaccaactcacagccatggccccagacctatgggtttcataggctgcatgtatttatgcatatttactaacaatattataaaatatcaacatgaggtattaacactacatagtcctttgctgcatctaaaattatttgcagttgagattattaaattgtttaaatccaaaaaaatacagttctaccactaataagtagcaacaacaactaatgtaattcttttgctgattaccaaccatttatttgccttggtgttcctttggaatgtaattatttctagctagttaaaattcttaaatacctctaacaggtaaattaaaaaaaaaatcgaactagttgacagaaaggattaaatagtcaaggaggcttccattatggcagccataaaatcagtaaacataggaaagggatattttatcattatttttctctgtgcagatgaatgagaacagccacatcatcctgtgtggtcaaatttctcagtacaacaaagatgtgccttatcctcccccgctatcccctgctatagaggcaatccagaaagaaagaaacatcacaaggtgtgttcttcctctttgcccttattaccaggttcatggggttttaaatatcatagatgtgtatgaaatctattgttcttcatagacactttttctttattaaataaaactttaggtcgggcatagtggcttatgcctgtaatcctagcactttgggatgccgagacgggtggattgcttgaggccaggagttcaaaactagcctggccaacatggtgaaaccccttctctactaaaaatacaaaaaaattagccgggtgtagtgatgggcgcctgtaatcccagctacttgggaggctgaggcaggagaatcacttgaacctgggaggtggaggttgcagtgagccaaaatcatgccactgcactccatccagcctgggcaatgaaaacgaaactc

SEQ ID NO: 76733 - DNA, 1770 bp, Homo sapiens
tgtagtgtcattcattcattatacaaatatttagtacctaccagttgcttactgggaagcttgtatggaagccctttaagctcatagtaaacacattagaagtgggaagtgaccgttaatgggcacagggtttccttgtgaggtgatgaaatattgtaaaattgatcgtggttctgcttgtacaactctgaatgaactaaagatattttaattgtactctttaaatgagtcaatagtatggtatgtgaacgatatcttagtgaaactaatttttaaaaaagatttacattgcagttttggaaatctgttgagtaaggaattgggaataggaatgtttaattgtgtatttgccgttacacctatagctaatgtacatagtacgttgctctgttaaagatgagatccccacagtacacttgataagatactgagtgctctagtacaaattcttttgagttcagttgcatatcttaatgcatcctgctattttttattttattcataccgtacacatacaaatcataaacttggacacaaaaattgtatggtagtacttagttataatatgaatacccagtgcttgagaaaatgctcgtgttaatttttaaagattattgaagtgaaaacactgaaataaaaagatgtcatagataacataaaaaggacagtaaatagttgtctggttcctcagagattttacaatcctggaatctcaaagttggaggaaccttaaggatgacttaaacaacaaacatctgataatttcttggcttgttaagacaagctggaattggggaagaggaattcttgttttttttgagacagcctccatttgttacccaggctggagtgcagtggcgtgatcactgttcagtgcagcctcgatctcctgggctaaagcaatcctcctactcagcctccctagtagctaggaccacaggcatgtgccaccatgtgatgctaattgaaaaatttttttttgtagaaatagagtctcactggctgagatcgcgccactgcactccagcctgcgtgacagagcgagactcagtctcaaaaaaaaaaaaaaaaaaaaaagaaatagggtctcactgtgttgcctaggctgagaaaaggaattcttaggccatggagattcagggtcaaacctagagagatgtaatcactattcacgccaatgatttctgcatacttctggtgtgggtgggagtcctggctttgcaacttaataacttggtaattaagtaatatactgagccttggttccttcctctctaaatagagggatggataaaccatatgaaactgttgcagtgcttgaataagaaaaatatgtgtggaagaaaagtcagggatttatgatactttatgtgggaaacttggaaggagcatttccatttatatcttgtaaatggttagttttttttttttttttctcgacacagagtcttgctctgtcgcccgggctggagtacagtggagcgatctcggctcactgcaatctccatctcctaggtccaagcgattcccctacctcagcctcctgagtagctgggtctgcaggcacatgccaccacacctagctaattttttgtattttagttgagacggagttgcaccatgttggccaggatggtctcaatctcctgaccttgtgttccgcctgcctcggcctcccaaaatgctgggattacaggcgtgagccactgctcccggcctaaatggttacttttttacaatgaaaaatgaggatttcaggtagcttagaaa

SEQ ID NO: 76734 - DNA, 1041 bp, Homo sapiens
ctatcaaagtgctgggattacagttgtaagccaccacacccaacccttcacagcatattttgaagtgacagtgccatatttaatcaaccattccctaattgggggtgtgtgtgtgtgtatacattgcttccagttgtttattacataggataagacggacatctttggacatagctctatccatatttaagatagttttttagattattagaggttgaaatactgcatcaaagcgtagtatttttatgggttttgatgcctgttgagcttgttgtattttaaaagaagtgtttcggtttgaattctttatttgcttgcttgttgtgattttttttgtatatgtaaagaagtgtctttatgtacctgtgttttcccactgctcttaatgccccctctctcttttttacccctattctaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagaggtgagcccagtcagcttgtttccttttcttttggtgggctatatttcaaagtttatcttcagtttagggggtcagcaaactttttctttaatgggccagataataaatattttaggttttttaagctatatggttttgattgttactattttttcaaagatttaaaaattatattttttgtgattgtttttatatctgtttttcagtatatgtgaaatcatacatttagataatgtaataaaatcttataaataaaaatatatgtttatgtataaatatatacataaatatgagatacatgtgatgtataggtgtataagtatataaatatttactactacaaattcttttgtttattttatatatatctgtaagtattttctttctaaatgtgattggggatttaaacattttttgttgttcacttttcttactttaaat

SEQ ID NO: 76735 - DNA, 1123 bp, Homo sapiens
ttctagcttgttgcaagatctacagccaagtgatagcacttcttttattcttcttaacctaacaagagcaggtattctttccttttttttgggctctgcttatgcctaagaaaaaaattaggggtggggcatatttaacttagtcatacttaaaatagaaagaacctttattattttattattttggagaattggtgtgtctggtgaccatttgaatatgtagagggagagggaggactctagtatgactcatatcttgtttgggaaattatgtagtgccatttactgagatcgcacaggaagagcaaggcttgggggaggatgattagttccaatttgcacctatttatgttgagattttggaggtatattcaggaggacatgtcctttagagagttagaaacatgaatccagagttctagaaaggtctgttttggtgcttatcagcattcaggaaacgtatgaaacaatgaacatggattctagagaagtctcaagcataaacagaaaagaaggcaagtctgggaccctgggaaaaaacatttaagaggacaacagaacaggaaggagcagctggaaggggatgaagagaactgggagagagtggtagcagggaagccaagggaggaagaagttttaaggcagaaaagatactaaatcatgccaaatactacatgatgggcttattagtgagaagaagtgtgtgtctggtgaccctagcaagagcaattgttactgtggtagctgaggtagaggccagggttaaagagatggggagtggatgggaggtaagacaatagatacacaagttagaaggtacacttgttcaagaagcttgactttaaaggaacagggaagaaggtaaatagctagagaagtacttggggttttctaattctttttaaaaataagggtgagagacttgagttaggacatatttaaagacataaggaaatgctggccgatagagaggaactagttgcagataggagagaggagataacacaagtatatatggggggataattgaagaatgagaatgaaatacagtaggtggggattagtctggttgaccaagaaagacagctttgccttgaaaccagaggaggcaaggtaatgacaa

SEQ ID NO: 76736 - DNA, 1039 bp, Homo sapiens
atctcactttgtcacccagggtggagtacagtggcgccatcatagctcactgcagcctcgaactcctgtgctcaagtcatcttcctacctcagcctcacttgggattacaggcttgcaccaccacacctggctaattaaaaaaacattttttaaagacagggtctcgctatgttgcccaagctgatctcaaactcctgggctcaagtaatcttcctgcctcagcctccagagtagctgggattacaggcgtgagccaccacccagctatagttttaacaaagtcttcagttgattctgatatatccagtttttggacttactgtttgccttgagagtcaataggggctttgacttgtcatctctagcaaagagtgttttcagatatttttccttatgtgattatttttgcagaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggtgtgtgcagcaccaacattcctttgggcagtctgctccttggctctgcatgtttgcctctccttaggaaagactcaagtgggaatagaaatgaaggtctggggttgttgctagaactctgaagatgggatttctttttcaaatgacttgttgcacttataataacatttattgtatttttacctgtgtgtgtagagtagacagtgttgatttctgttttcaggagcctaacctgcagggagagctgtaagaccttctcagacaacaatgatgtggggagatgtggacaaaatcagtctgtgttcaaatctttctgaacactgcgcagttatgattttgggcagtaacatttactgagtcacacaaaccatacagaacctgttctaggcactaaatggggcagggtgggaaaaaaatacaaaagataagatataatccctgactt

SEQ ID NO: 76737 - DNA, 1074 bp, Homo sapiens
ctctgttgtccaggcgagagtgcagtggcgtgatcttggctcactgcagcctccgcctcctgggttcaagcaattctcccgtctcagccacccgagtagctggtattacaggcgcgtgccaccacgcccgactaatttttgtatttttactagagacggtttcaccatgtggccaggctggtcttgaactcctgacctcaagtgctctgcctgccttggcctcccgaagtgctgggattacaggcacgtgccaccacacccagccaacctttcaccttttgatttcattcctaaatgatacctgaatctcttatttcataaaggattgtaaaatggtggtttttcttattcctttactcctttcacattagttggaattcttctgtactgtgcgactctttagttggactcttccactaatatcaagtagggctatttgatcatttgcataggcaagacaggataaatatgtaattcttttaattgtgaattttgagaataaggaattgatgctctagttacttctagtatttcatgtttgatgctatttcaaatgaaatgttttcttgattttatttttgagttgttcattggtagtatatagaaatacaattgaattttgtacattgatcttgcaaccttggtaaatgcttgagttttagtagtttcttttttttttttcttccagctttttagttcaggggtacatgtgtaggatgtgcaggtttgttacctaggtaaaggtgtcccatggtggtttactgcacagatcatcccatcacctagatattaagcccagcatccattagctattcatcctgatgttctccccctcctcctacaccccatttttttttttcttttctgtttatttttttagagacaaagtctcactctattgcccaggctagagtgcagtggcaccatcatagctcactgaagcctttgaactcctgggaacaagtgatcttcccacctcagcctccccagtagctgggactgaggcagaaatttaaaaataaatatgcattcattcactccaagaaaagtaacaggcaaggcaagggttaaaaa

SEQ ID NO: 76738 - DNA, 1772 bp, Homo sapiens
ctacaatttttctagatctggtcagattcccccaaagaggtttttgtattttgcattcccagcaaaatacaatcagcaatgatgattgctgtaccatgtgtttgtcaattgtgaatttgttcctagcatttagaaattgggagattctacttaaaaatccttatttccagtgtcttaaaaaaaaatcagagaatctgccttaatctacccatggcaacagttggctagagctgaataacagctgccccttttctaggtactctctaggttactgcagcccccacttggccattttacttacttttgctacctatcagtctcctatagacatgagtttttgacccctgctctaagtatggttttctgggtaggtagaatggagacggagagtttgggacttgaagacatagaggacaatttagattattatgttgtaagagccaccagtgtgaatgttgatgaccctaaagagggtggcagggaatatgacaaggggatattaggaacacaggattgaaatccttgaggaaagcacatgtcctagaggtccatggaagactaactgaaaaagaaggcatattttttgtggttgccatggtcctataccaaagaggttttgtgaaggcagcattacagaaggtctggaaaggaccagcagctgggagcagggagtgtgctaaagccctcctggtgtactcttcctgccttcccccatatactgaagtttgagaggctgggaaggtgcggaatgggaaaaggagcagctgcttatgttcagtttaacattctctgggtttctccatctaggtcttgagttcattctcttcctgtccttttggcttccttgtttaacctggtccctgtttcaggagagaagcctcatcagtgccaagtctgtgggaagaccttctctcagagtggaagcaggaatgtgcatatgagaaagcatcacctgcagctgggagcagctgggagtcaagagcaggagcaaactggtgaggagggtgggcatagtggaacgctgtactacttctagggttccaagagccaaatcactgtcctgcctgcttatctggaaattttctgattctgttttgggtagatagacctggtctcatttgatgggctgatggtttccaaacatagctatacagtagaatcatctgcaaccttttaaaatttatatactttttgttgcttgtccgcccaccaataaaacaaagcaatctgataaatgagataatttgcaagatcctagaatctgtagttttaaaagtttccctagtgagtttgatggtaactagtgctgatccatgaacaagcatttgagtaacacagtgataaaagatttccacatgggaagagtttaagctttttaatttttttagatggagtcttgctttgtcacccaggctggagtgcagtggcgccatctcgactcactgcaacctctgcctcctgggttcaagcagttttcctgcctcagcctcttgagtagctgggattataggcaggtgccaccacacctggctgatttttatatttttgtagagacggggtttcaccatgttggccaggctggaagcatattttatttaccagtcatgactacctttttgccctgcctgaaatttgataactctttttaattcttattccttcgccatatctttccttaattattccaaatattcctttctaaagatccacctatcctgtttcatatgctaattcttcagacgctgaacacaagcaaggatcattatcttcta

SEQ ID NO: 76739 - DNA, 1803 bp, Homo sapiens
acgcatctgagaaaatggcaataaaaacagatacttctgaatttttccacaaagatagtttttttaaaaaagcttgagaaaggtgctttagttagagcaggcactcttgctatcagtcatcctgtctccacagctactgagaaaatatccactcatcatcattatgatttgagatggggtcttgctctgtcacccaggctggagtgcagtagtgtaatcatagctcaatgtaaccttgaactcctacgctcaaggcatcctcccacctcagcctcctgaatagctaggactataggcatgtaccaccagtccagctaactttttgtggtttttttggtagaaatgaggtctgtgttgcccaggctggtcttgaacgcctggcttcaagcgatcctcctgccttggcccctcaaagtgctgggattacaagcatgaaccactgcaccgagccagaatatccaattattattggtgagaagaaaattattccaaagttcacctactagtagaaaatcttggttgtctgggaaattttaagtttacttaaaatgaacctcatgctcacataaacacacaggcacattctaaacagataacgggagagaattgttttaaattcttaatttgttaatgacatgcataatcacatagtacatagactgtgttcatggcaattacttgtattcttagaatgccagtttttgcttcatgcagccatttatattagagcagtggttctcagccaggcacatttttgccccctggggatatgcaatatctggagacatttttggttgtcacagctggggagaggggtactactggcatctagcaggtagtggccagggatgctactaaacattctacaatgtacaggacagttcccttccccaaccctcaacaaagaattaggtggcccaaaatattaatagcactgaggataagaaatcctgtactagaagttgtaagtttttcatcccccatgggctagatctgatatgcagatgtattttattttgcccatacaatatttctaagtaatttttaaattagttgatagcatacaaatttctggcttgatgaaaatgtagttgatgtagtaactctgagcctatattccagcaggatttgatactttccagtgtctactatctcctactgtctacacccactccatggacgcatttatgtttctgcactagccccttataggcatttgggcctgtgctctcttttctgtacctaattctctaagtgtgaggcacaaagcaggaacccttaactttaggctaccatccctccacctgagcctccccactttgatttccttgaactattctctgttatctgctgctctttttttttctcagacagagttttgctctgctgcccaggctggagtgctgtggagtgatctcagctcattacaacctctgcctcttgggttcaagtgattctcctgcctcagcttcccaagtagctaggattacaggcacgtgtcatcacgcccagctaatttttgtatttttagtagaggtggagttttgccgtgttggctggactggtctcaaactcctgacctcagatgatctgcctgcctcagcctcccaaagtgttgggattacaggcgtgagccactgcgcctggcctgttaatctgctactcttcatttgtccatcctctaacagtagccatgactcaaaacccaagttttccctgccttgactcaaacccaagttagctgcttaatatttttcaaaagcagtaattttaagtgtagtgattaagcaagtgatacgagat

SEQ ID NO: 76740 - DNA, 1005 bp, Homo sapiens
taccttggcaacttgttcaaagagatagggccttgtttgtattcgctgcttcatttcctccagttctttcttatattctttcgctcttttacggtcattgttcctggaattagcaagacttttagaaagaatttcatcttttctaatccagaatacccttcatttccagtaaagcagtgtaactctcgtgtacactgtaaattcctatctgacttggaaaatcatgaccctgctgtgattacaggagcctacctacctcgataactctattttgcattttctggcaataggccagtggtctgttggatcccaaggcaagcaccccttttgacacatagaggacactgaccggttctctttcagctttgctttgaacacttcctccaggcttttatggggatccatggcttttgcacgcaaggtcacagatttggacattgcttgagacttctttttgtgtatctccagccactgaatactctcatctgctttgttctttttttcaagtgcacttctaaaggaaggaggcagaaaaagagtatagattaccaacctgggtatactgaaaagcaatcttaggccaggtgtggtggctcacacttgtagtcctagcactttgggaggccaaggcaggtggatcacctgaggtcaggagtccaagaccagcctggccaatacggtgaaaccccagctctactaaaaatacaaaaattagctgggcatggtggtgtgcacctgtaatcccaactactcgggaggctgaggcaagagaatcgcttgaacccgggaggcagaggttgcaataagccaagatcgcactgctgcactccagcctgggcgacagatcaaattccgtctcaaaaataataataataataaaataaaataaaatagccgggcatggtggctcatgcctgtaatcccagcactttgggaggccgaggcgggcggatcacaaggtcaggagatcgagactatcctggctaacactgtgaaaccccatct

SEQ ID NO: 76741 - DNA, 1192 bp, Homo sapiens
ggaagaccgtaaatgacaatctccgtacagtgatagaagtatgcataggatgctgtggaagcatacaggggggaaacacagagaaagactggaggagttaaaaagaggcgacgtcttctggatgctctgagatgttatcctaatgaaatagagacgggcattctaagcagaggagagtcatggaggtagaaggatactgtgtgatgagctatactgtggctggtgcgtggttattgagggtggggactagtgaaaggtgaagctcagaagtaggcaggggccagctcatgtacagtttggctagatcttaaaacctctggggagtgatgagaagttgctttgcacttgaggggcttatcacttgtcaagatcagtgtaggcaagttgggtagcattagcctaagctttggttacaaacaaggtttctttattgaatttttaattccctgctactcacatttcaccttgtttgtcttgtggctgatgctgctcagtggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattgggtaagacgataacagagcagggccactcccttctcactttgctgccagaggtcacacctgaactctgctttattcttagggatgcagcccacagagtccatccgcttgcaggacagggtgtcaacatgggctttggggatatctccagcttggcccatcacctcagtacggcagccttcaatgggaaggacttaggtaaggattcagatactatggggaagtatccagaggtcatatagttaggcaagatcagggcccacagtagcaagagggagtggacataaaatatatctggcttgctaggagatggaagaaaaccttattattggattagggatttaatctttcctctgcccttcaggttccgtgagccacctcacaggttatgaaacagaaagacagcgtcacaacactgctcttctggctgctacagacttactaaaaaggctctattctaccagtgcctccccgcttgtgttgctcaggacgtggggc

SEQ ID NO: 76742 - DNA, 1027 bp, Homo sapiens
tttaagcctaggagtttgaggctgcagtgggctatgatcacatcattgttactcagactgggtgacagagttaagaccagtctcttgaaaaaaaaaaatgaatagggatttctaatgatgaagatgtttaagctccttttgctgcttgactagtttcatccctgagaacttccatttaaagatatgttttttctgatgggtgcagtggctcacacctgtaatcccagcactttataggaggctggggagggaggattgcttgagcctaggagtttgaggctgcagtgagctatgatcacaccactgcactccagcccagtcaacagagtgagaccctgtctctaaaacgtgtgtatatgtatgtatatttttctttttttagctgaaataaaacaaggacacttgggaagaatacctacgtgattattatctacaataattattttcttcaccttactgtgttaagagtttcattcacttttattttttctccaggaacagattatggcctttgcaagcaaatgagtactcctctcctaaagaaagattacgttgatgaaaaagaacatcctgcccaggacccatcatacatattttcaagatcttatttaatttaataaacttactttacattaaaattctctttttcttctttgcttaatgggcctgtggcacccaaataatgaatgataatttgctgtgaggagcgtatattagccagaccaaaggaaaaaacttcgaaggaagacttacaatttggttgaaaagagctttttattactaaaaaacccacaaggtgctgtctcactcatttccagttaatcatttctaaagagaaaatttacattttgtttttgttttaatgttggtcataaatttatacagttgttttttgatagaggtaagaattagactcgatgcatttttgttagaattgctgtttaaatgttaacatcagaatgcaaattaaatataaattgctttaacctttgttacaggtatactggactttctgaaaggaaaacca

SEQ ID NO: 76743 - DNA, 1029 bp, Homo sapiens
gtaaaacacacatactgtccagcagactcctttggtcatcccaaatacctctgaactccagggaagatgcattctaactccacgaacttacctattttgttaaccttgattagaccttctggagaagtaaccaatttgtccatcttaggagcaatttggaatgagagtttttatttttttctgtaacgcccatcctgcctgcagtagaccctttgggcttaagaggtcctacagattctaatagtttcctctttgtagatgtgttaacatatttaaaatacttaggacatggcctggtacgtgacagatggtgtttaacatcattgtcatatgaagaacactctctgtgggccaatggaggtgtgccttaaaattcttcatcttgcctgattttgtttgcataacttctggagagtctgtgtcctcctcatctaggccacctttccattttttgtgaaagatgaccttgtccctgcagtctccgccaggagtcacacagcttttcacagcagctgccatctttaattctttttcctgagattccagcaaggttgtgacattgtcacttttttgttctagactcttttaaattttctgcatttgcctgaaaagcacccctgtaagaatagatttctcatggctctaaaaattattcccaagaataccttacttggttcaaaagcagactgtttctcttcatttcatctcaaatcagacttctgggcaagatgttctttagagtaagcaaacctacaacctaaaaatctcttcaagaggcatctctggtcttgtgacgagacctcttcaaaaacccacagtaaaactcccctccctccagttggccaccagtctgccaccaaacatgaacaaattctgctgctaatcggtttcccttgtgatctggttcctgaggtcttcggatctgtgcaatgaattatttattgttttattaaaccgacagtggtgtcccagagaggaaccataaataaaatggaaatctggtgctgtgataaagtaataactagcatt

SEQ ID NO: 76744 - DNA, 1036 bp, Homo sapiens
ggttttgctttccatgtataattcaacaacgcaaaatgggaccatgtcagaatctgtatgatcctattctgtgttagctccaatcagccagctgagagccatcctaaatattaataggatgagagagtaactcctaactgtgcataaattacagccttaagaaagaaggccacccggtctctggggacatgttttgggagggtgtggctgcctcatatagcctacctttgctttaatcagcattttatcagtcaactctgggattaatgaacatatccgactttatgggtatgtgtatattcagtgccagtaccacctcccaggctaatgtgttaacagtgttttctatgattctaaacttgttttctttgtatttctaagaaatacaactaggccctaacttttggtctgtggtcagaggtcagtgtctgtgctattccaggatctattatttcagtttgcccttttattctctccgtttgtaacagtaccttcctgtcctggtccctgatcactttagctaatatcctttgaattatttatctagttcagagtttccaataccgttcctgacaaaaccccacttggatttggttggctctctcagcccacatcagtacagtggaccaacatttccagggagaaccatatttaatgtccctcatgctctctttttgaatccaagtgctcagagctcttgactgtgaattatttaccccaaattcattatcttgcacttttttttgagatggagtcttgctctgttgctcaggctagagtggagtggcgcaatctcagctcactgcaacctccgcccccaggttcaagcgattcttgttctcagcctcctgaagagctgggattacaggtgcccaccaccattcctggctaatttttgtatttgtagtagagatggggtttcaccatgttggccaggctggtttccaactcctgatctcaattgatccacccgcttcccaaagtgctgggattacaggcatgagacaccgcgcctggccttatcttgcactttcaa

SEQ ID NO: 76745 - DNA, 1187 bp, Homo sapiens
cccaacactgacctctgcgcttattcactcatgcccctgccttagggccttcgctctaagctgtccccactgcctagaaattcttttcctatatatccacttgatgaattcctgcaactccttcaaatacttgtttaaaaatcactttcttattgagatctacttaatactataacctctcaccttcacatgctcccacctctacctgctttctcaactccccttactctgatccacttttcttttttccacaccacttatcacattctaacatactggaaagcttactgatatttattgtctgtgttcctctgatagaatataagctcctcaagagcagaaatctttttgtttactggtgtaacccaagaacctagaagagcgtccaaggtggaattcaataaaaactgacaatagaaatgggctagggtttctctcagccttagcgccattttcttggaaacctctgcatcatgagagctaagtggaggaaaaagcgaatgtgcagtctgaagcacaaaagaagaaagatgaggcagaggtccaagtaaaccgctagcttgttgcaccgtggaggccacacaggagcagaaacatggaatgccagatgctggggatgctggtacaagttgtgggactgcatgctattgtgtagagcttgtctcaatggatccagaacttcaccgccctctgatcgctgatcacctctgagacccaccttgctcataaccaaaactgcccatgttggtcctctgccctggacctgggacattctggactatttctgtgtttacttgtggccgagtataacaaccatacgataaatcatctcttctgctgtcttagctgaagaatcaaaaaaaaagaaaaagaaaaaaagaaaaaaaaaattggctgggcatggtgcctcatgcctgtaaatcccaacacttgggaggctaaggcaggaggatcactggagcccaggagtttgagaccagcctgggcaacacagcaaaaccctattaaaaaaaatttttttttaatgaaaaaattagccaggcatggcagtgcacacttgcagtcccagctacttgggaggctgaggcagaaggatcacttaagcccaggagttcgaagctgcagtgagctagaatcatgccactgcactccagcatgggtgacagagcaagaccctgtctcaaaaa

SEQ ID NO: 76746 - DNA, 1018 bp, Homo sapiens
acagagcaagaccttgtcaataaaattaaatttttttaaaaaccccaagtttttttggtatttagaaggaaagcattttaaagccacatttggtgggggaaagacaaatttgggaaaatgtaattatggggaacccctattccttcctttatacatgaaactatcattgtaatatttttatctttggcatgtttttcattttgatttaacatgtttgaagcagtagctatttttcagttgataacaagaaagggaaaatgtttttattctcttcccacagttaaaatccaatataaacggtgcccagtggcactgatcctagtggcagttactcttctgtaaatagtgcctcccacaatggatatgggtttggaggcagacagagcttatcacctcagattttcattctgatttttcattggggcaatatgaaccccctcctgaatgacagtatcttcttatctaaaggactttgattcttaatgaatgggcaagaaaagaccttctggtttgtgaagaaaaagaggcaacaatagcaacagctttcctccaagtgattattgtagcaaagtcaagcctgaaacaatggagaatgaagttatgcctgactcattttgttattacacccaaatgagttcattgtacagaatgggcctttttgacacgtgtctaatgatattttgatgcaaatgaaataatacacataaaaaatgacctgtttacaggaaagactgatgtatttgttgataactaccagtgacatcaattctcatttctttattggcagttacagtatttgaatttagggttagaccttaaaggatatatccagccaggcatggtggtataagcctataattccagctactcagaaggctgaggcaggaggatcactagaactcaggagtttgagaccagtctgggcacaagaagaccctgtcttaagaaagaaaaaataaaagtctaggccaggcgcagtggctcatgcctgtaatcccagcactttgggaggccgagg

SEQ ID NO: 76747 - DNA, 1037 bp, Homo sapiens
gccactgcactccagcctaagtgacagagcaagactccatctcaaacaaaaaagaaagaaatactagtttcagcataataatgatggctaaggtttgattgtttactatctgccaggtattatgttaaatgttttagatcaattatcttaggaacaatatatattggattctgattgcatttctcaattaggaaagtgagtagcactttataatacctccttcaaaagctaattaaaagaagaatcatgaaaccccagaaatatatgctaactttttttctgttttccttagggcatccaattctacactcagttaaagaccattacttctcagtggaaagaagaagatgctactctttcctcacctgctgttgtcatgcctaccatgggccgttagaaacaagtttgtttaagactgactccatcctgagtaatctccctttatttttgaccagcttcatttgtcagctttgctcagatcagatcgatgggattggaatacattgtaactaaaatcttcctcaggactattaacccccgcaaagtttctatagggaactgcctagtgtaacaatgaaaccagatttctcacttgctcttcatacttctattttgaggtaactgttgtaactatgaaatgcttatctgaaagtagtgcttaaacctgatttctaaaaattatcccattttctgatgatttgaaggggagaaaagccagtgtatgtaaagaaaatgttccagccaggcgcggtggctcacgcctgtaattccatcattttgggaggccacagtgggcagattgcttgagcccaggagttgaagaacgtggcgaaaccccgtatctattatttaaaaaaattgaaaaagtaaaaaaagaaaagggaaaaaaaattttttaaagaagatgttccaataattgcaagaagaactcttagatggggaaacaggacagaaataactcaccgcttttggttgatcctcaaacatagcgctacctaaatgccactgggagagacctcctgcaaagttttctttag

SEQ ID NO: 76748 - DNA, 1048 bp, Homo sapiens
acattgggttgtttccaagttttgggctactacaaataaagttcttatgaacattcatttttcaaatacctatatggacataattttaattgcatttggtaataaattttgatttatatttacattgattatatactctattacttatatttatatttacattgatttttttttttgagacaaggtctccctctctcttcctggctggagtgcagtggcataatcacggttcactgcagcctcaccctcccgggctgaagcaatcctcccaccttggcctccctagtagctgggaccacaggcatgtgccaccactgcctggctaattttttaattttttgtagacaaggttttgccatgttgcccagggtggtctcaaaactcctagactcaagtgatatacccgtctcagcttcccaaagtgctgagattacaggcgtgagtcaccatgcccagcacattgattttatatgatcttaaattcagtacctattgtgttagataccatgctaagtattttcatattgttagatttatggtacatttgccaggcccaaattaggaaaatataatgacaaaaagattttttttaatcagtactatcctggaaatataggacatgattattatggtttattgtttgttcatagtttgctgtgtcatagattcatatcttttctctttaatgactgtatggcctttgagagaaacataccccctatatactatagcaaatagcatatagtagctatttgctaaattttaaataactttctgctctcatttatcaaaataatcgttcttttgcctcacaggtttcttccaaggtgaaatccagtcccacctggtattcagcatcttccttctcttcttcagtggtgagtttatttggcatagaggttgacttctgagaaggaattcagtatagttttgggtatctctatcttctttacataattgtcatcagagtgtatgtgaaactttctagttttttcctccttttggattatttccctcctgaaatggattaccatgtcaaaagatacaa

SEQ ID NO: 76749 - DNA, 1052 bp, Homo sapiens
accccatctctactaaaaatacaaaaaactagccaggcatggtggcgggcgcctgtagtcccagttactcaagaggctgaggcaggagaaggtgtgaacccaggaggcggagcttgcggtgagccaagatcgcgcaactgcactccagcctgggcgacagagtgagactctgtctcaaaaaaagaaaaaaaaaaaaaacaataagaaaaaaaaattagccgggtgtggtggcatatgcctgtaatcccagctactcaggaggctgaggcaggagaatcgcctgaacccgggaggtggaggttgcagtgagccgagattgcgccattgtactccattgagtgcaggcaggtctcaaattcctgaacgcaagtgatcttcccacctcagcctcccaaagtgctgggattacaggcgtgagctactgtgcccagccacctttttttaacatgtgcccaagtaacatccaaatagagatgtggtaaagataattacgtgggtatcacctgaagaggaaaatactggccaaggactaaagagttgggcatcatcaggatctagatagttaagccatgagagttgataaaatcacccaaggagcatatacagaatgagaagaaaagaaggcctaggaccaagccttgggaaacttaaagagttaatggcagcctggtggggtggctcacccctgtaatcccagcactttgggaggccaagatggtcagatcacctgaggtcaggagttcgagaccaacctggccaacaaggtgaaacactgtctctactaaaaatacaaaaatgtggccaggtgcagtggctcacacctgtaatcccagcactttgggaggctgaggcaggcagatcacttgaggtcaggagtttgagaccagcctggccaacatgttgaaaccccatctctactaaaaatacaaaaaattagctggatgtggtggcacatgcctgtaatcccagctactcagaaagctgaggcaggagaatcacttgaacccgggaggtggaggttgcagtgagccaagattgcaccactgcactcc

SEQ ID NO: 76750 - DNA, 1848 bp, Homo sapiens
cgtggctatacttaggggcggggctaggcaaagattgccctatgaggcgagggaatgagactgggctgcgagttggggatagggtttctctttgggggcgtggcttatggaacctcgttttcccgccgacggttggccacgtcacgtgacatgggttggaagatggcgtctcccacagacggtaagagccggcttagagatctttgcctgcagcctccttctttgctctactgggaacatccactctgtctctgcccctcgaacatacatttctttcttgggctcttctcctttcccttttattttttttcttgagatccatcgccgtcttcagctcaccggttcttcacagcagctccggaggtgcccagtttccccgctctgtaccaggcgtgtggaggagggcactagggagggactcattctgggtaaaaggacaggggggtcgccctgtgccttccttatctctatttgggcgaggctgagggtcgaggaggagatgtttctggaggacgtggcttactgtagttttttccttggggtacccattgaaaggatcagttctcttctgattgagcgcacggatggaatgattctcacaaaccctcgcagggctgctggctgacctcatctcgatactgaaccgcaagagaaacatgatctctctcctgtctcctcagtttgggaccattgccgtggcagcaagagaagcgggggacgttctcggcccctcgccctgagagtcgcgaggagaatcagtattgagcttttaagtgtcgtcttgcacaggtcgcaacctgtcttccatctgctttacgtgttgtttcttaaggctgagtgaattaacgatttctgtttatatattgtgtaaaatgcaagtcatttcaagtaacaattaagttgttttggtatactcccatgcttttcctcttggttctgctttagagagttagggtcttgcagtcatttttaaactcatttttagttctaccatcctcatcccaactatatatcgattttattgatatataggtttccttcccttagacaaaaacattttatatttggaaggaatcttggaagttcattgcaggaatgaagaaattgaagccaaggtgagctatattaagtacctgctacatgaaaggcataatgctaggtgctttgggagaccaaaagatgactcaaacatataaacatttttttttttcagtttcagttctctttttagatgtcacctcccaaagagtctttcttagaacacagtatctggagttgccctttcccaccattattcattatctcagtatcttccttgtcagcatagttactctgttaactttgccccttttgcgctagattgtaaattccaagtttgtcttgttcatagttggatccaggtttagcacagtgcctgacgaacagtaggtctttaattaacatttattgaaagattgattagatatatgcagaaataatatattacttgatcttaagttttaagtttaaccgagtcttaaattttgtgagcgcaggtacatactgtattagaaattatggctgggcgtggtggttcacacttctaatcccagcactttgggaggctgaggcaggcagatcgcctgagctcaggaattgaagaccagcctagacaacatggtgaaaccccatctctacaaaaaaatacaaaaattatctgggtgtgatgccacaaacctgtagtcccagctacttgggggggctgaggcaagagaatctcttgagcccagggggtggaggcggcagtgaaccatgttcatgccactgcactccagtctgtgtgacaaagcgagaccccgtctcagaaaa

SEQ ID NO: 76751 - DNA, 1020 bp, Homo sapiens
taccatgcccaactaactgttttttttttttttttttttgagacagggtcttcctctgttgcccagtttggagtgcagtggtgtgatcatggctcatttcagcctcaacttcccgggctcaagccttccaagtagctaggactacaggggcacatcactacgcctggctaaattttgtattttttgtagagacggggtttcactatattgcccaggctggtctccaactcctgagctcgagtgattcacccgcttcagcctcccaaagtgctgggactacaggcatgagccactgcacccggcccgttttttaattttttgtagagtctggggtcttgccctgttgcccaggctgatcttcaagggatcctcctgccttgacttctcaaaatgcccagccctgatttttatttttctgcattttaatgtgattctttctgtgagaaatttaaataaataaaattggattgacagaacagcatctctaaaaaggcagtttaaactttctggtaagagatattgtatcttaccaccctcccaaccagctaactcctggtccttccaagttcagttgaggcattattttccttgagaagctttttatgccccctgggtctgacttagcttgccattttttgtcttgccatagtcctggcatctttctttgaggactgaaacagtgttatagttattggtttattctttctcttcttctaaactataagaaaacagacaaagctgttttcttattatttggatcttctatgcctgagcaatcatacttattgaataaataaagttttgtttttctttttagtaccaggtgttgctgaatttgcagcttccttcaaaagtgtaagtaatatcccttacctactgaggtcaatccaaagtttcgctcctgagtaaaagctcagatctctgttctttattttattttattttatttatggcagagtctcactcttcgcccaggctggagtgcagtggtacgatctcggctcactgcaacttccactt

SEQ ID NO: 76752 - DNA, 5401 bp, Homo sapiens
gaagaggtctcactatatttcccaggctggtcttgaactcctgggttcaagtgatcctcctgctccagcctcccatagcattaggattacaggtgtgagccaatgtatgtgtttttgtttttttgttttttttaatgtgaaaaaaatacctactttatagagttgatttggaggtaaatgacttgatgcatgtaaagtgttttgcttgtcacataataggttctgagtacattttaattaaaaaaagagaaagacgcaaagctgaaataatgtttctcaaccctaccttttgtgcatgacagaatcatcaacatgcagctatggagctcttgaaaaatgcactgtaacaaatgagcaccaagaaaaaaattaattaaatataaaaaaagaaaagcacatatgaggagtcccttgctctactttttccactggacccttccctacccctcatattctaaatcattatgtctggagtgtggccaaggcatttatagttttaaaagttacacaggtgattctcgtgtgcaactagcattaaactgccaacccagagctattctaagaatgggctttctttcatagttttaagttcactttcataaatgaaaaattgtaaaattctgaagtttcctaaaacctctacaataaaattgtgaaattccaagtgatgaccattccagacttctctcacttaaaatgatgattttctcattcttgattcttctttgaatctcccgtatgccagagaatgttacttactgattagtgtttcaaacagttgaattggaggctttcaccagaactgaatttcaagtaatttcattcattgctatactaacttgttaggcataaatcagtaatagtggtcatacctattcttccacagtgatttctctgagactgactttcaagatgagccatgttttttgcagtgactatttgtaggccatatctaaacctggagaaatccaggtttttgaaattataatctgccagtatttccaaacaacctgaaggctatgtgacaagctgcattttttctttttcttttttttttttttttttgagacagagtaatactcttacccaggctggagtacagtggcacaatcttggttcactgcaacctctgcctcccacattcaagaggttcaagcaattctcgtgcctcaccctcccaagtagctgagattacaggtgtgtgccatcacgcctggctaattttttttgtatttttagtagagatggggtttccccatgttggccaggcgggtctcgaactcctgactcctgacctcaagtaatccgcccaccttggcagccaccgcatccggcccaggctacacttcttataagaataatagggtctcctcacactttttatgtgtctgaatggatatattattttttgacagcctattactagttctccacccaaatggatggctgagatagaacgtgatgacatcgacatgttgaaaggtaagtgatgctagttaccacttttaactggatatttatgtttttccatagaccacctctctattttttttttctgtttccttacaagtatttttggcttcagacttctcatttaaacctccttatttgtagtttttcatgtctgcaatgcccttctctaccttttccatgtgtagaaatcctgccaattcaagactcagtcatagtgaattctgctgctggtgctaaattcttctaatgtgaacctgattttgtataatacagttaacgaatagctctaacataaattttttcatttaattcccataaaggtcctgtgagttgggtatgatgatattcaaagttcataagttaaccaagatagaatgagttaaaatttggctaggcgtggctcatgtctgtaatcttagcattttgggaggccgaggtgggtggatcactggaggtcaggagtttgagaccagactgaccaatataacgaaaccacgtctctactaaaaatacaaaaatcaaccaggcatggtggcaagctcctgtaatcccagctactctggaggctgagtcaggagaatcacttgaacctagaagacagaggttgtggcgaacaatagttccactgcactccagcctggctgacagagcaggactctatctcaaaaaaaaaaaaaagttaaaaaattttaactctggttttttttttttttcagacggagtctcgcttttgttgcccaggctggagtgcagtggtgcgatctcggctcactgcaacctccgcctcctgggttcaagcgattctcctgcctcagcctcccgagtagctggaattacaggcatcccccaccacgtccagctaatttttgtagttttagtagagatggggtttcaccatgttggccaggctggtctcaaactcctgacctccagtgatccacccacctcggcctcccagagtgctgggattacaggcgtgagccaccacgccccgcgtaaactctgcttttttaagtctagcctctttccattataacacaagtgccttatttagaatttactgccatatattgtcagtactattaaatgacaacctcttagtgggttaagacctattttttatttttttatcccatcaatttcttctataaagaatactataagtagtgaatattgttgtttgataaatgatttgaaactcaatcacaaagtggaaatttaaattaaaaaacattaattttccatgattttgccctactttatttattttatcatccttctggtgataagattcatgatgattgtgaagtaatagactgaaattaaggtaaaaacctgggattcttgaggtatttaaacagctgaacatatcaagaaagtctacttatgctaggtgtagataatgactgtggcatgataaatgagattaaaaaaaaacacctttatttgattttagaagtaattcattgttctttatgaaatgcttaaatgcagattccctcctcctgccatggaaaaattaagtctcaagggcatctcaggttcattcttctaatgtttcaaacagacatttatataatatctcatcagcatgtatttcttaaggcaactttaaatttttagtgagggatcatagcattatattctatgcaaactgacctgtgtcttaaacctaaaaggaattgggtgctatttaaataaaaattcaggaaagaacatttttaagtattgtctttgtgtgtgtgtgtgtgtgtgtgtatgtgtgtgcaagagactggagttttttttattactcagtctccccgagaatttggggatcagagtttttaaggataatttggtgggttggggggacagtgagttgctagtgctgattgattgggctggagatgaaatcacagggagtcaaagctgtcctcttgcactgagtcagttcctgggtgggggccacaagatcagatgaaccagtttattgatctgggtggtaccaactgatccatcaaatgcaaggcctgcaaaatatctcaagcacagaaacacccaacagtgaaactgccattgcagaattgtaactgtgatggtgaaagagatctgacctaaccaactccatttgctcctaacctccaacagtatgctgtctttttacttagtaaacttaaagatttttataggaatttgatttgaagggaaagtttagatttttatttagtctttgttttctaaacttagggaaatggggaatagtaagtgttttgttgccactttattataagtcgaaataatgtggacttacaattaacagtggagacagtgtccattttgtcagatcagatctgtcttcaaggctttcttaatgctatcaaaagacaaggttttacattttaatgatgtattccaaacaaatgttataaataatgtttcctgaggatgaatcacttaatttgttactttattatttttttctttttttatttgagaaaaggtctcactctgtcacccagactgtagtgcagtggtgccatcatggctcactacagccttgacctcctggtgatcctcccatcccagcctcctgagtagctgggactacaggcatacaccaccatacccagctaattttattttatttatattttttttttgagaaggaatctcactttgttgcctaggctggagtgcagtggtacaatctcagctgtctgcaacctttgcctcctaggttcaagtgattctcctgtttcagccttctgagtagctgggactacaggcgcctgccaccacacccagctaatcgttctatttttagtagagacagggtttcgccaggttggccaggctggtctcaaacccctgacctcgggtgatctgcccgccttggcctcccaaagtgctaggattacaggcatgagccaccatgcctggctgaatttttgcattatttttatacaggtgaggtatcattgcccaggctggtcttgaactcctgggctcaagtgatcctcttgccatagcctcccaagtagctgggactgaaggcatgtgctaccatgcccagctaattctgtttttatgctagttcttttcttattaagtgggtaagcttatctgaggaattttgcaatagtgggaaaattccctgatttgtgtgtgtttaagattgggggaggagttacggatccattttctacttattcagtggtaattaagcttgaaaacttgtataacaagagttcccaacccaaggaagttgctactagagaagagtggaaagaaatgatgttgaaataaatgattctgtttcagaactggggagtctcaccacggctaatttgatggagaaggttcgaggcctacagaacctagcctatcagctggggctggatgagtgtgagtaccccgatcgcatttgttcaggggtgtattccaccctgagctgtgtattccaccctgagctcaggtattccaccctgagctccagttataattcagaaagtatattagggaaaagagaagcattctgaaggtaagaagtcaatctaattcattgactttttatggtggagtgtggtggaataattactggatttactaggtaacaaatgatttttcttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctgattttttttgtatttttagtagagacggggtttcaccgttttagccgggatggtctcgatctcctgacctcgtgatccgcccgcctcggcctcccaaagtgctgggattacaggcgtgagccaccgcgcccggccgatttttctttatacagtaa

SEQ ID NO: 76753 - DNA, 1104 bp, Homo sapiens
agcctctgaagtagctgggactacaagcatgtaccaccgtgcctgggtaattaaaaaattttttttgtagagacagagtctcactatattgcccaggttggtcttgaactcttgggtttaagtgatcttcctgcctcagccttccaaagtgctgggattatgaaccaccgcacccaaccagcattttagtttacaaataaatttaaggctggccacagtggctcatgcctataatcccagctagttgggaggctgaggatggagaatcacttgaacctgggaggcagaggttgcagtgagccaagatcatgccactgcactccagcctgggcgacagagtaagactctgtctcaaaaacaagaaaattaatttaaaatttctaattttcaactgatagtcgtcacttcctcagacctctttatccttcctttatttctattactgtcatcagcagttggctttcttttaccaagaaaacatttttgaattggttatggaatcaagaaatagagaacaacaaactgcttcaagatatggttgttagctgctctgctaagttcactcattagtacctaactcttctctatatactggtaatttatttcttatgattaaagtttataccttggcaaaattactagttaccatgtatgtcatggacctccttgatttataatgaaaaggcaaatctgtgattagtaaattcatgaatgtgagactttcatagtcgattttgttccttgattttgtttctagctttggataataaatgctgtaatgatcattgtgatcaaggctttatctctttgtgtcaatgtttttcaatgaagtaaatgttatgtttgttatatcaagaagatgctatattaccaaatagatttgtcagtagtattatctatagttatagctgaaattatggttcctctaattagtttctctttttctgctttcctactgagaaaggtaatgaagtattttttcctgctttttattatttataccaaagtagagtgaacggaataatgacccatggcccagcttcagtaatcaacatatagccaatcttgttttacttataacaatttcctgtagctactttaaag

SEQ ID NO: 76754 - DNA, 2283 bp, Homo sapiens
tgcagtggcgcgatcttggctcactgcaacctccgcctcctgggttcaagcgattctcctgcctcagcctcccaagtagctgagattacaggctcatgccaccatgcctggctaatttttgtatttttagtagagacggggtttcaccatgttggccagaatggtctcaatctcctgacctcgtgatccacctgcctcagcatcccaaagtgccaggattacaggagtgagccactgcgcccagctggctactgttattttttaaaaatataacaatagtttcattattataactacaatttttttaacaaacttgttaaatatcatcaaatagccaatcagggtttagatttctgtagttgactcataaatgcctttatacagttcattttttgagtctggatctaaataaggttcatatactgtatttgatatgtctctgaaatcttttttagcctgtcatacttccacctgcattttatttccccttgtcatttgttaaacctagtcatttgttctgtagatttttcaaaatctgggttttgttgattacattcctgtggtagagcttaacatgttcacctatcccttttttatctgctgattgttagatctagaagcttgcacagatacaggcttgattttttttttttaattttgataagaatatttcacagttggtgttgggtacattatgtgtgctggtctttctttttgtgatactaagattaatagttgatggattctagatctaactatcaggaaataaaaagggataggtgaacatgttaattaagctctaccacaggaatgtaatcaacaaaacccagaatttgaaaaatctacagaacaaatgactaggcttaacaaatgatggggaaataaaatgcaggtggaactatgacaatcagatttattcattgtaatattcttcatcagtcttatacctagagtagcaggctttgatcacagtctagatttactgttttattataggttgcaaggtagtaatattctgtcatttctctcattgactagaatttttctaaaaaggactgtatcttatcaactatttggttacctcgaaaactgcttctactggcatgatgggataaatgattctttttctttctttattagttttcagaataatgagtttgttccctaagcatcagtaaagtttattttaatgactttcaatggaatcaaaaacttggtgtggcatttgttatttttttaaatccacacaattaaagccattattactgctaactgtatttctaaaaacttaaggctttgggggtgggggtttgaagtcatttaattcggccaccttcagcactaaaccaaaactgtataagagaaatgcttgtttctgccaaatgagtcccatgagcacagctgagattgttcagaattatcttctacctcaaaatttggtgttctttcaatttccatagcattgctttgcaactgattgccgttttccttgaccatcgtgaatttagctgacatgaaatagctttaaaatttagaatgagaaacaattacattgatgtgtattgaacttcttacatacagtctctctttgttttattgtgtgtagtgtatttgcattaaaaacaagatttttttttttttgtccttacagattattcatctactctaggggttggcttttacttgacaccctaatctggtgtttcaatgtctaaatcctctttcctgcattaattgagaggatgacatgggtgaaaaataagcagtaggaactgatgaatccccaaggaccagtgatcctgtttttatgcaaatatctgcactgataaagatgatggaaagaaaaaaaatgcaaaaaatatttgtcctcaaaacatgattgtttgtcacttcccaagagcattgttaaatgttagtataaaaattatatgaaccttctagggctgatagtaactaggttgtgtcttttggaagatgagtgctaccctttgaattggtacatgattatgcctcagataacccttttggtgtgcaaattttggaatgcagtaacttttcttatagggatttatagtctctcagatgattgaggcctcttggcttgatttgggcagttaatttatatgaaattcccttgaaatatatagaaatatttaaaaaagtaaaactctgccttagcatatgaagaattccatttctattatttccatctgagctcagagtcctccctcttttactggaactatgttacagtcaccttctagctggtccctctgcctctca

SEQ ID NO: 76755 - DNA, 2484 bp, Homo sapiens
caggcagatcacgaggtcaggagatcgagaccatcctggctaacacagtgaaaccccgtctctactaaaaatacaaaaaaagttagccgggcgtggtggtgggcacctgtagtcccagcaacttgggaggctgaggcaggagaatggcatgaacctgggaggtggagcttgcagtgagccgagatcgcgccactgcactccagcctgggtgacagagcgagactccgtctcaaaaaaaaaaaaaagattaagatgtctccattcaaaacttaatactttatcccattaatctacattgatgaagttatctatacaactttactatttggtactttatttgatggtagtaactaagaaaaactgctttcaagaagcagaagtttccacagcactagcctgtggtactagacttctccaccctctgggcatgtgatttgcaaaaaagtgatcatttacatttagaagttgtttcccatctagataaaattctaaacagttcttttgatttgtaattttaatatataaaggagggaagggagagtataactgtgattcttacacctttttgtttttttggagacagggtctctgttgcccaggctagagtgcggtggtgcagtcatagctcactgcagccttgacctcccaggttcaagcaatcctcccagcccagcctctcgagtagctggaaccacaggacagtgccaccatgcctgactgatttttttttttttttaatttttattttgtagagatggggtctccctgtgttgcccaggctggccacatcctcctaggctcaagcaatcctcccgcctcagcctcccaaagcactgggattataggtgtgagccaccatgccctgcccctggtatttatttatttatttatttatttatttatttatttatttatttttgtgggctgacatcagaattatttgtctggcttcccttattaggccaattaagtcctacctctcatagaactaaattaatagtccttgactgaggagaaaaatcatctagcctttaacctctagatggcagcatgagtctttctgtaccactaacagaaagactacccacatctcttgaactggatttttgatctatgtaaaaacttgttgtgattttttttctttttttctttttttttgttttgagatggagtttcgctcttgtcgcccaggctggagtgcaatggcgtgatctcagctcaccgcaacctccgcctccgtggttcaagctattctcctgcctcagcctcccgagtaactgggattacaggcatacgccaccacgccaggctaattttgtatttttagtagagatggggtttctccatgttggtcaggctggtcttgaactcctgaactcaggtgatccgcccacctcggcctcccaaagttctgggattacaggcatgagccacagcacctggccccttcttgtgatttttaccagactacttgcctagctttgttgataccttgttgatttttatttttagctttttgtttttcttttttatctcttcatctttttttacatatttccttgtttgtttgtttttttttaaatttttttttgagacagggtttccctctgttgcccaggctggagtgtagcagcacaatctcggctcactgcaacctctgcctccggttcaagcgattctcccacttagtagaaaaaaattctaaaaatgtggttaattcaatagtttttatatctgcatataagaccctaaaaatgggttaagttctcttgtctcaatactttcccctaccagtgacttatcttgtatccttggactctgttggttttcatgtggtatcaggcaatgctctattacattaaacaggaatgttagctaaagttgatgaaactacattggactaattagtccttcaagaaaaatttaattgttttaaaataaagctttcaaatatttagccattttgaataacaaaagaatgaagtgtcctgttcagcaactgtttgggtgactacttcatacaaggctatgtaggggataggaagataattactgccctcttgtagattaaaatctagtaggaaaggaagataagacaactaaggtaaatgattcttaaaaaaatatagaggagaaaagctctatgagagtacaaagaactatatggatgggggagaagaggcaattgcattagattgctacaggagtggcagataaacttcattttatttagttaagacctgcctaggaccattgaattgagaaagattttgagagggagcctagattcagagaaggcaattagtgatgtctgttatagacaagggaaatgagtatggtaatatttgcaatttctggaacattggaaataaacctggccaggtgcggtggctcacgcctgtaatcccagcactttggaaggctgagttgggtgatcacctgaggccaggagtttgagaccagcctggccaacatggtgaaacc

SEQ ID NO: 76756 - DNA, 1479 bp, Homo sapiens
ctgggactacaggtgtgagccacagcgcccggccagaaatgcttttttaatataactgagattagtgtgtgtgtgtgtgtgtgtgtgtgtgtgtgtgtgtgtagttttaacttgtgctttaaaaaattttattctatcttaagcattttcctgtgtcattaaaagttctaccactgaagatttttgaataggaaagatacacacctttaggaggcattggtgcacaggatagagtaggatggtagagagaggaggcaggaagttacagtgggaatccagggtgaaggattgagagcttgaatggatgatggcagtgagaatgggaagaagtgcactgacaatagatttttcagatttggaatttttaggagtaggtaaatgtctggatggggatgttacgggataagctgaaattagagcttaccatgatgttttagcctaattaatgacagggaagtcagaaggaggctagatgcctgcttaacaacaacaacaacaacaaaaatcacataattcttttacttgctcctttgtaggcaggcatctttattttcttagaaataagtaaatgtcatttgtagaggctagaggttagtgttattaataagatatctagttcagtcatattacctaggcaacaggtaatgttttagatagtgaatggtgagttatttgatctcaaagaaatcaatatgtgaaataggatgtacataacttcagaagttgacttgtgaagtccctattttctttggctggtcattaggctgctaagtagaatgactgacttttgtatggttttcttccacaatagtgctttttctttcggttccctacctatgaacttttcctgaactttcctacaagtttaaaaagttgttatggcctctctatacagtagacatccaattctttgttaactggaaaaaagtttcagaagtttaaatttgaagtaacaggaattggtccaaaatatttgttgttgctcatgttttaaataagcgacattggattatatcagcactgggataattcccattaggtattatgactgcaatttacatgcaattggaaattagtgattgagagggaaacagattgccaaattatcttccaaaaaggtactccccactccatatccttgctaataacaagtattataattatttaaagtcattgccaacttgataggcaaaatattgtcttgttctaatgttcatttcttctattgtgaaggcgaactttttttttccatgtttcttgatcctatctgttgatgagggctggaagttcaagaaagtataaatttaaattattttaacctgaaaaataaagccagagaacttgattgaaaagcaccccaaagactgtgttgaaatctgcattgcaaatactgatggaaacttatccttgttttctttgttttatgcattactttaccatcttgccatagtcattagctttgcacctatttaggttaca

SEQ ID NO: 76757 - DNA, 1045 bp, Homo sapiens
agtatgttttaatgactatcttgagtggtttttaaaattttctgaattttccaaattaacaaaaacacattctagtctgttgaataggaaaaaaatactacttaaaaaaataaggaaaagttgtatgccattttagaaacaaaattgtacttaaatctctgaattttctaggcagttaaatttttgagctcttctgtggactgtttctaaataaaaatgagtagatccattaacaattgatcagtttatacaagtgataaatagcaaggtgaatgtttcccatacatatctcatttcccatactcaggatgtgcttgcataagtaggaattgagagcaaaagaaatggtaggctgttgggtcatgggcaagagacgatttagttggccaaagaagcatattttcttaagcaaatgttggccaagatgttactttatgttttcgggctgtcttcactgtagttggagaactgtgaactcttggtattaagtactcagtaggagcaaagaaccatttggaatgtctgtcaatcttaaatagaactgcagctgtttggctgagaggtgaaatggacctggatttcttttttttggcgggggggctttgaaagtagtttttgtataacaaagaggtgatgagaactaaagtgattacaaaagtgttcataggagttcagtttctttccaggctttgggtttaagaatgactgtttctgcccatggggaaataaattggcatttttctgctttcgtttgttttttagttattgatgttctagaaatttcaacaaaataaggagtgtttttgtatttcaaatgtagtgcccgtttctttatttctttctggtactttccactggtttgtgttgataatatgatctggaaggtagcgataatgcatgggaatttataaatgatcacaaaatactttgtcacaggaaatctggagaaataatgactttggcatatgtataagagaagtatctctaactgttaagtctaaactaaaagcttgttacttttcggtttggtataaccaaaaaaaat

SEQ ID NO: 76758 - DNA, 4377 bp, Homo sapiens
gagcttgtaaataacctttatttcacagttcctgctgatactggacaccagtctgacacttaagacacttggaagcttaaggaactttttgttataaagaaaagcagatcaaggaccatcttatgcttattgggtgaatagaattgagatccatgcactacatatgacctaaattttttttgtttggttggttgttttttgagacggagtcttactctgtcgccaggctggagtgtagtggcacaatctcagctcactgcaacctccgcctccccggcttaagcaattctcctgcctcagcctcccgagtagctaggactacaggcatgcgccaccatgcccagctaatttttgtatttttagtagagacaggttttcaccatgttagccaggatggtctcgatcttttgacctcatgatccgcccgcctcggcctcccaaagtgctgggattacaggcgtgagccaccgcgcccagccatgacctaagttttttatggtagtgatagtctgtgttgaaactcttagcatttccttagaactatttttattccaaggagaataaaatcttaatatataaaatgaaaatgacatttgggttctgtgaagtgtaaaacggacctcaaatcaacaaggggtcagataggagcaaaatcgaaaccatgtcaattgcatcctccatatctttaaaaaaaaaaacaacccatttcttgacagggctcaaaatttcaaaatctatcagagctaatttggttgaggcttcatcctatggagatacacaaagattagtattgacttgtgtataactttaatgacactcttgatttggtccagttatgtagaagttagttggtaaaaactgttctacatttctgctttgcagagaaatcttgtgattgggttggtgtttttaaaacctgctagtcgcatctaaataagctggggaagatggaagagagcagcatgtgataaaatgttccttttttcccttcctatactattttgttaaaagccttctagaatataggtaccaaaaattaactcactttattctttctagttttcagtagtggggatctgttaagccttattatttaagaaatagatattaattcttatctttggtatttttctgatttgctttattgtaacaagagctgcacattaattaacacattaatcagtgcatgcagagatggttacataacagtctgagccatgaactcagtccagtattgaaaaataagtatctccagaagtaattcttattctagtatcaaacataacagtcctttaaaatttcctttggaatgttgaaaagagatcaaatgaaaccttcagaatggttatttatcagggaacaagaaacctccaatttcgttcacccattgtagctccactttctcattttaatgctcaatccacagtggcgatggtaaaagatgtcctgcaccttcagagatggcagtgggagaggggacatcacctttccatttattgcttgttgcaatttggcctgtttacagacagaattgctctgtgggttcttttagtggagagtggaggaaatcaagataggaacaagaaatcagcatttacacatgacccatgagttggctaatttttaacatgtagttaagaaatgattacagcctgcagagtcatgacctcaacttttcatcagctccattggattgtgcctcagtttggaaatgaaggaggtacacgggaagttttaattgtacctgtgtgatttatccctagtcagctctttaatttcttctggctgtctgaggtttccgacatgctgtaaatttccccaactttttcattatctgcaatttctttatgacttgtgaatcggagtggagagagagtgtggatttacagcagagataaacatgtccataaagtctgtatctgtgtcagtaattgtactgctgtcagtgactgtcctgttttacaggcctctcttgggaaaggaacaggcttcactaccagcagcactgaagtgcttgctttgatttgcattaacttgctaggagattaggtaggaatggtgggataggaattgatactggaccttggcctctcttgtttgtttgagatcaaatgacctcctaggataactgtgtgttgaagatagaacatggacagacaatattcatttcctaaatgaaaatgaaacttgaattgatatggtagatgtgaaaaatcctttctaacttcattttataatgtacctttaaggtgacttccctttcctatcactgttgataattaaacttaggttccctctggcccccctcccccattttccttttcttagaattaaaacacagggtttcacttttagagcactcatatctgctcaagagtgggccagctagagttaaggtgaagactacatctgccttatcttaattctcaactattattggctctttctcatctgcttaaggtggtgtgcccacaaccatttaccatgagaaaggcagtcacaaggagcaattcttaatataactgtctttaaaaggctctttaggatctctctctttagtgttttcttccttatagtaattttgaaagaaactgaaattaagagaagtcctttctaagtagatggaaaagcaaacacattgttttcttctagtacatttcatactcaacaaatccctcaagaattgaaactatccttgcataccctgaaccttctttgaggtagggatttgttgttgttgttgtcgttgttgttttgagacagagtcttgctctgtcgccaggctggagtgcagtggcgtgatctctgctcactacgatctccgcttcccgggttcaagcgattcccctggctcagcctcccgagtagctggtcctacagtcgcgtaccaccacgcctggctgattttttatattttagtagagacggggtttcaccatgttggccaggatattcttgatctcctgacctcatgttctgcccgcgttggcctcccaaagtgctgggattacaggcatgagccacctcacccagcctctttgaggtagtttaaaagcagagtaggtgacagaagagtttaacagtgaggggataagatgcatgataagcatcaacctatagtcagcccacaagtccaaataatatactgagcaattaagttgatttctccataagttctcgtctgcttacattcctttttgactgcaactgaccatagccatttttttttatcatgggagtgggaagattaaaggaggtgatgtgatacaaaattgtttggcatccttccagaagctgtggtgaaaagtgtggttaaaattgttgcaagaataagatttgaaattatctgtggttttaattccttatcacatctattgccatagtagagtttattcttacttaacaagggataaactactttatttgagcaagagggataatctcttcaggcccctttgtcagtcatttcttgtcctcctttagaacagggagttttttttttttaactccttaaaacattttttttaataacactttgttgagatatcattcacataccataaggtttatgtttgtaaagtttagtgttcattggtttttagcacactcaacaataaaaaactatttgggtatctaaactattgagatagttttctccttttctttttcagtccatgctaatggtattcctcatggagtaagcttgtgaaattacattgttacctaattctagtttgaggaaacttctagtgtatcacttgctatgtccaatgtagcaaacaaatacaataatctaaaattaacctaacaaaacctagagttattgtgctagtgctgtaactccttgttttaggaccttaaatttttttcttcagtgaatgcgcaagttgaaagtgcttaacattcattttgatgcagacctttattttttcttttattaattttatacaatctgattgtaagcacaggtttggaccaagttaaggagtttcacctgtatgcccagtcaatatgttgaaagaagagtgagaagtctagctgggtctgattacagaaataagctttctaattgcttaggttgaaaagcttgttattactaagaatttctcttcccagaaaatagtttgaaaggtggggaaagtatgtattctagcttcacaggggaagcatttttcttctgataggagggaaaatagtttatagttgtttgcatccatttctgctgctgtcagctgttaagttcagtaaaaacaagggtttaattagccaacagtctcacagtgttggaggaaaacgttattaaaaaagaaaagaacaatacaataaaatattatttggataataaattgtgtatctactgttctttgaaatgactct

SEQ ID NO: 76759 - DNA, 1808 bp, Homo sapiens
tccttggaactataattttaaaaacttatttcaaattatcaagtaaatgaatatcaatgccacaaataggtcaggaaagaagcccctcttcactaaattaagaagaaaagtcattaagtcttcttttcctccaacagttcattatgaaaaaattttgatcacccagcaaacccccctctgtgtgtgtatattttatatatgaatatatatatatatatatttttttaatctatattacgtattgatattctcttcttccttagccatttggaagtaaatttcagacatcatggcactttacccctaaatgcttaagaacacatctcctaagaataaggatagttttctatataatattatcacatccaacaaaaataatttaaaaaatctaatatattttcacattcagacctccccaattgtccctaaaaatcttgtgtagcatttttattaaaaccaagatccagtccaagttctggcattgtaaatgccattacattcttgataagagaacattgagcactaaattcttcacagcagctctcttttttttttttttttttgagatggagtcttgctctgttgcccaggctggagtgcagtggcgcgatctcagctcaccacaacctctccctcctgggttcaagtgattcttctgcctcagcctcccgagtagctgggattacaggccacgcaccaccatgcctaactaatttttgtatttttagtagagacggggtttcactgtgttggccaggctggtcttgaactcttgacctcgtgatccgcctgcctcagcctcccaaagtgctgagattacaggcatgagccaccgcgcctggcctcacagtagctcttttaataaatatttaccagctttttcctgtggtgaacatatatttactcaaatgactatcattttcttctagaatattgagttttgagttctctctttacaataagcctgctttatcaagctcctttatttctggtatcctctccttcttccaaatgaattacctgtagaattgatattttctccaataactactctattccacagtcagagtaatatttttgaaacacaaattgacatgtgaccttattcccttcttcttaaaatctgtcaacagcttctcattgttctcaggatcaagtcaaaaacctttaacttggccttacagctctgcctgatctaacgtttttcacaccatgctccctttctgagcatgtgttccgcacattcagaaaacagagggaaaagtgaggtaaataatccagggaacacctcttggaagagatgaaacttgaaatagaatttgatgtctaatatttgtatataagaggaaagaatacacttcagaatgggaaggaatttttgagaatggataagatattttgggggaaaattgataaattgtaacagactagagagatgagtcaaagtgatttcaagattttaagcccttgtgactaggagaatacaatttagtgtggaactgagatatgcattataaaacttcagttttgtttgctaaggtgttgttaaagcatctttgaaggccaacgtggcatgatcacttgaggccgggagttcaagactagcctggacagcatagcgagtctccatctctacagaaaaatttaaaaattagctggtgaggtggctcaagcctgtagtctctgctacttgggaggctaaggtgggaaaatcacttgagtccaagagtgaggctgcagtgagctgtgattgcaccctcaccccaccccctatcctctgcactccagcctgggagacagagtgagac

SEQ ID NO: 76760 - DNA, 3104 bp, Homo sapiens
cattagaacaagataaaaatgccctaaagcctcttatctgatgtctggtgtaacctgctgtaagcaggattgccattagtttatgttagaaatcaaatgaccctctccagtgcaggaagtactgattaaacctgaagtgtccccggaggactctacagctgtcagaggggtggtgactgtccgtcacgaaaagggaaatctgggccagaggtcccagtggggcggtgctttaagaacccgcacgtggctgccccagctgttctgctttgcctaatgaattgttttacaagaagaggctgggtattatcatcacaagctgccttccttagggactggagcaggccaaataataagtaatgttagtgatggtaattgaaatgtgatggctctcctgagatctttatggccctggagctggttggcacttgtggattgccttgtcctagcaagtgccttattttttttctgttttgtaataccgttgtgtgcgtttttctcttctgtcccccatggaaattcattaataaaagctatcgtaggaacattacaatgatgttaactacaaaaggaacagttttaactttttcatttcaattatcaaacactgtaatggtaaataagtggtttctggaggaaaccactgtaaagatctctctgtgcttttaaaggaatatgttaaacttatacaaataatacaagctcttgattttaagaatattttaaaataacatgaaaggatataaagtgaaaagtaaaatccttatctgctgaatttatgagcggtaactgccacgaacagtttctccatggatgcttccagacattttctgtacatagtaaagtttatatacattaccatacacagatgcaatcataatatacatactgttttgtgacttatctttgaccccacaacatgtcttggatatctttccacagcagtatacatagatctgcttcactgttttccaaatgcttcataggatttcactatatggatgtaccaattcaagactctttgtagatagtttgacttggaccttataaatgaagccttaccatacaagcaggttgcatccactgacttgtgttccatagttcaaactctgcttttacatgaagtgattttccttacttcaggaatgttacattttagtccagtattgttttaaaataggaaattctggaggtaaagcttttaggggggaggtagtgtgagtcttgtcatgcatcattagccggacatatgtgtagtgatatgcaccccactgtgtgcttttaatttgttgcttagttaaatgagaagtattctgtcccagataggtggggaaaacaaatagcctttgatgagtgttgtccaaggcactgactggcggcttcctctaaagttgaatgagtgttttctcccctaattttctacttcagaagttccaggaatcaagttttgaacgcattaatggacttgggaaatgatttgtcagcacgtggaaatgaggacttaggtttcttgtgtaacagcttggctaacaaagcaagtttgtgcctcatgaactttaagggccttgctgggagtggcagtgtgatgaatgaagcaaagcaattttccaggagcatttcaggtcagtgataggagaaatcagttgtcttctcagtcaaacagaaacttaattttagttgcatctgtcttaataagagaatctgtatgcaaattgaatggtagaaattccacatctgccaaagatgggagcattgcaagtcttttttttaactcgaagctctttagtcccattctcaacacttcaaaattgaggtttgaccaaatattgaagagatgtcatactactaaattgcaaaatgcaaactagttttgtttcagactttttatacagtgcttttcttgtccttgatgttagtcatttgaattgatgcccaatctttaatttaataattggaggctattattaataacaataactgatttacttcttgtccaagcctttattagattcatgggatgtaggtatacagagatttctggggctgttctgggctattggagatcttgtagacctaaactattcaaagcagtagccactaactgcatgtgtttgtttgaagttaaattaattaaaaataaaatttaaaatctaattcctcagtcactctaggaaatgctcagtagccatgtgtcgctaatgactaccacattggacagcactgctctagaccaaaggtcagcaaactatggcctgcaacctgtttttgtattctctgagctaagaatgttttttacgtttttatgggggctgtaaaagtaaaacaaaaacaaaaaacggaagaatctgaaacagactgaatgtggcccacaagcctaacataacatccttacgtcccattcatacttatgttatgttaggcttgtgggccacattcagtctgtttggttctttacaaaaaacctttgctcagccctggacctatgcttcctcttggtgacgttttggctttctgatcaaattgggttaggactttccataagtcatcagaagactaaatctaataagcaaatagacaaatttcagataaagtttcttactatagatagactatggaatgagtccagagcatacacaaatcagttccctgaagctaggacaagcgggatgtgcatttgaaataggaaaatagtttatagtataaattatcaatttcctacaagctttgtgcataacacctatagtttaacagaacatctttcttattttgtacactattttgtgtcttctgtgttctatactctcctatcttactctgacagaaacagaatgagcctgggcatagtggcttatgcctgtaatctcagcactttgagaggccaaggtgggaggatcacttgaccccagagttcgagaccagcgtggacgacatagaaagaccctgtctctgccaaaaaataccaataaaattagccaagtgtggcagtgtgcccctgtggtcccagctacttgggaagctgaagtgggaggatgcatttgagcccaagaagcagagcctgcagcgagctgtgattgctccactgcactccagcctgggcaacagaatga

SEQ ID NO: 76761 - DNA, 1050 bp, Homo sapiens
agtgagatcatggcagtatttgtctttctgtgtctggcttatttcacttaacatgatgccctccagtttcaaccatgttgtcacacatgacaaggttttattcttcaatttttttttttttttaagacagggtcttgctctgtcacccaggctggtgtgcagtggtacaaacacggctcactgcagcttcgaccctggggtcaagagatccttccgcctcagcctcccaagtagctggtgtgggagccacacccagctaatttttttttttttaattggagccatgggggttgggaggggtctcactttgttgcccaggctggtctcgaactcctgggctcaatcaatcctcccaccttggccttccgaaaggcagggattacagatgtgagccactgtgcccagcctcaaattatttttaaaccatcacattatttcagtctctcctaggaagaatgcagcaaaaagattctttttctggtattctcaacatctgagagattgtcttcccttagcaaatgtaactctaacaaattcttattaaatataaggtctatgaaatctacctataaaatgagcacctggcacttctgtggtaagtcagcttgtcgctttcaagacaggaccttgacattcatgaggtaactgcaaatttccaagtttgtgataactcatagtgtatcatttttcctctaaaatgtggtaaagtacagttaaaaaaattgttaccgtttgggcctttggtatgaattattctataattagaagtaagtaaagtattctcccactaaaataaatgttacactgcaatatgtttaattacaaatagaaatgttaactggaacttgtctgaatcttcaaactcaacatgtcagatgatcacgggttgtgtggttgagatcatgaagtgtgtactaagccacaaaaaaagtgacacttcaacaataaccttgaaaacaaggcacgtgatagaagagataagggagatcattgtgaaacagtattctgagagggaacctttgtgaagtgatcgcttctttctaaagaact

SEQ ID NO: 76762 - DNA, 1455 bp, Homo sapiens
aatctgactagagagacaaggcaaatgtataaaaagtttgatcacagtacaagagagcatgtactgatccacttgaggagcatagaagttgacagaaatgagagattacagtaggctaaaggtgtttggaaaaagtcttataaaaaaagtgggatataaacgaacaacaacaacaacaaatcctacatatcaacagtggcaagttggtttccttcttgctgtaagattccatgtaaaatgtagtattttatatagcagttgctatttgattaacctgcaaaaattatttttttctcatattcatttcccttgttagtatcccagtttgttaggttagacagaaaaaaaaaattgcttgattgtctattcctccacatatagatcagtatgttaagggggcgaagtaactttacatcataatttggccactgggccatgcaacagcctgtctagctttaccctgctaagcctagaagtggcaacaaagagataagaaagccaccatcaagtgtctgtggcctagtatgaatttgacctgcaccttgacaatgattttgatttcagctttccatggtgaatggatttactacctatcagagtcacaaaaacccttaatttttaaaatattttggggtttttcttctacatgttaaatgttaacttcctgtgacaggcggtgatgatttctgaattttcagtgggcacaactcattattgaagcactgaagtagttggttactattgcagctaattcttatttaaatgagcaagagttctttggaaagattaggcagcatggttttaaaaattcacagcaacactgatgtatatcagttttggcttggcaggctttgacccagggccgtgcagtgttttataaccctcagctacataaggacacatacttatagcatcacttttgtagtggatatttttataactctacaaaacgattagactgacgtaaagcaattctctaaattcataggtattaaaatattctggcagctgtctcctttttgcctttaagttgagacatcatgatgagataagactgcaccaggcctgatcggtacatgaatgaggttatgcgtggtattctcacattattgacaagggtctttgtcactataaataggagaaatctttggggaggggttgccattatagtaattccgattcaattccagcaatattcttgtttttcataaacttttttccttcaaaacacattccatgcaatcagataagaaagaatgatataaaaatgcctttgaattctaactaaaataatttagcttatagttgaaatatataatatctttatctgggagtctgaggtattgattagggttagagaatgtttaggagaacctggatgaaagaaacttactggtaaattggctgtaggctacagtgacatgggatacagactcttctgtttgcaaaatagtc

SEQ ID NO: 76763 - DNA, 3215 bp, Homo sapiens
taaataatgcaaaaatttattattgataaagaacatagtagaatactgtatagccatgaaaatgaaccagctcttgctacatgcaacaacatgaatgaatctcaagaatatatataacattgaatgatgaagctagacacaaaagagtttatattgtacagtttcatttctataaagttcagaaacatgcagagctaatccatggtgatacaaatccaaataatggttgcattggggctatgatgatggctgggagggggcctgaggaagaggcttctgcagtggtggtaatgattctctatgtacctatatgtggttgttacacagtatatttatgatttgtacatttttctgttcatatgttatacttttttaaattaactaaaaaaaatttaaagacaaatagtgactgagataaaaatgaaaatgaatacactctaagggctaatagccagtctgaccttaaattgaagtggtagcacttaaagcctttctggtttgatatgggaagctcatgaaaaaaggatattgagcatcagtagttttccagccagttaggaaaagatgttgaagatgaaggaaaccaaccctcccgcccccctgctccaagctccagatttcaaaatatttcttgagcaggccttatataatgggatacgagtagctggaattgttttcgaagatatttttgtcatgggcagctatgaatgtacacaaccttttctgccttagaggtttgttttttaatataaacctccttaaaatacaatttttatacccagagagtcattaattgaggtcaccggcatagagaaagggtggtgatgaatgtgattcagtagatggcagtattccctttgaagtttttagttaaaatgtgggtgtactggggtagcaacttttttcggtgggaatgaagaaaagtcacatactgggataattagaccagaaagaacattttattatttttttccatatgtggtattactattgtgaatgaagcaataataaccacaacatacagagtaagaggaagtttgtttaatgtagtattcctttaagtgggaattattggatagaacccttggaaaggatttggccagtgtctttttttcctgtcatatatttaggaagattgagataatgactaactgctttatacaaagatgtcagtgaaatttattaatgaggtgattaggatgcagttgagcagaaattaaaagaaaaaagtgattgaccagtctgtttttgctggttattttaatataaatcaaatgctatttgaatagattctcttttttaatgttgaaattgtcttataatagtagtgcttggtgggctttaagactctttgccatatgggggttttaattttaaggaatttgacatcgattatagtaacatgccatagaagtcaagagttatcagccagttaaaaggacgaaacatggctatcgtgcagaacaagagatcaattaacaaactaatcagttggagtcagaagaactacatgcaagtcctgactttgctccttattaggtagtgaccttgggcaaatcacttaacctgccattttttttttctcatctatgaaaactataggtgataagtaactgctgtgccttccccacaggttgttaagttcatcaaatggatgcattgtcttaaattaagtgtgctgttgttaggcagggcgaggtggctcacgcctgtaatcctaccactttgggaggctgaggtgggcgaatcacttgaggctgaggtcaggacttcgggaccagcctgtccaacatggtgaaaccccatctctattaaaaatacaaaaattagcctgacatgatggtgcatgcctgtaatcccagctactcgggaggctgaggcacgagaaccacttgaacccaggaggcggaggctgcagtgagccaagattgcaccattgcactccagcctgggtgacagagcaaacctccatctcaaaaaaaaaaaaaaagaatgctgtgttaatggtgatggactctacagatgggctctacattgtttttatactgttcaattaacttttgtttcctcctgttctgcctatagtcatcaggtgcttgctaagaaacattgataatcattgcttcaatagccatcattatgagtacctactaataggtacttcattcactaagtgctttaggtacatagtctctaaagcctcacaacagccctgtaagttggaacattgtcgccattttacagttggcaaaggtctggactagcccaagagctgtgaatcaatccaagccatctgactccatagcctttgcttttagtttattatgctatgcctgccattatgcacttgagttttgacttttctgtatctagtattttagaagccagggccagctgggcgcagtggcttacgcctgtaatcccagcactttgcaaggccaaggcaggcagatcacaaggtcaggagttcgagaccagcctggccaacacaatgaaaccccatctctactaaaaatacaaaaattagctgggcgtggtggcacatgcctgtaatcccagctactcaggtggctgaggcaggagaattgcttgaacctgggaggcagaggttgcagtgagctgagatcgcaccactgccctccagctggggcaacaaagcaagactctgtctcaaaaaaaaaaaaaaaaaaaaaaagccaggaccatagatagtatttttatgtatcagatacttaaatgaaagacactgagccttagtggaaaaatttattattatatttccctttggagttaacagaatcctagtgcgtgcaattactaatttgggagtgggaggagttgtgctcctgacctgagcctacattttatcattaccagagcacatgcagattgtttcttgaagattcagacaaggagaggaacacagtaaaggatgtaaagaatgttaatgtctggtttgaggatatgttataattttatttgcagatacccctcccaactatattttaatgttagaactagttttttctttgtgtgtgtatgctttatggcggtttcccattcattgtaatagtcattgatattttgcatggggttatcttctagagaatacatttaaaactggtaactaaatatgctgataactaaatacatttttgctattcatattaggttaaaaataaataagtatatatgaacattttcatttataaaca

SEQ ID NO: 76764 - DNA, 2648 bp, Homo sapiens
tgtgttttggccagcttctgatttagtttgtaaattgtcactagttgtttttcaataagttgtaaattttagaatatttttaaatttacaggaaaattaagaaggagcgttcccatataacccacatggaatttcccctgttgtcgttagtgtggtacatttattacagttaatgaaccaataaagtccatactttattcacatttccttagcttttccttaatgtttttttttttctgttccaggtcccatctaggatactgtattacatttagttgtcatgtctccttaggcttatgttggcatgacagtttctcagactttccttgttttttgatagccatgacagttttaaagagtacagtcaggcacattgtagaatgtccctcagttgggatttgtctgatgtatttttcataattatggtttgcctttcactacataaaccaggctatatgtggaggttgttcttaatcataatgagctctataaggaaggcagattaggattttaaaatattggctgtggttaaccaaagataaacattaacatcattctttgttggatctgaaacactggctacattttttatattttatcatttttccgaagcagccagtcctaattctggctagaagtaagagtctaggttatatgatctgctcatatccctgaaacagtttcttttctaattgcacctattggggcagttgggatgggttttaatgttactcctaagagctttatttaatctgtattggccttttaattagtaatgggcaattttgggtgaattgctaattgattagagttgcggaaattatccacaaagctgttttgtccctgcagcctagaagacgtaagattaaaacaggatcgggtttagttactagtgtaagatgaatgcttgaaaagtattattttagtggctttggtttgtgttccggcctggtgttggttttaactctgctaagaattattgtcttttaactcactgaggtcctcaattctactccattaagggccacttttctgccaatcaaaaagcagcatccctgagattgatttttgttacagtgggtagtaatggctgcctagtgacaacatttcaaactcttttatgtaaacagaaagcaatcaaataagtactaatccaaggattatgtggacccaaatcctgtggccaaaagaatctctgcagtgtatgtctctggctctttgccttctagtgccaagcagcccctcttcttcctggaaagcttgcttgttgcttgtgctgcctgttagatttcagtgtgctaaaaccaaaacactcctgcagctcctgaatgaaattcaaaaagacacttacatttccataaataaattaggaattcagtggtttctttgggctaatcagggcaggctgataaaccttgctagctgtttaataaatgaattgtgacctattaatatggacgcctcaggaattcaccctggtggaagcagagcagtgaaatagagaggggcatggccccttgggaaatcagggcttcatgtttgcagcttaaatatctctgtgaagtatcaataaggaggtaattgaattttgaacacaaacatgagcgccggatggatgaaagggggtgggggatctgatcgtctcttctctgccccttcattctcccctccccttttccttggagaccactctagtaaagatagatgctaaatccattaaataaagattagactccgtcgtagtagaaaatggcagcttagctagatccccaggcaaattggagccttttgcaatacagaaaattaaaatatacatttttaacaagtgtgctatcttcctagcaataatgctaggctagcttgtggggtttactcctccttcagattggcttttgtttgggcagatcactttctcttgtattaatgccaatcttttctgtattcctggaacagaagggactgggtttatttatttatttttaaagcttctgttgaggcctttcctctagcatcctgcttgcttgtaatcagaagagtgggaaggagattagtgtcccatgaattgacggtagataaatgttccctccccttcactggtgggtccagaagagcccaatcacttgtatttcagggatgactggagactgtacagccaagcaagaaaagggcttacagattgaaataaacattgatgttttagatgcaattttacttggctttatttcctgtagataaggttattgatttgctttgtcctcctattttaagccaggtaaagtcatattaatgtaagaaaaaagaattggcattatttggttacagatcataatactccttttttagcaatagcagaaaacaaacatcaagccttaaatgcttttgttatgttgatgcgaatgcccagtattgttttttttagactaacccttttttacatgtcaatctacaattctaataaccctttcctatagtcagtctgtctatcaacaagtataaattgagcatctgttaggtgtgtagcatggtcaatggtgagaaaagtctatcctctactaccacagttacttcttttctttgttttttatggttttgttttttgtttgctttcattgtttttaattgacacataataattgcacatatttgtg

SEQ ID NO: 76765 - DNA, 1001 bp, Homo sapiens
tggctaaccacagatacttctttgaaaacaaagtgaatcatggcatactcctgctatatatatatatatattttttaattaatttatttattttagagacagggtctcactctgtcactcaggctggagtgcagtggtgtgaacttggcccacctcagcttcgacctcctggactgaagggatcctcccaccttagcctcccaagtacctgggactactcaccaccacacctggctcattttttgatattttttttttctgtggagatgggattgctctgtgctgcccaggctgggattacagggatgagccaccgtgctcagcatactcctgcttatcaaagttctatgtctccttgggtcctacaagataacattcaaattctcaggctttcacaaagtgccttcctgacactgatccaggctttccgtagtgtcatcattctatgggatctacacctgaggctctggggatttcctatggaagaacaaatgtggaacttcttggtctcagattaagggctttgtgcatcatttgccagatggtgtttcaaatgttcacaattctttctttcaacttcaggggtatattgttgttcagattttcaacaatttgcccttatgacattcactttataatttaactttgtttgcagcaatggaggaaacctttcttgttaagacaattaaggtgtctatgctttctatcatcactgctatatatatatatatatatatttttttgagatagagtctccctctgttgcccaggctagagcacagtagcgtgatctcggctcactgcaacctccgcctcacaggttcaactgattcttgtacctcagcctcccgagagccaggattacaggtgcgcgtcacatgcccggctaatttttgtatttttagtagagatggagtttcaccatgttggccaggctggtctcaaactcctgacctcaagtaatcctctcgcctcagcctcccaaagtgctgggattatag

SEQ ID NO: 76766 - DNA, 1472 bp, Homo sapiens
ttctatgacttttatcagattttttaagagatctctgttatggattgaattttgtcccctgaaaaagatatgttggagtcctcttccttatttggagataggctctttacagaggtaattaagttaaaatgaggtcattgtgtggggcctcatcccaatatggctgaagtctttatacaaaggaaaagtttggacatggagacagacatgcatagagggaagacagtgaaaagagacacagggagaagatgccatctacaagccaaagagagaggcctggaacagagctttgcctcacagccctcagaaggaatggacaattctagcattagctcaagctgctgtatgatgtacttgtgtgaaggattatttatgggcccaaatacccttctctctataggagtttataatctctatagactaaaaggaattaggtccccaaggttgctgccgttcttagcctagatttaaaaacctttaatttttcactattttatgtagttccatatgcatatggagatttcatgatcattaggtgaaaattactctttaaattaattattcatagtaaagggaaagggtttgccttttgaaaaaagtatatcttttccatttttctaagtcttctacagtttaggccataccggttttcagaaatcccttctagttaaagtctactaaacactaactaacttactctttactttctcaagcactaatggaaatactggattataaccaatctaatactctctgggcatttctactagacactttgctcagtgtgatttaaggcagtttataatcactccttgtggtcttgaggccagttttcaattcatgagactcatatatcctagctagttttaattaattttgcaaggaagatgccaggagaagcaatattaaatgctttcttataatcaggttatttcatcttttgcgttctcgtcagccactaatcttgtaattttatcttaacaaaatacagaacttgctttgacatagtttgttctttactcatcatgtttttcagtacatagaacttatggtttgggtaaccttatattcatgattgtcttaacattaggatttggggatagaccttaattagtatcacattgtgtttcatatatttggtcttttagggtaatcatattagccaagaacagtcaggagtaatttgaacagggaaaaatttatttatttatttatttatgacagagtctcactctgttgcccatgctggagtgcagtgcatgatctcggctcactgcaacctccgcctcctgggttcaagcgattctcctgcctcaacctcccaagtagctgggactacaggcatgcaccaccatgcccagctaatttttgtatttttagtagagatgagattttgccacattggccaggctggtctcaaactcctgacctcaggtgatccaccctccttggcctctcaaaagtgctgggat

SEQ ID NO: 76767 - DNA, 1203 bp, Homo sapiens
cctggcctatgtccagaaattcttaacatgtaacccaattcactcaggttttagattaagtatgtttccttttactctaaatgctatttgacaagtgaagtattgtccctaatactgcacctattttttcttttttcagtttttatattttttatagagatgggggagggtctcactatgttgcctaggctggaattgaactcttgaactcaagcagtcctcctgcctcagcctcctgagtaactaggaccacaggtgtaagccagtgagcctggcttcctttcttttacttacagttattatattccatttatctaccttgactacaccatgggcagttgggcagtgatctttgttacatttcagagggcagaattaggaacaatgagaagttagagagaagttggattttgttttggggtttgtttatttgttttgccacactcttggaagaactttccaaatgtccaagaattaaatggaccctcaagaagtactgagtttcctatcagtggtaatgctcaggcagagctctgcaattaactatagaatgttatgagatactgcaggttattaggtgggagtttagatcagatattcttttcaactacatgaattaaggattctattatttttgctttcaacagaagatatacaaaataaacagccagtgtccatcttgaattgcaccattgtttataatatttctgtttttttaatcttacagtcctctctgttataacagttattacttattaatggagatagcaatgctattagtacttgtattgaattagtaagtgttctgatagaaaaattaaccagctttgccgggcgcggtggctcacgcctgtagtcccagcactttgggaggctgaggcaggtggatcacgaggtcaggagatcgagaccatcctggctaacatggtgaaaccccatctctactaaaaatacaaaaaattagccaggcgtggtggtgggtgcctgtagtcccagctactcgggaggctgaggcaggagaatggtgtgaacccaggaggcggagcttgcagtgagcagagattgtgccactgcactccagcctgggtgacagagtgagactccgtctcagaaaaaaaaaagaaaaattaaccagcttttcaaacagcatttagagtaaaaggaaacatacttaatctaatacctgagtgaactgggttacat

SEQ ID NO: 76768 - DNA, 1045 bp, Homo sapiens
agttcatggctgacatgatggaaggaataagcagctctgcctgagtgggggtttcaggaaaagcttcacagaagagacactggaagctgggtcttgaagagcacataaaaatctgccagatggacatcagcagtactggaatacgaaagaggggaggagtgatgggcctgtttaagtaattagaataacgtggacaggaacagaagtgtgaagtcacatggtgcatttgaagacctgctagttgttcctgtgtagcaggagcatatggaagaaaagcaagagacaaagttgttcattagatgtgagctccatgagagccaggacctcacctggcccattcgttattgtatccacattgcctagtgcataacagatgcttagtaaatatccagtgaataaataaataaagaggtaggtaagggccagatctagaagtgatttttgtctaaattccacaaagactgactttttttgctcttttaggacttgtatatcttctataggttcttaagcataattattaatgggcatttgtgtgtttttggggtaaatatgaactattaaattatttgattacctgccagaactcgtagtgccacattttgccaaattaccaacctcaaaaaaaaaaatggaaataatttttattgaggtgaactctataataccctgtttaactttatagaagttgccttggagtttaaatgttccattttctccctgattaaaaaaggaagagatagaaaagttagaggtttttatttttttagtttgatgtttcatattagactacagtgtgatatattatagtttctataagcagtagaaactataaagatagatataaactgtccagaattaagtactgagagaaaaatattaaaagcaaaattaatagaaccttgatattgtgggacaatatcaagcagtttaacatacctgtaactagagttccagaaggaaaggagttaggtacaggccagaaaaaaaaaaaaatttttaagacataaatgatcccaggcatggtggttcacacctgtaatcc

SEQ ID NO: 76769 - DNA, 1063 bp, Homo sapiens
gaatttattgttcagtcaggttgagaaaataagccatatttattgaaaccacaatgcaaacaattaaaaatcaaattatcagttaaattatcagctaagtaatgtagatgctgatttgtccaaatcagccaagtaatgtagatgctgatttggacaaatcagcatctgtgaagtaaaagaatgatcgcagtaaaattggattagcgaggtcatcatttacatatacagttgttgatagtgtgagggcaaagtattaatagtagaaatttagttagactagtggaattttaacttaagctattcctttttgtgacttgttagctatcaaactggcctggacctgaaagttagtcttgctacctatctcaaaagcttcttttgagaagattcagtaagtaaccaaggactctttctctccacttgccagcaaattttgtagaagcaacatgttaagccgggcagtttccctcatagttgttttatgggcaaagtgaaaattgtattcttagattcatcagtatgatttcttaaatatttaagagagagaaagcttggaaggtagtagctccttattattaggcttaacctgagtttgatttggtagattttaaaaaatatgtaatctgtgtttgattcttggttgtatgtaatttgttcctcatctaaagaatttaacgatggaaataaacattcgtgacatgaaaagttacccttctctctctctctctctctttttttttttttagacggagtctcactctgtcgcccaggctggagtgcagtgacgcgatctcagctcactgcaagtttcatctcccgggttcacgctattctcctgcctcagcctcccaagtagctggcactacaggtgcccgccaccacgcccggctaattttttttgtatttttagtagagacggggattcaccatgttagccaggatggtctcgatctcctgacctcgtgatctgcctgcctcggcctcccaaagtgctgggattacaggcatgagccaccgcactcagccaaaaagttacccgcttctaaagctttttctgtccatc

SEQ ID NO: 76770 - DNA, 1773 bp, Homo sapiens
tcaaatctgtattcttaggttgtagggttccattaaaaaaaataaataatctcagcccctcctccctccacccccgtttccccccacactcattttgtataatatggtaatgatatcaccgtagcagtaattacgggtcatcttcatttctttcatctctgcctgttctggtggcttcattcctttgacgggaaagatttggctctgggtgctatgattattttgttaagcgttattcgaatagacaggagtgagagaaattaatcaatccaaatgcaattagcatcatgtttaacccagtgatggacgtctcaaggtgaaacagccaggggagtttcagacattattattcaatccagtggttcttatctaaattataatcaagagaggtttttattggcttctcagtgtgaagatgtaaccctttcccttccctgggggtcaagaagactaggccttcatcatccctagacgttagctgttgccagctgccagccccttgaagtcagatagacagggcaggaaagttgtctgaatatgcaggtcatttgaaattatctatactgtgatcctggtctgattttcctgagagtggaacctagcctatgaataagctactctgtctaacttggggcaaaatattttgtgttctgatcaagtcactttgactagttgttgttcttctatcttaaccttacatgatagattattattgctgttcttactttatggatgaggatattaagtctgtgaagctactagcctttggtcataataagtgtttcaccaggatgtattactatgtaaaggccctgaagcatgaatgttctgcacaaatttatgagtatttaataaaagttctagcccccagagtattaattcattgctctgatctcattgcctttcattcaattgagttgtacccttgaaaaggaaaccaagtaaaactatgaaatagacctgtcaggtcctcagaaaaggaaacaaagtgcagctaagaagttgttagctctcatttctcgaacacagatctttgggggttttttgctgttgttttggtttgtttctagtaggaagaaggatgataagaatacatatttgaaatctagtcttgttttgctcttaaaagagggcagagcaaggagagttgatggagaaacagtctttcacttgaatgcaacatttttcaaatgcctgacaattaagattcttctacttctgccttcaatcatcaggcatcatggctgacacttcccatattttatgttcctgcttgatgttttatattctgaaaataaatctgttggttggatatttctgtccttttttttctgttatgaaaagccattaaaattattttccatattggaactgtccaaatttgtttacctgcacattgagtcctggcttttctttttcatattacttcttggataaaacactgtctgcaaatgggtgttactatgaattgaagaaaaaaagtttgatataaaattatctttctcaggctgggcatggtggctcatgcctgtaatcccagcactttgggagactgaggcaagaggattgcttgaggccaagagttcaagaccagttcaacatagcaagaccccatatctacaaaaaattaaagttataaagtaaaataaataataaaattttctttctcagcagtcactggagggaacattgttcttggccactgcacgcttttggaagaatcctgataaagagccaagatacccaatagaaagataatctagaaagtgtgct

SEQ ID NO: 76771 - DNA, 1046 bp, Homo sapiens
gttactctaaaagaaatgaatcttagatagttttcccaccaggcatcctattgcttaagtaaactttctgtttgaaatgaaacaaatagttttacagtagctagcatttattgaatgcctgtgtgactttgtattaatcctaccttgaatgaatgaggaaaggagctcagaaaaataacttggtaatttgcctatgtggcccagggtcaatgtaagagctgaagtcctgctcttttcacaatattacattgtctcctttgtttcctggccactcatattacaatctcctaaaagcaacctgttattgctcttctgaatatgagaaacccagtggaaagtaatttgtccccgcttcacaaacatttttaattatgttgaggcatagaaatatttaaagtagtttgcattggaattgaaaaactgaactatgagtttcttccacttcattaaaaagtttcttaaaatttacattgttccctacataaaagctgagcagaattttatcaggcaattgcctcaaagttataatctggacaatctttctgtaataaaacccatatgtcattggggaaaggtgcagagccctggcagagagggctggtcttgagagaggttctgcacccaatctcgttaaccagggtgcctctggtaatccctcatccctcaccagtgagaaatcaatctgtaccactgaatctttttcaaccagccaccagaaaaatttactgcagagaaggcagtttggggatagttatcgtggaaagtgagccagaagcaaggctaaatgtaggatggaggaattggagagtctaaagaagagattatattaaaccacacaccactttcagagcaggcacagtggagtcctcctttcagccctgacctctccaagtatacccaggtatttacagctgccatgaactggatagccctggaggaactacgaaagtggtgggggataacagaaacagtggaaacctgaaagttgattgtagtctatccatttgctgtctctcagtgtgtagtagccagtcccctctccacac

SEQ ID NO: 76772 - DNA, 1772 bp, Homo sapiens
taccaagctacaaccattgtgaagaagaagggacagaaccaggcagtggggaatagaaatggctttctcttctctgtaagcaggcagtagtcatctctaaagatttttccccaaagagatttgaaattcctgatgggagcttaaaaagctaagagtaaaatacatttatttataagaccctactagaagaggtgtgtgtgggtgtgtgtgtgtatgtgtgtgtgtgtgtgtgtgcgcgtgtagacgaggaatacagaatagtagcagaaggctgtctccctactcctaatgggattttgtagcagtatgtgcaagtttgtttcagaagtcaaaaatgaacagatgttagtataaattacctctgtgtctgatgtcttgcaaattaaaagcgcagttggcatcactaaacaatttcactaggtttgggggggttcggttagcgggcggtgattactgtagcaggtcggtaagaatcttcgccctgcagcagagcaaggataaagaaatgaggaataaaataagggctatatgaattaatcagaaatgttaacatctctgatgacaagtgaacaggagggcacgtgctctggagcagcccctgacccacagcaatttctctgtgcacaaaaaggggttggtgcttagcatctgatttatagggcacagccctcttttagggagcggctgtgtcatacattcgtatatctcctgtatgggactggcgagtaggaaaactttctctcctcccatgtaggagatgatgtcttttgaattacttctacttttacagtggtttcctgcagctctgtgtacttggattaggttgaagggggaggaatgattgagtagaaaaagggttgttaaaaaggattggttaaattcaaggagagcttgccactgagagacttcagaatatctatttatttttccttttaaacccttttgaccccttaaattgtgtggatcttttaaaattctaagtcttaaaatattggtcattttcccatttggggaaaaacagtaaggagttggtgagtctgaaggtcagcaggcagaaatcattggttagagcaatgcagtgctccaggcccaggatttttggaacaaggctctattctctccagaagacttttgtattgaccgtgtctggtttccagagctcctgcttctagccatgttgcaggatcattagttacatgtttaaacttgagagtagacagataacccatctagtagaaataagtgagacccaatctgcccaaaagtataagtaaatttcttttccttcaagctgagggaaaagattccaaggaacggagttttgtttgctagcctccctttgtgcagtttgttcattcattcattcattcattcactcactcagaaaatactaagtgcgagagaacttacccccctctggaaagtgttgtgttaatgattagcactataccaagcatgttcattgctaatatccaagagaaaagtagggtattaacatgctctccgttacaaatgaagagactgaggctcagagatctgcccagcccaaggtgtcaccctgctgctaagtgctagagctgaaacttaaactgagttcaaatcctgtgttctctgcaagaagcccatgctacctcctatgggcaagacagtacttgattggattttctctagagtagttagtccttgaccccagtctctccatgaacttggcattatttgcattaagggaaatgattttcttgccaaataagcaaggcacatttaaaaagact

SEQ ID NO: 76773 - DNA, 1024 bp, Homo sapiens
ggatactgtaatataacagggtttatattccctcagtgcagttcatctgtggatggtgtcataaagtagggtttatagagctttggtcttctctcccttggcattgtcagtccttagctatttaatatagccagccaaggtttatgtgtctttctccggctttcagcaccatcaatctttgaatgctatagttacaagtgggtttatacagctactttcctacatataaggctccaaaatgaaagtaaaacatttctcaattacaagggctactccagaggtctcccattttagatctcagaaagcatacgtagtgtaacagccccttcctcatcctcatcctcatcctgcaaggccatgttttcagatttcttaaatggatttaacagtgcagaaagtttctgatcgctgatggctggctctggaagccaggccttctggaaccatgcagtaggcacggggtaggctgtgtggtctcccaagaacacatctccgtcctggccaaagaagtgaggtggctagggaggcactctcaggaatgagaaggaccttcaccctggcctccttgttgcctttcccaagtccagagcaaatggagctagatgaatggcctccagctcccctctgccccaatttaagtttaacagtttcttgttttcttgtacaatgaagaaataaaaactacacaacctctgggaccacagggaggcttttgtaacttcagtctatacattccccatctttcactagttcctgtgccccaacaaagggaaaggaaattccattaactaggcatagaagcccagtgttgggtcttgcctcatgtgctcacaaccccaacccagaccaaatcaaacagaccattccttccttcatggatttacagcaaatcctgtacaagaaagttcccataagacttgcatgcaattactagcttatatggttgtcttcctccactaaaatgtaaaaactgaaggcagagactgttaagagctttggtcttctctcccttggcaaaagatcc

SEQ ID NO: 76774 - DNA, 1800 bp, Homo sapiens
atcattcttaaaggtcgaagtcctgctttctcatttctggaagtgattcaggagccccaggatcttacggttgatttgactcagtcatggcagtcagttgtgacatgttgattggatgggttcttttgaattgttcttgatctcttagaaagtgtttacgatgtgaggagaccagagaccaagtagattctggaccagaccatgcagcctgacctgtgaactctccagtatatactaagttcccagaatccccagctgaagaaaccagaatcttctcgaaatgtatatctgttttttaaaacttctatacctcttatgatagtcccatttgcttttcattccttacttcccagccccaccttctagttctgacttcgggcagagggatccctgagtccctcctggaattagcttgtatagtgaaaggcccatccaaggttgtctaaagaccaatgtgaaggtgacagaaaggacttttgagttctaattaatctgttacagcttcaagcaagaaagtcagtatagcctgaaagacaagagaaacgggatggtttataggagttcccatttggttgaaagctagaagccctaattgaccttaaagtaacatgctatgggatggtgggattgtcccctctgacagcacatatgaaatagttcatctatataatagaaacgcacacacacgaaaaagaatcttctgacttaaatacaactttcatggagttcttcaccacttatctgtctctgttaaaatctgaaaatctagcccatggctaaaatctattatatgtgttctccatatttcttgtataagccagtccccagcatctgatgttttgagaagtgcatggagtttcctaaactttgcacaaaagaatatcctggggccgggcatggtggctcacgcctgtaatcccagcactttgggaggccgaggcaggtggatcataggtcaaaagatcgagaccatcctggccaatatggtgaaaccctgtctctactaaaatacaaaaattagctgggcatgatggtgcatgcctatagtcccagctacttgggggcctgaggcacgagaatcgcttgaattcgggaggtggaggttgcagtgagccgaaattatgccactgcactccagcctgggcaacagagtgagactctgtctcagaaaaaaaaaaaaaaaaaaaaaaaaaaaaagaatatccctgtggcaatagtctgatggtgtttggacacaagaaaagttatggttttgagtcgtgagtgtttgctagggcatggcactcttcagtttaacagctgatccattaaaccttttctgacatttgtgccttgttctcatgctagaattaatgctggatttttctctcatttgaccatcaatgtagttttacttattgaaaggaaaaaagacttaacacaagataggaaagatgagtatgagaagtaaaacattctgctggggtgctacatagaaggttaggttgtaggggctttgattttaatttaaacttattatcgattgatatttctgtatctcactaaatgcggttgaagagtgtgtgtgtgtgtgtgcgcgcgcgcatgtggccaaaaaatagtgccataatgtcaaattcttcctttgctctgtttttgagagttgatgacatcaggcacttttcagtgtttggggaaattgattgggatacctcccccaaaccaactcaagtctgtaactggaagccaggtggttggttttctggtccgctttgtcctctttcttttaccgtcatcctattcaccagcacttaatgtaag

SEQ ID NO: 76775 - DNA, 1047 bp, Homo sapiens
tgacagtctcctgcccatatttctaagctctctgggtctcgttgtgctatttctctgtcctctctggggtttgtaacaccaatcatctgcaggtttcattagcatgctgtttacccctgtctttcagatcattaatgaagatgtgaagtgagacaccaatcctcacagcccccaccacgtgctccctcccatgcctggcgctgctggagtcattatccttcctggtgtgacagggtcagaaccaaaccaatttgcatcagtctttggtgatgttgtgaagcgtcgcctgccctgcaatcctgctgctgtaacaactgcttcagctgtctgttctggagtgctcttcgctcctttggaagactgatcagatctggccaccccagttctggctgaaagccctagagcgaccgcaatggtagggcaggattcagggctacacatggctgacattgttccttcttcgttttgctcttctgagctggacagaaagcagtccctctttggaaaacaggatggacaagtgcatacattagtggaggacgcagcagatgtggcaggcatagaattttactcattgctccatctatttctatcaaggaaaatggggagtgctcccaatttccgcccattttctagcccaggcctagtcagatgtgtgggcttgtatattctgggaacctggggctgatgtggtcaagtcacttcttggggacaaggtcaattcttctccattttctcatgtcatttggtcctgagggttttatatcttctttagcaattccatgactatgcttctcatcctgcagggaaactgactttatatacacacttgtctcccaataaaagtgagaaccacctcctacatatcccttgtgtcttccagactccaactcagatgaaatgcacttccttctctttcctgattgtgcagcgcctccaactggttgtttgtgatgaaaacatgagtataattacagactcttctctgacccatttctactcctgacccccaactcatcttttcttccttctctccaattgggaagg

SEQ ID NO: 76776 - DNA, 1012 bp, Homo sapiens
cacttttattgggagacaagtgtgtatataaagtcagtttccctgcaggatgagaagcatagtcatggaattgctaaagaagatataaaaccctcaggaccaaatgacatgagaaaatggagaagaattgaccttgtccccaagaagtgacttgaccacatcagccccaggttcccagaatatacaagcccacacatctgactaggcctgggctagaaaatgggcggaaattgggagcactccccattttccttgatagaaatagatggagcaatgagtaaaattctatgcctgccacatctgctgcgtcctccactaatgtatgcacttgtccatcctgttttccaaagagggactgctttctgtccagctcagaagagcaaaacgaagaaggaacaatgtcagccatgtgtagccctgaatcctgccctaccattgcggtcgctctagggctttcagccagaactggggtggccagatctgatcagtcttccaaaggagcgaagagcactccagaacagacagctgaagcagttgttacagcagcaggattgcagggcaggcgacgcttcacaacatcaccaaagactgatgcaaattggtttggttctgaccctgtcacaccaggaaggataatgactccagcagcgccaggcatgggagggagcacgtggtgggggctgtgaggattggtgtctcacttcacatcttcattaatgatctgaaagacaggggtaaacagcatgctaatgaaacctgcagatgattggtgttacaaaccccagagaggacagagaaatagcacaacgagacccagagagcttagaaatatgggcaggagactgtcaaatgagactcgtcctaggaaaatgaaagtcgacacgtcagggaggaatgatgaaggtgcctctgggtgggggcctgcaaacctgaaaagcagagatgggtggcagggtcaggaggttgagggatatgataaggtttggggtgtgttggagggagacagaggagc

SEQ ID NO: 76777 - DNA, 1108 bp, Homo sapiens
cggccctgttaataccccacttctcttacgtgtctttgctgaagtacccacaagccctcactccctgcccactctctccctcttaaggtcagggcagacacctccatccggacccttcctccctcactgccttggcttcctctactcttggccttgggactgccccacctgaactcctgggtcggcccagccctcccctaggtgatcgcctcagcctacaggggccgggagagctggggagggagaagcagcggcttgcatcacctgaccctactcagccaattcacgaagacaagatgtcaagttaatgagcctgtgggcctctaattagctgtcaattacctcaaattaatcacctcctcgcctaattaagcattatcggcaggtgggcacaaagcagaccattgtgtgagagccatgagaaaagctgggctggcaaacttggttaggatcagctctgtgcactgcgcccgcctccccacagcgctcagccatgggcccagctgagaggccctggggccctctgcccaccactgtccccagacactggggtacttggggacctcctgggaagctgagtggactggaagggaggtacagagcctagaggcaggtgagacagctttggggcagtggggcggtaggaactggaggccacggagaagggcggagcttcaaggcgtggtgaccagctccaggcacttactgagagccaaggcgagagctgggcagaggggacaccaggttgtggctgggcgtccaggcctgtgcgggcaggcagagctggcttccaatgctggcctggccacttgtgagttctgtgaacccagaaagagacaatgtttttgagccacagtttccatccctgggaagaaaattttttttgttctaaacactgtcctgggtctttgtgagggttcagtaggatcatgcttgtggagcacctgccacatggtaaatgttcaatgtctttactagtggcaacagtggacatgggtggtttaagacccagggccacctcacctaacaactgctgaagctgtattgtatccccaaattctgagcccccgggcctcaagcctgtagtgcacccttgaaaaatgtgagt

SEQ ID NO: 76778 - DNA, 1028 bp, Homo sapiens
cggcacagggcagggtgaggctgggggccacctggacagctctgcgctcccactgactgtcaaaggccaccactcccatgccagatctgtcccctcaccccaccctagccgccccttgtaatctgtacccactacttcagccctggcacaggaagacctttccctatctcctgtggtaacagagacccttagcctcgccgccatgaaagcttggaaacatctttcctctccttggtctcggtcatttagcaaacattgtaccttactaattaagctcactgtaaaggggtgatggtcaggtgaacacaaatcattaatggatgctctggagagacaaagaacaaaaaaaagctagcacttattaagtgcctactgtgtgctgacaggagtggtaagagattccgtgaatatgttacacctgtatatactgttatgtttaatgaattatttatcaaaatagataatacatatacacacaattttttaaactaaaataagggtgtagaggaaaccacaggcttccctcactcccctgccctccagccatctgattctgtttcccacaaccaaccagtaaccagtttttcatacacttttccagaaattaaaaaatatttatatgtatatacatatttcattttcacaagtgaaataaaacgtactgtccatcttccttttttaaaaataataccgtcagccgggcgcagtggctcatgcctgtaatcccagcactttgggaggccaaggcgggtggatcacctgaggtcaggagttcgagaccagcctgaccaacatggagaaaccccatctctactaaaaatacaaaattagcctggcgtggtggcacatgcctgtaatcccagctactcaggaagctaaggcaggagaatagcttgaacccgggaggtggaggttgcagtgagccgagattgcgccattgcactccagcctgggcaacaaaagcgaaactccgtctaaaaaaaaataaataaatactgtcttggagattgaatgtggaatagcagcac

SEQ ID NO: 76779 - DNA, 1198 bp, Homo sapiens
ctgcctcaacctcctgagtagctggcactacaggtgtgcaccaccatgcctttctatttttttttttttttggtagagatgggatcttgctatgttgcccaggctagtctcaaactcctgggctcaagtgatccactggcctcagcctcctagagtgctgggattagaggctagaggtgtaagcgaccacgcctggccctagttttgtttcttaaaacccctgagcccctattacttggggaaaatgaggataataacggctcctgtgctcacacagcccttctccccagccttgacccctgctgctgctccctggcctggctccacagaatttgatgaggcagcagcatatggaaggcccagcactgtgtctgatccacggggaccgctcgatcacaagctctcacagaagtctcccccaaaaggattcttagtcagctgggaggaaggacgcctagcaatgggccagccaggggggcagaaggagcaggcagcagccagtttgagtaactacgtggggtcacccactgggttgtcactcatgggggctgaggccaacccagatcttcagggttctccctaagtggccccttgccccccaaggttgcctcaagtttggccctgtggctcctcctgtgtaccttcccccgaactgggaacccctccccaccttctgctcaaggtctgaatcccttcacatgaatatcctgctctctgccttagtggctggacgcttctcaaaggagatgcacgctccctcaggaggctccaggaccctctgcaagccatcacaaactcatgaggtcttggtacagacaagtgtgacaaaccccttcctgagagcctgtttggcttgctgaggggagagggtggggagggggcccttgtgcccaagtaacccccaccacacacaccctactggagtccccacaccaggagggccggaatacacctctgacctccccagccttcctaacaaatccacttgaacaggaaactcatgttgacagcattctattatgggatattaagtggaattggattgtggggctaaacctttccctggctgggtttctgcattcggttggcctcctcacctctgcgcctaccacagtccttccctccagcagggctcgacgggagggaggggggtttcctgcccaccttcgtcaaattattcccccagactctgtccccg

SEQ ID NO: 76780 - DNA, 1009 bp, Homo sapiens
aagcaagagaacagagagcaaggggtggccaaaaccagtgagcgttgcaaagggattgagagaaggggcttgaggggacgttgtgggcagcaagaaggcttctgaggctgggatgctggagaggtcaagactagatgagggatgtctcagcatggtccagagtcagaacccagcggtgcctgcagccaccaggggtgatggaggacctgtggggaacagggaggatggcagaggccaggtctgggccttgcctcagagagcatctcccagcaccacagggcccgaggagagcagagtcttggggctccggcatctgagcgcgccttgacctaagccatgtcctccagctgcggtggactgagcctctccgccggcctgtcttcatccatggcctcctcctcctctggcttctcggtactccgggccaggctgtccggcccagacacagtccccagcactttggtgctgtgctcctgagctttggcccggagcaccgcaatgctgttctccctcagttcctcctgggagatggccgcctgagcgtcggggccccgctcgtcctgctccatcttgtcgagcttgggcagggcctggcgttccccctcgggcttcctccccgactcggctgctgcctccagcgactttttgtgcatccctagaaagaattgttggtattcgggtttagaaaagcgcctgggaaagccatcttgaactgaaaacggcaaagatagagagaggccagaattaaggacgagcagaaagccttactccccacaccgcagtcacacaagtcccagggctggaccagggtcagggaatggggagatgggtcgccagccctgtggaggacctccccctgccaaagccctgggcacctgggcctcgggtggcctgttctgtcccttccaggccacagcacatgctcccctgtccctcccccatgggattccggatcttagaaccccaagaggagctggtgctgttctcagatataggcccagagggcagg

SEQ ID NO: 76781 - DNA, 1057 bp, Homo sapiens
ggcaccgctgggttctgactctggaccatgctgagacatccctcatctagtcttgacctctccagcatcccagcctcagaagccttcttgctgcccacaacgtcccctcaagccccttctctcaatccctttgcaacgctcactggttttggccaccccttgctctctgttctcttgctttaaagagtcctccttcccagctctacattctgctctgcccatgcctaaagcccattgctgcaaatgcattgtgaattgcctgccatggctgtgacacagacggaggactggaactgcaactccagcgtcctcagcaccccactcctcagtaaaagtcttctcccaactcagcctgttccttcctgcagacctggctgggcctgggcttccacagtgtgaagacactgtgcaggcccaggcaggcccagcctctgccccacccatcagtggagtccagatggcaggctacagttgggaagtctcagcctgggcccctcagccacccttggtctcatgccccgccatggtcaccctcaggaacccaccctctccacacccagcctgtcccactggctcctcccagcacaggcacctatgtggcatgtggtgatgtacgctgcgtgccatgagtccatgtcctatgcctcacaaatgctgtggttcactgcactgttcaggagtccaaaccttctaccctgggtcctcgggcccctgagcctgtgtcctgaagaatctcgactctcgtgatatgctgcttgtgaccttgacttgccatgaaggcacctgcccccacagctccttgcaaactatgagttcacatgtgccctgccttgaacaacccaatctggctggtaaatgacatctacgaagccacaggcctggcctcaactgagaagccaagcctggagtaggcctggggctatgcatacgcattaagggcctgctggagaaaccttcactccagacagacagggggctaaggggctagggctgagcacctctcagagcaagcctttgacctgttcagaaggatgggaaaaaggctggaaggaaagca

SEQ ID NO: 76782 - DNA, 1356 bp, Homo sapiens
ttcttttttcttttctttttttttttttttttttgagacagtctcactctgtcacccaggctggggtacaggggcacagtcatggctcagtgcagcctggaactcccaggcttaagtgatcctcccacctcagcctcctgagtagctgggactacaagcatgtgccaccacaccctgctaatttttttatttttatttttgtagagacagggtcatgctatgttgcccaggctggtctggagttcctggactcaggccatcctcccacgttggcctcccaaagtgctgggattacaggcatgaaccactatgcctagctcataagctttttgcctggcagcagctggagccaggagccaacattgaagggttataattttatgctcctctggctccaccatcaaatgaatgggcacccatcctcctctcccaccaagctgtgcctggcaggtggatgggtgtggacttttccaaagactgacattcttgcgggggactgggattccctggattgagtggtcccagggagtggctggtgcttatctatagaagctgagagatttcatgcagctgctcacaggctattcccttggagagtctggccctctgctcctctggcccatccttctccctgaggcagggcttctggaagccagagcagctttcagcctcccctgggtcccagctggggttgagtatgggtgggaggagaagcagcggcggcagagggcagggctttgatctcttcctctgtgctctgccccctcagtgcttgatgaagccaccagtgccctgacagaggaagtggagagcgagctctatcgcatcggccagcagctggggatgacgttcatcagtgtgggacatcggcagagccttgagaaggtacccgtgctcacaaggatggcctgaggaggagaaagaacccaaaggctcagcctggccagggccagaggcccctcaaaacggggagtagcagtagcagagagaaccgagtggcctcctctgccagcggccagggcagcctgatctccatgtggtggtggtctcttgtagtttcattccttggttctgaaactctgtggaggaggaagatgggagctgatgagaatcaaagtggaatgaagctctggcttttggaaggagagccacactgtggcgggtcggcggccctcaggagagaccaggaggactgacagcgaagatcgagctcaggttcgccacatagatcccgtgcaggagccacatgggtcctgtgcaggacccctagcagtggtgggctgagcccaggtctaggtttctgtgggggacactgaatctcccagtgttcagtctcccaggactctgctgcctcag

SEQ ID NO: 76783 - DNA, 1047 bp, Homo sapiens
gatgagaggatcttgaggttcttggaattggcaggcctggtaagtggggagagggaccctcaggacccgagcccacctgggagcaccagctacaggtaggcaggtgctggccctgctatgcttgggcccaggactggaagtctgaacctggggtggagaatgggagtatcagttgacagtgtgtgctgttggccaggtttaggcacgaagggggtagtgctctcattggagaattttaaaacaagaataggattgatgaaggcggtttgctttttactgtcatcatgctccagcaagtctaaacagtgtcattggtagaatattcctctctgcctggggcagactgtcccacagtcccccgccttggtatgccactggggcatatatttgtcttagaggtgtgtgtgtatgctggggagtgagggaggttccccatgatggcaggtagcagggctggccatttcatggacatcctgccctctgggtctgttacagtccaacttggtggcaaggacagagggcctggaccagcaggtggactggaactggtaagaaaagagcttgggtgctccagagatagccccaccataaagacagtgggtttcagggtccctgtcaaggaatggaacggctcctgaccccaaagtccagatgtttggctggtcagtcgggtgcaagtttatgcccttgggaacagagttttgcctcactctgtgagggctgtaggcctatggtcgaaagggaaggggcttctgtctcctggggctcacctctgtgcagagaaacctcttcctacccagaccattctaggtaaaagccaagctatattcttcctcctctagcagtcctctctcctacctttcctcaggtatgatgttctgtccccgggggagatgcaacggctctcctttgcccgactcttctacctgcagccgaagtacgcaggtgaggtctcgccttgtggctgcacatgccatgcgctgtctgcactcacgggtgtagcagcatgtgttcacaggcacccaggcacacctgtgaatggctggg

SEQ ID NO: 76784 - DNA, 2244 bp, Homo sapiens
gcatgaaggagggtctgtaggaaactggaattgctgttctgtggggagccaggcatccatgcagaggcagaaactccagaaccatttagctttaaccactcccattcttgttattagtactctggtcacactgtgatgccatgaagacccaccagcattagaatttgttgaataccgctctgcaacctgggcagttacttagccacctgattcttagtgtcctcatctgtgatgatatttgagactcatgggcattagactgagtaagatcagtcccataaggggctttgtccagccaggcagagagtagaagttccacccctacccctgtattaatgtgctcaggctgccatgacagaaaaccacaaaccggctggcttaaacaatagaaattaatttcctcacaattctggatgcttatggtccacgatcaagttgtcagcagggttggtttcttaggccactccttggcttgtagatggccaccttgttgctgtgtcctcacgtggcctttcctttatatgtgcgtgcccctgccacctctatcttaagaggacaccagtcatattggattagggtcccaccccaacaacttcatgttaacatcatctctttaaagaccctgcctccagctgggcacggaagctcacgtctataatcccaccactttgggaggctgaggtgggcagatcacctgaggtcacaagttcgagaccagactggccaacatagtgaaaccctgtctctactaaaaatatgggcacggtggtgggcacctgtaatccagctactcaggaggctgggacaggaaaatcgcttgaacccaggaggcggaggttgcagtgagctgagatagctccactgcactcaagcctgggtgacagcaagactttctctcaaaaaaaaaaaaaaaaaaaaagaccctgcctccgaatgcagttacattctgagtcactagggggctggacttcagcatgtgattttgggaggatgcaagtcagcccataataatccacaggtggtggctcccgggagcagtgcctcccccacagcaatactgaccctgcccatcttcctcacgccccctctcttctctgacacagacccccagggtggccagcggcagagccagcagacacagcatttctccttgagcgggtctccatctctgccccctcctctgacaaacccctaatcaaggatctgagcctaaagatctccgagggacagagcctgctcatcacaggcaacacgggcactggcaagacctccttgctccgggttctgggtggcctctggacgagtacacggggtgagagccaggccctccctgcctctgacccagcctgggccctaggggtggggtgaaggcggggacggtgtggtagaatccattcttttctgttggggaacaaggaagagaggagacaggcagttgcctcttctgggagatctcacaatggaggtttctgtgggctctgcaggctcagtgcagatgctgacggactttgggccccatggggtgctattcctgccacaaaagccattcttcactgacgggacccttcgggagcaggtcagtctagttcagggggctcactcctccctcctcaaccccgcccacccacagctgggacctctggcactgtgacaagtctcaggtcctagagtcagggcaaaaggtgaggtggtgaagtggcccgggcctgggaactgctggctctaagaaccttctattcacatccatggattgggcccactactcatagcagctcctgaggcaggtaaatggggcaaggactcacgccaaataccacacgcgtatgtcaaacacccaaggtcggattctggggcccctgccctcaggaggctgtcagactgttccccctaaacacacttctgaaggttgtagggaccttgccctgctgtctgccggccagagcctctcccatctgacccaggccaggcgttcccacctctcctccttgggaggttccagtgggttctggagggagggtgggctgtgtgcagctccgtcttttgctcgccctcctaggttggtgtggtttttttcttttctcaggtgatatatcccctgaaggaggtctaccccgactcaggtgagctggtcctccttaggtcatgtcctctccttctgtcatggttgtccctgctctacctgactgtggcctcatctgtgcccttggggagaggctccagccaggccgctgattcaaggaagag

SEQ ID NO: 76785 - DNA, 1613 bp, Homo sapiens
tcttcacacagacaataccattaaggcatgactgaagccgtgaatgggcgctaccagtagacagatcctgagaccaagatcatttgaatggccttggtttctaaaggagggtgtgatatgggacaggcggccccccaacctggctgaacctctccagccctgtggacatcccagcctttccttgtcagagctgggcatgtggagcacatgaggacagaccgcaggctgcagagactccttcagacccagagggagctgatgtccaaggagctctggctgtacagtaggcgagggggcccagggaagtgggaaccatggggttggactggtctgcttcccttcccacacctctctacctcctgtctgcaaggataaatgtgccatgatgaaggaattaaccggggatgaggagggggggctgttgcctttctgtgagtatcctcaggagaatgaggatccagagagtccacgtggccctacttggcgtcctgctccctgtcttagggttgtgtccgctgtagggcatgtggatggttcctgggtgtctcacagatgtgttttctacagtcggcatcaacacctttgactatctgggcagcatcctgagttacgttgtcatcgcaatccccattttcagcggggtctatggagacctgagtcccgcagagcttagcaccctggtcagcaaggtgagactccctcttggtcaccccacatgctgtccctctctgtccttggcccagtgtctgtgggctcgagtcgagacctgcttgacctcttcccatcctgtccagaatgcctttgtgtgcatctacctcatcagctgcttcacccagctcatcgacctgtccacgacgctctcagatgtggctggctacacgcacaggtgaggccgtgtcccacccctctggctcctgagcaaagtgtgtgctgctggcagaagtggctgagtgaaaaaaggaacagagacataccatgtactcgtgggtgtgagataggaaaaggagttcaccttcacctggctcccagaccctgcctcagattttcttttcttgttcagaattgggcagcttcgggagacgcttctggacatgtccctgaagtcacaggactgcgagatcctgggcgagagcgagtggggcttggacacgtgagtagcgggctggcagagcagtagttgaggctgcaggctgtggcatcacctggcttgggttaccctggagtcctgccctttcccagctgggcagcagagttgtaaggagtaaatggaaatggaatgccaggcacatgtaagttcacagtcgatgttgctgttccggcatctgttgtgttaatttacaccattccccggccagtggaagcaaagtacacacaccttctgcctgagataacaggaatctgcagtgtcctccccttcctgtgcttcctcctcccgctgattcctctccctgcccctttccttggggcatgtctgtctttgttcccccacctcactcagccccagagatgtctgtatccgtgtgtctgcgtggatctgtaatatttctgtgcattcaggatttgcttgatctccacactttccttgggcagattacctaactgttctgtttctt

SEQ ID NO: 76786 - DNA, 1011 bp, Homo sapiens
agaggattaggaggattaatgaaatcatacctgagaaggtctgagaaccgtgtctgcctggccatcaccatcgtcattgtcatctcttggccttctcactgccctggcataaccgccctgtcttggatcagttgggtgtggcagccaatggatccagtgcctgccctgtgcttcttgtccccctcctttgggccaggccctgggaggaggagatgctgtgagcaggaatacccctgtcctctctgcagaaagctgaggggcagccctgtctctgcagagctcctgccacaccacctagccctggggttttctaccccataacagtccaggaaagggtcagactgaggcagccacggttttgaggcagagccgggctccgcttgggcggtctttgtgatccaggactccaacaagagtgaggccagtactccctgttgtcagcacacatttccctttggtccgcccaggttcaagcacatgcagattcgggtgaatgcggagcctgctgctttctacaggtgagtctggagagatggttccccttctgccttgccagagctgagagtggagaaggaaagatgaatcctcaaccctcccaccaccaccgagctcaggggctgagtgttgtcacacttggctgtgaccctctccctctacctccccctgcccttgcctgcctcatccttaggtccaggggtttgcttctgaagctggtggttccttactgtggccagctttagtcttagtggcctagcgtggggcctgaaattgtcaaatgaatgaatgcctcatcctcttgctggtgactgtaagacatccgtctgcctctgctcttctgtctgttaagaagctttcttgccagtgcctgaggttcaagcctgatcctttgtctccgtagcgtgggatggaatgggagcttctcagaaaaccaggagacctgctccccacaatgctgtctaatggagccaagcgtctggtctcctgacggcagcagcaggagcagcagcagcg

SEQ ID NO: 76787 - DNA, 1034 bp, Homo sapiens
tggcactgtgttgaataaaaacatttaactctaatgaagttaaattcatcagttttcccctgtataggtttttaaggtatcttcattaagacatttttctacatttccttctattaacatgatagtgttacttttcacgtttagatttttaatccatttgtaattttttaagttttttgtttttggttttttttttttttttgagacggagttttgctcttgttgcccaggctcttgttgcaatggcgcaatctcagctcactgcaacctctgcctcccaggtccaagcaattctcctgactcagcctcccgagtagctgggattacaggcatgagccaccacgcttggccaaagaatttcctttgtatccgtggtctgttcccagcctaccatcttcagcatttgaaaaccattctttctgcatggcctggaccctctacagaacaatgtggatgagcttaataactactccctaaggcttaattattgtcttgggcttttctctgcctccccaccttctcttcaggcccaggttagatctgcaatttctccagcggttcctgcagatactgaaggttttgtttccttcttggtcatcacaaaatgccttgatgttcctgacccttttgtgcctgaccctactgggtgagtgagtgagcccagactagaggagggaggggagctctggtttggggtccctttccatcttttttttttttttttttttttttgagacagagtttctctcttgttgcccaggctggagtgcagtgacataatctcagctcactgcaacctctgcctccctggttcaagtgattctcctgccttcgcctcctgagtagctgggattacaagcacccaccaccacgcccgactaaactttgtatttttcagtaaagacagggtttcaccatcttggccaggctgatctcgaactcatgacctcaggtgatacacccgcctcagcctcccaaagtgctgggattacaggcgtgagccaccgcgcccggccccttttcatctctttggg

SEQ ID NO: 76788 - DNA, 1493 bp, Homo sapiens
gtgtgccttgcctccttggtttcataccttttcagatcacttccaagagttgtgggggccagggcaggccagctgggcaaagtccatagattagctatcactttttgcacctccttccctgaatgcacctggcaaccggcttgtctgctttgcattgcacttctaggaagagagccattgccaaaaagactgttgcacctgaaccccatcatcaattgtctacttaagagtgataggcttccccgtgcagcccctaccctttccacacggccctattctctggtgggcgaatccatctgtgggttgggagtgagtgtggagctgcttttccttaagcttttgaggaagccagaagtggggtatcacatacttgtacctcctacctctttggggaagagaaaggaatgaaattgggtggagccgggtggaactgggcctgggaagagtagatagggtgggacgaggagggtggggacaggtggggactgtgcaagaggaagtgtggcatatctggacgttgtgttggaaggtatctggacactgctgcatgaattcaggcaagtcgactctacctttgtggacctcaatttccttatctgtaaaatggccaggtttgtcttaaagtcctaaaaatccataagtttctggatccattggataatgagaattttggatgatggaattatagtgcttagaaagggagcttgagagtcaggctgcttagactttgtagcttttaaaagctgtgtggtcttgcgaaagctacttaatgtaaacccggaacctccaggtgtgaactcggactagggatcctgtagatagcgtaggtgtgatggaattgtagttcacatggaaggaaggtgagaaccacatataaacaaaattaccactgaaaagcctgaactccaaatgcttgagggtgaaaagctggcagatacttgttaacacttcagggaacatcatgctctcctcaggaaatcggctaattgcgtgtaagggtataaaaatatccacacagcttcagtatattgttccctcttgtttttcctgagattttggttgaattacctagttaaatgcacataggaagcagtcagtaaatggtagctattttcctaattttgtttacaaagtatctagcagagcactcatttgtatgcagttgtaaaatagcattcaacaagtgacataatgcaagaaaaacaaaaacccaacgtcttgcttgttgacatcattgtctgccaaaatgaaaaagcttgtctgtgtgtacacagtttgttcttcaggattccttttttaaaaattgtataatgttaagtgctgtctttactaaggactgatatggattatctcctgaatccaaagaaaagtaatagttttctttttaaagtaaatataaaaggcataaaagttgacagattaataaaagccaacttctagagttaaatgatatggtacaaatagaaatatggtgagaggttataccagatttg

SEQ ID NO: 76789 - DNA, 1071 bp, Homo sapiens
actctttaacacactttaaaacaaaactcgtccacttctccccatcctgctcttctgtgtgtgtgtctgtatgtctcatttttccagcttggtacttggtgggccttttaatctaaatattcctttttgttttttagttcaggaaacacttgacgcttctgcttctttaattgttatttttctcctctagtctttccgttgtgtctttctgaaactcctattagattgatgttggacctcctgggactctccttcatgtcccttacctttcttttaccttttccatgtttctgtctttttgctctatgtcttagataatttcatttactttttcttttacattgaaaggtcttactttatctatgcctagtctattatccagtcttttcactgaatttttgaaaatttcggcgattatttttaatttccaaaatgctcatgttcttgaattgctcctttttcatagcagcctgttattgtttcatagatgcagtgttcttttatatctgcctgaggatatgaattcaaaaaattttttttcaaagttttttttctgtaacttgaatgatttgggatcttattgggtcatttgttctatttgtttatttaatccttctcttttattttcctgtagttgttttttattatcttttgttgtccatttatacttaggaatgaaggaaggcattgactagaacaagcagctagtatgaatttcctctgaagttggctaagtttgtttccacagtaggcctctcttctgaatgggagttgttcttacctccagtgtttggggctacaggtttctctacactgatttcctcaccaaggaatctcatctgctctttatctccaggaatttctggcccactgatataattcttttttgttttccacaggatttattatgattttattcttttaaaagatatacatcctgtcattttaatagaaacttaagaaggaaaagaggtggtcatttgtgttcaggctaccctcttgaaccggcagcagcctccccttaggttttctgtctcaggtggttgcatggccttctatttggttgacaaa

SEQ ID NO: 76790 - DNA, 1013 bp, Homo sapiens
gtgggtaaggccaagaaggagcctggcagacaaatggatggctgctggccttgaacatggcagagctgctgggtgtgccagatcaaaaagcagagagcaggccagcagcagcagactgttctcagcgctggagaaatgcattgctctgcccactacaccctcaaccatccatatgcctctgccacaaagggggatactgcaaatggatcaacataggaaagatgaggtttgatggagattctcagtgtacacacacaatgcttgtaagattcttttctgttttgcaatcaaagtaactctcacattagtgtttagtggtaagatgatttttttactaaaacaaagagaaaacatcccagaagctcttccattaaccactgttaatgtgtaatgtacaaattgaagggattggactaatcactaaagcctctgtcaggactaacagcttatgatgcattgagacgctgaaaggaagttgaagaaccactggcaaatggacacagatgaatcgttttctagttactcatattgtgagggcggggaaaatctctgaactccagagaggcttaggatggagactaaggccaagacatttgctttagagaccatttcagatatgttgggcccaggagactttcacttggttctgcagaattctgagatttgtgatgctgatttttttttctcctaatcttgcctttttcctgcctggaattgttagtctcagaccctcccaggagcttcagagtctaagagcctggcaccagagaaagagagagagagagatgccactagaacttggactgctccacaggacagttgagcacttccccagaatctgtggggaggttttcacttttggaagcagtagttgtttacagatttctgtaacatttaaaatgttaaatacaagctgggtttatatctcacctccaactttttccagctgcttgacttttgatgagttccttaacctcttagggccttaatttcctcagctgtaaaacaggatg

SEQ ID NO: 76791 - DNA, 1675 bp, Homo sapiens
cagatctcatgtgaagtcagtgagaactcactcatcaccaaggggacggtgctaagccgttcatgagggatcttcctccatgatccaatacttcccaccaggcccacctccaacattggaggtcacatgtcaacatgaaatttcaaagggacaaataaccaaaccgtatcacttcatttatatgccattgatctaagagagaagagaatgctttagaaattacatttgataaattaaccaagttagtatgtggtgctgctagcatcaaatcacaagtataactttgttcactctcttaaggctgtaagctgtgcccacatgctaagcagccctcatgatttaagaaaaaaagtatgaggagttaggaagtttgctactgtacatctaggattcatagttaaaccaattatggatagaagtcaggtcctattttcatttttctcaattatttttctctttctccagataaaactggtggtggagtggcaacttcaggatgacaaaaaccaaagtctcttctgctgggaaatcccagtacagatcgtaagtctatctgggggtgagagggcatgggtggagggaagaaagtggaggagaaatcagactgaaactaaatcagtgccataagataaaaggaatttcaagactgctgttttatgcctctcaacctctaaaagcatctgagaccctatttcctgagagctcagaactgttgcctttgtaatatcctttgttaaaaaaaaaaaaggttgaaggaaagaagagagagtgagactgtagagattgatttaactgtcttcattggtttttttctgtcggagtaaggaaggtccagccagacaggacctgaaggaggttgcttaggaatgtctgataacttgccctagggttattgccctgacagtggaggaaaggttccaaaccacttccactgagctgggacattacatccacaggtttctcatctctaagtgcctcattgagttcggtgcatctggccaatgagtctgctgagactcttgacagcacctccagctctgctgcttcaacaacagtgacttgctctccaatggtatccagtgattcgttgaagaggaggtgctctgtagcagaaactgagctccgggtggctggttctcagtggttgtctcatgtctctttttctgtcttaggtggtttcattaaatgcagcacttggttagcagatgtttaattttttttttaacaacattaacttgtggcctctttctacacctggaaatttactcttgaataaataaaaactcgtttgtcttgtcttctgcatgtgggctgtggtcttctcctgctcctttcagggtacattctgctagaaccatggaaggcaggcccccagttccgtggtcccagagtgcactgaagacatgactttttcagaaactctttttcctcctttttgtccagtaagaccatatctattttatataaaatggccttgttttgctttatttgacacaatcttataccaccaagcatgctcgaaagaagcagtgaaagtaaaaatcacctagttgaataataacgcctgaaaggttgaaggaactgaatttggtggggagggcaggtaggggttagggattacaggttaggatgaggcatggtgatcttttgggaacactgctgtgaagaaagccta

SEQ ID NO: 76792 - DNA, 1050 bp, Homo sapiens
atataagatctaaattcttcacataatgtataaaacaggagaagcctcttcaaatttattttttgaagtctggaatgctggcactttccaattaggcaatagttcttcattcctgtaacctagctcagagctgctgctgactatgggcctagagcagcagacatgatttctttttaggctgtttcttttccactggtgtttttctatttatctgtctgaccaggtcataaaatatttcattaacattgacctttgactttgcagattattctaaaatggcacagttccatcactgtcatgctaaattctggccctgttctttgccaactactcactcatcttccaggtcacatttattgccaaccaaaatcattggaacatcttctgtgtccttaaccagtaaaatctgttccctcaggtcctgtaagtcaaacgtggactgaatatactagtgcaaaaccttggccattcttcatatacaaatccctcattgctgtaaattgccctgtgcctgcagtatctaggattttaagcatacactgttggcagttgacttcaacttgctttctgtaggaatcttctatcgttgggtcatatttttcaacaaaaattccctgaacaaactgaaccatcagagcagactgcccaacacctcctgaaccaaggaccactagctcacccgtgatgtggtctgtttaaatactgatgattcccccagtctggcacctcctccacctcctcctccctcctccctcctccctcctccctcctcccagctgcggctcctgcttcggctctgcacagcaacggctgatgccatttttatatacaatatttcacttggatctcatgaccatcctatgtagaggtgatattatctctattttacagctgaagaaatttgagcctctgaagttatgcaatatgaacagagtccactccactaagaagcagtggagcccaggttttgagctgggtcttataactccaaagcctgtgcaatgttaaaagattttagccaggtaccaaataattaaagatccaagttgt

SEQ ID NO: 76793 - DNA, 1044 bp, Homo sapiens
atgagttgaccctaaatgggagagcagagcaccttcccattaggtggtgggcagcctagctggcttatttctcctcctattctcctattccaattcatttttcttttgcaggttctgtggatggagttataaaggaagtgaatgtgagcccatgccccacccaaccctgccagctgagcaaaggacagtcttacagcgtcaatgtcaccttcaccagcagtgcgtaaaagtggctcttaactcaaattcatgttacagcataacctaaatatcaagtgttggaataagcatgggaatggaggggaggggaattggcagtcatgaattttatgatttcttttgcacctcatgcaaagctagggttcactgtgcccttggacacccttctcatgcagggtccatggctcccagactccctttaagcaaacagggagatgtccatgtgttcacaggttagagaagacagcttggcttttctgtcttgacccatattgcatagtaggctatgatgggaatgtcagctctgtttagctacagactgcagagtattagtatggaccccaattctttaagctttggaactcctccaaaatgttgttttaagcagtaatgcctttcagctattaagtctacatcccacctgaaaataaaggtgcaactaatacttaacagcctccttaagatttagggaacccactggggacccaagaaatagccaagaaatctgagctttcttctccaatattcaagaaatatcattggaactttttgctttcttgtaccacatcactttgagatttttaagaatctagacaaatgtaaaatcttttattactaagcagggcatgttccttgaatcttttcctcattttctgtcctgtgaaactagactagacagtctaataagaaacctcaaagttcctgtcatcttttgttcataagcctaaagacagctctaagtactagctccctgtttcctctctggactataccctggcctctctattgttccaaaccaaaaaaaaaagccttctgaacaagtca

SEQ ID NO: 76794 - DNA, 1435 bp, Homo sapiens
gccgttagggacgacccccaggcggcagccatcttcctccacaagctccgcccctcgcgtctcccccgtttctcacccggggcctcgggaggcggagagaacgaacaggaggccgggacttcacggaggccccgcccccccaacatgcctattgggtagtgcgggaggagaaggtgtctgattggctaggaatgctccagacggcagcggcggggacgcacccaggaagccggagaggtgctctaaagggaaggaacggggcggggaggagtgaggcggggcggggcggaggtgggtccgggcgggtcaggcctctgaggggatggcatgggcggagactgcaggcttctgggcctgagagggctggagctggctttccggagccgggggcggggcgcgggcgggcctcagctgtggttactggtgacaggtcgcctgactgggctcctccccgggcccgccccgacaggtttgtcttgtgaccgcgggcggccgctgcttctttcccgagcttggaacttcgttatccgcgatgcgtttcctggcagctacattcctgctcctggcgctcagcaccgctgcccaggccgaaccggtgcagttcaaggactgcggtgagccccaggcccgcccaaggttcccgcgccctctgtggaaggccccgccggacccccgcgctgagacccctggggctgggctgggcggatccctcgggcggccaggctgagccttggaccctacctaactggaatgggctgggtcgggggagaaggcgccggcctccatgaaacccgaccgcgcacaactttgtttctttccttagaacgcgtgttttggggttcctgggaactccaggaggtgggccttttgctgaagtttcctaaagtttgtagggcggacaacagaagggctgtatccagctctggtggaggggtggagcacagaacttctttttatttatgctttgtatcttggaatcccgcctcccccttccaactccttttgcttttcttttaatttcgtttttgctgacaagtcaaaagtcaattcccctttttcatcatttattgttacaaataggacttcctttgggctttggaatcttgtgattcttaatcagtttttccttgtataaatctcattgtgtctctaatcacagcttgtgatacataactccctctcgccgctgtggttggaatctttgttggaaaatacaacaggtggtagaaattctgagtgccttcattgagtcgagtctatagaattgtcggaacagaaactcgagcaatgttgttcagaggtggagatagagagatagaactgtcaatgaaagaggcatgaaactgactttgtaagatctatgagtggaaaggaagcacggagatcgtataatcaatcattgaattccagggatgttgggtagcctacctaaagt

SEQ ID NO: 76795 - DNA, 1263 bp, Homo sapiens
ctgaatcaaagtaactaagttataggagcaaaattgatctgcccaggtccattgggtagtcggtagaaagtcaggccggactagattccaggcttaagtccctacacgtttcccagtatttattccattgaatcattttgcctcaaagaaaatcagcacctgttaaaggtaatggggaagctccctctgtactttagaaaacagaggatgtgcacctctgggctcagggggtgtcttttttgtgtttgcgatactccttaatgccttcctcctgtcttttcagggtatttgaacagggtggggcaagagtggtggttgactctgatagcttggccttcgtgaaaggggcccaggtggacttcagccaagaactgatccgaagctcatttcaagtgttgaacaatcctcaagcacagcaaggctgctcctgtgggtcatctttctctatcaaactttgatgtgatgactggtgactctgggattgtcaccagttgtaccaatttgaagaacctggaattagtagaattctagaagtttacttctaatcatgtccctctcaattttatttcccgcagtccaggagtgttatgttttgccactattattttcagaatgtgaagattttactcttggcttaatttttccctccactcagtgctaaggctgagcctccagatgctgttacctcagatttaatcactggttgaaactccgtataatctgtagagcctccatggctctaaaatttggaattaacttctcttgccttaagagctgcttgtacatatgtggatagctatgtataaaagcttcattttaaagaaggttcttattgtgttgtggatcagggtcacagattgggtagcttggacaccagttattagaggatgagaaaagtaaatgaaatgttctctttttcacttcaccctgccagaatgtgccacttgacttatctttattgtctatgcaacccatttgccacttcctgtttgataggacagatacattttactctcatgctcgtggatctgctatgagtcataaaaccaagagcccgttacccagaaaacttggaccaaaccctcactgatagtgaattatttcaaaaatagcctccctactcatacagacattttaagattctgtgacaatttaatgactgaatctttttaggatatgttgctttacctgccttctgttgtaaaatggctctggtctcatgcacagcaggaagtgatccctttattgttataggtaatagat

SEQ ID NO: 76796 - DNA, 1065 bp, Homo sapiens
ggtttgtttcctgtaagaagcagtgtttatgtaatagaggtctttgtagatgggtgctgtatcccatggcagcccttgctgctggtgcccacaggctatcactgggcggattcagctactgaatattttctttagacgtataaagccttggctcccctttctcatcaactccacgtatttttcatcatgtcctcttgctgctttctcaggctctttgttcttcttcatttgtgtctcttacattcaacaagctaatatcagccttgcttctctgagtgaagggatcttctgccactccttggggtcagagaatgggctacaggatggaggtgtggcaaaatcagggcccagaacagattggctgagtggtggtgatggttcttaggagggggctctggagtcagtccccaagcttccccaaatcctttcttgctccacagattctgaaggacctccctagggcagatgtagcctctgtcccagttgtgggatcgtcaggatgatggtggattgtggctggaaaggggtgtctgcagtgtgaggccatggggccttgcatgctcgcacagcttgggagggtggatgagggccatcctttggtaagcatcccatagcaaggccaggaaaggtggtggacagggcctcatgcggtggctgaagcattaaagcgattggtggtgcttgagccaagcaagggcatggaggcaatgaccgaagcttacagccagaggctaagctgggagagatgaaagcaggcaaggctgattggaaacctctggcctgatgtcacggtgtcttcccagctaggaaatcatcctcaaggcccctgcctgtgactggaggccatttccaggtagttgccacactgacccctgactgctactccttggcagtgcagtgggggggccctgcctcagccacatatcccggggagcagtggcagcggtaggagccctctgtgttctcgcagtaaccatggacacagagcacagcaggcccgttcaagtcatcacactcattcacatctaagaggaaacaaaggagagtgctgtagggagcccaggt

SEQ ID NO: 76797 - DNA, 1024 bp, Homo sapiens
gtatttgaaccttccaacagaaagaaggctttgctttggtcctgacccttgcccatgacgagagttataggtgtagctctgtgatgccagcccctggggaggatgggtatgggagggtgctgggggcatgaggggcagagagccttagggcaggtcacagcagcaacaccattattatcacccttatcatcattcacaaccatttattcagagtacttataagtgccaggcacggtgctaagtgctttttcattttcttgcatcctaacaatatttctagatgttgggtgctattatccccattttacagaagagaaaattgggcctgaaactcccggcctatctgactccagttgcctgcttccagccactctgcaagtggcctctctctgctgcttcttgcacccggcacaagcatttgctgaactggaggaccccagcttggggaacagctgtgctggggtggggctcctgttctctgggattctggatgagatgcccagtcccctactctaaagaaatgggattttcagaattccagttgtcagctgaaaaggcagtgtctctttggctcagagatgttctgagagcttcttccaagggacttgaagcctgctgggaatgaattgtgcctcaggcttaagtgagcaccctcccaacccagcaggggtgggtgtcactgacatgtggcacctctagcccggagagcggaggaagggctggggcaggggtggctaggtggcacctgcctgagccaggggtctgaccagactctttttcgacctcactgtttgtggtgactttggttctatcttgctctgaggaggcagtcagaggccatctttgggcagaatgtccataatcactggggggccccactggtccttcaccaaggagggaaatctgaataatggacattatgagaattcctaaaatgggacaagtgttgtgctcagagttgtacatgcttatttcatgttcataataaccccatgaagagggacttatcatctccagtttactg

SEQ ID NO: 76798 - DNA, 1009 bp, Homo sapiens
cttgcacatttcagtaagtggcatcattatgggtacagactgcccaggcagctttcttgtgggcctgaagaccccggccactgggatgagaatttttcctcatcttggttgaaaagcccagagtccacagttgagaacagactgtggtggatctggtggctgtctcttggctctgtgctggcctgtgatggggatttcatgatccataaagaaatgaagaaaataaagtcatttggtgagatttccatgaagttaggcttattcaaacgtttcttttttggctctgaaatgtcttttctttcgtgaaattatggtggtagtgattggcagttttgtgtgtgtttgtcttaaagtcttagcaacctaaataaaaagcgactttatgttgttcccccaattttgttccaaaatcttacggattcatgaaatcctgaagtctagagatgactttttggtccattgtggaggcttggccaggacttccctggaacagtcccagaaagatagcaagttccattcttgtgctgggtgagtttgggaacctctgtcctttgatgaaattgcagcggttcttccaaggctgatagtagatggagcatctcctgggggctgtggtcaccttctcattgagacttgccttcttctgttaccagacctctactgtccttaatcggggggatactgcttctttggaccagcctggggcaaacatggcaccagacccttctcttgatgtcccacaacctgagactaggaaagaacatgcaaacaggatttggctaaaggcttgcgatttgcttaaaggaaatgagtgcaaagataacacaaggctagacagtggggtttgcaaactccacagctcacagtctccactccatcctagctgcctgtgcccttctatggggtgatggcagtggtaaccaattggagaccaccagggatccagagttgagccaagaacctgcagccctccacacagcgagagcctctctcgctgctcacctctgag

SEQ ID NO: 76799 - DNA, 1048 bp, Homo sapiens
gtcccagctctgtgtcctggggcaagtgactgggccttttctagccacagggcctcgtccataaaatgggcataacaatctatatagagttggttttggggatgaatgatatgaacgtgatagctcttactgtgcgccaggtaccattctaagcgcttcatattgttcatttttaatcctcacaacagccctataagctagattggatttttatcctgagggcctgagttgacattgccctttcctggggaaagggtcatagccaagaagctcagaggccatctggcctctgggggagtggttagttttgttgttgttttaggctttgctgtgctggccagtggaacttcctgtgatgatggaaatgttctatatcttgctgtccagtgtggtagccctgagccacatgtgggtatcgagcacttgaaatatggcttgtgagactgaaggaactgaattttaaattttatttaatctgaatccatttaaatttaaataaccacatacagttcgtggctacagtgtgagactctcttgaacagcacagctttagagagtacaaagtacacccacgtccaggtgctcagctgacactcacaacagctctttgaagcaagaattatcagccccatatcgtggacgaggccactggcacactggtggagacatctcagcgagatgacatgtgtccaaggtcatgcagctgagatgtagcagagctggggtcaaaccaaaccaatcctcctgcccccgaccccgtgttcttgctactacccagtagccaatgagcaggggctctgagcagatggtaggagcagcctgcatggggtggtcgggaggggctgtttctagaatctctcccaggcctgcccattctgagtttggtcccttcccaaaagtaggggttttgtgtggaaaatctgagcaaacctctgttgactgttctggggtggagtgaagggagaaggggctcagctaggaacatggggagattaggggaacaatgccttttatttcttgcttttaaagcaatttcaggagttttctt

SEQ ID NO: 76800 - DNA, 4721 bp, Homo sapiens
cataaatgggcctggggattttggggaaacagcttgccttttctccttgatattcccaggctaagtttagagcagactgtcaggaaacagtttgtgtgtgtgtgttttgtcctttgtttcatttaaaaataatccatagtagcagttcttagggtgttcatcagaaatacctcgcctgtaatcccagctactcaggaggccgaggcaggagaatcacttgagcatgcaaggtggagaggtggaggttgcagtgagccgagacagtgagactccgtctcaaaaaaaaaaaaaaaaagaaaagaaagaaatacctgagcaattttttttcttcctgtataagctcataacctgttccgagagattcagatttagaggtcccaggtagggccaccaacacttgtataaatatatattttaaaagccatgtgaatcttttttttacccactggttagcaactattgccctgttgtatgtaattgattttcctaaagcagtattctggcattatgacctcaccttctgtctttttcctggtaatgttttcttctacattttgcctgttaacttaggtaattttgaccttatattgggtctttgtctctctgactgtcatagtaacaccttaccatctttttccagctgctgatgtgtgggactggagacatcagtgtgtctgacttcaaagcccatgcagtagttgttggtggctcatggcatttcagagaaaaggtaaatggaccaaacttctttcagttggatttgtgccatgttataaggaaaaagtttcagaagaaaaaagtagaggaggccgggcgcagtggctcatgcctgtaatcccagcactttgggaggctgaggcaggcggatcacaaagtcaggagttttgagaccagcctggccacatggtgaaagcccgactctactaacaatacaaaaaaaaaaaaaaaaaaattagctgggtgtggtggcacatgcctgtagtcccagctactcgagaggctgaggcaggagaatcgcttgaacccaggaggtggagtgagctgagatcacgccactgcactgcagcctgggtgacagagcgagactctttctcaaaaaaaaaaaaaaaaaaaaaaagaaaggaaaagaagaaaaaagtaggggagtcaaagcagttgatatgttttctgggaaaaaaaaatgatgcatggggaaagataggtggttgtccaggcagaagggagccctgatccctaagggctgtcatgctgactgccacaggagtagtaaattggagatggcgaagaaagagaaccaacagtcagtgactaccctcctaatcatgtgacagtgtaaattcttgaagtgcttgtcaaactgttcctaccctgtgtcctcatagaacggtaactggggcacagccccactttagtgtatcttgttccttccccagggatctaatcctagcttgtttactgtgtgtgatcccagccttgtgctctccctgccaggtcatgaggtggttttggactgtggtttccagtctgacccaggaggagttggctcggctacttcagttcacaacaggctcctctcagctaccacctggaggctttgccgccctctgtccctcatttcagattattgccgctccgacccatagcacgctgcctactgcacacacatggtaggtatctgcccgcctgatgcatgcccagtgtttttggtggtatgagttaatcacttctcccttgcccttccagttttaaccagctgtgcctccctacatatgactcctatgaagaggtgcacaggatgctgcagctggccatcagcgagggttgcgagggctttggcatgctctgaccactctcctgtcatccagttggctcccatgctctctggagcttctgggcgcaagttacagacatcataaccactgatcctaacacacataaccatcagccagaagatgccgcatgctcccctgtgtctggaggattttgtcacctacaagccttgtctttacctcacctgctccctgcccatatctaccacaggccactttggcatggtatgtaagctgagctcttcattctgtcatgagaagaggaccatgctgctatcatttatttggtcctttgaagatctcagtagctgagggagatggcacacggggctcagccctgttgggaaactggtgtggagacccttaaatccacactgtgctccaaaactccctctgctgatactccttggagacaccctctttggccctcactacttgaccagactggtacttgagtccttctcatgggtggggtgattgcctcttctcatcaggagccaggagagagggggacagataggaggtggcccataggagcagtcccgctgcacaatggtaggcataggccatggcactggactgcctctaaggactgctaaaaagaatatttttttgtggtgtcagaactggaaaaagcactttcccttcgggcatttctggaaatgattattaatccacaaagaagaactctgtaagctttttcttgaattgtagccagtgagaaaagcagatagactgaagaatatgaaggatagctgagctgtagcctccagagtggggcatgcctaggcatatggctggcttggagactactgatgcttttccctgagtttgttattggcactgaagtatggccggcttgggccactgacttccccattatgtagtctgctaaaagctggggatcctttagcattctactgaagaaaattttgtagcaaaagattagaacagtaagaatagtatgccagcaatccctgattctctctctgcttggtgttctctggcagcactaagacaaaggaacagggactaggagtttacgtgcttatcacaggtccttggcgtcaggacactagggatgaacatggaggtgatatgttacacagtaaacacctgccaacccctgtactcccctttgctccatcagttatcaggaaggagaactaaggagggaggaagcttattaggttcactgttgaatgatgattgaagagtacctgctgctgtatcttggaagatgacaacatcctttttcattactgtttgattgaaaataatttcaagattcaaaatctcattgacttcccaaatttgtgtttttaagaaggctttgctgcaagctaccattcccaatggggcagtcaactctgagaatattacaagccatctttattgccaaaaccagcaagtacacagagtcctgaaacaaggcaggactttggcaatgccttggcctcctggaagcatgtctgagccctcctgttcgcagggatcatgaggaacaagccctcctgagctgctacagttcctgcctgacctcagtctttcgcagtcatcatttgtcctttcttggcacatgggtgctgacctcactcatccttggggtccgggatccagcatcagggtctctataccccaggatcctccatgccacatggtcactgctctcctcagggaccaggacaaggtgctgctgcttgcccaaatgttttcccatgggatatgtaccggaaggtttatcaccaccctgggaaacataatgctgccccttgggcccagaaaggggtttccagctgggggcacgtggactggttctgctgtttttggcagtcgcttttctgaattctcccctccggcagccttccagagactgatcctggagattgagttgattgtcttggctagacctgtcattttaagctctagtcatagcactttttcagagcatcttaggcaccattgcaacccaaccagggaagctgcatccctgtggtggtccttaggcaccagtctttgttaaacaaaaccctttggcactattgtggttttctattctctgtctgaactctattcaaaagtatctttgctctcttgggccttttcttttactgttttgttttttttttttctaatcctgctttcatactagccagtgtggggaaaaggtacaatatgtcaaagagatgagagagtgttatttcttgggcaattttctattagtgtttcttattttggccagttcttttatttatgtccttgtgacccaggtacttggggggccagctacccttctggccttttagcgtctttgaaggagaccagacatgagtgaatacctaggagagtgtcagcatgtttctggaaaattggcagagaccaagccctgctgcagattcgtcaggccaggtgaaagggccaggcagttgcagctgatgatgtaaatattttgtacagtagataaataaatgtttaaaagaactaaggagtgagtggctgctttaaatggagattcatggcttgactggaaggtggggaaggaaaagatttggaaatgattttgcatttccccaggaattcctcctgaagtggtcggctcggggtagagtgtacacctggagtcctggcctgtcccactcttgccctttcacccttccctgattgctgtccatggtgccaggcagggccactgtctcagccatggggagacgaggacaagtgtttatgctcagtttctgaagaaggaaccggttaatcagtctttaaacaataattcattgttgttttactacctagaaattcaatatagaaaatttggaaataagaaaaagaacaagggaaataggtaagttgctatccagaggtaatcaccgttaacactttgataaatag

SEQ ID NO: 76801 - DNA, 1021 bp, Homo sapiens
aatccaggatcttcaagtatcaaactgtggcttgttctgttgactcacattagagataaaagaatgtgtgggaacaattgttcccatcttggaatttctgagacataaaaagacttccttactgcttatctgattttactcttagttgcttagagaagaggtcaatagtggtttcattttggatcatagattaaaacattgctagcgaggagccatagtatcttcctattgcatcactactacttgactgagtcagagaagaccttacccaggcacccatttcagaaataatagctagtatacagcaatagtggtaggaaccctgaagcttaggaactaaattaaaccaagtgtgttgaaaagctgaatgcacagcagaaacttgtgactgacagtgatggaggtcagtaatctgtgtctataaaacatccaggcagatgtcatctcataaatttccatccacagcctctcccttgtctgtcttttgctgcctgttacaggttgtagaactcatgacaggtggagctcaaactccagtcaccaatgcgaataaaatcttctatttaaatttgctggcccaatatcggctggccagtcaagtgaaagaggaggtggaacatttcctaaaaggtgggatcctgtctgttcttggccttgaagttaaaatacctgtatccatggtgtgggtatgactttaacttgcctactttgtttcaggcctgaatgaattggtccctgagaaccttttggctatttttgatgagaatgagcttgaggtaagtgattgcaattcagactcccattcttaacttggcatttttgtagcttacaggaaccagcttggtgtaccttctcttatgagatgcagctggaaagccatttatgcaagaggtggtttcacttttgtcgctcctccattcattgacccttcagcctttaaaaaattagaatgtgaaaattagtagcaaagagtgcagagatattagcttaagggataaataaatgaaagtagcaagtagct

SEQ ID NO: 76802 - DNA, 1014 bp, Homo sapiens
aatggcccagggcctttcagtctctttcttggacaggtgcatcccaaccctaatcgccccgctcatctgcgcctgaaaatgtatgagtttgcgggacggctcgtgggcaagtgtctctatgagtcctctctaggaggagcctacaagcagttggtccgagctcgcttcacccgctctttcctggcccaaatcataggactgcgtatgcattacaaggtaacatcttgggtgtgcatttcctactaaggcccctggccattaaccctgaaatctctcctcctgggcttgtaaataatttttaaggttgaagggataagtggttctaagcagttacacctttcagggcaagagtattcatgttctgttctgtgtctttctgcctcctcagtactttgaaacagatgacccagaattctacaaatctaaagtttgttttatcctcaacaatgacatgagtgagatggagctggtctttgcagaagagaaatataataaatcaggtcaattggataaggtgagaaagaggacaaagcctctgggtcctatgttctccagtttcctgtagagcaggactgtctaagagaactttctgcagtggtggaaatgttccatatttgtgttgtctattaaacacccaaaatgtgggtgacataataagtgaacttctcattttagttaatgtatacttacataactacacttggctagcagctgctgtattggacagcacagctttaggacattgcatcctatgctttatgatctcagcccatttgagtgaagcaaaagacacatatctccatctatcccaccgagtcctgcttccagttgaaaaataactgaatgatggtgaagtgtcactgtacaagcagatttggaagagatggcagtgtctgtgtcaacatttgcagtagtgatgtaggtgattcctattttaacacaatgcctgggtatttttaaactttttggctgggcgcagtggctcatggcctgtaattgcaacactttgggagg

SEQ ID NO: 76803 - DNA, 1047 bp, Homo sapiens
tattcccttaacagagttattcacagagcacatgttttcaattttgatgaaatccactttctgaggtgggagaatcacttgagcccaggagttcaagaccggcctgggcaacatagtgagacctcatctctacaaaaaatttataaattagctgggtgtggtggcgtgcacctttagtcccagctactggggagtagggtggagaagtgaggtggtaggataacaagcccaggaggttgaggctgcagtgagctgtgatcttgccactacactccagcctgggtgacaaagtgagaccctgtctcaaaaaagaaagaaagaaatccagtgcatccatttttttcttttatggtcaaactgttggtgtctaagaaatctttggtctcagatcctgaagatgttctctttttttcccaaaagtttttacagtttgaaaatgtgtatttagggtcatgatccatttttagttaattttaatagatttgggtcaaggtcctcttttttttttttttttttttgcttatacatgtctttactccagcatcatttgttggaaaggtgatctttcattttctattacattgcttttgtacctttatcaaaaagcagttggacatatttgtgggggcttatttcattaatctgtgtacctatccctcctccagtaccacagaatcttgatttctgtagctccctcttcttttcttttttttttttgaggcagggtctcactctgtcacccaggctgagtgcagtggtgcgatcatgattcactgcagccttggcctcctgggttcaagtgatcctcctgcctcaacctcccgagtagctgggactacaggcgtgcaccaccgtgcttagctaattttttatcttttttgtaggaatagggtctcactatgttgcccagggtggtctcgaactcctggactcaagtaatcttcctgctttggccttccaaagtgttgggattacaggcgtgagccaagtcacacagcctgattactgtagctcttataataagtcttgaaattggtaagctgactc

SEQ ID NO: 76804 - DNA, 1703 bp, Homo sapiens
gaaagaggataggaatagtaaggctctggactagagagagttgtttggctcacgccatacactcttctttgtcttactctgagatagctatgaggcagagttggagacaaaaactaaacaagttttcttttaacagctgcagctgtgatcctcggctgtctgttggcattgacgggacctgatgttttacgttattggtacgttatggaaagagctctctctattatatttttgtaaaggttgcttgggtcctttttgcctttctgcctattcttttccctttgaaaatggagctgaaaatatttctagtcgtgccagaatgtaccttcacagagttggcattggaattcattcatttgggtttattgagcaattatagtcaatgccagacactgtttactgtggagtctaaagttgaataagacaaaaatctgccttcaaggagtaggcattcataacataaaggggaacggtcaaggaggagaaaagttataccagatgaatgtgtaggagtttgaaggagcccagaaaagggaactgctaactctggtggggattggagaagacttttgccaagtacacaagggaggggagggctcccaaataatgcattctttaagaaggaaatggtgggaaccaaaggcacatccttttgactgcttctgtggggtgcccagcaagtgcaggaaggtagggagcagggcggacattatatgcagctcatatagagcaagagtttgcaaactttttctataaaaggccagagagtaaatatttttggttccgaaggctcatttcaatgactcaactctgccagtgtagtgcaaaagtagccatagacaatttataaatgatgggtgtggctgtatcccaatggaactttatttaccaaaataggcagtgggtgggctttggcctgaggactgtagttactgacccctggtgtagaagttcctttcttatctacagaggtagtgcccagtgcagtgtttctttggcagtcttacagtctcatcctgacctcctttaatttttgagaaatggctggcctgttgcataatgaaaagctgtaatgtgtaactggcaggcggtttgtgtgttctctcttttgcataggtggaatcacagtgtctgtggttgcattcttcttcacaattaagttcctctttgagcttgccgcacgtgtagtcagcttcctccagaatgaggaccgcgagcgccgaggggaccggactatttatgactacgtgcggggaaattacctggatccccggtcttgcaaagtctcctgggattggaaggacccctatgaggtgggccacagcatggccttccgagtgcatgtaagggaatgtttctgtctccatacccattggggtttctgagtaacttgctttccagagcccaggtgctggcctggaatgttaacattttctcttgtttttcaactccctccaggaactagtgaattgctactatctgaagagtcacaaatttctctgtcattttgatttaataggtccttagctttgaagaagtataaagcttaatgttaccttttcaaaataagaaaaatattacagaaaagagtaagtattatagataggggttagcaaatcaggcccaccttctgtttctttaaatacatttgtcttggaacacagccacacccattcatcatgtattgactatggctgttttca

SEQ ID NO: 76805 - DNA, 1037 bp, Homo sapiens
tctatgaatatattcaacatatccatgttttatctttagaaattcatgcaaatattacattctgttttattatctatgagtttgatttaacatgaaatttttttttctccccagtcactcatcctctagtgaaacagatgctgtaggaacatgggtcatttatcctctggcttctagcacattctagcatgccccagtgtccaaatctgggagttatagaatgaggtacagtctaatacggcagcacagtagatttctgtgatttgggggattgcctgctcaagagtagtatgtcatggaactgaggagagtgagttcatcctgctgactaatgaggctgtccctggaaggctgcagtcatttggaggcacctcattaccagatcgttggggatcagctggagagagttcacagaagacccacaggaatgattaagagactggagaggctgactgatgaagaaagtataaatgaaaaccatgtaacttggctaaaccacaatagcagaaatagacaactgtataaatatctcaagagtataaacttgatggaggagggcaatcttttatggtgggattttgggttggggagtataaactaagagtggaattaagccatagtaaatgtaaactgataatccaaagtgtctgatatattcttggaacctccttagttagaccaccctaacctgtgcactttttgaaaattgaatagtttgtttttttaagttcatgtccctggactcatggctggtgcttctctgtggagaatgctggagattgcatcttacaaaacaaacgtctttcttttgtcttgtcatttggtggacatcagtaggtgatatcagaacttctgtttgctgccactagctctgtatgcaccaaaattttgaaatggacttttacatcatgtttttcatggctgtgtgtgtgtgtgtgtgtgtatgtgtgacaggatctctctctctgttacccaggctagagtacagtggtgtggtgtgatcacagctcactgtagcctcaaacttctgggcttag

SEQ ID NO: 76806 - DNA, 2293 bp, Homo sapiens
agctgaatctaagctatgcctttgtgtatactatacaaaaagaaatacgggtctgaagaactctggcttgttttagagagaatggtgcaatagagagaatccaaactgaattaagaaatgcagaattacttttgtcttggttagcttaacctttataagcctaaattttaatttaaccagtgagtgattataggacaacattttccagtctcatcacaggttagagtgactcagtaaggtgggcatgatcttataaaagactctcgttaaagccagaagggtaactagtttattgtccctggcttaacttcaaggtgcatgttctgggttgtggaatttagttgttgttttaagaaccagtatcaggggtgcagaggtcttatgtggatttggagagaagtgagggactaaaaccttggctaaacttaagcattccatttactagattgaagagaggaaaaatctgttaaaatattaaaatctttccaaattcagaaatagactataactggggccaggcatggtggctcacgcctgtaatcccagcacttagggaggctgaggtgggcgaatcacctgaggtcgggagttcgagaccagcctgaccaacatggagaaaccccgtctctactaaaaatacaaaattagctgggcgtggtgacgcatgcctataatcccagctacttgggaggccgaggcaggagaatcgcttgaacctggaaggtggaggttgcggtgagccgagatggtgccattgcactccagcctgggcaacaagagcgaaactccgtctcaaaaaaaaaaaaacaacagaagactgtaacttaaatagtgcatggtaatgtgcagcattgaatttgaaagaaacaaggggaataaaacttaatgactatgagataaatggaatgcaggagttttaaaaaattcttgttaaaaaatttgacgagaggattttctcttgtgaaacgtttagataaccctctagaaaaaaaccaggagaaaatctttgtgaccttgagctaggcagagttttaaaaaatagaacacaaaaaccacaaactatgaagaaaaaatttatgttggctttcatcaaagttagaaacttgtactctttaaaaagtgtattttctgttaagaaaatgaagaggcaagccacagaaaatatttgcaaaatgtttatctaataaaggacttatatttatgtgaaaggaaaataagtcttggggcccccaaatcactaagctaaagggaaaagtaaagctgggaactgcttagggcaaatctgtgtctcattctgttcagagtcatcccctgcctaccgagatagatgcatatctgattgccttctttggaagggctaatcagaaactcaaaataatgcaaccatttttctcacctggaagcccccctccctactccaagttgtcccgcctttctggactgagccagtatacatcttgattgatgtctcaagtctccctaaaatgtataaaagcaagctgtgccccaaccaccttgggcacatgtcgtcaggacctcatgaggccgtgtcctgggcgtatgtcttcaaccttggcaaaataaactttctaaattaactgagacctgtctcagatattcggggttcacatttagaatgtataaagaactcttacaactcaatagtaagaagacaaacagctcgatttttaaaaaagaaaagatttgaatagatacttcaaagaaactaatacaaataaccaataaacacatgaaaaaaatactcaatattgttagtccttagggaaatgcaaattaaaatcacagtgagataccacttcacacctattagaatgggtaacattaagacagtaccaagtgttggtggatatagagcaacctgcctcttgtgcattgctggtggaaatgcaaagtggtccagccgctttggtaaacggtttggcagtttcttgtaagttaagtagatacttaccatatgacccagcaatcccattcttagatatttacccaagagaaatgaaatcatgtgcctacacagacttgtagcttaatgttcatagcagctttatctatgataccaccaaactggatgtaacccaaatgtccttcatctggtgaatggataaacagattgcagtatgtccatttaatggagtactactctgcaggaaaaaggagtgaactaccgaaatgtgtaacaacatgtatgaatctaagaaccattatgctaagtgaaaaaatgctacacacgaaggactacattttgcgtgtgatacaaatgtatttctatgta

SEQ ID NO: 76807 - DNA, 1040 bp, Homo sapiens
tttctgcttctcctttctctttcaggcacacattcatttagatggcttaatagtttacatatctgtgggcactgaatttttgatgtagaaatggtagctacagatactgtatgtgccttctgctttaccccatttgtggtcactagaagttcctaatctttctggagcagcttgtctctgtcaagctgccattcatgtgtagagctaatagcaaccagttttttgatgtatctcttggtgattagacaataagctttttattgtctaaaagctaaaataacatggtcagttattcttcttaaacatttgactcattagtattatatataggttcagagggaaaattgcatatcattaaatagtaatttgcatttaaatttaggcactgacagaaaaacgctcttctggtaatgtgtactttgaattttggaatccatgaacaacaacaacttaaaaaaaggccatttgtaatttctattgtaacctctattgagagtgttctgatttccttgattgttaatacctaatagggagctaaattagtgtaggaacaccatgggggataagaacatacttagaaaaatttgtttttgttgcattgtaattttattgcaatctgaggttcttatagcgtgaaatgaaagtggtcagatactctacagcattctttgatggggatggaaagtgggggatgcgaagctgggaggtagtgttgatttgtgatggatgggagcagaaagtaattgcttttgggcacatacttgtgaggaaaagaaatgattttagtccttctcagcagtcaagagggttgttttgcatttttctgcagtcttgaagagaaaaaatcacccaaggcattggacacacagtttgaacacataattgggcttggacttcattccattcactaattggtctaacttactaatttaagttggtatcaaatttctttgtaaaattattctggataatgaaagactccttaaagaacatcttgtatttcaatgttagaaagttataagtagattcacttttttgtc

SEQ ID NO: 76808 - DNA, 1869 bp, Homo sapiens
ctaagcattcgcttcatggtcgcatacttccttgttttcttttgcttccccttgaaacagaaattttagaattaaaaaagttggaaacacacggcatcttttaaagtctcttcttttctcttgtctattgccttcccttcttgcctcaaataacccagaccctcttccccactctgtaaagcataacagtcaccgcttggagaagtttaagagctaagaccagaatgaaaatatgctaggataatgtgaaggaaatttggccacggtctgactacctccttctccacccaaaaagtggcctgataacgtcccttcttggaccgtcttctctcaccatggtcacgccaaactcctggttcttccgtaatcaccaacggcgcaatacttctacgtcattcacatactgcttccggcaaaggatagcccggaagcggaaactccttggggaaagggcaatcccccgagccggttcccaggccgggtggagaccaactctggggtctgttggtgggagagtggggagcccgtcttctgctgagtgctgccgccccttcccaggacagcggaggtggaacttcgtcgcgctgcaacccccggctcgggtaacgtttctctccagccttaggcagagcccagaagacctgcctttaccagagttccagagagagagggaggaaaagggtaggggggttcagactcctggtttgcccagtagtttgggggaacacattctcctcaccctgtagcgttggggtatccggtgtctatggtccagccctgaggctgtggttcctatttggttttcctagccgatatggtgctttgtgcagctaggtggatgattgttctcgagtatataccgtgtactcctctcggtgaagagagaaatgaagcagtgtttgagggcctagactatcgctagagaattggggcataagcttgcatatgttactacttacccaagccaagaaaatggtgagatacaatgcacatttattgtgaagccttggtgtgtcatctttaagtaaaaagggagaatttgtgagaacaaggagcgaaaggtagcttttttctttgagtacctgctatgtattccagtggttcttaactttttggagataacttatttcttgaaagtttgtggaaagccaggaacaattctttaaaaaatgggcacacatacagtttgtaatacacttaatgagattggtggactctgaagcccatccgtggaccctctgggtgtctgtaaactttaaatgaaaacccccatcctgtatactgtacttgtcactttattcatattaccttctttgaccttctcaataacataaattcttttattttacatatggggaaattgagccccagactttgttcaggggtctgtttgagtctcgtgattccaaagtctgtacttgtatttctttttttctttttctttctttctttctttctttttttttctttttttttttttttttttttttttttttgcactttgtcttccattctccagctactgatcaagctgggaacggaatgggtacctctgtcatacttttcttattgcatgatgctatcctagagttggaagtaaaatatgttatcaggtttaaaaaagaaggtgaccattgtataacccttatgatgaaaacacgtttattgtttaacacgaactttggagtctgactgatggggttaaaatccttgctctgccttataactcgccatgacattgggtgagttaatctatctgcatctcagtttctttatctgtaaaatggagataatcatagtagcactcttttattgggatgttatcaggacttatgtttattcatagttaacatgcgaggtccctagaag

SEQ ID NO: 76809 - DNA, 1435 bp, Homo sapiens
agatattatctaggattattaactttttctttgccagggatcttttaagagacataagtgccattgtttaacacaccagcagttcataaaagagagactgtatcaccaaaaaatatttaaaatatattttcagaataaagatatttatataaagatatgacctttatataaagatataaaggtatttcattccttttaagtaagtacatttaactttatgaaaactttaccacattttccttatttttctaatttttccctggattggtaatggacatattatcacaggtagatactgatccatggcctagcatttggaatcactgtcatattcaacccagacaacttgggctagatgtgatacaggtcctgctgtagtatataatcctaacactagacaaactgttctctatcacattccataacagcagttttagaatcctttaagaatgacaaacgtgttgttgtatcattctaatcacgataactgtattctacctccctgtgcccatggtgattctacttttgctagaggaagagctagattggataattgctttttttgtttgtttgtttttgataattgcttttttaaagttggtgacaaaggttgccaggggagctgagattaagataatgatattactttcttccttgccttcctttttaggatttatttccaatgaacatggacaaaagagtttacagcaaacagtcccaagcagacttcttttttgtttttgttaatactagggtatcaatgtaaatttttctttgttcttgttttctttttccttcagtccccaacacccttcctgcttatttttccaatataatacacagctgggcccaccttaccacatcctcgttgataccaactttatcaacttttccataaaagccaaactggacttagtgcagtcaatgatggactgtctgtatgccaagtgtgagtatcatacttttatgtttccgtgacatttgttcagaataattatatttatacaaatacatgaaaggagggagatggggttcttgttaactgaattgctggccatttaatttacagtggtcaccatagcagtgaccatgtttaatgaattgaagtataatgcaaacttgactggaaaaaattaaactttcacaattcagaaaacacttagaatgcttcgagtatcattatggacatcaattttgaacataggggaattttctgttttagaattctagattttaaaattctagataaatgaaaaatctatttttcagtatctatattcttttatgttaacaaggatatgttctcccttttgccccagtgttgaaacactaaataagacattctgccatttatgatcacagccctagaagttagatagatgatggtcaattcctaagtttattcagtttggtatttattcgtagtacagaggat

SEQ ID NO: 76810 - DNA, 1065 bp, Homo sapiens
ctgggcatagtggtgcgtacctgtggtcctcgctactcgggaggctgaggtgggagaatcattagaacccaggaggataactagaacccaggagtttgaggctgcagtgagttgagatcgtgccactgcgctccagcctgggcaacagagcaagactctgtctcaaaaaaataataaaaataaataatttttttcccatcaggaacttacattaatataaaaataatgacagagttcagcttagttttttttccccagatatgtttataacagggaatctgcagtttggggttgggacaatcttagtttcttagggttttcttctactctagttcttcttgtatatttcagtgtgctaattctgctgtcattgcaaaagtgtcctgggtctttttaaaactctgagcagggatataattcagagataatttcgttacaagttctgttcttaatgtgaatttttttccctggcaggtatcccatgtataaccgattgtgtaatggctgaaattgagaaattggggcagaagtatcgagtggctctaaggtaggaaggaggtaaactagatctgttctagattggtatactgaagattcatctgtttgttgtttaaagatttcttggccagttagttgtgaaaatcatacaaaactatttatcatttttgggggggttgttttggtctttctctcacacaaaaatcagttccagttagagtgtctaaacttttaatagaaaatacagagaatatcttgtccgggctcggtggcctgtaatcccagcactttgggaggccgaggcaggcagatcacctgaggtcaggagtccgagaccagcctgaccaacatggagaaaccctatctcttctaaaaatacaaaattagccggctgtggtggcaggtgcctgtaatcccagctacttgggaggcttaagcaggagaatcgcttgaacctaggaggcggaggttgcagtgagcctacatcacgccattgcactccagcctgggcaacaagagcaaaactctgtctcaaaaaaaaaaaaaaagagaaaatacagagaatat

SEQ ID NO: 76811 - DNA, 1764 bp, Homo sapiens
ggatccaagatttgaacgattaccatgtacacacaaaggaacctatgcagatgactgcttagtacagagagtaactcaggtattatcagttcataactgtttactttgtgcttaaaaaaaaaaaatgtaaactattatctcctgaatgttcatggtcagtaaaacatctaggaatatacattatggttaaattaaaaaaaaattgcatagcattccttcataagaagcataggtgtcttcatttacttgagaaagtggattgaaaatgtacactctaaccataatggaaagagcacaggcttggggaggagacatgggtttcacgtctcagcacctgcatttactggctgtgtgatttgggacatttaactgattctttatctcacaaatctctgtaaaatgattttaagtgagttaatgtagaacccatttatttttgatgtaggaattttgttcctcttcacgatgcctaatccaaaagtgcttcttagttaaatctgagagtctcccaagatgctgtttcacacataccctagaataagtaggtttttaattccttcattaagcaccacaaggacttctgctactgagtgcttttataagggcctctctgctgatgataatcttcatctgctctgctgaccacagagccatccttttagccacttcaccccatggggcgggtgggtggggccagtatttcccacagcacagctgacaccactctgccactttttataaaactcagtaggagagtcagacgtgacagatgtgaagcttcctataaaatagctttcacctgacagctaaatattactgcttttataactgctaggctctagtttcaggccctgaatatcctacttaggcttcctgtttcggggatagcttacctctaacatcagtaggcccagagcacacccaagccccaagatctagggaaaggagggagctatggcctccaaattaaggcactttttatctccatggagttcctcggagcattttcccaaaactaaagaattgtctgccccaagtgtgaaagtccctttcatttatgagcagaaaacagtttgcagcttgtgaaaagttttctaccttctcctcctcaagattctaaatgctgcattcagcccaggcaacttgtttattttatataacaagattaggagctcctagatcatagtaggtactcaacaaattgttatagcctgcccttcgctacttactgtgaaaatgaacgattctcagactggtcagtcgttgtgccattatccagtattcactaagcgtgctcagtgacctcagtgtgaacatcactccatgtctcttacagcataagtgttacattgtggccacagttgaccgggacctgaaaagaagaatccgtaagattcctggagttcctatcatgtacatttctaaccataggtgagaaatttcccttggagaagggaatagaaatatataattgatatcaattgaaaatgaggataagtgataaggttataaaggatttgaaagaaattattgtatcaaatgtttacatagttatatttgaagaaatgagacaaagcaagagcaagagcaaaagagagagataggatttaaggaatgaggcaaacatttaaattgttagagtaagattactggaagaaatagacgtattgttttaaataaaagcagtaatttaaatcaagctaatctttttggccagaaatacctgttttgaaagatttttttttattaacacttcatctgaga

SEQ ID NO: 76812 - DNA, 1072 bp, Homo sapiens
ccccctctgccgcccccgccagtgatgccggggggcggctacggagactggcagccgccaccgccaccgatgcccccgccacccgggccggccctcagctatcagaagcagcagcagtacaaacaccagatgctccaccaccaacgagacgggcctcctggtttggttccaatggagctggaatccccccctgaatctccccctgtgccgcctgggtcctatatgcccccatctcagtcttacatgcccccacctcagccgccaccctcttactaccccccgacctcatctcagccctacctgcctcctgctcagccgtccccttcgcagtccccaccttcccaatcctacctggcgcccaccccttcttactcatcctcctcctcttcctcgcaatcctatttgagccattcccagtcctacttgccctcttctcaggcatctccttcccgcccctcccagggccattctaaatcccaactactagctccaccaccaccgtccgccccccctggaaataagacaactgtccagcaagagcctttggagagtggggccaaaaacaagagtactgaacagcagcaagccgcccctgagccagatccctctacgatgactccacaggtaagaaagcatctgcctgaacctcatctttcacctagagggccctgaatgagcaggcctcagggctttaaccagtggttagtctaattccaacacacaatgactagctaacactccaaaggattccgtaagagtcagagggctgacagctcagctttttaattagctagatgtgaattaccaaaaaaacagcgtttgtagatgtgtatggattacatacagtggtggggtggctcaaaagttacctctcagatacattccttggtttctttgaccatcctcttagattttgttgctgttgcaaatagattttgttgcagagggtcttgttttaaaattgtattttaaacgaaagtttccatttgagagaaagcatgaaaaagaggcctcgccaagggctgacacttgaatgtttgtaaactttatgattagttagcttcttttaaaa

SEQ ID NO: 76813 - DNA, 1011 bp, Homo sapiens
ccaggttcaagcgattctcctgcctcagcctcccgagtagctgggattacaggcatgtgccaccacacccagctaagttttgtatttttagtagagacagggtttcaccatgttggtcaggctggtctcgaactcctcaccttgtgatccgcccgccttggcctcccaaagtgctgggattacagatgtgagccaccgcacccagccaatagttctacattctttatgtttgaaatcccttcattcaatctcgttttaaatgtgacctatattatgatttccctctacctataaaacaacatcccatatgaaatggagttatctgatatgatgggacattcagaagagctggcatcattagcaagttcaggcattttttttctttctaaaatagggatgatcacacttctcttagggtcagtaaggacatttgtgagtgatatcattattatttatttgcagagcttcaaaaatgtgctgaagcctaccataggattgaattagatctggttactacttatagggttcatattaaatagaaattgacctacaaggcggccgggcacggtggctcacgcctgtaatcccagcactttgggaggctgaggtgggcggatcacaaggtcaggagatcgagaccatcctggctaacatggtgaaaccccgtctctactaaaaaatataaaaaattagccgggcgtggtggcgggcgcctgtagtcccaactactcaggaggctgaggcaggagaatggcgtgaactcgggaggcggagcttgcagtgagccgagatcgcgccactgcgctccagcctgggcgacagagcgagactccatctcaagaaaaaaaaaagagaaattgacctacaaggcatactgtcagtgaatcaacaagtacttcagcccttaacaagttcttaaccctggtctggatctaagacaaagcatgagaataggtgatgaagaagctgataaagaatctggacctgtacagttttcattctgtacagtct

SEQ ID NO: 76814 - DNA, 2053 bp, Homo sapiens
ttcaagttcttgaaattatccatattaaaaacttgaaaaatacttattgctaagataggtatttgctttattgtttggttggtttttccaactctgtagtaagttgtctaagccaaaggaaggaagaagaatgatcatcactcaaagaacttaacgaacttattcttagcctcccaaagtctttagtgttctaatttcctaaagcgtcaaatgcccttgattcattaatattttaacctatgattaattatcttatatgaatggttttaaatagtttttatccctttatttgtagaccatgtctgtagatatgcagctgcggcattatgagatgcagcagcaacagtttcaacatctttaccaagaatgggagcgagagtttcagctatgggaggaacaactccattcctatcctcataaagatcagcttcaggagtatgagaagcagtggaaaacatggcagggacatatgaaagccactcagagctatctccaggagaaagtcaattcatttcagaacatgaagaaccagtatatggggaacatgtcaatgccacctccttttgttccatattctcagatgcctccacctctacctacaatgccccctccagtgttgcctccttcattgccaccaccagtgatgccccctgccctccctgctacagtgccaccacctggcatgcccccacctgttatgccaccttctctaccaacctctgttcccccaccagggatgcctccttctctctcttctgcagggccaccaccagttctccccccaccttccctgtcttctgcagggccaccaccagttcttcccccaccatctctctcttcaacagcacctccacctgtcatgcccctcccaccattgtcttcagctacacctcctccaggaatacctccccctggagttccacaagggatacctcctcagttaacagcagccccagttccaccagcctccagttcacagagctcgcaagttccagagaaacctagaccagcactgcttcctactcctgtgtcttttggttctgccccaccgacaacttaccatcctccgttgcaatcagctggtccatcagaacaagtgaattcaaaagctcctttgagcaagtctgctctgccatacagttcattctcatctgatcaaggacttggggagtcttcagctgctccatctcagccaatcactgcagtgaaggacatgccagtgagatcaggtggcctgcttccagatcctcctagaagtagttacttggaaagtccaagaggcccaaggtaggtctgcttttttttctctttttttttggtttggctattttattgacttaggctatttggttctcgatggtataaaaagcttcatttatacaatgtttatactctctttgtacttatattgtctgcttgttaagacatcacgtatgtaatctagaaaaggtaacatgcccccatttctttgatgtctctgcttttgtcctatatgtagagattataatccagaatgaatgtagtattgtagagtaatgctaatcattttgtattgacttattagctttaaaaataatattaaactttatcttttgtttgctttttcattcatttgacaaataattgaattggcaattactatttgttagataatttgttagttgttagagataaagatgaataagccaatattctactggcttgaggcagtgaaatttagcataaggtaagtaggacttttattttatccattcagcaaatatttaagttcctgctcttgtacttagagcagtgaatatagcagaacacataaaattcctgcccccatggagcttacatcctttatattttccccagttaaggagatacttctgtttatcctgaacaacatatttagaaagaaaaaaaattgctggtgtgtaagttttttctctttaccttctaaaaactgttaaattcattttttccaagtttgtaaaaatagatttttctccccaagttgacctaaatgataacttttctatggaaattattattattttttgagacaggg

SEQ ID NO: 76815 - DNA, 1010 bp, Homo sapiens
ttccgtcatgttaatattttctctctttgcctactaaatcttggctgtgtgaatttaggacctattttaagttttgtcttcagaagaaaataacttctcaagttaataatctctgtgctgggaggatattagcaattatctaatatatctgtctacggcaacgcacgtttgtattccatttcagtttgtcacaatgagtcttgcacatatcatcttatttattcctcttagtgatatcaggaggtaaataaatacataagaaaagctgagattcagagaggttgtaaataccttgcctcatataacacagctagtaaatggtcaagatgagattagaatccaaggacttctgacccactttaagtccattgtactttctgtgatgagcagttgtatgcttaacattggcattgtgattaggaacactgccatataaggcattgattctagaaagtttgttttttacattgaacctaaatgtgattctttaacttttatctgttgattctagatttgcctctggagcaacacagaatgaattatcctatgcctcttctacagcatgtcactacagttatttaaaaactattaccctcatgtctccctcaccctacctcacccagtttgctctgccaatcacaactcagattcttttcatcttaacattgtttctaacctcatcctgctgtactgctcactgtcctttgaagggcctttagtttgttagtctccttcagaatgaacacttacttcagatgcagaggagcatgggcctagtaccaacttcattataaataatgtgcttatattgtatagcttaacaaattgcttttttgtttgtttttttcagcactctcacagtgttgactcttgttgaacttaacatcaatctagcttcccaggtctttttcacattagcttttattaagccaagtctctcttatcctgaacttgtgtggttggttttttgtttttgtttttcttgttcctttttctaagactttacattt

SEQ ID NO: 76816 - DNA, 2735 bp, Homo sapiens
aaaaaatactaaaattagctggcatggtaacatgcgcctgtagtcccagctacttgggaggctgaggcaggagaattgcttgaacccgggaggcggaggttgcagtgagccaagatcgtgccactctactccatcctgggtgacagagtgagactccgtctcaaaaaaaaaaaaaaaaaaaaaggcacacatggtatcactactagatcaagaaataggaattactggtgcccaagaaatctccctcatccccctcagttattttctaataccccaaagataactgctatactgagccatagattagttttgcctatttttgaacttcatgtgagtgaaataatactgtatgtactcatgagtctggcatctttcacttgacattgtattattgtgagagtcatccatgttgtgtgtagtagtagtttattcccgttcctgtacaatagttcattgtatgaatataacacaatctgtttatccattttaatattaatggtcattgaagttttttggttattatgaaaagtgctgctgtgtgtcttttgatgctgtatgtgtccctttagatgtatgtgtttgtttgtgtgtgtttaattttgtttggatatctattaaggattggaattgcctgattatagagtatatacatgttctgcgttaatgggtattgttaaacatttttccaaagtggttgtttcagtttatattctcaccagcagtgtttcagtgtttcagtttttttgcatccttatcaacacttggtattgttaaacttttaaggtttagcaatcctagtggatgtttagtggtatcatgataatggatttaatttacatttccctgatgactaatgaggtttcactttttttatttgattattgttaatttgtatttcctcttttatgaaatgctgattcaagtctttttcccattttttgactaggttttatgtcttactgattttgtaggagttctttgtgaattctacacatcagttttttatccattatatgtattacaaatttctcactgcaggactttttattttcttaatgagcacttgaatgtaaacgctgcatgctgggtacagtggctcatgcctgtaatcccagcactttgggaggctgacgcgggcagatcacttgaggtcaggagtttgagaccagcgtggccaacatggtgaagccccagctctaccaaaaatacaaaaattagctaggcatggtggtgcacgcttgtaattccagctactcgggaggccgaggcacaagaatcacttgaatgcagaggtggaggatgcagtgagccgagatcgagtcactacactccagcctgggcgacagagtgacagagcgagaacgagattccgtctcaaaaaaaaaaaagaaactaaacgctgcagtaagacagtttgatctcagtatagtagaaaagtagtctttaccgtttaccttttaggtccaatggaccctttgtattttaaagtttaaagtaattttacaaataatttacagaatttaagaataaaggggccgggcatggtggctcacatctgtaatctcagtactttgggaggcctaggcgagcggatcacttgaggtcaggagtttgagaccagccaggccaacatgggaaaaccctgtctttactaaaaatacaaaaattagctgagcatggttgtgcacacctgcaatctcagctactcaggaggctgaggcatgagaattgcttgaagctgggtggcagaggttgcagaactgcaccactgtactccagcctgggtgacggagtgagagtctgtctcaaaaataaaaataaagggatagtgaaaaaaatgttaaagacaaactcttttcatccattaaatttgggcacacaaacatcttaaaagatgaaataattctgtcacataccctttttttttttctttttttttgagatggagtctcgctctgtcgcccaggctggagtgcagtggcgcaatctcagctcactacaagctccacctcccaggttcacgccattctcctgcttcagcctcccaagtagctggaactacaggtgcccaccgccacgcctggctaattttttgcatttttagtagagacggggtttcaccgtgttagccaggatggtctcgatctcctggcctcgtgatccacccgcctcggcctctcaaagtgctgggattacaggcgtgagccaccgcgcctggccttctgtcacatatccttttagcaaattgagatggtccaggttcttgccacaaaatatgtgataagataaggtccttcctgtttaataactaagtgaattaccacaccacatttcctttctgttcttagaaatatattgtcagctgggcatggtggctcacacacctataattccagccctttgcggggctgaggcaggaggattgcttgaggttaggaatttgagaccagcttgggcaacatagtgagaccctgtctctacaaaaagtaaaaaattagccaggcttggtggcatgtgcctgtggtcccagttatgtgggaggctgaggtgggaggatcgcttgagcctgggaggccaaggcagcagtgagctgtgcactgcactccaacgtaggcaacatagtgagatcctgactcaaaaaaaaagaaagaaaagaaaccgtaaggctacaagtattattatttactttttcttcttttatttctttaaccttttatttttaaatcaatactcca

SEQ ID NO: 76817 - DNA, 1579 bp, Homo sapiens
gataatattagttcatccttctccacctgattcacactccctctttcatgttctgtaacttaaatactgaaatataaggttaactcttattaacacatgttagataataaggaagaaaactaatgaaccaaaaaatatttggttaatacacacacacacacacacacacatatttaaacacaaatatatcaaattaaggaagaaatatttgtaactattgtagtccatatttctgcaatggtcatgtggtcatagctggtatatatgttcttccactactcattccatattccctttgctctaagtaagtacttcagccagttcggattccttgcctcatggggtgacccaggctttcattcttgaaagatatgggctattagcagttctttctgaattacttctgctgtttgcagttctacaaaaccctttgcaattttccgtggacttgaatctcaggacatgggaaatactaagagatgtcctagaggatctcttgcatttcagacacacttcacttcacctgtattgtgcaatagtcactcaaattcctcttgaaagttagggtcagttatccccagtgaatacagtaaccctctccattgcctcttgatttggaacttcagagtaaagttggggtctcaacttcaggttagtggaatcatttgttgtgtcccctagtggatgtgttcgtctctttgaaactagacttttagaacaacaaagcctaaagtcacagggataggaaataaatattttgccaacactgaatttattagtcttcattgatttcccaaagaaatgaaagaaaaagcctcctagcactcattaaaagtcatgaaaggcatcactgtctactactcagtcacctaagccagaaaccttggaatcatcttaaattcttcccttacaactatcattttatttctactggtgacaaaatcctatcaattctaccttattttacatctctcacttttatcccctcctctacattctcatatcagtcactgccttagactaggcatcaccttcacttacccaaattgtaaagatgatctttaaactttttgtctctgtccactatttttctgctaaagcaatcttttaaaaatcagactatatttagtggctctaagtgcttataaggtaacaccaaactccttaaccagctgaattaatttatctgttataatcgagatccaagtcagatggctttaacaagttagaagtttattctctcttaggacttaggtgatggttcaggaatccagttccttctgatttacctggtcttggatatttcaccaccatgtcagaaccagcatgaaaaaggaaatggagaagaggaggatgtgccctttcctttaaggggacaacccagaagatgtgcaaatcattttcactctcagctccttggccagaacttggctgccagttctagctgcaagagatattgagaaagagagtcttgtctggggggccttgtgtctagctacaggaggcctgttattgtagataagtggggaatgggtattggaagaccaccagtagtctctgccacatgaggcatacacaa

SEQ ID NO: 76818 - DNA, 4001 bp, Homo sapiens
tttctgctttactgtcttgagtaatatcttttgttttacttgtagatttgatggtcctcgaagatttgaggatttagggtcaaggtgtgaaggaccgagacccaaagggcctcgttttgaaggaaatcgccccgatgggccaagacccagatatgaaggtcacccagcagagggcactaaaagcaagtggggaatgattccccgggggccagcatctcaattttatattacccccagtacatccctaagtcctcgacagagtggaccacagtggaaaggccccaaaccagcttttggacagcagcatcagcagcaacctaagtcacaagcagaacctctttcaggaaacaaagaaccattagcagacaccagtagtaaccagcagaagaattttaaaatgcaatcagctgcattttccattgctgcagatgtaaaggatgtcaaggcggctcagtcaaatgagaatctaagcgactctcaacaagagccacctaaaagtgaagtctcggaagggcccgtagagccctctaattgggaccagaatgttcaaagtatggagactcaaatcgacaaagcccaagctgttactcagcctgtaccccttgcgaataagcctgtacctgctcaatctacttttccttcaaaaacaggggggatggagggaggaacagcagtagcaacatcatcattaacagcagataatgattttaaacctgtgggtattggtctaccccattcagaaaacaaccaagataaaggcctgcctcggccagataatagagataatagattagaaggcaatagaggcaacagctcatcttacagaggtcctgggcaaagcagaatggaagacacacgggataaaggtctagtaaacagaggtcgcggccaggcaatcagtcgaggcccaggattggtcaagcaagaagactttcgggataagatgatgggtagaagagaagatagtcgagagaagatgaacagaggagaaggtagccgggacagagggttggtgaggcctggaagcagtcgggagaaagtgccaggtggtcttcaagggagccaggacaggggtgcagctggcagccgagaaaggggaccacctcggagggctggcagtcaggagaggggacctcttcgaagggctgggagtagagagagaataccaccccgaagagctgggagcagggagagaggaccacctcgagggcctggcagtcgagaaaggggactgggaagatcagattttggtcgtgatagaggtccattcagaccagaaccaggagatggtggggaaaaaatgtatccatatcaccgggatgagcctcctagggctccatggaaccatggagaagagcgagggcatgaagagtttccattagatggtagaaatgctccaatggaacgagaaagactcgatgactgggatagagagagatactggagagaatgtgaacgtgactatcaagatgatacactagagctctataacagagaggacaggttctcagcaccaccatctcggtctcatgatggagataggcgaggcccttggtgggatgattgggagagagaccaggatatggatgaggactacaatagggaaatggaaagggacatggacagggatgtggatcggatttcaagacctatggatatgtatgatagaagtttggataatgagtgggacagagattatgggagaccactggatgaacaagaatcacagtttcgtgaacgggatattccatctcttccacctttaccgcccctcccacctcttccacctttggatagatatcgggatgatagatggagagaagaaagaaatcgagagcatgggtatgatcgagatttccgtgataggggtgagttgaggattcgagagtatccagaaagaggagatacatggcgggaaaagcgagattatgttcctgacagaatggactgggaaagagaacggttgtcagacagatggtacccatctgatgtggatagacattcccccatggcggaacatatgccctcctcacatcattcctcagaaatgatggggtccgatgcaagcttagactctgaccaaggccttggaggggtaatggttctcagtcagaggcagcatgaaatcattttgaaagctgcacaagaactgaaaatgcttcggtaagttgactccttcagatcctttcttttaataaaaaccacattcagactgctctttttaaagtgatatgatatatttgaatggaatcattttacttcaagttcttatcacatacttttaatttatatttctggtcattcagtgctgttttagggttagaatgggtatttaggaactgtgttaatgataaacttatgccctaagatgtgaaaattgattgctgtcttggcctttgtagaagtgttgctggcatgccatgcctgtgcatgtttcaagtgtcaaacttcaacttttcagtgctctggatttcacagggttcatgtgtaaccttcattttttccagtaatcagtttgttctttggtattagatctgatagactttatattcactaatcattgataaaactttggaaagtgctgtatttttctttgttgaagctaagaatggtttgcttaggagcatcctcagatttgtcttaactattgatactttcttttggggatgttttatctttcattataactaaaagcagatatttctccttgaggatgttatttgtttctacataaccaaatgttttctttgtgaaatggaaaataggatttcttgacttacaatcaactgtgtataggtatctacataattttcctcttttcttgtggtaacaacaataacaaaagctaacatttattgcatgcttactccgggccaggaactgtactaagtgtgttgtgtataataaactcatttaatccttaaaccagctgtatcttgggataggaatttagaagtcagtgacagattgaaaacttttttaaagcaatttttttgagaaagtcaattaatgattaggttttgataaattccaatgtatttcttccatttttcaattctggtttacatttgtggatcttaacaataaattataacttaaactttagaactaggaaagaaaaatacggtgaagaaaaggtaatgatgaaagaccagatacggcaggtttgtatggtctatagctaagaggtttattttttccagattactcatgaagaaaatgtggaaagcatgctatagaatatttagctactacactattcacttttaagttatagacacctttaattttaacacctaccgtgtaactgggcacttgctaataattgagtgtatattatgtcagtctgtctatctcaaaggcctgcaaagataaggtagtattatccccacttcacaaatgacactaaagttcaaagaggttaagttcccttggctagtaagtggcaaacccggcctttgaactcaatctgtctaaaactctaaaatctgtgttatttatggagaataccaagctgattggtgttgttaagctgccaaggtttctttttttttcctttttaaatttctttttaattcgttattgctttgcatggtaatgctggataaaaggtgctgctgctgcttcatccttttttaaagctttctaggcaacatgaacataattaaacaatatatagggagtgatggataatgtcatagccgaatacaagtcgtttatgttgtgtcagtgtaaagtcgtaaggagtatcataagggatgtgatgatgggatttacctgagcagtaaataatcttacacacttgacccttactttgtggtccctcatttgtggaccctcatttgggtcactttaatgtaaggagaaaattgtaaaaggtcttaagaaattgtagtggattttacctatgtttaaggtaggcattgtgaaaaaaagtaaaaggaatttcgtcagtttaaagaaaaaaccgaaggattacataattatcttcaggaatatga

SEQ ID NO: 76819 - DNA, 1019 bp, Homo sapiens
ctaccatctccatcatagacatttctgatggtaactggtgatgctttgggaaaacaaatggaaggagggcacacaacagtggcactccttagattactagatgttcatttagtttattttgttgtttcatagtactcatgttctctgttggtctcagcttcaccacagatgactattgtcaaccagataactgaaaggaacagaagtgtggaggctatctaggatttctctcactgaaaatttactgtttttgtggaggagataggtctctagagtaggaagatagttcttatttatttattcatttctctccttcctgcacactgagcataggaagatagttcttaaccgagggttataaatcagaattattcatggagggtttttttaaaattttgaattactggtgggaccccacctacagaagttcagtagatttggtattggcctgggacatttgaatcttacgtggctaccaccctaatttggagtatggaaattttaaaacgttttcattacccctgtaagatcactgcaccagtttacagttagttaatcctcattcctaccccagtcccagcactttctgtctatatagatttgcctttctgggcattttgtataaatgaattatataatatgtagtcttttgtgtctatcttcttttcaaagtttacccatgttgtagcatgactcagtacttcatttctttttactgctttttaaatttctttttatttataacctgttacatgaatataccacattttgtttaaccattcaccagttgttggacattagggttgttgaatagtacggctatgaatgtttgtgtgcaagtctttggatggacatatgtttttatttttcttggatagataccgagaaatgaaattgctgagccatatgataaatttatgtttggccgggtgcggtggctcatgcctgtaatcccagcattttgggaggctgaggtgggtggatcgcctgaggtcaggagttcgagaccagcctgacca

SEQ ID NO: 76820 - DNA, 1017 bp, Homo sapiens
tcttagttgaatttatggcaaaaatttataccagctctgaagttagatttatagttttctgcttttatttctataaaagggatatagttattttgtactaattgtttttgtagagcatgcaggccaacgtgatcgttatgatagagaaagagatcgtgagccttattttgatcgtcaaagtaatgtcatagcagatcatcgagattttaaaagggatcgtgagacacatagagatcgagaccgggatcgtggtgttattgactatgaccgggatcgatttgacagagaacgccgaccccgagatgataggtatgctataaaacaatctttgctaggtgtacaaattactgtatacttaacagtaaaagtttaagagaaatttaataagtaacatattcttctcatgcatgtgtatatgtaatttggagggggaagaacaattctggaccagttttcaggaaagtaggtccttgacttggtagcttgaattccagagaattaaatgggagatggagatagccagaagggaatggaaatggtattgtcaataaaggtgcagtcatactcagtaggcaagcaatttatttttgcaattcatgagctttttatttattattattattattattattatacctaagggcattctggcagccagccaaggaaaagggaaaggggggcaagcccatgaactatttatttatttattcattactattttgtatggagacggggtctctctcagtctgtcacccaggctggaatgcagtggcgcagtctcagctcactgcagcctccacctcctgggctcaagtgatcctcccacctcagtctcctgagtagctggggccacaggcatgtgccaccatgcctggctaattttttttttgtttttgatgacgatgtggtttcaccatgttgcccaggctgatctcaaacttctgagctcaagtgatccacctgcctcggccttccgaagtgctgggattataggcgtgagccatcatgcccagcttt

SEQ ID NO: 76821 - DNA, 1466 bp, Homo sapiens
atccatgtttggaggtagagtgatgccttattaactacaaggatgttgagaatgtaaagcatgggagatgctttccattgtagctatgaatttaaacttttagagtaaaacgtattcacagatttcttagagctggtggcattgtcctaaaaaatagcagtgtaattaatgaaataaagcatgtttatttttaaaacaaagtagaatcaaaattactgatagtctcactacctaccatactacagctattataattttgtagctttcctctcattcgctctttacagacatatttatgaagttgtaatcaaagtataataatacaatttctttatcgtgattgttctgattgatattgcaccatacacatttttcatatgtaaacctattttattaatggctctgtgacattccattgagtggataaaatataagaccaagacccttattcttagttatttaggttgcttttagtttttcactgctatgatttacacttaaactagaaactcatacctatttttaggaacaggctctcctaagatggtataactcttactcttaaaaccataaagcagaagttacagaacttaggactatccagcaaagcatttattattcttccatgtcctgttgcttaactttcctacatttaatacaaacaaggatgaattcagtgttttgcagaacattctatttgcctgaaatcatacttaaatcttctcattttcttgacttcagtagattttacattaccttaaattttctctaattaaagttaaaagtggccccaaaatcactggacttggtttgaattatattaccttaggatgtgtggggagagttgaatttcaaaataattactctacaaatagtaattttgttcaactgctggaatcctaggagaacgaaggacttatcctgaggagcgaatgcctctgccagctccttcactgagccaccagcctcctccagctccacgagtcgagaagaagcctgaatcaaagaatgtggacgatattttgaaaccaccgggccgggagagcagacctgagagagtgagtcctatgaagttgattcgtcttcgtgcaaaccagaagataagagatcttgttaatatcctgaaaagaatttctttatttttctgcaacatagtaataatatcagattcaagacgttttactatctctaaatcaccatataatctcataaatggcctacactatagaatctttaagaatttagcactaaagtacttggcaaaaaagatgttgaattttaaaacatattaatgagacctcaattaattgcgcgttgaagagaggaaaagtggatttggttttatggtgtgtggaatagaaagggagaattaggagacttgattagcttaggcttaatttcctagtgacctccaaatgtgcgcattctattaaatttgtcttattacagaataattagactgactc

SEQ ID NO: 76822 - DNA, 1021 bp, Homo sapiens
tactttatattatttctgtcctttcaaatttatgaaggtttgtttcatggcctgttgtatagtctatcctggaaaatggtaggtcattgttaactgttatctcattgcagaaaattttctctcagtgatttttttttttttttggtctattctgtttcagattgttgttataatgagaggattacctggcagtggaaagacacatgttgcaaaacttattcgagtgagtatggggaagctgaaaaatcagctgcttgtgctgcttgtgttagtagtcacttgccttcttattaatagcaagcaacataatgccaatagaattgtcttccatttgatccattacagttggcccatgtggtagatgttgtcccatatatatttttatctactcagagaaacatttttgcctctgcttgatttgaaaccaccagaagattgtatattatttagccacaagagggaactttggtgtgaacattaatttattccataaattcgttttaaccttcttgactgtatgattcttaggataaggaggtagaatttggaggacctgcacccagagttctaagcctggatgattacttcatcactgaagtggaaaaagaagaaaaagatccagattctggaaagaaagtgaaaaagaaggtatggtattcatctcagatctcgttctgattcattaatagtatttaaaggaaaatgtgtttggagagaaatgtggcttttttgagggcagggacctctctcttttccgaacacagtactttagtacttgggtgtgaaggaaagactacaaagtcatctctatccaaatactaaccaaggaaaaggttttggatgattctttgcttttgctaattccatatctcttttgggggaccttaggtaatggaatatgaatatgaagctgagatggaggagacttaccgcaccagcatgttcaaaactttcaaaaagactctggatgatggcttttttcccttcatcatcctggatgccatcaatgacagagttaggc

SEQ ID NO: 76823 - DNA, 1136 bp, Homo sapiens
ttatggcctggcatggtggcttaggcctgtaatcccagcactttgggaggctgaggtgggcggatcgcttgagcctgggagtttgagaccaacctgggcaacatggcgaaaccctgtctctacaaaaaaatacaaaaattagctgggcatggtgtcatgtgcctgtggtcccagctactggggaggctgaagtgggaagatcacttgagcccaccatgtcaaggctgcagtgagccatgttggcgccactacactccagcctgggtgacagaccgagattctgtctcaaaaaaaaaaagaaattagcccattagactttacaatattaaattaatatttaacaaatatttaattaatatttaacaatattttaaaatattgttaaatgttgtttatcttggatgcttacttggtctttgagtagtttctagagataactcaaccatctgaatttttcaatagatggctgatcactgggaaactgcacctcgtcacatgatgcgtctagatattcgttctttgctgcaagatgctgctattgaagaggtgagtatcctttggttcaaatgcaatgcaaagtgatgttactttttcacctttttactttgaaaaacttaaaacctacagaaaagttatatgaatagtattcatacaagaacacctactgatatgcctttcattgagatcacggttagtattttgccacatttttctctgaatgcatgtattcttattaacattcttgttaatgatgtcactgtttttgtggaaccatttgagagttaagttgcagatcttataaaccttcacccttaaatacatcagtaggtatcttgtaagaacaagtacattctcttttgatttgatgacagttatcaaatgcaggaaatttagtattgataaaatactatattaagtaatataaatttcctgaattaaatttcttgaattatctcacatatagtttatattcacattttaccagttgtccctataacgtggtatatagaaattttcaaaaatctaagattcaatcctttaatataaaatatagtttctcagccttgtcattgtcatgaaagataaagaatttatgaagagtataggcctgttttgtagaatgcccctcaatttga

SEQ ID NO: 76824 - DNA, 4382 bp, Homo sapiens
attgtcattgtgctttttttttttttttttttgaggtggagtctcactctgtcacctagattgtagtgcagtggtgtaatctcggctcactgcaacctccgcctccagggttcaggcgattctcctgcctcagcctccttattagctggaactacaggcatgcgccaccatgcctggctaatttttgtatttttagtagagatggagtttcaccatgttggccaggctggtcttgaactcctggcctcaagtaatctgcccacctcagcctccgaaagtgctgggattacagacgtgagccaccatgcccaaccgtcattgttcttttatgtgtttttaattcccatgccatttctcaacccatttttttctggcttctgccactaccattgtctggcaactctttcactaatgatttccgtggcagtggacagttctcatttcctctattgattaattttgtagccacatgtaatatagttgaccatgcccaccttcttaaaaaacatatttttctcttggcttttgtgaattcacatttttctggttttccttttacttttttggctatctcttttcagtctccttcactggcttctcctgcttctcactctttaaaagggcccccttagggctccatcctaggctctgtttttattttgtaccctctgtatagatcatctgaatctttccggtagcttagattgtcacttacgtgccattaatgttataaagtctagattgaattatattactatctaaatagtagtgtttctgaatggagggagtataggtgatttttataatcttctttttactattattttccaaattctctacaaaaaatatatattatcttagtatacctcaaactcaacctatccaaaatattgttcgtccaaacctgtttttcatttagtagtctctgttttagtaattagaaccctaaccacttgattgctgaaaccggtgctctgggagttatccctgactcttttgtcattgttgagacagagtctgactctattgccctggctggagtgcggtggcatgatcatagctcattgctgcctcacctcctgggttcaaatgatcctctcacctcagcctcctgagtagctgagactacaggcgcatgccctgtgcccagctaattttttatttttttttagagatggggtctcactatgttgcccaggctggtcttgaactcctagactcaagcgatcctcctgccccaacctcacaaagtgctgggattataggcgtgagccactgtgcccaggcctgactctttactctgcccttgtgacctgtcatgtagtcaagaaagtttagtcagttgtaccttttaatgacctctgtaactcatctgcttatttgcgttgctaccactctgggccaagccaatatcatcccacttttcactatactttttcttatattttgaaatttgaatcattgacatgtttttacctgattggaaaaatactcgttaaagatttttaaaagtctagtaatccataggcattcaaaataggtaaccatctacttagcacttatacttaactttacagggaattgtacagatggatattcaaggaaaattaaaggcagtagtatcctgtcttttatcagttctgtttcaaaatttagggtgttaaaaattacttggtatgtaacagtgagcctgtcttgctctgggcaactgtattcattccagatctcaatgagggagtcaatattttgctaaatgttaactcagtctttttttttttttttaatggttggtataggtagagatggaagattttgatgcaaatatcgaagaacagaaagaagaaaagaaagatgcagaggaagaggaaagcgaactggtaggagacagaccaaccactttgaacagtgtctctttattaaaattcttaaagaaggtttaaattcagatctgtggttagacaactactgttgatatacactttagtggtaaaagtttccataatcatcttcaaggagacttttggatactctttatttttccccagaccaaaagaaccctctaatgtggtgttaagagaaagttttaacagagtgctaagaaacttacccttgtactcatctatttgtgggtggttttaggggagtataccttttaagaaaatcaattacatatgaaagggcattcttacattccagcagatatgtggcacagcctacccaacatatgcataattgtctcttctttgctacaagatctccaaatttgagtttctgtcaacagaggcagaagaacttattgaatggggaggcagagggttgccactggctgctagatttgttcttctgcattttatcctaagtgacggggaaaaattaaatgactgtgtaggcaatggattttgctcaggctgattagaggcttacatagtgtgagtttaaagtttctgtgtacctaatgtaaaatgctttcgatcacacctctgtagagatgtttgcctttccctgtcattcaagaatatgcgacctatagagttacgttgacttttcagtgtttactgaagtacagagattagcaatgccttggaatagtgttgctttttaaatccagaatattactcggtttatttaatacttgagcccttgctaaagttgctcctcatattcttttgaaaatgtacaaaatgagaactctgattcctaccccctagagtatacagaatctccagggagtggtcccatcgaacccgtgtgtgatatagaggactcttgataaaaactgtgtttatataaagatggtgtcaacctctacattccaagatttcaaatgtggattaaaaaataagttttaaagttaatggcatttgagtctcagtatgtgttttttttaaatctagttttcttaagttgtattttggcatatataatttaaaatgtaggcaggatattcactacaaggtccacgctcttctggaatatggctaatgacttctttagccatttgcagcgtgtgtactagaaactgattacgtgagaagtctataatgttttagctttctgaagctccgtctttcttttgtggagatttcagtggttcataacatctgacttgcttaggtgtaggtcaaaacttgggaacttttaattgaatgtactattactttttaaagtgaaacacactgtaatactatatttttacatcagagtcatggcaaggaggccttaaaattctaccctgctggattatctgttttatttccaagtggcctacaatttcaagcaatgggagagtaatatagtttaaaggaagcacaggatgattccagcagggggaaatgaatacacttgtctgcctgacttgattataaaacttctcttaacccattcaaagatgcagaattgaaatcttttactattggagtccattccaagagtaaaagattcttggagaatatgttaaccaagggttaagagcaagtttcataccaaccactcagatcatttaaatggaattctcagtaaaccttgcattttccactctgcactaattaatatagctggatgaaatccaaagttttgttggtaaagataatcgtttgtaggggatcattggtatgatagtttgcctcctttagtgcttcagtgaacctagtagataaaatttataaatatattattccagtgatgcttaaagttttcagatgatttttaagatgtaacttgtcttcagtacttttagcactatcacttcagtatagctttgtcttggtttgttctaaaaaatgtatttgggaaatatataatttgtaatccaaaatactacctagtaagttgaaattgaattattagttctggctggtagactagaaatgtatgaaacccataggattatgctctagtaaactcttacacagaagctatcatcatgaaatcttcaaaatgctttgtgacttactttacctgtgtgtcagtttgtttcatgaacttgaacattcccaacagtagagagatagattgattcataaaagaggatactgacacctttgatgaatctgtcctatttactaggttccaatattaacatttctgtatgttaggtctaatggaaaacagtctaaatgaaggtaaaggggaataatgataaatcacatggtaaaagcatatacttgctaggtgaataaacagaaatgattactgcatagttcaataggcacactgggaaatttgaaaatcttttgggagtgactttgaaataagccacccagttattttatgaaatataagatgtaagttgccagtggagatttctggtttttcatgtaagaggaaaacataattttaaaaaacatcagaaataataatctagttttcaactgataaaaatg

SEQ ID NO: 76825 - DNA, 3974 bp, Homo sapiens
atattaacttgtaatctctagaggcctcatgtaatacatgatctggggtaatgctgttttaaactcaagccagtccatcttttacttttctttctgtttttaaaaggaaaagggaatttagttgtgatgattattcaagaatatatattaatattggtatttcttggaatttctggaaaacattctggcccgtctaccatttgcttctcagaaaaaaacattttatacaaattttcagttttaaagacagaatagtagacaatgaattccagaaatggatttttaaaacaaaccatttcagtgaaaggcactgaagatctggtaataaatctaggaaataaattttaacatatttacagtcgggtttttattttttaacaagagtgatagtgatgttgtatataaggacttgtatcttgcaccactgtattgagagctaatcccaccacagaggaaggcaaatttagtgtgcattcttgaaagtgcttagtactttgaggttggtccattgagccaactgagaagattcttctctaaaacatgaggatcttgtgtcggatcttgtagcctatttatgttgccttccttatcataacaaatttaatataatttgattaccaagtacaatttatttttctgagtactttaccaacattctccaattactcttggaaaatgattatactgggtggaaatgtattaagttttagcagtgtcacatgttgagcaaaaacagttgaatctgaaacagaggaattttgattcacaaatgagtctgccagtgagaacatacttacctatagtctttgaagcagctggttagagcttattgcagattcttggtctatgctcattaagtttagtacacagttcagcctgtgcctgaatgttaaattggaagtgatgtgatttttagaacagttcagaacaggcctgagctacctctggcatggagttgttgaaggctgcctgtggcccaccttcagtcccaccagactggttcttccctgctgggacacaggcatcataatgcaagggcaggttgttacttgccacatcaggtggtgggattcagcattgaagctacttaaactccagtgacatgattttagtttctcatactgtgaagctagaatatttgagactgttaccatcctaatttaggtttcttcatataaagtacttttgcttttctcatctcagtgtcatttgtctctactcttgagttgtatattggttttctacatgtcagacagattcatctcttcagagttggaatataattattatttgtataggtgcataatcttgtatgtttacgttgaacagattttcagaaataccatttacatttagaaaatacatagatgtatctaaggaatttttctgttgtgctataatacatactgtttcaaatatgtggtaaaattctgtgacctgccatattggatttaaaacttcatcttcatcttaaaacttcatcttttgaaatctctgaaaatcattagtgtgcatgtattgaacaccagtctttattctgtaattaacaccccagatttctttcccctcaccttatgccatccatctgtgtgtttggtttccagtatgccatgtggaagaggtgtgagcctttcttcagcccaagaaggaaactttaaacatatttgcacaataaaatttcaaattaaacatttcaaaaagggtgctcagactagaaatacatgctcttctgaaattccatgttgcaactgtaactcctgtcatatatacccagtgtatgaggaaaagttcttgcagttttcacactgcccttctgtattgctgcctggctgtgctctgttgttggaactgaaatatgaaatttttactttgaagtatgttaatgtcaaagttgatcgtattaagtttggaaatcctttgaggtttatctaataagtgtgttggagcttctgtctcttctggtaatactgtaccctgttgaaccaagaacagttttattgtttgtgggacttcgttggttttctaataccataacctgtgtccctgtgcagtcagggggtcacttctttaagatcatgtataatacggcccgtcatatacacgtagatagagccatgtgattccagaaattagaagactggatctgtggaatccatacatgttaaaattttgccaaaatgagatgattaaaatttttgtgagttttataaactgttgcagttcgccttactgatttttcaatgataatcacttttatgggaagggggcttaggaacaaaaaactttgccaagaatgcaaaatcttactggtttttaaagcttgtaacagttgtgtgtaaaacttttatatttgaaacgtaaactcaccctttctgccactgctttcattgcacttttcataccaagttctctccaacgtggtgtctgaaagatttttattatatacactctttatggaattcaatgaagtgtggttatgctgtgtttctgaagtttttaggcttttcttcattggcctgcctaatactagtgtgtttctataacttcagatgattcaaaagtttagtgcttcattgtagcaaaaaatgtatataactcataatatcctacatgtagtattcaaaatcaattattaataaccaataaaagactcaacacattttcattgcgtgttcttctttaagacacctaaactcatatctcataatttctgaatccgcaatccctattcattaattgattacagtttttgagttgttggaaagcctagccctctcagattcagggttcagaaagaattaccaggtctggtaaaattgtctgactagcccttagcctcagaatggtcaacttcatagtataagcaaagaaagtggtgatctcatatagtcagctttttcatgaacattaattcatggtgaatgcactcacagcaaccaaaatccaaaaaaaaaaaatgttcatctaaaaccttaaacattagcttggctcattgagttcttggtacaacctgcttttcatatgacacagtatcaaacatgatttcagatgaaatgggtggtgttaatattgtgttaaagaaaaaaagaatggaagacactgtctagaaaagcccaactttgcatttgccatcagaaaatgagaactgtggtgggtgggaggacaaggaggccaggagccaagtgccttttcttgccttgcccatatttgctcttaaaccaacatcgtaaacataatggctaccagtgtgaataccaaacaatggaaattgcacagaacttgatattatctcagccaagaagatagtttggatctgcaagtgatgctgcactcaaaaatgtggatatgccctctgaaagcgttccagccttcttttcccctgtgtgtgtgtcgtgtgcaaactcacactcttccttaatgctacggctctgtgtttgtccctcagacaagttggatggcttgaggactggtactaaaaggaaacgtgactgggaggccattgccagcagaatggaggattatcttcagctccccgatgattatgatactcgtgcttctgagcctgggaagaagagggtaagagactttgtcaataactgccaacaaatgaagggcccatttaggcatctggttttaggaagttacaggcagatgatcacatggatgctatttttagaatgatttagtttacgctatgtcatgtatcccaagaaggagtcataccttataaattatctcatcaaaatgtacaagtagcttaaaaaattggagaacagaacctcacatggctagcacgttgtcaaccttaaaggcattgggagtggccagtcacttgtgctattttgtcatggggcaaaaaaagccaggtacagagtagggtattgaagagaacctgtggaacttcttaatggatgggatgtggagggtccaaaggtagatcaagggtgaccccttggtactctggccatgagcac

SEQ ID NO: 76826 - DNA, 3969 bp, Homo sapiens
tgcctcagcctcctgagtagctgggattacaggcacccaccaccacgtccggctaattttgtttgtatttttagtagagacggggtttcgccatgttggccaggctggtctcaaactcctgacctcaggtgatctgtctgctgcagcctcccaaagtgctgggattacaggcgtgagccactgtgcctggcctaattccaatgttaaaatcttgaacatttattcgcaaacatactactcatttcaaaaacacctacacattttttcttctaatcctatattctttattttatctgagtttaaaacttagaatttaaactgtagatttaaaagtagcaaggtgagattgatcagtatatttaactatgtgctgaggttgataagtatatttaactatgtgctgaggatgccgtgggaatggatttaaatttgctgtgggctgtttactttttctttattcaatgagccttaccatataaggggcaaactgtggccactgaacaaagaaaaagtaaccagcccacagcaaatttaaatccattcccacggcatcctgagcacagtattgtgttttcacataaatgcccaagacttagttcgtaatgatctttcgctaaaatgtgtatccttgatccaggtggagctgagagaatatacatgaattaaatttaattaattaattattattgaggtagggtctctctgtcacccaggctggagtacagtggtgtgatcttggctcactgccacttctgcctcccaggctcaaacaattctcccacctcatcctccctagtagctaggatttcaggcacccaccacacaccatgcccagctaatttttgtatttttagtagagacacggtttcgccttgttgcccaggctggtcttgaacacctaggctgacgtgatctgccggcctcggcctcccaaagtgctggagttataggtgtaagccactgtgcctggctgtatatatgaattaatcaaaataggtacttcagcattgatgagcagaatgcccaaagatttttctatattgaagcccacattatttattaggcttcttactaaagcccatgaaagacattgagccataggttttctatacactaaaaacctactttctggaaagtcagatgttaccagtttcttcccactgctattactttggctcctccctttgaccaggtgatactgttaaaagcctagttatttcattgctagtcatgcaaatggtaattagtgtacattagagcaataatgcattcccaggttcagtgtaaagagcatggtgtttccatgctctggttctctctccttgtcacagataataaatcacaagccatgtttaaaatacattctctgcagtctttgatactgtgtagtgcaagcaacagattcatagtttctttttaagaatctgaacttttacagaatatgtatatctccatatacttttaaaaacatattaacataatatgtggctgggcatggtggctcatgcttgtaatcctagcactttgggcggccaaggcaggaggattgcttgagtccagcagtttgagaccagcctgggcaacatagtgagactctgactctaaaaaaaaaaaaaaaaattacaaaaatttttaaaaagcataatatgtaagaatatatatatattaaaaatcagaataccaataggaaatatccctgatccatatatttgtagttgtaatcttgccatgaattatatcagttgagtctgtttcttggtctctttatctcatgaatgaaagtaataataccagcttactgttttctctaagattaaatttcaagaaatatttttgtgtagagataaataaaattcagttattgatctagggtgttgatagtctgttagggaagacagatctgtaagtggataattatactacggtgtggaagttcaaaagcagacatatcaaaatccggaagttaactgtggaaagcagtgattatttgattggcaaaggaaaaaggggtaagtcagggaaggatgactagactcatgccaagtggataaggttagggaaaagacatttcaggaagaatgactagtacatatatgcagagttatagagacatgaaatggtgcgatgcgctctgagtgctagaaggaagtctgtattgtttgtataaaatgccataggcactggccagagatgttgcaggaaagtgtagttggggccagatcaagagggacctgagttcttggactttgcctggtaggtaggggaaggagttaaagcaaatgaatcacaactgtgtgttttaggaagatcactctggcagcatgaatctggagcgggtgagtacagacaggaagactaggtagagattagtgctttgctttcaggtgaaaaaaaaatgaggtcagtgaattattaaataaaaaggaatggcagaggagaaagagaggacaggattgagctgaactgttcaggagctggaatggttaggacttggattgtccagagagttttctctttgtgacttaaaatatatggcttttcccagttttcctgggttagtttttaattttttaaacttgcggtttcaaatgagtcattctaccccttagactgtccagagagggagggggctctttgcatatttatttttcctaaagctcagcctaatgctatgttctttttaggtcagatgggcagacctggaagagaagaaggatgcagataggaaaagggccataggttttgtggtcggacagactgattgggagaagatcacagatgaaagtggtcacctggctgaaaaagccctcaatcgaaccaaatatatatgagacttagtttttgaacggagtcattattcctctaaggtaagagtacacagtcatataaatagcctactgtgtggttgcttcaaagggtttgagataaagaagacagcatattttgctaaaaatgctctcttcttgtgttattttatagttctgaaagagtaagtatgtactagttgttaacatttacaatactattagaaaaggaagccattttctgcaagctggctcacttataaaaataaaaaccttgagaaaaacttgaattctatagatttgggaaggactgaaatgatgttatactaagggctactgaactttttgcctgttctttccaggtgtgacagccttttcttttctttccaggtggttcgctttgaggtggtctgaagccaaggcctcgcggagcttctttgtgtgtcaccttgcttccacgtttcagttcttgttttgtttctactgctttagttttttttaaagttctccagtgtccccaagaggtattagaatcttgctgtacccaagcaagacgttaatttttcttttaactgttttggggagggagggagtgatagcttaactgctgaagccaggcgggggtctgctggaggattccaacagagagtatttcctccactgtacaatgtcacagactatctctatcatcattgctttgtggctgtttctgttttttactgtatgtaactggtagctgattgtactaggattaaaaacaataaactttcatgataaagccgatgagattcatgggctatacagcatgggcccttttctcttgttttcttaattttatttttaattgctttttaaatatggtatgtcctaattaaatgctagctgaacatcccaaaacctttttttcattgaatattatatggctcaatgattccgtagcacatgttgtaaaacacagggttcaaatgatgttcaaaacactcatctttgttttatagctgatttctctatctttgtgtcttgaagactgaccaagttcaaatattcatcagttccctggagcatatccattctgtaacatgatgctttatttaaaaattttttttgatcctctctctgttcttccctctcttctttccttccttcttcttttcactttctgcct

SEQ ID NO: 76827 - DNA, 1774 bp, Homo sapiens
atgaagattgcagggaaagagtataaagatgcagagcactctggcatgtaacctttaagcctgtcaggttttcaagttcttgccagattgttcattactggaaagcatggccttctgcacagaatttcctctcttgtggttaataccaggtggaacccagaaacatacagagataaaacccaaatattatttctatgtaaacacagaaaagggactcttccctttttcatcctgcaaagaaaaaagtcatcttttagcatgaaagaagatgagagagccttcttcctcaagcataatttgcattttgtaatccaactcagtaatttgtaaatgtgttcactgaagacttcaatattttgaaatattctctttcaggccacagatgaaaatcctttacttttatgacctacattaaagactgtatgaatagagctaatagttactagcatttgaatagtatcactttgggttcaacaaattgatattatagtactgaatacccctaatttaatggaaattctaacaactttctgtacttttatcttccctgaaaatctgaatttttaagcaagtgactttaagttcattaagtcaatattgaatgtataaattgctacattaaataacttctgctgtttgtagtatttaataagctattttcattgcttattggcctacaatacatttctgtgtactgacctttctcagcagcctttattatgtagagtgaagatatgtcgcaaaaatagccaaatagaattattgtttgtacaaagactcatttactactttctaaagccacccaatgcctattatcaaaaacaaaacttccataatgtgttctctagttcagatgaaatggaggccgatatgttcttctgcaggatgctttatttcagttgtccttaaccttgtgatgttctgacagtagttagaatgccaatgaaatgagtggtgattatccgtgagtcacttggaatcatgggtaattttgcatatgtgtgttttcaccttacagccatggctttatgtctgtgctcttataccagggcagggtgggaagctggggaagagttaacatagtcagaaacggcctctgccaattttcagaagatatagattacgtgaccttagagaatgaacatagagtgctcctactttagaaaatgggtataacaaccttcatgcaaggagattaatgaaaaaagatttggcaccaaaaagagtaatagagacagccagctgataattgattttgctagtccaatgtgggacttaacaaaattcttgcacttacattactattagaagcagtatcgtataggaagcccaaggtatcttgaagaagaaatttggtgtgggtagaaaatgccttgataatacaaatattttaagtttgttaagaggtgtcctggaaatgcagaggactaattttggattccattatttgctagcattttattttaattttattaacattgtcttctcttagaaagttgctggtttaaatcatatgagttttattttaaatcttttgtggtgtcatgttacttaaaataatcttatgttgggaaaggtttctgataccttggtgggtatttcagctttttttttttttttgtcagctctgtaaaggatgatttcagacattttaaactgaaagtgaaatctctcacttaagtgatctaactttacttgtaaacttcctgtgtgaggaattcagtagacgagacccagaaatgtttctgtttgagaatatttagagttaagtgcc

SEQ ID NO: 76828 - DNA, 2543 bp, Homo sapiens
acacacactaccttatttttcctttaccagtatgttttagaggtcattcagatcatatataaaatattcacattttctctcccccccacctccttctttggttttccaaaggtaccttcataatataaagaggtttactgaaaaatttcagaaattgtttcagctgcatctctgttcttttcgtggcatggaatacatggtatgggtatatttgtatacaattctttcatatatgtaggttggtgtaaccaccctccacctttctcctagtcccccaaccccaccatctctaacccttggcagccactaatctggtctccatttttataatcttgtcatttaaagaatgttataaatatgaagtcatacagtatgtaaccttttgggattggcattttggcttttttcactcagcgtaattttcttgagattcatttaagttgttatgtgtgtcaatagcttattcctttttattgctgagtagctttccaactcattctcttttgcagctgcagaatgttttatgtctttactatcattttaacttacagagtctctattaatgggtattcatgctctcgtttactgttataaattatgaatttcacatatactcagtcattctgcagcttcctgtacttgcctgatttctagcaatgaaggaaaataccgatggcaccatttcatagacatactcaaaggatgacaagcacttaaggaccagcacagcacagcggtgaactctcaagacagtatgacagtaatgagatgacgaaggcacatcttgtttcctggaaaattctgcatgataggagactgacaaagcaaagaaccatgatgtgtcttagagaaccagaatggtcagagactctgatgatcccctggtccacacgtgactgagagttaataccttaggtcactgttctcagaacctggatatttatatgcacgtgcacctcagtgactgatccattctcagttttcaggtccattgctttcacatttgaaatagtcaaggagcatctttatgactggggctgagcttctgcattcatgtacagccctctgcctgccagcagtgccttgcatttgtgatcctacaaagagcctgtggacttaatggtttactgtatagggaaaggcttgactttgtgtcttctacttaagaagcttgaactttttaccaaatattcgtactccttttcctgaaaatactgatctaggctacagatccatctcttaaccatatttgaaaaattgaaataatatcttctgccataacttgaaattccactctcagatctgttatttctgacagtgagtttgtatttctcaagtagatatgtctgatgcttatttcttttacagcatctggctcagtgcatggctcatatatctgtagagtgagtaaatacagggaatgtttcctatgtgtatggcaagggtcacagactcaggcaggtaacagatgagcaaggcagagggtggagactggtaaactagacaactagataggtcaggtcaatcgggggcagcacctgctcagccatagcagattgtggccatgtggggatataggtctcatattgccagatttcctgggttttcaagaaaaagtgaaaaatctggatttttatgtgagatcttccagtatttcagcatcaggttctttttgtttgtgagtgctttggccctcacagcctgcctgccacatctgacttgtggactgccggcttgaaacctttgatatttagagaagtggttagaccttagagttggttctggtgagatccttcttgttttacagatgaggtttctgagaccgaaagaagggaagtgacttgctcaaagtctcactgttactcagtggcaaaacaagactagaatttgggtttcctggtccataacctgtcactttcttttttcttaactacaatacctcctttatgaagaccttcataaattctaggatggtgaattctcctttattttgtgtgtcgtgtgcaagtggacatgtgtgtatttactaaactctgtggacctggaaatacattctgatatgactatcaggaacaatgtgattacttctgaaaccaacttccttaaactctcatgtataaggtagctatacacctaggatccctcttaaacacttactacttggttgggtaattctcatgaataacagaagcttgaaaattaacagagtattggattcagtgattgtacaagagcagtggagttttctccacaaagtagagaaaatcatttgtgtattgttatgcaaatagcttacagaactattaataattttgttttctttaatttgtaatttcttatgtaactagtccatttgctttcacccagtgatgagcatcttacctgcttcactcggtagcgctccattcctaatctttttaaggacaaattcatcaacttggcgttaaagtctatcagtaacatgatcccagctacttctccagattcctcttgagctgtccttactacatgtgcactacactgcagccacactgtgtgactta

SEQ ID NO: 76829 - DNA, 1082 bp, Homo sapiens
acaggaagataagtgtaaatgagagaattggccagtaatttcataatatatttagttttattctttcaacagaaacttactttgtttgcagattagacatgtgggaatattcttcactcttatagaaaaataccctgtttctcattctcaaaacttttggcactctcttagttttcccacctttggtagagacataagtacagtattattttttctttactgtgagaaaaacaacagcagaagcagaataaaacagggtacttggccctctcagcctcagggttcaggaagcagtagggtatggtggaggctgggatggtgcagagtgcttgtcctgtctcaggggacaattctccagccagtggttggaatgaagaaagacagacccaatgttactagatgaagataaagtggaagtctgcatttttatgtgaaatagtcacagtagaaacaaatcacatctggaagccacatgttaccaataggctgtcattttgggacttttctgacatgctctaaaggatgatgacaagtctgaaagacagttatggcaaagaagatatttgtaagaaaggaaacatcaggttttattacatataaatattttgagcagcacctttttactagtattttggaaaagcatttctgtcttcattgagcgaagtggcaatacatatgtaatatactgatgctgaatttgcggtgggttgatttttgtccattgttggctttcacatggaagcatgaatattgtctccccgctaccccttttgagtgacatccttccagtacctccatttctcaagttgcaggtaagcaccttgtgtatatacagttaaatagtgggcacacatctatcccaggaaaagaagacagtgagaattccctttggttaagtggagcagttgaatggccactatacctggatgcaaatttgatccgaattttctgctctaaaccctccactgctttctgctgtttccactgaggaaagaggatgtgtgtcattaaagctttgttgggacctgtcacagtcaaggtgggtataattatgtttaatttattgaagtgtttctgggcat

SEQ ID NO: 76830 - DNA, 1124 bp, Homo sapiens
ggactacaggcacacgccattacgctggctaatttttgtattttcttttttggtagagacggggcctcaccacattgcccaggctggtctcaaacccctgggctcaagcgatcctcccacctcagccttccgaggtgctgggattacaggcatgagctatcgtgcccagccaaagatatattttcaaaagacacttgtaaaattagggaagtgcaattttaaattttttttttctgaggattctctctattttgtcattgaaagcaaagacaacattttaaaagtggacctacgtaagagggctgggtgtagagctttattaaagagtgctgtgctgtttgctgtttatactttgctcattctctgatggaaaataaattgtttaggtaccccttacatgtccttcagcctctcaccgtttgagtctggtttgggttttgtatactatatgaaacagtgtttgaaataaaggttcctaatgaacattttcctccatgggataccaatcaactgcctgcttttaattgataattgggcattaactcctcagtagtgccatcatcataaaccacagtgcagaccctatagtccaccattgaaaaattaagacaattatgcagtatttgaacatgtctaatctaggagagagtagcacccaaggccgggcacagtggctcatgcctataattctagcactttgggaggctgaggtgggagaattgcttgagcccagcagttcgagaccagcctgggcaacatagtgagaaccccattgctacagaaaaattttaaaaacttagctgggcatggtgacatgtgcctgtagtcctagctactcgagaggcagaggtgggagtatcacttgaacctgggagatcaaggctactgtgatcgtggcactgtgctccagcctgagtgagagagtgagaccctgtctcaaaaaaataaaagaatagtgccctcatataccttagtggaaaaaatgaccagatctttggcaaagtatgattgctaaaataataacccactcagcttacactccatgtgtttccaacagagagggatacgcacttgatagaaacagaaaattataatcaaatagaattcttctgttggcagagcat

SEQ ID NO: 76831 - DNA, 1049 bp, Homo sapiens
ttcatttttgtgaaaatagggcaaagatcttctgagtgcaattggatgtactggagggcacttaacctttagcctgtaaagatgggtttgggctaagtctgttttgtttttcctttcagctgtttgaagagaaaattcaaaggaaaattcatctttcatactttttatgctgatagttctagtaatagtttagggattttatctcatctgctccagcaacaccccaccagaaaaattatggaagttgagtagccgaatatgaaacttgttttatatagacaggaaagaagctaatgaactcacagacaccccttatcaggactacaaagcccgagctgtgtattacccccaccccaccccacccggcgtacctttggcagtgcttacaaagacttgatcctgactagcttagaagacagatgcagttactcagctttgtacatgccttgcctatatactcaagagtgggtcacaattgtgctgggccagcagcagggggaaatgttgatttcatgaattccttcatcagtggaaggtcagccatggactgtaattttgttatggagtgggagaatttccatttctgtgtgatgctgcatttgtcccagttatgccatttatcatctgcaaggctgtgcacagcctgtgcaagcctcctgtctggactgcggttcttccttcccaatttaagcagcatgggccagatgatctcctaaggccctttctacctttcacagtctgaagttcagcttcttctgcatatatgaggttggggcaccaattgcaatggtcagctggagactatttgcattatccagctgataaactcttccagcagacaaatgtgaataaacagcaacactcaagtcctgcataaagtttgtcttgagtttgctgaaatgatcagcagaaatcttgggcggtgaagtgctcctaagtgctgggcaggagttgtcaggtgacggtgccctgtcagcgctggatgcttactaggggtggggtcctgcttgagatcctgagttagctgcaggagatgggtccagcatgca

SEQ ID NO: 76832 - DNA, 1069 bp, Homo sapiens
tggatgtaataaaactcacgaaagttgctgaaccacttgatcatctgggaggtaatgcagcggttgaactgtacaaacaagaggtccatccagtcagacatttgccacgaggtgctcagaattagaactgtctgcttccagctcagtataggggttcatatacggctttaaccagcattaacaggggcttcctttaaaaaaagaagcgaagccaccgctattttccaagcctatttagttatactcagaaaaatctaaattagctacagtgcccattagaacataacttttttttgatatgctagatttatgggggttgttttacccatgaaaagctttttgtggtgtttgagtgggacttaggggtcacgaccagtgtggtgccagattttgctgcacccaggtggactgcatggcaggcctggggccttccacttggataaagggccaagggaagggcaagatgtaggtcagggagcagtttattagcaactttgaattgtggaatgaattgaaatcaaaatcagaggttgcttcagggatcaaccaaccaactgaatatgagggaaagaaaagcttgaatgatgtagaccaaaagtattaacagcccctaacccaacacccaaagtaaaagaggccctcagaaaccttttatgggaacaggggaggtctggtcccaacaattagtttgattttccttattgtcacacttcatctgtatgtactttcactcagttttgaactatagcaatttgaacataaatttgacagtgtctgacactctgtctctctctccctctctatatatattttttgttgtttgtttgtttgtttttgtgtgtttttttttttttgagatgtagtctcgctttgtcgcccaggctggagtgcagtggcgtgatctctgttcactgcaacatccacctcctgggttcaagtgattctcctgcctcagcctccgagtagctgggattacaggcgcacgccaccacgccagctagtttttgtatttttagtagacatggggttttaccatgttggtcaggctggtctcgaactcctgacctca

SEQ ID NO: 76833 - DNA, 1048 bp, Homo sapiens
cccagccaaggcagaaaactagccaaaaaggccactaactagtgtttctgtttccctctacttttcctgcccatgtgtttctgttttggggattatctacagctcagtagcttaagaatttagacagccagcctttctagcctaaagttattcacggttatttgggtagagtctcagcccagaactggacattgcttccatcagcaacactaaggggagcttgaagtgcacatatgatgacctaggacttgcctcacaccaggcaaaacacactgcctcttgggagttctgcagaagctgccatttagttgagtgactttacctgaacatcaggaaaataaaccttcaggaggttggagctgggatatcgtgtgaagaaaaacattagtttggccttcttcaagtgaccagggtttagaccctcctggatttatctcagtgtcaaggaaaatgaacactttaaaatgccagtttatcaattaactagtgaattccttgttcctgtggtttctatttgatttcattttgtttttctgattggaattgtgtatttgctccatttttctgtctctggaaactctggtcaaataagctggatgacatatgtgcacagttaagtcacagaatgtaaaaatcatctcgatgtggaaaagttatgtagcatagatgatgtcaaatacaggttggtgtattttgtgtgtgtgtgtgtgtgtgtgtgtgtgtgtggtgtcttagatgtcaaatacaggttggtgtattgtgtgtgtgtgtgtgtgtgtgtgtgtgtgtgtgtgtgtgtgtggtgtccaagtgggatgggaagagatggcaattctatcccagataaaccatttcaaaaccccaagcagagatttacttcccctctctgcctcagtttcctcagctgtaaaacgagaagagtaaactaggtggtccccattctggctgtcactcttatcattgccttcacagtgttgcctttataaccagcaaacatctaagcaggctgaataccagctcatattttgctcttgctcaagaagcttga

SEQ ID NO: 76834 - DNA, 1083 bp, Homo sapiens
aaaaagatttacacaaatacgctttgcatttttagggacagtccttaggctgggtgagaagcattacacagagtaacctgggatctcagatccgagagctgtagcttaagacagtgaagacttccacataggatgaatctgtttaaccaaaagaaaccagaccaactgactatggttataggtggcccaggcacctagttgctgcacaggagatccctccctgctgccccatcagcccctacttacccttcctacagatccacaaatgctgtggagagaatcctggattgggattccaaagacccagtttcagacactgattttgccatctattagctgtgtgaccttgggcaagccacttaactgctctgagcctcattgctaagatgtggagtatagtggttaaagcttgtacttggccatcagatcccgggtttaaatcctggttgctcattagtgtgtcttgggactttggacgagttagctcccttctctgtctctgcttctcggatacccgatcttagagtggatgcttgagaacggtgagataatacaggtctaaacccgttatctgaaatgctgagccaaatggagtttggatttcagaatttgttagcttataaagataatacgatgtgtgtaccacacattaattaacatccacagctgagacagtgtataatccaatacattaacatttctgcagcagaacgtatgactatactaagtgggataaaatctattaatagcctccaatcagtgcaagccaggttttgctaccaaaaaaaaaagattgcatcattcttagggggggaaaatcatagggcctgtcaaagctttatgggtttcagaattgtagctaagtggtggtgggcacatatgtgtgaagtgctggtagcaatgcctgccaccgagaaggtgttctgtcaatgctcccctcgtgatcttcacatctgccctacctatgtcacaggatgtcatgtgaatgtgaacgttctttttatgctgtaaagcagcttgctctcaggtggctttcatggcccacaggaataaatctcttggaatataggcagcaggaatgag

SEQ ID NO: 76835 - DNA, 1035 bp, Homo sapiens
cagctagcttaaaaagcaacatccaaaatatattctcaagaacttaagttctgcaagatgcttgttagaagtggtcatatgggtttggggctgtgtacattctcctcttagagcttccatttactcatgttaaaggctctgagaattcctgcagaaaagaaactatctcagtatttccccaaggtactttttcttctaactcaacaattattaatatcccgagggttactctgggaaatacattaagagagtagtgtctacttaagggttgcaaagatgatgcaataagatccagagccctgcagatcagcctgggccactcaggcctcctcatggggagcctcctctcccttcatatgcccagcccctagtctccaggcactccattgcaccttggaagttgttccttaaactggagacctctggccgtttccagccacctctctgggtttaatccccgaggaaaactccttttccatttggcccagaagtttcttgttcctcatctgctccccaggaattatctacacaatataggatttttgcttgtagagctatggggttggggaggccataccttagatgacgtcattcctttgaccctctcctcctaagtttatgggtggctgacaaccaaattatggattctttcttccttagggtattcattgtatttcagaagcctatttgagtctcaaaacaaaacccttttagacccaaaggaataagtcaagtggcagaacccgatgggtcatagaagaagctaagtgaaccttcccaggtccttaaattccagaatgtggtcaccactataagctgaaggcccagagcaacattaagaagaccctgagtgatctgtccccagctcctcttcaacttttagttttcttgtttctctgcacagtgtcaatggtattttaaattatttattgaaacattgtctctctctgttgcccagctggagtgcagtggtgcaatcatagctcactgtaacctcgaactcccgggctcaagcaatcctcctgcctcagcctc

SEQ ID NO: 76836 - DNA, 1335 bp, Homo sapiens
gaggttgcagtgagccgagatcaagccactgcagtccagcctgggcaacagagcgagactccatctcaaaaaaataaataaatagatagataaataaataaagtctagacagatgtggtggtgcttacctgtagtctcagctactcaggaagctgaggtgggaagactgcttgagcccaggagttcaaagctgtagtgtgctacgatcatgccaatgaatagccactgcattccagcctgggcaacaaagtaagaccctgtctctaaaaacataaagtaaaataaataaagtctattttttttaaaaaaactgcacttttttctcattaactctttcccagatacatattcctcggtaccagaaataaaaaaccccactggagaagcaaatttagctacaaacacaagcatagaacacagggcttataagataactgcgaaggcacataggattttatagctggaaaatgtaaaatgagggtgagtttgaatttcaagtatataatggacgacataaggctagatgtggtagctcacgcctgtaatcccagtgctttgggaggccaaggctcaaggatcacctgagcccaggagttcgagaccagcctgggcaacatatcagatccaatctctgcaaaaaatagaaaaaattaaccagatgtggtggcacctgtctgtggttccagctacttgggaggctgaggtgggaggacctcgaacccaggaggtcgaggctatagtgagccatgatagcaccgctgcactcagcctgggcaacagagcaagaccctgtctcaaacaaacaaacaaacaaacaagaacatacgagagaagttgtgtgttgtctcctttcagctttgtgttagagcaccggggcatgagctgaaaaggaacagccagtgtctgtggcatcatcacctgcacagatcacctcctacatggcagcctttctccctgtgggtctatgtccttccatggaatatccctggagagctcccgaagctctgcccaagtgggacaaaggggaagggctgcctatgaggccagctgaggtgagactggcagctcacaggccatgtctccccttctgtgatgtgtacacatttagggaacagcaaacacctttgatgcgcttcagctgggtcacaagagaaccaatcaataaagcaaggtgggctatggagagtccttaggtaaaaggtacctcgtgaagcccaagagatgctaactcattctcatcactgtcattgaagctcaaatcagatttatacaagcagttttattgttatttccttgataaaattcctgcctggtttttgttgggaaaacatgttt

SEQ ID NO: 76837 - DNA, 1717 bp, Homo sapiens
tgtcatccatagctttttttctgttatatgcctagcctaagtatttgttgaatgagttgaccttgttgtgggctttctttgtgccaagcatttatatgagtgctttctgtgaattttttagttaatcatctcaaaacagtaaaaagtattttctctattttacaaatgcataacccaagacaagagagcttaaaagccttggccatggtcacccacccagctgttgataagccaggtctacctgacccatcctgaactcttaacccaccatgttctcatttactcatggactcaacagatcatttattgagtgcttactatatgccagccactgttctaggtaacaggggtatagatagactctagcctcgagattttatgggctagctggagagagagagcaaatatacatttatgctccgacaagggcataaattttggttactacgagagaggaattaaagggtgtgatgagagggtgggatgatgtagaccagcttgggaaggttgggaatgtcagtaaaggcttccctgaagaagtgacatttaactgagacctgaatataaaagagccaagaaaatgtattccaggcaaagggaattgcttgtgcaaaggttttcagacaggaaaggacttgaccagtgatagacatgggaagaagcctgtctggcaggaaagatagagtgggctggacggtacaggatcgcgtaaagtgtggactttatcctgagagttatgagaacataaagcccctagcacaatgtcggcttgtagtggactctcaataacaaacatgtttttcaagtgggaaccctgaacaatgtcagtaaacattttctccacttcataggtgggcaggacaatggaaagagccttgcacttggggatttgcatttgggctcagggattcaccttgggctagtcgcttaacctccaaaagtcctacttatatgaaatgggaataatggcagatggtcgttccacttcagagagttgtgagactgtaaaatcaaaatgaggtcattatgggaaagctttttataaaccctaaagcactgtacaaatgaaatttgctgtaggatgaactctgaattggactccaggttcccaaaatcagtgtgagccgccatctattctagttcaaaaacatactatgcttagaatttgcactgcatagtcattggctgctggacataaaggtgactggcttacctatcttgggatgcttgtgaggaggtgggcataagagagggctagctctcatttggtgtgtcctgagcccatggttcagaaagagttgttaatctgaaagaaaaaagacataagaaagaattcagaagaggcagctgtagttactagtcatcagttggggaaatgcagttaactatgataaggacagctggtgggcagaaagggtctctcaccttgttgagagtgaccagggtggaagacttcagaaaggcatgggaagtcaataaactgaaagatggggacatgattttctcagctctaggacaaactggagaccccgagcctaaagtagccaagtctttgctactaggattcaggtgataagatttccaacccaatcttttcaaacccagaccaaacatcctccttgcttctcaaattgggttatgtatagtcacaggataagccatcccatgtctttctcaagcttcagttgtatttgaagacttggcgagtagagacatt

SEQ ID NO: 76838 - DNA, 1005 bp, Homo sapiens
gggtgacagagcaagactcttatctcttaaaaaacaaaaaaccaaatcaagaagctaagtcatttcggtctgcaaaggaccaaggtgcttatttttttattgaaagagccaaatgtaagtctgttttgtgagagttggcattgcattgcagcacaggggcctgagcatacttggggagctcaccatttaaggtacctgggtcgttaggctctactccagacctgctgagtcagaatccctgggggagaggcctagacaagtgaactttgaaaaagttcctccccaagtgacactgatggacacccctggtcaagagtcactgtttaaggggaaggtgacccatggggccttaactagactaaaatgtgagtggttcgcctgttaaaaggagttaacgtgtgtttcttttgtagcattaacaacagtgtcttcagtgttcgctttttcagaactacagctgtatgcagtaagtacctgctttcttgggaatggaattttatgggaagagcaacaattgattgagtttaattaaagaaaaatattaaaaaggaaaaatgaactacttatgattttcttttttgcatttttcctagaggatgacttggttacagtcaaaaccccagcgtttgcagaatctgtcacagagggagatgtcaggtgggagaaaggtaagatttagtttcctattttttttttttttttttttgagacagagtcttgctctgttcccagcctggagtgcagtggtatgatctcggctcactgcagcctctgcctcccaggttcaagtgattctcctgcctcagcctcccgaatagctgggattacaggtgcccaccaccatgcctggctaagttttttgtatttttagtagagacagggtttcaccatgttggtcaggctggtctcaaactcctgacctcaggtgatctgcccacctcagcctgccacaaagtgttgggattacaggcctgagccactgcgtgagccactgcgcctggctcc

SEQ ID NO: 76839 - DNA, 1009 bp, Homo sapiens
tggagtttcactctgtcgccaggctggagtgcagtggcctgatcttgattcactacaacctccgcctccggagttcaagtgattctcctgcctcagcctgccgagtagctgggactatgggcacatgccaccacgcccagctaatttttgtatttttggtagggacgggctttcaccatgttggccaggatggttttgatctgttgaccttgtgatccgcctgccttggcctcccaaggggagtaatcccttggcctgtaatcctgggattacaggcgtgagcaactgcacccagcctattttttaatagtattcttgcatatataatgttaaaatagaggatgaagagtatcagtaattagaaatatgtttatgtatgcatttcaatattttaaattgcctaggtgtttttttttttccttggaagtttacattttcttgggcttgataggtgctttgaaagtacttgctgaatttattcagtggaaacctgtgaaattgggaagggagctaagttgagccagttatctgatggacatttagggaccctgaggactagagaatagtgccttatgtcattgtgtgtgtgtctcatagtgctttgcatattgctgatacccagtagacattcgttacttgattggagctagagtttttgccactaaattttgcttggttgcttctcatttcagacagtgccagtggcatatacttttcttgtttttcagctgctcctgctaaggccaagccggctgaagctcctgctgctgcagccccaaaagcagaacctacagcagcggcagttcctccccctgcagcacccatacccactcagatgccaccggtgccctcgccctcacagcctccttctggcaaacctggtaggcttccaactcccacatgtcatgtgggagaacatctcgtctaatatgttccttcaaagggtaaactctagactgatgatggttctgaacaggccaggttggctgctttgtagaaagaattctag

SEQ ID NO: 76840 - DNA, 1320 bp, Homo sapiens
tgatagtgcgctgtggcattgttcagagtagggctctgtgacctgttttactagatgtcatccattctgttgggaaactttccgaagagactggatgacattcaagccaaagatttctctcttgttcataggatgtaggggaaggaccttgactaatgaatcacaaaggctgcagcttatgtttcagtgcattagggccaaattgtacacaaattgaattggactttgaaattctacccagtttcttaagacaaaacatgtaaatatttgtggccctgaaagatgcagttggcccaacagctttgattggaaaggaagcgtaatagctggatctcctttcagcagctaatcaaggtgtcacttaacaatggcctgcggtcttgctgcagcctaatttggtttagatcgagtgccctttgggtcttgtgctgatcagctaacccataagggacctttctgagaccttctcccttcctctattgtcccagcctttgcctccaagggcagagctctgaaatagaagctacttaatgaccagacaataacatttgggcaggtttgagagcagagatgtttatcacatctctttccctcttctgcagctcttgtgtcttgggaaccagtaatgtctttagggtggtaatcctagcactaaataaggttagaatcaggaaaacaagcattttaaacccaatcagtcccccttggaaaaacttcctttttcaaaaacaaaagatctgaagggggctgttaaaattgtaccacatcttacctttcatgctaatgtcgaattaggccattagagggagaaagggagaactgagcatttggccctgagataaagttaaattcaattttcatcgtagaactgcattactgcattccgataaatactgaggtttatgcagcaaagtgatgggaaagccatttctcactaactctgcaatgtgtcattgaaaaaaaaccagtcccaaaagaataaaggctgctcatgttgtaaaggcttttcagaaggcttgctgcttaatctgaagggaaccagcctaaaccacaagtggccacttttctaaataccaaggaaatcacagccattaaactaatcttagggcaagaactatgtcttaattagctttgtatcttggtacctggccctgaccctcacatgtagtaaggtgttagtacctgtttggaagaataagtggatggaactgccaaccctggaaagatgaagaacggatatgactttccgtgggcctgaaagaacactgggttatacccttccctgcagagtcatgactgctttttcccgcatggagcctc

SEQ ID NO: 76841 - DNA, 1006 bp, Homo sapiens
taatggtccagagtgagggaaaagctctcacctaattgtgtatatggattgagaaacctgtgtgaaagtcaaaatgcaggctttgtggtcagtttgttttgtaatattttcacagtaacatccaggagatgagggctcggcacaaagaggcttttttgaagaaacataacctcaaactaggcttcatgtcggcatttgtgaaggcctcagcctttgccttgcaggaacagcctgttgtaaatgcaggtgagttgcttgtggctggaattggagaggtcctgggaggtaggtgtatgagcacagacctgctcccacatgcagaggatcaacagaccaaggctttttatttgctacctatagaaatatcagtatcttccccagggatttcttggttcaccttcctgaagcagcatcatgattactttctacccgccagctgggcagaacagtttctcttcccagtgtacagctcggcagctgctcaggcagcaggcagttctgggatagcccagctctccaggctgtctcctgtcaaggtggaagcacgtgttctggcttcctcccctcccccagctccacaggccctgttaccttggggcctgacttccacagttggtgtaggctcctggctgacctttgatcttaggtcgatgggcctcactgggagcttcggcttggcctctcatggacctggtgcttattttctttcctttttacttacctacgtcattgtagtgttgacctaacaagcactttgttttcctgttgacacacttctctgttccttgggagattggagaggggtcagtgctacttttgccatcctcagcagtgtcaggggccctaaaggtctagaagtagaagccctagtccctcctgttgagtggtgctctagggaggtagaaggccatctttgttttgcccaaatgtatacctcttctttttcccattcttctcatgcctccctgactggctctcatctttttcagtggcccccttctgcttg

SEQ ID NO: 76842 - DNA, 1556 bp, Homo sapiens
cgtggcctctttttcacattacatgcttcctctggatgtcttatctaacaatacaacatggactttctgcggaaatgattcccaagcctttattttcccattagttgctaggtgtacattttcagatgctggtttgccatctcttgaggtagcatatttcaaagccagatcaccccgcttactcttggatctcccctcttcctcttgttgagagttggaagcagagaatgggtagtatctctatatcccttttcctttgctaatttgcccttttttggaacatttgttaaccctagtcattctctgctaaaggagggcttgactagagctacttaacgagagtttagtgcatacctatcctatggaagccagtgtgttgagcccttcttagggctgccaaagaaatggatgctcctatgcccaggctcagtcagggacttgggagatactatacttgggatgggagtaagtggaatgccagctgccatgcataatgcagtggtgttcatggtggttggtcagcccacactgtatcaagctctgcagatttttactctgttaatgcacatattacctcattagtcttggccttcctggggagttgtatgtaacatgtattttctctctcatagtgattgacgacacaaccaaagaggtggtgtatagggattatattgacatcagtgttgcagtggccaccccacgggtatgttggggcaggaggtggggaatgttggtcttagaccctcaccttatctgtgtgaaggagatcacacaagagaaatcatttctttaattctgtatttttagaagggagttagtaaaagtaaccttttttttcttttaaaccatgccgcattcttttaacactttctgttaatcacactgagtaatgaaggtattctagggagggcataccatgggttgaatcaagggagttgttaactataaaaggtactattaatttgcaactgaaaacagcttttcacccccttcagggtctggtggttccagtcatcaggaatgtggaagctatgaattttgcagatattgaacggaccatcactgaactgggagagaaggtaaagtagaaagatgtatacaagctgctaagcaggcgagggaagagagccttcagaaggctgggctcactagcaagcagtgctcatggaaagtcaagtgcatagcccctgagaaaagcagttgcccatgagagctaagtattttatatatctggtggagtttaccatgctctggtaactgaaatctcatcagatgagacctgctagaaaagatcatctttgaagtcttcaactgtatgaaattgtgccttttctctggtggagcactggtcatagacaccttagccgaacaactgtcacacggaagctagcgcttgtgccatcgatctcgatacaagctttctggacttcctttgcttttttgtttttagaggcagggtctcgctgtgttgcccaggctggagtagagtggtagagtcatagcttactgcagccttgcactcctgggctcaagcgattctcctgcctcagcct

SEQ ID NO: 76843 - DNA, 3376 bp, Homo sapiens
ccaagtagctgggactacaggtgtgcaccaccatgcctggctaattcttaagttttttatacagatgggggtctcactatgttgcccaggttggccttgaactcctggcctcaagcagtcctcctgcctcggcctcccaaagcgctgggattatggactgactttaggtgaaggaaactgggttggcttgatatttcaattatgaaatctgtttttaggcccgaaagaatgaacttgccattgaagatatggatggcggtaccttcaccattagcaatggaggcgtttttggctcgctctttggaacacccattatcaacccccctcagtctgccatcctggggatgcatggcatctttgacaggccagtggctataggaggcaaggtaggaaccgtcacttctaaggtcctagtggctaggtctcgatgaaagggaaatccaactaaatgctaattgtaaaacattaactataatttcaggcctaagttccatttcttagtttctaatagctaaggcactgattatcaaattgtggtctggatcagcatcatctgggaccttattagaaatgcatattcttagaccccatcccagacttaaagaagaagtgcagatgatcctgatgcatattcaagtttgagaaccactgagctgaggaggcttgtttgcttctatggagtgggggatatagttggaaacgtggtcccttgcccctgggaaacagatgacaattatgcatgtcagtctgtgagctgccaagttgtatgataaagcttgtaaatttcccgggagttcagagaattaagtattaaaaggggcttgagctggcccttagaagatacgttggtatcaaaaaagctttctgggaactcctgtgtttagaatccttttgggttactgactcctgtgtgaaaccacagtctgtagatcttcctggaaaatgcccatacacccagctacacatacaattccagaatttgtagaccctggcttaatttttttttttttttttaaattctaaccccagagagaagcaagtacaggcagccagaactgaagggaaaactttccttgtaggcagcagatgcgttagagggcagagtatgtttttaaaaaataaaaggcagttgtgagaagacagttttcttggcaaactttgtttctgagtggggaagctttgcactgagggtaagtcctggtctttgaaatactgtaaatatgcagaggcaacatcaataggaaaggctctggaattaggaactttcttatgggctgtgctaaatctccttcagcgaggctggctgtggcttgctggagacaaacctatttacctttcctctctgtaggtagaggtgcggcccatgatgtacgtggcactgacctatgatcaccggctgattgatggcagagaggctgtgactttcctccgcaaaatcaaggcagcggtagaggatcccagagtcctcctcctggatctttaggaggaacccacacaccctacaagttgatcatgcaggaactgaaaaccagtcttctccctgtcccctcatgggtcccgggttagcctggtgacaggcagacacatgctgttggcctcaagcaaggaagcagagcactgtgtaaccagcagtcacaggtcttttcttggcgttcctgccaggctctccctctctgcacctgtctcatagcctcgaatatcttaattccttaggcttaagagagagagccttaatggatgctcattcatattcctgcctttcttccatcagctctctgcaaagatgattttgcttttccctagtgctggtatactatagagaaacccctggggaccatgtgattaagttcctatcttttgaaagtttgttctgcagagacttctaggaggatgctgtgcctcccaagctcagagcagcctctgtcctggctgtgcacattctcccttgattccacttgtgtggagggattgaacacaggcaaagaggtgctgctttgcttcttcaatggcaccttcattctccgttgtcattgacttcaagatgcctcttctacctcttccaggaagcacaggccaggggatctgggtgtgtgagtgggaggagagggcagaggtcccctgaggtcatgcattgtaatcatcatagaaggagagcccaggcctgccctcacgctctccatcataggctgacaccaagaagactcgtcttggcacaatctcacacagctggggctgtagcaaccctttccaacccctttgctggttgctgggcctcattctagcaccttgttcttagagcagattctagcacatcatggcagtgggaccaagcgtggtcccgaggaagggccagagcctggtagagactagggaagggaggtctcctctagactgactcacattgccttgagcttttcagttaagttgctgtaagcacctgggctgaggaggcagtttttgttccttcctgcgttatagcggggccttgtctcttcctctgcaggacacagatctggaggacgtggactggggtaggaaaccaccctgagggtgttagtacctagtggtgaaacggatgaggtcatttctaaggtgtgttgcccgtggatctgggcacaatcattggaattccttggagccactgggattcatggctttgtatccaactgcatccaggcctgaggctgctgacgtttgacaccagggccagtagagagtgcccttttgtatcttaagccaagaagtgaggcctgggggtgggggaggggggaaggggtgggagccaatactgagtgcctgcagcatctactactctgtcttcactattcagaacttgtaactaaagtatttaaagaaactgattttaaatgcaaattaaagggcagatattctcaaacagggttcctgtatctgttccttttggctactgaggtggtacaagtccccagcactgttgcactgaaattattgaaagccactcaaggtcctgttgcttattttgtgaaatcagaaatcccttatgtggaacttaacactcataatttgacagaaggtagaaccctgactgccagccgggaaagtgttgccaaaaagagtcaacctctgtaaaaatatttgaagagatttattctgagccaagtgtgagtgactgatggcctgtgatacaactcttaggagatcctgagaacatgtgtccagggtcgtctggctacaacttagttttatacatttaatacattttagggagacataagataccagtcagtacatgtaagatgtacagtggtttggtctggagaggcaggacagctcaagacctggggatgttgtcataggcagaatcaaagattttctgattggcaattggttgaaagag

SEQ ID NO: 76844 - DNA, 1041 bp, Homo sapiens
ggagaccaaggttttatgcagatgaagcctccagccagcaggcttcagagaaaatagattgtaaatgcttctcatcagacttaaggagcctgttttaacagtaattccaaaagggaggggagtataatgaggaatggctggctccctcttcccaccatggcccgaactagcgtttcaggttaactttggaatacccttgactgagacgaggggtccatacagatggttggggggcttaggatgttttttgttttgtttccataaagcatcatagtctcttagtgccccaccttccttgagcctgtcaagccatactctagaatagagaatttggggtcaccatctttgtgaagccctttcaaaacaccagtagacttgcattttttgtgtgggcttacattatttcagtgatggatttgggaggagtgggggcatctcatttcatttggatttgatagccttgtggaccaagatgctcaaggtcaatacacatgaacaggtgagggttgatgacctaggagcagtggtcagtgagcgtgagtgtacagggtgggtagctaacctagactgcaggtggcaggtgtgatggagtccaggcttaaacacagccttgtcttttccagagtccctgtctgctgagctcttgcagtgaggccatccctctgtgaaggtctgtcacaggagggaagtgggtcccagagagtagaactagagctctagtagatagaaaaacaaattaggttgaatgaaaggaagaacaggatttggtgttagaagctttaatttatctatctggtaaacctgcaaaataggcattatttaccccattttatcgaaaggaggtcgactgtaagagctgggacccacagtattctaaactcagggcccaacaaagtgtcagatgtgtagctttgggtggatgaagcacagaagttccagaagggacttgtgcttcatgaagcggtggttggaagtggtccagcctgacttagggagagtagcagaaggaacactaacttgcaactctggctaggttgtgtc

SEQ ID NO: 76845 - DNA, 1057 bp, Homo sapiens
tgttgtgccccactcaggacatctctggagactcatctcaggacactgatccactggctcagtggacccaaaccagactgtcctggctagtcctcttagtcacacagcgagtaggcctcttccaccagaagctgttcgtgcagctggggaggcccagaagcagggatgccatctgttgtgcagggagggatgaggtaggggacaggatgacccccacccccacccccccacccccgattcctgaccatgccccctatcttgtgatttcagacttgggagagcaaaagggaggggaagaaaataagagtaatggggggaggaaggaatgcatgggtctgccccttagagcaagtctgaaaccagaatcaagagtcctcctccccagtgggcctgtgtgggggaagaggggcagcctgccccaggggtgcaagaggacagcaattcagcttccaggccaaagcagtttagacaaggtgtgcccatcaggactccctctcaggccctggctgtttaccatgtcactgcctactgtgacttcatgcccttttgggataagaaaccacaaaacgcatggaacaactatccatggctcttagccagaaatgtcttgcctctggtctctgaaaagctggggtgagtggttacctcaaagacaattgcctccagtttgggggctcctctcagggttcaccctgtcaccggggcgtgggaccgacctgggaaatttccactagagttttgccctcagctcctccctgccagcatcccagtcaccaccaggtggcgcttctgacacggtccacgtgcctggctctgaaggcccaactgtcagaccagacccctcactcatggtggggagacttgacttcctcgggctcttcaggagactgagacagagaagacaagtgaaagcgcagcctgtacatgactctctgtggtccacgtcctgcctctccctggggtttacacggccccaataaagcctgctctggcctacggtgttctcgcttcttccatgcaatgaccacggctcattggggcaggttggaaggctccc

SEQ ID NO: 76846 - DNA, 1117 bp, Homo sapiens
agacagggtggtggtgactgaagttatgaggacaggaactgggccatgtagcagatactgatggttgtattgatgactttttaaagtgaggtgcacatctggggtcatgacatatagtcatcataagtgtgtgcctgacttttctttaaatttctttatatcggtctccctaaaaacagtgttcacactagtgaacccaccacccaaaccacagacactgatagtgctggacatctctcggtggtgtgccagtttgtaaggctgggcccactttagttgggtcaagaggagggcagagggcattctaagctgaggggtgggagggagcagaggtgaggggctgaactaggccaggacacccagaggcggaaagtctgcgcccaagacagaagggaggcaggagtgggagccggccctggcatccatactctttttctccctgtccccacgctcaccgctccctctgcatggcccaggaggcactctctggtcccacctgctctcccaggcgcactcccgacattctgggctcagctctggctctacccaggagaggatgaaggctcagctcaacccccacctcaacctcctgaccccagcgaggcttccctcaggccatgcccctggccaggacagaatcgccctggagcctcctaggacttctccgaaccttctcctagctggggaggccccatccaccagaccccagagggaggctgaaggtgaacccacagccaggaccagcacctctggctcctcggaccttccaaaggccccaggtggccacctgcaccttcaagctaggagggctggccagaactcagacgctgggccccctcgggggctcacttgggttcctgagggggccggcccggtgctagggggctgtggccgaggcatggatcagagctgcctgtcagcagatggggccggccggggctgtggcagggccacctggagtgtgagagaggagcaggtgaagcagtgggcggcagagatgctggtagcgctggaggcgctgcacgagcagggggtgctgtgccgggacctccaccccgggaacctgctcctggaccaggcaggtaggtgccctcctcacccctcagtggggtggccc

SEQ ID NO: 76847 - DNA, 1442 bp, Homo sapiens
tgaggtcaggagttcaagaccagcctgaccaacatggtgaaaccccgtctctactgaaaatacaaaattagctgggtgtggtggcacatgcctggaatcccaactacttgggaggctgaggcaggagaatcgcttgaacttgggaggcagagattgcagtgagctgagatcacaccattgcactccagcctgggcaacaacagtgaaactccgtctcaaaaaaataaataataaacaaagaagtcaaggcactagacagtcctccatcctccaaaccactgagtaaaaggagtttcttgtttggttggatgaatgggaaaatgcctgctgctttgctgcccttttgaaatataatgaaagaaaaaggagaagaaaaagaaaatcccctgaatcctgccgaactccaagataatcactgttaatgttttagtctaattatttctgaatactgaggttggttttaatatgtttttaacagaaatctttcagtgtatggatcaaggtttatttctggcctcctcagccttccctccttcgctagtttttttggactctgtcagttacaggcccttgcccaggaccaggtggtggggaatcccacttggcaagggacagtggggaattatctggggtgtcaggatttgtgggaaactctgttctcctaaatgactccagagttttcttccttgctttttctaacattgcacaagtttggtcagggagccaagcccaggctggactcggtctctggctgttggaggagagacctctggtggttggagaggacacctcgctcctgctgagaaaagggtcctgggcgctctcatctagtccactgccttcctttcactgatgatggagaaacaggctcaggagggaaggccattgccagggtcacctggttgtgcccccagttccagtaaagtctgcagggctccgggatcagcctgtctgggttcaggtcctgacttgaccactttttagcagtgggacagtaggcaacataacctctctgaggctcaggcctgaattttggcaggattgtggggataaaattaaacaacctatgtaaagtgcttagcacagagtaaccactttacagccagggtgggcttcccctcggatgacactggtaataatcacgacaggttatcaagggtgtgttctgcggcaggtgcaggctgctgctctgcctgaattgcctgctttaacagaatcctcttcaggaccccctgaaggaagtgctgctatgaccccgttttgtacttaaaaagagcaaggttcagagaggccatgtgacttggcagatgtgatcactgacattctcacagcctttccactcaccaagggctttcttggttttttgttttttgttgttttgttttgtttttgagatggagtctgtctctgttgcccagactagagtgcagtggcttgatcta

SEQ ID NO: 76848 - DNA, 1050 bp, Homo sapiens
actcccacttcccgcttcccacagcacccccaccacactcaccctgaaccccagggctgcagccaagacgctctaccgagcacagctggggacttcctgcggctgggacgtgctcaactccagaaacctgtccagagagggcccgttctggcccgtccttgcccagggccttggcaagtctgccctttttttcctctcctgacctaactgtaactttaccctgtcccaatgctatctcgcatgctttgccttattcagggcagacaagaagataggaggcgacgtcccaacccttactcggggcactcattgttagagtgcttctgattagaaggacagacaatgaggtcaaatcagagtccagccagtatgaggttcccctcttcccctgaaccctggaatagtcacccaagaagttctttaccaagctggctaaatggagagcttcctaaaaatacagatgcccaagaatctgttatttaacatactcactgggtgattttggtagatctgggggcccacagagaaaaggagacagtcctgtacttcccacaggcaagaggatgacatgctgcctgagggaaggccccgcgctgggcaccaccccgggtggccacgggcaagccccctgctctctgagctgtggtttcttcctctggaaagtgagatgagaattctcccccaatggggtgatctgggaggtaaaacaaaacaattttggggaaagacctggcacatgctgtgacactgagtacgtgcttgatggctctaaatacaagtgacaggagtgagctgggaggcacgcaggcttctgctcccgggccttactccagctgcttctcctgggtccctggggcaggtcccagactgtcagcgcaggccctgccagcttccatctgccacggtcccctccccactgcttgagtgtcagtggccacgacccaaccttggctgagcacagccgttcccagggactggccgggaggtgactgacaccgtgcctcccggtacgatcccgctgaaccataggtgttgtggtgagaggggttc

SEQ ID NO: 76849 - DNA, 1046 bp, Homo sapiens
aggctaggagaccactttattggagcagagggttctccggctcagcctaggggatgatgaagccaaagagtgcaaaagggctttttgcaatgggggccagggaacttttctaagcaggagactggaaggatcctaatggccctttgggaagcttcattcactcaatgcctcctacatgctttgtctaagggggcacagaggggagatggatgattctgcctggagcaggtgggaagggcagaaacagctccccatttgacatgggcctcaaaggatggattggagtcatccagacaaggaaggacaggaaggatgaccaaagctggcaatggaacctggcagctgtgtgtatgtgtggtgggaaggagggctgtgctcttcattcatgtgtgccccgtagagccaagcacaggttgtcctgaggagctgaacacagtgtctgtgccagaatcaaggagtccaggcagctatgacggtcccccaggacatgtaaaaagaagcaagtaaaaattgcctgatgctaccctgggccaggctgacctgacccagggaggagagcagctgagtgagtgcgagccattagggaggacacaagacaggtgccaaggccagctggctgacccaccagagagacccacttaggtctcaggggtaacagccatttgtttccccacccagatagagaacatgtggaggtatgggaagctacctggccgtactcctctgacacctcccctccctgggaaacctccaccaaagacattcccgccagcccacccaccctacccccaccatcctgctgtggtcaagtggccaagggcccagcactccaggctccagccccatcacggccccctccagcctctatctcttcagagcgggaaacaccacatcccagctgtctgtcccaaatccacctggaggccggccagcttggccgaagcccagcttagttaggccagacccaggagacactgccgggaagaggcaaggactggaaggaagcggctgggccagagacgggcccctctctggggcttacccag

SEQ ID NO: 76850 - DNA, 1086 bp, Homo sapiens
acagaacaaaagtgagacgtctgcccaaggggcagccgaccctggacatgcattcagagcgtcagtgtcagctgacactcgggagtgacagctcgggcagtcaccgagctgggaagacaggagggagtgccgcaacttcttcagtgtagccttaagtcgcggtgaggggcgcgtagagacttgctgctcccatagcaacgggaccagccaccctctacaggcctgacgggttacttccgttcaccgtcggctgagccaagaaaggccgcttccgatcctccagcccccgaggcgcgggggcgcgcggacgcccggttataactgaacaacccgagccccacgtctctgattggctcaggcagaggaagggggcgggagatcggcaacgaagggcgtagccggcttccactcaaacttgaggtttccccccatcccctcacagcggaagccgacctcgcccgccccggaagtgcaaactgtgtggtctggcaggtgtggattccgccggtgaaggctgaaggcagctaccttaaagatgccgggatccgcagcgaagggctcggagttgtcagagaggatcgagagcttcgtggagaccctgaagcggggtggtgggccgcgcagctccgaggaaatggctcgggagaccctagggttgctgcgccagatcatcacggaccaccgctggagcaacgcgggtgaggccggcctgcctccgccggcgaacctggcccctgtctgttcccgatcccagggctgaaaatttcccaggcctcacttcgcgttggctcctcttatcctctctcttttggactgtaggggagctgatggagctgatccgcagagagggcaggaggatgacggccgctcagccctccgagaccaccgtgggcaacatggtgcggagagtgctcaagattatccgggaggagtatggcaggtcaggctcacgtcctgggctcctggttggatccagtgacactttttgcacgggcccctctacctgctcggagactttattggagctgaacagcccttgttacctgcctgaccactcctccccacctctctctttgggtcttgttg

SEQ ID NO: 76851 - DNA, 2431 bp, Homo sapiens
ctttttctccactgtagaaaaacaccctgtacccattaagtaatctctccctatttgtccttctccccatctcctccaatctgctcctgtctctatggatttgcccattttgtataaaaggaatcatataatatgtgacatgttgtgcctgacttttttcacttagcatgatgttttcaaagttcatccatgttgtaatgtcagaatttcctttcgaggctgaataatattccattatatgaacataccacaatttattaatccattcatctgtttatgggcatttgggttggttccagcttttggcttttgtgaataatgctgctataagcatctgtgtataagttttctgtgtggacatatgttttcatctctagggtacatacctaggagtggaattgctgggtctctagtttttataaattttttcctttttagttccccaatgaagaagactcatttcataagtttgtggctcctgaagaagtcctgccattcacagaaggtacagaagctgtgtgtgcatgcgtgcatgtgttgtgtgtattcggggtttgtgtgtgcatgtgttttggtctttttgttgttttgttggtcagtagaactgaatgctgtcaagttgtgttttttatcatacttcttgtggggactgttttctttagaagctcaaagtgcttgaggacctgaccaagtccatgttaatttgttctgagacaaatatattttagatttgttggggctattgtgggttggatcatttagcattgtctgggtttggctttgcatgctgtttgagatatagacaacaaccagttgggaaaatgtacctgttttcctgctataaggagtcattttggtgaattgactcccaaaggaagcaggttgtgaaatgttcctccttagaaaactcacctgtagcctggatagtctcatgtcttggggttcttttctctggcttcttctgaaggcagcagctcagctcattacgcgtgcagcctcatcagcaagggtggccttacacaccatctgagagcaacgcatagtagttggttggggtcctagttcctcttggaagttgattgacttcatccctttatttaaataaacattcaatcttcaagaaatagttattgagcacctacaatgtatccagcactcttctaggcactgaagataaaacaatgaatgaaaaagataaggccctgttcccacacattctattgtggaagacagatgagaaagtatcaggtcatgggatgcctgaggacaagcaaggctgatgtggtagaaagtggctaggggcctgagattgaggaagggtcttaatgagatgacatttcagctgagtcctgaatgaacagagtccaccatatgaagatcatagttttctatgagctggtgcaggggcttagccagttagaaaaggatggccatacatggctagacagtaatgagcaagggggagagtggtccaaattgtaattcatgtggtgtgtcagggagggcccagatcttaaacttcaatcctgagtttgaattttattctgagggctgtgcagaggcatgggagagttgtaagcagggattgtcatgatctgaagtcatctcttctggtttgcatttttccatagcttcccgtccttggggagctaatatgcctgcattctcgagcctggaatctatatgctacttaattatgagagagggagcctcagttttacctttagcatgtgtgcttgcctttcaggggacattctggagaaggtcagcgtgcattgccctgtgtttgactacgttcccccagagctcattaccctctttatctccaacattggtgggaatgcaccttcctacatctaccgcctgatgagtgaactctaccatcctgatgatcatgttttatgaccgaccacacgtgtcctaagcagattgcttaggcagatacagaatgaagaggagacttgagtgttgctgctgaagcacatccttgcaatgtgggagtgcacaggagtccacctaaaaaaaaaatccttgatactgttgcctgcctttttagtcaccccgtaacaagggcacacatccaggactgtgtcttgcctttcagatcttaacagagcagcagggcttaacttgttgattttggagcctcttagtgacctggttgcgtctgtgtcaggaacttaaactttctggttcagtagtgtgttaaacataacactgaataccttactgggatacagatttttgctcagaaatggctatgacactttttctaggctctaccaataaaagccacttgaaggttccatagttggtttatttattgtcctactctgacagaactgcttgaaacagcagcagcagagccttttttgtgtttgcatagagggctgtagttagcgggaaaagtgtacaacatggtagtactggc

SEQ ID NO: 76852 - DNA, 1492 bp, Homo sapiens
gaaagtatgcagtcattatcacctcaaacgtttctttcccattctctctcttgtctcttggaaattttgtcagatatctactgggccttatctttctactctgcatgcctcttcaactctcttccatatttcccattgctttctctctgtgatacattctgtgaaatctcctcacttatcttccagtgaactaaagtatctcttcatcttctgtttaattatgtgtttagcttatccactgagttttttatttcagtgactaaattttttatttcaatggctatattttttatttccagaagttgtgtttttttccccaaatctcactcttccttttttatggtgtcctgcttttttcatgattgttccttctcctttatcagtagctttcttgatttggagcacaggcaaatccacacccacctcatctagaagtctgaagtgctttagtaatatctaaaatagtaaaatctaaaattagaggatagatgtagtagataaattgggggatggatttatgtgggaagatttgagtcagggagagcagctgacgggttattgcagtggttaaggtaagagaagatgaggattggactgagtcagtagcagagggagtagagaggagtgacatatctgagacagaatttgggaggcagaagcaagaggacttggtgagcaatcaaacgtgaaaggaataaaggagaaaacaaaagcaacagtgattctgagggttgtagcatggatggctggaaggatggtggtgccattgacagagaagggacacagatgaggaggaacaaacctgcctaggagttccatcgtgaaggtgggtttagacacagtgaatgtgcctgcaggtggaatgcccagtggataggcacacttaaaagatctggtacttggaaaataaatctgggctgtacatatctatctgagagttaacagtatatatatattgatagtatcagaagctggagaagggccttgaggaagtgaggttgtccagggagaatatggagagtgaaaaggaagagacaaaagagtggagcctgtggaacatcagcatccagggtgcgtatgctttggaaaaggtctggaaagctctgctgaaaagaggaaattctaaggatggctgaaaatacttggttagagagggaggaggaaaaccaggaaaaagcaatattgccaaaactaaggaaagttttaagcaaggagggaatggtcaataacggctatgaagtagagcctgaaacgctggacttgactgtcatgaggacattagttgtcttgtggaatcatttcctggggatgaggtggggcagaagataagagtgcagtgagtcaggagtgcgtgaagcaggaggaagtgaagctaagtagacaactctttcaggaactttggctacacacagaagaagagagatggggtgagagctaaaggttagaagtggttgggaagtgtggggtgggattcaaggctgaggaaaggtgt

SEQ ID NO: 76853 - DNA, 1050 bp, Homo sapiens
aagttttagagcatttattctctatgtatttcaaaatattccctttaccttgtttagtaaatgtcatagcagatcaaaggcaaattaacctaaagttctgtcagaattatcatgaatatagaatttgtgaagatcaaattcctatagttttactatttctagaaaagtaatagttttttgttgttgttgtttttgagacgaagtttcactcttgttgcccaggctggagtgcaatggtgcaatctcagctcactgcaacctccgcctcctgggttcaagcggttcaccagcctcagccttccaagtagctggaattacaggcacccgccacccacgcccagctaattttgtatttttagtagagacggggtttctccatgttggccaggctggtctcgaactcctgatctcaggtgatccgcccgccttggcctcccaaagtgctgggattacaggcatgagccaacccgcctggccaattttttttttaagttttcattatctggaattctttgttgtttttgagatcagaatctctactaatgatactcaagatgggtgtaactacaaaatctgcagatgttgaaagaagcaaaatggatctgttgaaatttctctttttttctttacttttttttttttttttttttttttgagatggagtcttgctctgtcgcccaggtgggattgcagtggtgcaatctcggctcactgcagtctccccttcccgagttcaaggaattcttctgcctcagcctcccaagtagctgggactacaggcacctgccaccacgcccggctaattcttgtatttttagtagagacagggtttcaccatgttggtcagctgatcttgaattcctgacctcaagtgatctgccctcctcagcctcccaaagtgttgggattacaggcatgagccacaggcccagccagaatctgtgttttaataagatccccagggggtatgtgatatgaacgtttgagaagcccaagtctaaggcaggataaacatggcccgaggggaatctgggcatcacctctttctgt

SEQ ID NO: 76854 - DNA, 1041 bp, Homo sapiens
tatttactttgggagtgaaaatgagggtgtgcaaaggagatatttcaacttttactctttttgtcttttttttttcctttttgtggagaacggggtctcgctatattgcccaggtaggtctcgaactcctgggcttaagctatccttccacctctgcctccctaacagctgggattacaggtgtaagccaccacgcccagcccatcttttattcttttaaatattttctattgtttgactttttaataatattttcatgttttccctttataataatagaaagtgtatataatgaactctgctaggtttgtcaatatttacacagaatctcttggtgacctgctctaatgaaacaataatagtttgtaaatatattaactcattcaacaagtattaattgagtgcccattgtatgccagggactgtaccaggccctagggatacaataatgagaaaagatatatatgcaagagaaaaaaataattacacaaacataaaattttagttctagcccctgtaatggagaaagagatacaagatgctctaagaacctgtattgggagatttgatttcatcagggagttcagggaagtgcttcttggtaaaatgaggtctgaatatgaatatgagttaactaagtaaagaaaggagggaacaaccatgcaatttgtgatttattctcctcagtgagtggaaacagggcaaggggaactggagatgaggctagagaagtaggtaggagtcagatcttaaatgccagctacaagctttgctttgtcccaatactgttggaaaccattgaaagcttttttttttcattttttatcatttgtattttgatgttgtttttggggtggtacatgtcacatcacatttgcattttaaaaagattgctctggttgtagtgtggagaatggagtaggagtaggggtggagtcccagttaactgtagattgactgttaaaagaatattgcaatatctgagacatggttagatgggaccagggtggactagagagcagtgaatgtattggaaagata

SEQ ID NO: 76855 - DNA, 2044 bp, Homo sapiens
cttgtgattaggggacatgtttcttatttttaaaaaggctggacttgcactccaagttgctgtagttttatgtaagcaaaactcttcaaaaaaagctacagacatcaattttgtgtgtatgtttaaaaatagataaggtatattttgcttaaaggcagtaaggctataaatttgagccatagcttctctgtcagtattccacaatatctcttttaacagtttggagaaaagctgtaatgccagaagatacagtcaccaactctagtttaaaaagtaacagatcaaaataatttagagatacagcaaacactgaacatttgtagaacatagaaacaatgtacgtgacctttggtcttgaggctatggctcaccaaacaggaaatgccattccctcctttccctgtggttctggatgccaactttacctgttcccttttgccctagatactgtggatgatactgttagtagcgaatcgcttcagtctttgttctcagaatgggacaatccagtatttgcccgttatccagaggtgggtctgtagcagtttttctttgccttttttttttcttcttcttcttcttattttttaaattttgagatggagttttgctcctgttgcccagactgaaatgcaatggcatgatctcggctcacgtaaccttcgcttcccaggttcaagcaattctcctgcctcagtctctcgagcagctgggattacaggcacctgccaccacgcccagcgaattttgtatttttagtagagatggggtttctccatattggtcaggctggtctctaactcccaacctcaggtgatctgcccgcctcagcctcccaaagtcctgggattacaggtgtgagccatcacgcccagcctttctttgcctgttattttaaactttgagtttcaagatgggtacagtggcatgcacttatagtctcagctactcaggaggctgaggtgggaggatcacttgaggccagaagttcaaggctatatagtgtgctgattgcacctgtgactagccactgcacactatagcctgggcaacacagtgagactccatctcttaaaaaataagtaaattagttaaaaataaaatttgaattttatttaagctgggtatgggcatgcaagactatattaatttgtaattatgattggaaactgggcatatttccaaattatgtatttggaaattactgtttaatgtagaggggagaaataaaatttatagcatttgggaactcaggcattttggattaaacatgtataatcaatgtgagaacagtgaatgtgtttaccactctcagaaaccctgacttgtagctttggcacagtattcagggtggtgataatgaaattgttatcattagataaagccacacatcttctactggaggaacagttcctcattggccccgcatggatgttctctcctcagtgtattttcacagaatgtactgtgcatgttataaacagggtgtataatagatgagcatttgtttaccagttctttcctcaagatatcatttgaggacttgatcatggaacatagacaaattgttgttgtgaaacaattttttttgttttgtcagtaattttgtttataagcaaaaatttttatgtaagactcattattcataaattcttttgaatttttttttttttttttttttttttttttttttttgtgacagagtcttgctgtgtcgcccaggctgaagtgcagtggcgtgatctcagctcactgcaagctccgcctcccgggttcacaccattctcctgcctcagtctcccaagtagctgggactaaaggcgcctgccgccacgcccagctaattttttgtattttttagtagagatggggtttcaccatgttagccaggatggtctcgatctcctgacctcgtgatctgcccgcctcagcctcccaaagtgctgagattacaggtgtgagccaccacgcccggccgattcttttgaatttctataaattccctgaattaaacccacctctagtaggctaaataaaaatgaat

SEQ ID NO: 76856 - DNA, 2468 bp, Homo sapiens
agactagttttaaggacaaagctacataaactcattgactttttattaaggaaagaaagtattatatgcaagccaaagaatggtcccaccagtaggcaaatgaattcaagtcttcggcaccggtctaccccagaactctatggcatatatgtaattaatgtgcagtgccaattctgtgagtatgatgtgtgcatggagccagccaaaactctgattgaatttcagaactgggacactctcttgttttgcattcaggaaggagtgaaaatgtttttaaagcaagaaaaattatttgtggaattatcaggtgaggatattaaggaatttagtgaagataatggttttagtttatttgatgctactcttcagaagcgtgtgacttccgatgagaggagcaatttccaggaagcatgtaataatattttagattcctatgagatgtttaatttgcagtcaaaagctgtgaaaagaaaaactactgcagaaaacgtaaacacacagagttctagggattcagaagctaccagaaaaaatacaaatgatgcatttttgtacatttatgaatcaggtggtccaggccatagcaaaatgacagagccatctttacaaaacaaagacagctcttgctcagaatcaaagatgttagaacaagagacaattgtagcatcagaagctggagaaaatgagaaacataaaaaatctttcctggaacatagctctttagaaaatccgtgtggaaccagtttagaaatgtttttaagcccttttcagacaccatgtcactttgaggagagtgggcaggatctagaaatatggaaagaaagtactactgttaatggcatggctgccaacatcttgaaaaataatagaattcagaatcaaccaaagagatttaaagatgctactgaagtgggatgccagcctctgccttttgcaacaacattatggggagtacatagtgctcagacagagaaagagaaaaaaaaagaatctagcaattgtggaagaagaaatgtttttagttatgggcgagttaaattatgttccactggctttataactcatgtagtacaaaatgaaaaaactaaatcaactgaaacagaacattcatttaaaaattatgttagacctggtcccacacgtgcccaagaaacatttggaaatagaacacgtcattcagttgaaactccagacatcaaagatttagccagcactttaagtaaagaatctggtcaattgcccaacaaaaaaaattgcagaacgaatataagttatgggctagagaatgaacctacagcaacttatacaatgttttctgcttttcaggaaggtagcaaaaaatcacaaacagattgcatattatctgatacatccccctctttcccctggtatagacacgtttccaatgatagtaggaaaacagataaattaattggtttctccaaaccaatcgtccgtaagaagctaagcttgagttcacagctaggatctttagagaagtttaagaggcaatatgggaaggttgaaaatcctctggatacagaagtagaggaaagtaatggagtcactaccaatctcagtcttcaagttgaacctgacattctgctgaaggacaagaaccgcttagagaactctgatgtttgtaaaatcactactatggagcatagtgattcagatagtagttgtcaaccagcaagccacatccttaactcagagaagtttccattctccaaggatgaagattgtttagaacaacagatgcctagtttgagagaaagtcctatgaccctgaaggagttatctctctttaatagaaaacctttggaccttgagaagtcatctgaatcactagcctctaaattatccagactgaagggttccgaaagagaaactcaaacaatggggatgatgagtcgttttaatgaacttccaaattcagattccagtaggaaagacagcaagttgtgcagtgtgttaacacaagatttttgtatgttatttaacaacaagcatgaaaaaacagagaatggtgtcatcccaacatcagattctgccacacaggataattcctttaataaaaatagtaaaacacattctaacagcaatacaacagagaactgtgtgatatcagaaactcctttggtattgccctataataattctaaagttaccggtaaagattcagatgttcttatcagagcctcagaacaacagataggaagtcttgactctcccagtggaatgttaatgaatccggtagaagatgccacaggtgaccaaaatggaatttgttttcagagtgaggaatctaaagcaagagcttgttctgaaactgaagagtcaaacacgtgttgttcagattggcagcggcatttcgatgtagccctgggaagaatggtttatgtcaacaaaatgactggactcagcacattcattgccccaactgaggacattcaggctgcttgtac

SEQ ID NO: 76857 - DNA, 1085 bp, Homo sapiens
tcacatttatatgatggttgttagaagaaattgtttacaattagagttctttcttttagtagtttggagaaatcacaaggaagtcccatccatgttcagagatcatctccctgaaatctagtttccaaagaagaaatcagcattttgctcttgcagataataatatgatcaccacttactgttttttcctgttttctttcagttcaacccagtaatccactgggaattcactctatgtcccactgtagcgatttatttttggccagagcctaaaagaatcttgtgtttcttaaattcgtaaatacagttacggtgaagcaaaataattaggttcctgagatcagatgctccagctttatggcaactagtttgtgggaatgtgtgacattgaggacaccaagacagaagggacctagactaagatgcacctgcaccaccctggtaatgtctcaaatcttattccacagtgctgtgcctttggaagctgagtggttgtaccttcctgtcattcctctagagtactcaagaacaggtgattttcctggtatcctttaatcttcacgtaactcccagcagacgtacaccctgtctctctcctggactgtaagcatttttgaggacagggaacatattttgtgctttgtgcttaataagtgttaactgaatagaatttcagtacaatgaggaataaaattataggaattagagtataagaagtaaattactaaaggatctcatatacttgaggaactttcccctgatcaaattctttgagaggaactttcccctgatcaaattctttttttgagaccgagtctcgccctgttgcccaggctggagtgcagtgacgcgatctcggctcactgcagcgatcttggctcactgcagcctccacctaccgggttcaagcaattctctgcctcagtctcctgagtagctgggattacaggtgcccgccaccacacccagctaatttttgtatgtttagtagagacggggtttcaccatcttgcccaggctggtcttgaactcctgaccttgtgatccacacgcctcagcctcccaaaatgttgggattacatgca

SEQ ID NO: 76858 - DNA, 1024 bp, Homo sapiens
taatctgcaaggtcaaagagaacaggaaaggagcaacagcggtaactgacttgccagcgttgaggcaaaccaagggcctgcaaaggaggtactgctgagaggcaagccactttcccaacagaacctgagaggttcagtgcttggaagtacccgatagtggaaagtaaggaggtacaggactgaaaacaagtaggaccccacggctcctcccaccttatgcatccaagtgttcaacacccaagcacactcacagaagagcaaggatttattctctggagaaattgaaccacacagatttctgactcaggaaatctagacacgtggaactgggttaatcttggggctgaaaatggggattaagtacaagtgtacataccaaattatcgaactgtcagcctccttcccccactcagcccccagagtaccaagcatattggcatcctcataggaaaaagaggggtactctggatacacagaacagtccagagaaaagccttcagatactgaccttgggaaacgctaattaaaagactcactatctgggaaccttaatatgaagatccttagtcaatgagccccacttaagcttaaatatgaaaggacagccaggaatcatcagatatttgctaaaagctctaacaagaaaaagagccaaaaagtccacaaacaaaaacttaggaggcagcaacaaggcaggtggcagaagaaaacttttttttaacatgagaccatatcaacaaaatgagtattagaagagattgtgtccataaaacaagaagagtatactgtgaaaaaaagacaaccagagaaccagaaagaactattgtaaattaaaactttgatagctaaaaataaaaattatttaaatagaggccaggtgtgatggctcacgcctgtaatcccagcactttgggaggccaacgtggggagatcacaaggtcaggaaatcaagaccatcctggctaagacggtgaaatcccatctctactaaaaatacacaaaattagctgggcgtggtggcaca

SEQ ID NO: 76859 - DNA, 1013 bp, Homo sapiens
ccaaccactttctttctgaatgtctagtcagtatttttccccttttggtgttttatgaagccatgtggtaacgaatgaatctgtatcatttttcctacctgagtggcccaaagccagcaccaaaccctgggagtccctgaagcctaacagaacaggtagaacttgcaaaaggaatttggctgagagctcacttctaatcctgtactcactgtgtctttgtagatagaaacaagctagctttaccaaagagaaatagtgtcatagaagaacaaaacttcatatagaaagttctaggcaagtatttgatggtttccttaaggatgtgagctttgtatttccacctagccttgtaaaatgttcctgtggtattttgtgtcacacatcctacctttgatgagtctcacatcccaccttcctataaacagctaaattaattttgtttcatcttccccagaccaaaatgtttgataatcttatcaacattgtgggaggtcttgtgcaatggaaattttgccatttctccaaaactggtggcataaaggctgatgcttggggagaaccccattgctcgggacaggcaactctgttcaatgggatcttctttggtttgatgttcccattgttttctcagttctgggaagcctagtacattagtactaatgtaatcactgaaaccttttcttgaaataagggaagcagccaaactttgattaaagttgcaagttctggggacttgcgggggttgtcataaactgtaacagtgggttttggttcagcatgtaaatgcaactttgattttcttgaggaccgattgacctgtcatgtccctgtatcctcatgctcatcatctcagcaggcctgagaggctgggtcagtttgggtgttcatcatgaggattgcttctgccatggagctgatggacatgggcaggttgctgagaaggtggggtgaaagtgagtgccgggggtgggtgagtgccctggtcttgttcataggggagcctttccctagca

SEQ ID NO: 76860 - DNA, 1362 bp, Homo sapiens
agaaaataatagacaccttgtatggttctttggaggattaaatgaactaatgtttatgaaattactttagaaaataatatacaggctgagcacggtggctcacacctgtaatcccagcactttgggagattgcttgagcccaggagttcaagaccagcctgggcaacctggtgaaaccccatctctaccaaaaataaaaactaactgggcatgatggcacacgcctatagtcccagttattcaggaggctgaggtgggaagatcacctgaatctggggaggtcaaggctgcagtgatccgtgatcacaccactgcacttcggcgtaagcaacagagcaagaccctgtctcaaaaacacacacacacacaaggtaagattggcagctatagcagggagaagattgttttgcccaggactttttccattttaaaactaagagttctgcatcccaggaaaccccgcagtcctggacaaacctggatagttggtcaccctacctgcagtaaatataaaggtatggactgtatctaaaatagtgccatgagcgtctcacaagatcgtggctacaaatccttagccacgccttagccaatgccttagaagttggcattgaaaatatagtactgaactacttctgtgactaggtggcactgttgctaatgtggaaccgtgttttatccggacaggtggggatgcattccaaaggaactcagacagcaaaggaagagatggaaatggatccaaagcctgacttagattcagattcctggtgcctcctgggaacagactcctgtagacccagcctctagtctcctgagcctgtagagcccccaggagactgggacccaaagaacttcacagcacacttaccgaatgcagagagcagctttcctggctttgttcacttgcagaaaaggagcgcaaggcagaggctctgaagcactttccttgtacatttggagagtggcattgccttttagataggatctaggagtgattttattgttttggagaatggaagggcccccatggccctggctttgtcatcagtgactgccatagcaacagcagctctgtacctcatctgttgatcccacctttgaagaggagacacagtgctcaccttaattgcgctggtagcagcttatatcccatgtatcattttcaccattgattggaagctgccttgggaattcagtaccaggcattacccctctgggtgggagagggagaagtgtaaagttggagtgggctggaatcaggtgtggcccgcccagtgtcctctgcagagtggtgaagtagtctggccctcttgggagccctgagtccaggaaaatatgtctgatggagtcaatctaggg

SEQ ID NO: 76861 - DNA, 2679 bp, Homo sapiens
aaaatacaaaaaattagccagttgtggtggtacacgcttgtaatcccagctacttgggaggctgaagtaggaggaccacttgaacctgggaggtgaaggttgcagtgagccgagattgtgccactgcacttcagcctggtgacagagtgagattctgtctcaaaaaaataataattagccgggcatggtggcacatgcctgtggtcctagctactcaggaggctgatgtggaaggattatttgagtcccaaaggtcaggactacagtgagtcatggttgtgccactgcactccagcctgggcaacagagcaagaccctgtttcaaaaaaaaaaatctgtaggtttaaagctccctgtctaataagactaaacttgctagtgatttgaggagcgtgaacagaggaagcagcatgctgttctgtctgcacctttagcctcagctttcagcagtgttgcagccagcctcactgacacttccttggagcgccccagctcactgaatagcctgtgtagaataagcgtgttggagtgacacaccagaaactccagcctgtgttctttgagtttgcctttgcatcactgtttctctgatgaaggggtggcagttttttcacaggtaggctgtgatatgttgttaaccacaactgtcttgcccactagagggtgctgaagtcatgagagagggaaaactatagcaaaaagaagggaatttgggaggaagcaaatactgcaaacagactaatgagattctttctcatatacataggagctggaaaatgcagaatttatccccatgcctgacagcccatctcctctcagtgcagcgttttcagaatctgagaaagataccctgccctatgaagagctgcaaggactcaaagtggcctctgaagctcctttggaacacaaaccccaagtagaagcctcggtaactgagctttttgcctttgaatcacaactaggtaaacagtcactgcaagctctgcctggttcttctggcctcgctctagcttttgggtttcagctgccctgcatcaactcattatactgtctattcagcagtacttaaagcctcaacccaagactaaactgagttgcctcagaaaggtatttacccttccacatttctgacaggctaacacctttctaaagggattgtcttttccctctgcctcagaaataccaaaattcaaattcagtttttcatgacactggcagggtaggttagaggctctaaatataagaaagaagtaatactggtagtctagtgaggaagcaacacatgtacacctaaccttggtaaaaatgacattgtggtaaatacctcagtaaaactataatccaaggtcatgaaactttttctataaaaggctacataattattttagacttttcctattaaaggccacatagtaattattttagaccattttagacagaaatgtgtacagcctcttttgcaactactcaactctgacattgtagcacaaaaagcagcttcaagtaatacataatgaatgggcatccttgtgttccaataaaattgtatttacaaaaacaggcagtgggccagaattggcctatgggctatttgttgaaccctcctataaaaaaagtacagtagaaaagagaaaaatccagactaggatcatcagaaagcttcccagaagaggtaataatacctttgaaacttcaaggtgaatgttttaatttctctgtcagttcaccttcttaaattgtgttggtggtcctgtttactgaccacctctcagatcttttctaaagtgtgattcactgcatatcatgaatattgaccctttgggtctgtgatctgaaagacttgttccaaaccaaatcatgcttttccctacttcagcattttaaatgagaagataccaaggtgctttaaaatttttcacaaagtcctccaaaatagatgattggtctcccaccttggcctaatggggactgaggcagagagttcactttccatgttatgtcagtgcccatcgctgttataatcctagcatttctgtttctcgtacatatattcatgtgtatatatgatttatcttgttaatttaaaagtaaaatccgattgcacttagaggaagtttggattgaggagctatgacacctgggcagaacctcctgcaatctccttcttgtctctctagtcacctcggctgaatcctgcagtaacctgtgctgggaagggaacaccactgactcctcctgcgtgtgcgtgcagctctctgcaggtggaggttgagagattgcagggtctggtgttaaagtgtctggctgaacaacagaagctacagcaagaaaacctccagatttttacccaactgcagaagttgaacaagaaattagaaggagggcagcaggtgagagcattaaaagaataatccaatttctaagcctgttttgaagaatcacagaaacaaaacacaaagtactgaaatagacttgttcctttgcaggtccttactttttttttgagacggagtctcgctctgttgccaggccagagtgcagtggtgctatcttggcttactgcaacctccgcctcccggattcaagcaattctcctgcctcagcctcccgagtagctgggactacaggtgtgcaccaccatgcccggctaattttggtatttttagtagagacagggtt

SEQ ID NO: 76862 - DNA, 1045 bp, Homo sapiens
tatgcaatgttacttcctttttttaaattttgagacagagtctcactctgttacccagagtagagtgcagtggcacagacacagctcactgtagtttcgctctcccaggctcaattgatcctctcacctgagcctcccaagtagctgggactacaggccagtgccaccacacctggctagctttgcatttttttttagagattgggttttgccatgttgcctaggctggtctcaaacacatggttactttttaaaacttcccaggtgattccagtgaccagccaaggcagacagttgctaatgtagatagtgaatatacttagaatagcaagtggtgcttagcttatgatactaatttctaaaactgtaagttatagttctaaagttatctggagtcaaggagagcaattatctccctatcctagtcttctctcatttttcttgcctatatcagtatacagtgcttacctaccaaatattttttctcagagaaagtattgaattctaagaccatccgttccaatagcagtggcttatccattggaactggtaagtaccaatgtttcaggtaccagtggttttctgaagtgtgggtcttttggttagattccatgtagactccaaaacccaaaggaaaatgggaaatgtctttgggaagtgaggaatacagtggttaagagagaagatcatattttgtttggttttgcagtaagttataacttttacattgtggtcagagagacactacatcatctttgcctccaacgcatatgcaagtaattaagtagcttgcccagtactgtaatatgacttatgtattattcctttccttactattctagggggtaatgagtcctctacttccacggtattcccaggggtattccagtctaaagaaatagttcaccaaaacaggcactcagaataaaactcggctaaactttcagtgtggttaggagaatcatcccaaagatctctgatagatttcctttgactgctgtcttcatggttctctattattggggaccatgctaggaaattgaat

SEQ ID NO: 76863 - DNA, 1092 bp, Homo sapiens
accaataaaaagttgttgaagaaaaaggtgaatgattggatgaatgaatgagtgaatggcagtacataggaagagtgggcatttttacccaagtggaatcaggaagagtttaagctttatataggagaataaacagctttcccttgtttagtacatagtgggaagtctttctagctctaggatataaagatggggaacccggagaattgggaagccagtgttctgttaaatggtctactgtttaacttttttcctagataatcacatttttgcctggggcaatggtggtaatggccgcctggcaatgacccccacagagagaccacatggctctgatatctgtacctcatggcctcggcctatttttggatctctgcatcatgtcccggacctgtcttgccgtggatggcataccattctcatcgttggtaagagtttcatatgtctggggttgggatggctttgacagaggatggacccacatctgagtactgttagtcacattgttggaaacagaaatgtcctgaagaagccatttctgtaagtcttgtaatggtcaaggatgccatgcctagtggtgggaacagaacattgtcatttcctggagctttgctatctgccatctcttgattattttttaatataagtttgggctctgcctgcccccttagaattgatttttttggttgtttttttttgtcttttttttgagttggagtttcactcttttcgcccaggctggagtgctatggtgtgatctcggctcactgcaacctccgcctcttgggttcaagcaaattctcttgcctcagcctcccaagtagcttggactataggtgcctaccaccacgcctgactaatttttgtatttttggtagagatggggttccaccacgttggccaggctggtctagaactcctgacctcaggtgatccacctgcctcagcctcccaaagtgctgggattacaggcatgagccaccgtgcctggccctagaatttgttacttctaatcatccaccaattaatttgttgtctgtgctcatgctttcatgagaaacattcagtacatcctttaaaagaaactttaaa

SEQ ID NO: 76864 - DNA, 1015 bp, Homo sapiens
tagttcatgactttaacttcagaatgaggaatgtaaatttggattctgtggctgggcatattacctcttgatgttcctatactcctctgaactgtacttgatggcctcattcatgtccaagtcctcttttaggctctaggaatatagaaatgagtctcagaaaactcctgctttcaaggagctcacactctagtagaataggggactagcacaggcaggtgttaggtgctataatagcagcagcctagtcttctaagtcctggagtaccccaaggctcacttgtctctccaaagtgagcttgttcccttaaattccccctatacattgactgctttatatcaccaggcttgaccttcagactcatttattcaacagctcctcaacttgatgtctaaatttagggtgggccatataacccagttatcttagaccaatcctgattcatgccttcatgcctgttgtcctggcttaatgattaatagccaccctgtttcatttttttttaaaagcctgatttggataagaagttataggcatctcagacaaacttagtatactcaaaatcaaacttctgattttctgcccagatctgtacctcctgcagccttcctgtctcagtaaatggcaacttcctcctacactccacatcccatccatattggttatcttcagaataaatccaaccacttctcaccatctccactacaactggtctccctgcttccatccttgctcccctgccatcagttctcctcagtagacagagggattctcttaaataactactgctcaaaacctccagtggtttcctctatcagtcagtaagtgccagagtcatcacagtggcccgactggccctatgtgagcaggacctcagccacctcctgaccccttctgttattccgtcccttcctttactttgttctagctgcaggggtctccttgttccttgtttgtgctgctgacattacttttgctgttgctcttctctctgcctggaaactcttcgtcact

SEQ ID NO: 76865 - DNA, 1066 bp, Homo sapiens
gccccaggcaagactcacacagctgctattgatggtaagttgatttacaactgtatcacatgccttagtagctgagcctcttttattctatcaggtattaggttttctttatatgtatatcatcccgatttcccctgaaaatctagtattatttcattaatgtattcaggtacatatttttattgataattattataaatgcataataaatacatccttttatgagaacaccacacctatgattccagacatctgttgtctctgattagcaccttttataagtattctaaggtagtactcatttttctcactacaaatacagtactggagagagaatacaatatcgagtcgctgactggatctaattggttatagtgcctagatactgtatttgtcctaggtccaggatcatgtggctagttttatatttgtatattctaacaaccggaagctaatccatgaagtctgcttggctgcatcttctctgggttccaggactcatttgtgccttgttatttctttttgcttctctctcagagcgaggccggctgctgacctttggctgcaacaagtgtgggcagctgggcgttgggaactacaagaagcgtctgggaatcaacctgttggggggaccccttggtgggaagcaagtgatcagggtctcctgcggtgatgagtttaccattgctgccactgatggtgagtctgtacatatcatttcaagctttctggacacatggctgtgtttcagttcttggctgggaaagaaatggactagttatttgtatagctgaattgtggatgtacttttttatttgtattaaattggtggccggttatatatattgagctttattaacttttcatgtgttcaacatagtgattgtttttaaaggccagatttctagataatgataggttaatgttctacattcctccttttttcatttcagctttcacttttttggtaaaatgttataagaattattaagtacttctatataacttgcccagtatcttgttgattgatttcagtaaacattgattgggtagctggagagaacag

SEQ ID NO: 76866 - DNA, 1039 bp, Homo sapiens
aaagcagtatactgtctcttaacccaacacagccattttcctctcctgtttctacagttgaccaccagatgaaatattaatagttgtttttgtttagcggtcatgttgcatgaaacatattatctaattactctcagccttgccagagctggccctgtgagaggctcacagaggctgataccagctgggggaaaagcacagtcacatctctcccacctaccctagggcacaggcttacccattggagggttggctaaatcagctataccatttattgttagcagtgttttgggttttctgttttcttttttttttttctttccttgggaacttttagccaaaccagtttttatttatattttaaaaattaaattattatgcatttctagggaccatcctcaatgggattcccagctgttccttttctcctggaaaggctgtggcagaaactgagggttgaggtttcaggttttacacacatccattgtgaccccacacatgcatcaccccaccttctccagtcctgtctagttagctgtaaaaagatatgagcatttggaagtcctagatattacctcagtactctgtcacctctcctataaaatgaccagattgggaccccacagggctactgaatttctgtaactgtcaagcagccttccatctcaaaggacaaaatcagcaatgaattgaagcttctttctcaactttttgacaggtcaccctaagtaggacctattactaagacaaactgagagggtgctgtcttgtttagttgacctggaactgtcaccttttctttgatattgtaaaacttgagctcttcgttgacaacagtagccttgaccgagcacaatggctcacgcctgtaatcccagcactttgggaggccgaggcgggcaaatcacttgaggtcaggagttcgagaccagcctggccaacatggtgaaaccctgtctctactaaaaacacaaaaattaactgggcatggtggcacacgcctttaatcccagctactcaagaggctgaggcaggagaa

SEQ ID NO: 76867 - DNA, 1571 bp, Homo sapiens
ctggaccatttctcagagacagaaagcaaatggccccaaactgctggcctttgggtatttaatgaattgtctaatgaaaggactatataactgttttgagttgtattgaggtactttgctaaaagtattgtgatgttgtaggatgcatacagtttataagaggattaaatctgtgaaatgtattaaacagacacctttgcaatataaaaacctattatttcactcatgtatctttgcttttcttttggtagagagatggaggaaaaagtcactctgcttaatgcacctacaaagagaccaaggtaatgttcaagagactcttaaaaactaatatatccgaaattacaaccagggggttctttcttgagtgtaggcattatttgatccgaggatactttggcatcctttcaggagccagcatctgcttaaatgtcagacagtcatttctaagaagaaagctataatttcaccctcacactaaagtggccatcattaccatgatgaatgtggaaaagtgtaggtgttatgggtcagactggaatctgatctggccaagctgtgatgaagccctgaggcaggaattgcaaagtctgctgtgatagagcacattgaaacaagttgtcgagaaagaacatactttctcataccataattggcagttcttctcagggaacagactggaagcatttttctttgatattgtttttaatgttaaatgttcctttgttctgggggttgttggcaggtcaagcactgtgactgaagcacccattgctgtagtaacatcacgaaccagtgaagtctatgtttggggtggtggaaaatccaccccccagaaactggatgttatcaagagtggctgtagtgcccggcaggtctgtgcagggaatacccactttgctgtggtcacagtggagaaggaactgtacacttgggtggtaagtgaacgctaagcattttggaacagtgctgtaagcctaattgtttactgggcccacgatgtctaagcattttattagttgaacctatactaagggagtggcaacatggggtgatggaatggaagctcttataagagcagggattttgtctgtttagttcactgatgtatgcccagggctggtacatattaggtcacctataaatgttttttgaatgaatgaatgagagagggagagaaaaattgaaagactcaggagactggggtttcccatttacagctggatgatttcagacaagtcactcaattactctgttatattaccatgaggttcagagcaactattacctgtgaaatagctttgtaaacaaaggaaggactataccatgtcaggaaacccctgaagcccacagcagtgattgaagatggctaggtatattttgtgtagaatttgtttgttgccctctagattctcccctctcaccttccttaacaaattgtctgtgtttgctgtctgtttccttatctcccactctctcttcattcacctacaatgcagcttccatctctgccactgccactcaattgaaactagtcttgacaaaatgacccataaattgctaaaataaaa

SEQ ID NO: 76868 - DNA, 1052 bp, Homo sapiens
tagatttcaaaaaactgcaatgaaagataatttaccacttctaatacagaatgtctgtatttctcatatctcatggttcccttgctgtgtagttctagtattattcaaagtatgtttcatgaaacactggagtcagaatcaccagggaatgggggagttttgtaagtaaaaagaagattcctgggccccaccccagacgaactcaatcagaatctctgtggataaagcccagaaatctttatttgtaacaaacacctcaggtaattcttctgttctgtatatattgaggttcaagagccactgccctaactgaacaagtgaggaagatgcattataaacattctccttcatgtacaagtgttgattataatgaggtgagaagcataaaatatggagtatcacataagaaatgatttttaaaacaaaaggataatgcagtggtctttgactaattaacatctttagatccgatgtcgcccatttccattaagtgaaaactaaccctatttttactttttaggatcctgagcagagacctactgcagatgaacttctagatcgccctcttctcaggaaacgcaggaggtaaattatgaagaagtcactccattgtcttttctgagatagttgacttttagaggcttgatcagagtactaaaagaaagagtagtgtttcctgacttggttgcaatagtgctattttctaccaacatccctgcttttattgcttaggggtggcatctgacttttgcctccttagcctgtgctgttttgttgtaaatttgtactaatgaggcccaagagcccttcactccccaacccattggttttaaaccttagagttgaggcattagagtgcagtaaggaagaggggtgtctggactcagacatccttatgtttgtatctgaattttgtcattatctttgtcaagttatttaacatcgttatttcttggctttctcctctataaagtaagatgaggtcaggattaaagaagataacgcataaaaagtggtcagcccagggcctggcatagggtgcctatcaattg

SEQ ID NO: 76869 - DNA, 1054 bp, Homo sapiens
tgtatatgacttggagtcaggctttggttggaattatagctccatttttactatctgtgattttgggcaagttactttacatctctgagccccatttttctcatatataaattgataatgataataatttccttgaatggtgttagtgaggctaaaaaatatcatatatgtaatgtgcctgtctagtttgtagtagtctctcaataatgtggtggtggtattaccataatattgttagtattatcatcttattattattactgccttatctgttgcagcagagtattgcctgtacagccacaattaggatatataaattaggacgcaagttagttggcaagggaactacatgaagccaacaaggatggctaatcttgctttcctttttcttgggattcagttgaaaggtcagattataatatactctgagcatcatattattggccacatagttatagattgtatggccagttggcttcattctgtctgatagcatcagtgcatccctaaccatttttttttgatgcatactagtagttataacaagaagtcagacctattgccaattctttaaataatggtcacagacacctgagagcccctaccagtagagtatagcatcatctttatataaccaggaacaatgcagtcatcattttctcatagaacccacttaacctgtgtgtgaagatcgtgcaaggaattcgggccatggaagttgactctagccagtactctttggaattgatccaaatggttcattcgtgccttgaccaggtaggtgtgacttaaacattcacttcagtttcgtatttccccttccagcctcagtgtttggtgtatggcatagctataaaccatacaaaaccacatccacttccccagggtagagtgtatttgtggctatacccagaataggtattggtaattcattatagttgtgtgcttcagtgaacaaattcttacttcattctgttttgtaagtgttagtttgtgaaatgaatttcccatctaaattgtgctcgattttttatgaccaagagtaatttctgaa

SEQ ID NO: 76870 - DNA, 1050 bp, Homo sapiens
gtttcattgcgcgtattttagttagaacatctaattccttcattgagttaccatctccccactgccagtgtttggatttttttcccattggtgaacttctactaagtatgtctttaagtttgtgtaaagtcttcagtaggccttgaatgcctgaagcctctgtgatctaggaatcacagagctattgagcccctcaagttaccacagttcctttgtcacagagattgtccctttataattgacccaagaggtttgatatgaataagatttctttccatagtggcatcgtctcataaaaaccattttggaatctgctgatgaatgttttatggttgttatgactagttcctaggaaatttaattaagctgttgaaatgttaacatagttacctcagaaaagaagttattctttgattgtttctttgttgctcagcttgtgggaaccccatattacatgtctccagagctctgtcaaggagtaaagtacaatttcaagtctgatatctgggcagttggctgcgtcatttttgaactgcttaccttaaagaggacgtttgatgctacagtaagttggcatattatccccatattgcatttagcaggttgcaaatggtacagcttgactaagcagatcaactctattcccaggcttctgatttctggcaaaaataacctgtattcaggtacaagattagtaatctattactaaaatgctatagacccagccaggcgcagtggctcacgcctgtaatcccagcattttgggaggccgaggtgggtggatcacttgaggtcaccccggccaacatggtgaaaccccgtctccattagaaatacaaaactcagccgggtgtggtggcgcacacctgtaatcccagctatttgagaggctgaggcacaaaaattgcttgaacccaggaggtggaggttgcagtgagccaagatcatgccactgcactccagcctgggcaacagagcaagactctgtctcaaaaaaatctccaacttgaattccctgttgaaatgatcacttgaacccgggaagtggag

SEQ ID NO: 76871 - DNA, 1061 bp, Homo sapiens
ggaagagttttgtgcccatgtgaaaagtcaaaagaagtagttgcctatggagagaaagcagaatccttcatttccttgtgtcacctaaaaaaacctgttacaggagccaagctttgatctgtattaagcaattcaaatctgtgtcttgtttaattgcaggagggaacctgtatgacaaaatccttcgtcagaaggacaagttgtttgaggaagaggtaattcatatttctgtggaaggaagttagaattgtagtgttgtaattcttgcattctagttctgtatttactcttccaatagtgaagagtgtttttttccttttgttcagactccttccaggctctgatattcatgagaaaggaaacctctaacaaggaagctgtctatagctgcttcctaaacgttttacctccacatcatgattctctgtgggctttctttcctggttctattactgcgtactggtatgcccagttttctataactttgcattcttcctgaattttcctacatgtctgctttaccatactatatattataatgacattggaactattttatgaggaacctgttttttgtggttttttaccccttcacttttctttgcctactcaacctgcaaggaagagatgtcaagtcatgttgaatcataacttctggttgcagttttctttgttttgtttgtttatgtgtgtgtgtatttacttaaatggagctttttgtttctaatccaaatatttattttttctctgcagatggtggtgtggtacctatttcagattgtttcagcagtgagctgcatccataaagctggaatccttcataggtaagaagtaaaaaaaattatggatggattcttccctaccaattcagcccctaccgtggatacccccccaacaacacttttattttcttggttaagcagccaagagtttttccattgatatcactaggaaaggaaagtaatgagcaatattattttcactccctgaggttaaaccatgtttatgatctaggaagagtctcctcagtagccaagtactactgaagtcattttacagac

SEQ ID NO: 76872 - DNA, 1033 bp, Homo sapiens
cacagtgataccccatctcttaaaaaaaaaaaaaaaaaatttagctgagtgtggcagtgcgtgcctgtagtcccaactactggggaagctgaggtgggaggattgcttcagcccaggagttcaaagctgaaatgagctatgactgcactctagtttgggcaacagagtgagaccctatctcttaaaaaaaaaaaaaaaaaaagatagtagacatcaggagctacaggatacataaaagtatgagaggagattatagagttgcaaaaggggtcatgacttctcttatccagaaagggtaggtgaaaatcactagggaagtctaaatttataaaactagaggcaagtttagtattttcattttagaagctgggaccagctatagataattgctccccagttctctgcttctccagtattcttgccctgccataatcaccatcatgattagcagtctgtcatagtatcctcaatagaatctttttgagatctatccccagcccatatttttacctggaactgacatcatgcaaattaagtatgacaacaacgttttaatgctttacttcccctgtcctgcaataaattataatgctaaattgtacacataacctttaaagtctgttaaaaggaaaaaataagaggagtcagtctgtgcccctctaggaagttttccttctaggcttacagatctaggtgtggattcatttgctgccaggcaagaggaaaagcacgatacctctgttactgtgtttaggatgactcactggttgtgtggaaggaagtcgatttgacccggctgtctgagaaggaacgtcgtgatgccttgaatgagattgttattctggcactgctgcagcacgacaacattattgcctactacaatcacttcatggacaataccacgctgctgattgagctggaatattgtaatggtaagatagagttcagtgggacttttccagcaagactttcttagactcataattacgttgaggagaagaatataagaagagacatatacagtgataaaaac

SEQ ID NO: 76873 - DNA, 1038 bp, Homo sapiens
gcctagcgccagtcaggggccgcgagccggcggcggcgcggcggagcaggaggaactgcactacatccccatccgcgtcctgggccgcggcgccttcggggaagccacgctgtaccgccgcaccgaggtagcggccctcggcgccggccgccctgtctggcgctgtcgggtcgccccgagtccctccttctcggccccgctttcccagcgtcgtgagcttagtgctttaggcgcccacggggtatatgtcttagggtcttcaccactcttcccactcaccggcactagaaattggctagatcattggtttgactagtcatttttgattgtcctaagtcacctaaccgtctcttgagctttagtttccccatctgtaaaatgggcttactgataataccttgaaatcatctttttcttttttttttaagattatcttgagaatcaaacgaaggctctgttctgtaaattaaagtggtatacgaatgtgaggtattgccaaaacttccttcctctcatgctgtatatatagttctccaaggtcggggtgaggaggaggggcatagcttcaaaatccccacacccgtggcaactccgttatttttgtcattatctttaagttcagcagtgatcactcagttggaagcttttcttgaagctcattgggaagatctttgtgtgttggttctttatcagtgtttatcttgcagggtttatgcatgggaaatactttgttggtatattctaagccattagttcttaatttggggggcacaaggacccctttgataacctaagcaaagtaatcttgccccctccatcaacacatttgcacatatgcacatcctttggagagatccatggatcacggaatcccaagttaatatatactagtgtaaaaccctgcagtgattattctacttccaaaaactaacgatacactagatttgatcataaaatcttactttagggtaaacatttaatgagaacttgctggggttgctgaaggtgattcatccgtcggaaatccatctgcagttc

SEQ ID NO: 76874 - DNA, 4282 bp, Homo sapiens
tcaacatttatatataggataatgaacttttatttttatttatttacttatttttgagatggagtctcgctctgtcgctcaggctggagtacggtggtgcgatctcggctcactgcaacctccgcctcctgggttcaagcaattctcctgcctcagcctcccaagtagctgggactataggcacaagccaccatgcctggctaatttttcgtatttttaatagagacagagttagccaggatggtctcgatctcctgacttcatgatctgcctgcctcagcctcccagagtgctgggattacaggctgggattacaccatgcccagccaggataatgaacttaaaaagaaaaattatctgaaatcctactgttagacctagggacagagtgaagttaattaattgcctttacccacctcccctgccattgtttagccagctgaggaggctcacttcattatgtttacaatgcttttgtttttttttagagtcaacaaacactcgggtcctatacttcagcatcttttcaatgttctgtctcattggactagctacctggcaggtcttctacctgcgacgcttcttcaaggccaagaaattgattgagtaatgaatgaggcatattctcctcccaccttgtacctcagccagcagaacatcgctgggacgtgcctggcctaaggcatcctaccaacagcaccatcaaggcacgttggagctttcttgccagaactgatctcttttggtgtgggaggacatggggtaccacctacacccaacaagtcaatgagggacttctttttaatttggtaggattttgactggttttgcaacaataggtctattattagagtcacctatgacaaaaaataggggttacctagataatgccaaagtcagcatttgtcctgggttcccttgtgtgatctgtttggactatgttttcttttcttctcccacttgctcagcagcttgggcttccattctagttcttttaccaagatttttgtgtgaccatgttgacttcatttggattgccctctttcaatttccttgtgaaaacacccttaactttctctttacccttagctgaaatgtttacatagcttctggtgatatcttttcatgattttatatctcttaaaatggtgatggatgtgacacctcataaaagtgagctttgaactgtagataactcttaaagaaaatgtcattttagacaattaaaatatttgtgctcaactgcttgaacttttttcgtgtatgtgtatttaattctatgcaatattatcacatgtgtagattcatgtgaccaccatcacaagagacagaacagttctgtcacatggatcccttgcactgcccttttacagccgcagccacatccctttcttataccctcaccccaacctgtggctaccactgttctgtcctccatctctgtaattttgtcatttcaagaatgttgtatgaatggaatcatacagaatgtaatcttacgaggctgatcttttttcattcagcataattcccttgaaatccatccaagttgttgcatgtatgaatagtttcttcctttttttcttttaaaaatgttttatatatttagggggtataagtacagatttcttacatgcatatattgcatcgtggtgaagtgggggcagttccttttgattgctgagtagtattccatggtatggatgtaccacagtttgcttaaccattcacccactaaaggacataagagttgttttcagttttttgccctaataaagctgctgtgaacattcatgtacaggtttttatgtgaacatacattttcattttctgggataaatgctcaaaagggcaactgttgggttgtatggtaaacacatatatttttgtaagaaactaccctactctttttccagagtggctctactttttacatacagccactcatacaattcagacagcaatgtatgattgatccagtttcttcacatcctcaccagcatttggtattactactattttttatcttaaccattcacatagatgtgtgtaatgataccacatgtggttttaatttgcatttccaatggctaatgatgttgagtatctttttgtgtgctaatttgccatctatgtatcctcttcggtgaaatgtcttcatgtcttttgtctattttctatttaggtcatttgttctttttactattgagttttgagaggttttttatatatcctagataaaattcctctgttagatatgtggttgcttgaatttttaacataacttctaccaaggaaaaataagtaaaatttccaacccttgcatggccagtcacttacttaattcctgtccttcagtgttccatctagagaattaagagatatgatgtataaaatagacatcgagggccattaagagagtaaatacttaaaaatacatgttatgaaagcaaagccaataatcactgtaggagtatgagttgcctaagggccaaaactaatgtaaataagagaaagtgtggatataaatgaccattgtttataaacagttatgaaaaatgctgtgacttgaaatctttcccacatctcccaagaaagtaggtaggagtttatcctttccgtaatctctttttaaccctgctgactattacagggcttgtttaatcacagtggcaagaattacatgtatcttacagtaaagaaacagaatactggaatcgttagagaaccctgatgtgttgacctggataaagtacaaaggtggaagagggaatgagttatgctgttaaaatctcaggctattctgttaatgttcctgctactatgaacccaaactttttttttcccccttttgactccttgtgtcttcctctcctgtggcataaaagtagttctgtcgttaacttgtacaacattgccatctgctgttgagaattggtaggtactgcttctgagaacctggctgcagatccttagcataggcagcaaatgttgagaaagtctatctgtagtattacatatactaagttacagaggatgcatccaagtagagaaaataatatgtgggttaagatacatccttaaacttttttttttttggggggggggggacggagtcttgctgcaacgcccaggctggagtgcaatggcactatctcagctcgctgcaaccttcacctcctgggttcaagcaattctcctgcctcagcctcctgagtagctgggaatataggtgcacaccaccatgcctggctaatttttgtattttcagtagaagcagagtttcaccatattggccaggttggtctcgaactcctgacctcaagtgatctgcctgcctcagcctcccaaagtgctgggattacacgcgtgagccaccacacccagcctccatctttaaacttttaaatgtgaaatttctatcatgtaccgttagcctaacaagattttctttcctatttctgactggtgcctttcccctttttaggagcaacgaaagctactctcttagttatgttcttgtgatgtgacaaaatgtcaagaagataggagaagagaatattttatttcgttgatgcttttgttcccaagtgtgaccctaaacttaagctttgtaggagttgacattctttcatgtcccttccctttactcatgccgaaactatcaactgggacattttgtgcttttggtttaaaagttaattgatattatactttggttttatctaaaaagtaaatgtatttgcctttgacaaaagactgacacaagagcaaataagctttaaaatcgggtgttatgtgctttcctccatttttgagcatattatccaaaatggtctgtataatataaatgagaatgatgcagtttaagtaagccttgttataccattgtcatggacccctgtcataaagccatttcttggtttgtttgggaaagaggcatatgggatttatacagattcacttgtaaatgttggattggggatttttgtgtaaattttctcaaataaaggctagcagaaaccattttaggtgtactgttactcttgagtacttctatgtctggattggtgataattcttccatatttctcttttaaattatggcaaattatacctgatgaattagagaaaaaatattgttattcttcagttactgcagatcgatagtttatatgagctagtaaaagattatcatattttgtatgtaatatatgtaaattatatatatatatataattaagaatccttaattatgcatcctcagaccaaatatggttctg

SEQ ID NO: 76875 - DNA, 1052 bp, Homo sapiens
gtgacacagtatgtgttgtagggcttcagggaagacagtgtggacaagagtggttgaaggaggctttcaaggaggcttgaaagataggtcagatttgggtacagagagcataaatgcttttggaagtcagggattctgttctcgaattttacagcagagtttggcagtttaaatgctgtgatcaccctgggtagggagttaagagaccatggtactgttaattttggttggacacccaaagggctgagtaactttatggaatctttagtttcctcatttgaaaaatgagggactcactgcaaaatgaagcaccttgtaactataacatcctttgattatttaacaactacatgcagcttgccagggggatatcaccccctattggagaacctgtggtgcacattgtcttacagacttggcaaaacatacctcatgcttccagtgatgaaggagagtagaatagaataccagcctgccttcatgaaacatgtataatttggcatttttacagatactctgaacagttcaatcaactgcttacaagagcagaacaacagaaagtgggaattttgatattgaggattttttagctttttgtactgtgatataaagcctcaatgctatgtattgaatgcttagtccagagcaagtaaagagcgtcttcttgagaatacttaccatgatttgttttaaaattttactctgttgccctgcaaaaataatagcaatgggaaacccaggaagtttattagtcaaactttattagtcaagcaaacaggacaacttatatagatccttgtggcctaatatagcttgttcatttcacctttgattcaggaaaaacttagtatactcatctggttttctttattaaatttctagtacttacagaataaactcacatagacttggattctaatgccaactgcaccaagctgtgatactttgggcaaattatttaatacctcagagccttagtttcctcatctgcaaaacttaaggataaaaatattcaccttatagggttacgaggattaaatgagattacaaaa

SEQ ID NO: 76876 - DNA, 1093 bp, Homo sapiens
cccagctaattttttgtatttttagtagagacggggtttcaccatgttagccaggatggtctcgatctcctgacctcgtgatctgcctgtcttggcctcccaaagtgctggcggattacatgcgtgaggcaccgcgcccagcccaagggtatttattaaataacaacacatcaatgccctattagacagtagacatagctagttcccctcaaaaacagatgacattattgtgggtttatataaagaatgctttggacacagctgtcgtatagcattttagaacccctatacctcctggaatttccatcatccttggactttatagacattaggaaaggggctttatctttcctgaccttttgcttaacccaagaggggaatccctagcccaaagaaaaccacggtgcttcctttgcctgcttcctgcttcagacgtctgacatgtcctaagcctgcctttacgcatgtagttacaacacagctccaaggttctgcttcttaaccaagaaactcctccccactactttctttaacatctatccccaccctcctgcccttcacccctgctccccagcagcagaccagattgatgtagaggaggaatggctatgacacagtccgaagaccagccctttcttcagtctgcagcaaggctgccttgaaccttgcttagaaatggctgttagctggcagggcacggtggctcacacctgtaatcccagcactttgggaggccaaggtgggtggatcacccaaggtcaggagttggagaccagcctggccaacctggcgaaaaccccatctctactaaaaatacaaaaattagccgggcatggtggcgggtacctgtagtcccaactactcgggaggctgaagcaagagaatcacttgaacgatttaatttcaggcccttgagataatggagaggctttatctccagaggatttggaatctttggcatcagcattaagattcgggaatgtggcatacttctttaattttcatgtccaacacatctctccctcatatctgtggactcataattctgaaatcccatgtggtcctgtaagattgaatagtaattgtaccacac

SEQ ID NO: 76877 - DNA, 1083 bp, Homo sapiens
tatctggggcatggattcagtgctgtttagtcttgaacaactgttttgtgtttgggaaataacaatagtcaaagatagtttttagttaaaataatttcaaactttcaaggaagagggcaggatggaggaaaaagctgcaagagactaggaatggtgataatagaaatttgatgctgataagaagttatttattatagactaataaaaactgacacttatttgggtgacagggagatggaggtgtacacagaatgaggagaaggacaacagcctttttcatctctgcgagacttgggggcagcacaaaagggttcttcaaatgaagggcacctttgaaaaaccacaagaactatttaagactagataattgatctttacagaaagataagagtatttttacccaacaaaacagtacgtaagggcatgaaggaggagtggggtacaggaaatagaatgggcttttgaagaatgcaaactaagtaaatgaaggaaaattggtttaagtgatttaggaaaattgtctaggaatagtggaacagaagttgctctctctttggacagcactttggaagggaaatatcctaaaatggaagaagattggaaatgactggttaattctgcaacaggaagtagtacaacagttgcagctctttccttgttcaaatcctcaattgaatgaaactaggtagcgttatttagaggcagtaaataggagcaagtgatacagttgtgaatgggagacagtttccggtagagaattttcaattgtttgtttctgtttccaggctagtttaatttaaataaataaaacaagaagacctctttatttgatgaacttgagtaaattgaaaaatttttttaaaccttcatgattcagaagaatcttaattatatttaaataagattatgttaaagtgcttttataagatataaaacactagggagaatgttctcattattataaggtagaagaataggtaaaatgatttccagtttgtggttactgcttctgttcccgaactgtggaccattctcagttgaatttgtactctgtggaattttacctattgtaatctttttctc

SEQ ID NO: 76878 - DNA, 1036 bp, Homo sapiens
ttccctcaaaatttgacagggcaaccttttcagatgtggaaatacacattttcagccgaagttgttgcctactatctcttgatttatatgccactcaatttcacactgttttgatttttgagttttatttcccaattcaataagcctgtgtggtttcccttctgttctgttcctctgtagtaccagttgcagtatcttgtgtccttgcctgctcagagatgtttgccagcagcatgttcttgttgctttccggcaccccacacagatagaggctttgtctggaatgtttgtgattttagccagagccaggaattttctgcaactgagcagggggaggagttgtggctgtttccctctattgagagggtaggggttctgtagagggagggcgggcgggtgggtgggtaatttcccagaattttaagtatttcacacaatgattcctttgatttctttctcaggaacagggcggatacctgaccaactcgtgatcctagacatgaagcatggagtggaggcgaaaaattacgaagaggtatgtcctgctctaacagccagaggaggcagcagtgtgctatgctgtgaggtttctgtgacctcggcaggccaacaggctgtgctttgcccaaagggctgtggtttcttagcagtcttgtgacagccagccatgatcttactgatacaaaaagtggtattaacagccttagccgggcgcggtggctcactcctgtaatcccagcactttgggaggccaaggcgggtggatcgcctgaggtcaggagttcgataccagcctggtcaacatggtgacaccaagtttctactaaaaatacaaaaattagccaggagtggtggcgtgcgcctgtaatcccagctagtctactcgggaggctgaggcaggagaattgctggaacctggggggcagaggctgcagtgagccgagatcgtgccactgcactccagcctgggcgacagggcaaggctccatctcaaaaaaaaaaaaaaaaaaaaacagccttgaagaataattctggc

SEQ ID NO: 76879 - DNA, 1137 bp, Homo sapiens
tatttgctgcctattcttactacttttcttattttagatcacagattctgctggccatattctctactccaaagaggatgcaaccaaggggaaatttgcctttaccactgaagattatgacatgtttgaagtgtgttttgagagcaagggtgagtaatcaagagtgtttctctggattaagaatcttctccaactctaatgctccttaatacagtcagcacttaatatctagtttcatttgtattctttatttattctgatttggagacctgttaccttgtagtctttggagcaccttttaaaaggtcgactacatggaataaaagattgaataggtggaacagagagaatttttagggcagtaaaaatattctgtatgatactgtaatagtggatacatgtcattatatggttgtccgaacattacatttggaatgtacaccaagagtgaatcctaatgtaaactgtggactttggtagatagtgatgtgtccatgtaggttcatcatttgtaatgaatgtaccactctggtgggaaatggtgataatgggggaggctatgcatatgtaagaggaagggggatatgggaaatctttgtgccttcctctcagttttgttgtgaacctaaaactgctctaacaaagtgaagtcttaaaaaaaaggctgggcatggtggctcatgcctgtaatcccagcactttgggaggccaaggcaggcagatcactgaaggttaggagtttgagaccagcctggccaacatggtgaaaccctgtctctactaaaaatacaaaattagctgggcatggtggctcgtgcctgtaaccctagctgctcaggaggctgaggcaggagaatcacttaaacccaggaggtggaggttgcagtgagcaagattgtgtcactgcactccagcctgggtgacagagtgagactccatctcaaaaaaataaacaacaacaacaacaaaaaaaactggccgggcgcagtgactcacgcttgtaatcccagcagttgggaggccgaggcgggcggatcacctgaggccaggagtttgagaccagcctggccaacatggcgaaaccccatctctactaaaaatacaaaaattagccagatgtggtggtggcacatgcct

SEQ ID NO: 76880 - DNA, 2256 bp, Homo sapiens
tcacatggtcaggagttcgagaccagcctggccaacatggtgaaaccctatctctacttaaaaaataaaaaattagccgggcctggtggcgcacacctgtagtcccagctacttggggaggctgaggcaggagaattgcttgaacccggaggtggaggttgcagtgagctctgatcgtgccactgcactccagcctgagcaacagtgcaaatctctgtctcaaaaaaaaaaaaaaaaaaaagccgggcatggtggcatgcatctgtagtcccagctactctggaggctgaggcacaagaattgcttgaacccgggagtcagaggttgcagggagctgagatagtgccacttcactccagcctttacgacagagcaaaactctgtctcaaaaaaaaaaggaagaaaatgtggttaatgacctaaatatttatggagttctgagttatcaccaacagttataacaataatataacacctattgaatgcctgctatgtgacaaacactgttccaggcagtttacctgtataacatttaatcttcacagtagctgggcgtggtggtgtgtccttgtaatcccagctactcaggaggctggcacaagaggatctcttgagcccaggagtacataaccagcctgggcaacacagtgagaccctatctaaaaaaaaaaaatcctcacaataaccttatgatgtatgtacaactgttgtccttattttacaaatgaggtagacaagttaaggaacatgcccaagtgtttacagctggtaaacggcacacctgtgatttgagcacggaccagaaagtctgactctagaaccttccatcttaaaagtactatgttgtatggtctctcagagagagaaaaggctagctattcctgtttccgttctttttttttttttttttttttttttgatacggagtctcactctgtcgcccaggctggagtgcagtggcgagatctcggctcactgcaacctctgcctcccgggttcaagcgattctgctgcctcagctgcctgagtagctgggactacaggcgagtgccaccatgcccggctagtttttgtatatttagtagagacagggtttcaccgtgttaggcaagatggtctcgaactcctgacctcaagtgatctgcctgcctcaacctcccaaagtgctgggattacaggcgtgagccaccgcgcctggcccgtgagttttttgtttgtgtgtttgttttgagacagggtcttgctctgtcacccaggctgaagtgcaatgacatgatcacaactcactgcagccttgacctcctgggatcaggcaatcctcctccctgaggcttctgagtagctgggaccacaggtatgcaccaccacaccaaactaatttttttttttttaattatttttagaggcagggtcttcctgtgttgcccaggctggtctcaaattcctggactcaagtgaccctcccctttcggcctcctaaagtgctggcgttacaaggtgtgagccagtgggcctggtggaccttgtgagttttgaggaccctggccaggtattttgtaggttgccctctattgggcatttgtcagatgtttttctcatgataaggtgaggttatgggttttggggaggaagaccacagagataaaatgtcattttttttttcttgtcaaaaccatgattcacttataaagtgtcattttcatcacatcatatcaacatgatttgtcacgttgatactgcccttgatcatttggatgaattagtgtttgtcaggtttcttcactatacaatattcttttctttccttttttcccccttaatgatgttttggtcagtccactacagagtaactcttttttccccctttctattctgtgttctttagaaggaagtcactttatgtagcccacacttaaggagtggggagttatgcttcacactccttacgggtgcctacataaattatttgagaatcttcacggaagatttgtctctcttccttatttatttatttaatcaatcatttatatgtaagtgtagattcatggatgtttactatgtactttggattataaaccagtactataattgttgccctgattgtttcagctttagctattgggagccctttaggttcctgtgtccctttgacatacccgcattcttgtattttttggattttcatttttgtttgtttgtttgttttgagacagagccttgctttgtcacccaggctggagtgcagtggcataatct

SEQ ID NO: 76881 - DNA, 1076 bp, Homo sapiens
gatcacgaggtcaggagaatgagaccatcctggccaacatggtgaaaccctgtctctactgaaaatacaaaaattagccaggcgtggtagtgtgcacctgtggtcccagctactcaggaggctgaggcaggagaatcgcttgaacctgggaagtggaggttgcagtgagccgagatcacgccactgcactccagcctgggcgacagagtgagactccgtctcaaaaaaaaaaaaaaaaaaaaggaataggatgcatgttgctcagtcatcgaaatgaaccatcctttttatcaataacgatcccatgaacccttacttatgccagactttttctgtagggagaaatatggccctttcagcgtgaatttaacgtgactgttgttcactgggttagaaacaggtcaataaatagatggttcagtacagaaggctaattggtacattgacatttaataatataaatcgaatttctttttgtattatatacaaagttcctagcttttaattataacttgacctttgcgtccttctccataaaagttaaaggatacattgcttcatttaaatctctcttattcagtaaacagttgtctacagccttccctgttttgaactgatctagagaagggggctgcttccagtttgaaattgctacaccatatctttatgctgacttctgaagactgagtctggtttctaggaaagtggaacaaatatataaaggtaacccagtaggggtgcagtgacttctatgctgtttcttgtgtgaattgctgactggtagtttgatcctgagccattgcccccatatgcatatagagcctggcagcctggacagtagagccctctgtgaaatcagccagctggccacagacctgaacttgggctcccaaacaagtctccgacttgagggaggttgatgtcatctgctttatcctgtgctcccaacctcattgttcaacataaaatgtgggaaatcaagggaatagttgttaagaaagaacaagactttgtttgtgctcataatgaaagggtcacgctggaggtttttaccgtaaataactttggaacagtat

SEQ ID NO: 76882 - DNA, 1071 bp, Homo sapiens
agccaccacacccagctaatttttgtattttagtagagatgacggttcaccatgttggccaggatggtcttgatctcttgacctcgtgatctgcccgcctcggcctcccaaagtgctgggattacagccgtaagccaccgcgcctggcctcgtttttactttttaaaagggtttcagatataataagaccataacttatgttaaagtagtggaacccagtagtgtggtaatacatgtaatttatttctactttatttgggagagacaaactattttcagggcaattaatctgtgacccatcattttattattctgtttgggtatcaaactctctacccaggaaaatagtgatggcatgattttagaagcttagatatagtgtttccggggtgggagatcatgcttccaactcttcagaggatgttcatggactcagggaatttcagcaatgaaagagaccttgctctcatctcgtgttgctgtctgatttgttcttatattttaaagcccttcagtggctcactattgcttattgatagtttaaatttctcaacatgctttgttgtgctcttcatgatctgtttctgagctatacgtgtggtcacttcccactttgcattctacatggagccaccctggacagtaccctgaactcacttattttctgaactgtttttgtttatgccttgacctacttactagactgttagtatcctcagggtaggaactattttcaggttcatcttttctagaatgccaagcatgttaccttgcttctagtaagtactctataaataacaggaactgtagtttagcatggccttatgggaattacattgaatttagggctgctgaaggcacctcaacagcaggactttaggccgggcttggtgggtcatgcctgtaaccctaactctttgggaggccgaggcgggtggatcacctgaggtcaggagttcaagaccagcctcagcaacatgctaaaatccagtctctactaaaaatacaaaaattagctgggcatggtggcgtgtgcctgtaatcccagctacccgggaggctgaggcagga

SEQ ID NO: 76883 - DNA, 2057 bp, Homo sapiens
gccggtgggcgggcccagcgaagggccttgtggctgtttcctattggggcttggttgctatggtgtcactcgcctttaaactcgtgggtacatctttcggaaattaaaggagaattacttccagggctgcccatacttgccatggccgactcagtagtcactaacttcaacaaaaataaaactgttgcaatagtattctattaaagcttctttaactgcttaaacttgcggttttgacatggtacctatcctttcttcccttttcaaaagattcgctatagagtctttctctacatgccagtctccaaaatggcgcggacggcatcagaaggtcagaggtgagtcacgtgggtccccccggttccggcgcggttgaggccttcggtggtgaacgagtctccagcaccatgtctggtttgtctggcccaccagcccggcgcggcccttttccgttagcgttgctgcttttgttcctgctcggccccagattggtccttgccatctccttccatctgcccattaactctcgcaagtgcctccgtgaggagattcacaaggacctgctagtgactggcgcgtacgagatctccgaccagtctgggggcgctggcggcctgcgcagccacctcaaggtgcggcattgggcgacgtggggccgggagggaagacggcaggcttaggcgaggggaggctcgggttcgggggagtcgggccggcggaggcctgggagttgttctggcctcccgggagcgcaaaggacgtgcggtggagcccgccccctcaccccgctggttgcctgtcgcggggcggggcgggtcaccaacgcctgggaaccccaagaagggctgcgaggctttggcggatgtggtgacacctgagctggggcggttgtcaacgtcctataccagttttggtctcagatacattgaaccgtaatttggttctccaaataaatgttggggtgttgaatatttatacggattggcatcataagataccgcgatacctgcaggaaagtaaaggagacagagctaaccgtgattaataaaatgttatttattgagcatctgctgtgtcagttactgtgctactttgcatatattaccatttggttcatgcactaccctatgaagtaggtaggtactgttagccccattttacaaatgaggaaactgagactcagaggtaggataaactagtaagtgtcacagatggaatagattcttttttttttttcaaaattattattatactttaagttctagggtacatgcgcacaactttcaggtttgttacatatgtatacatgtgccgtgttggtgtgctgcacccattaactcgtcatttacattaggtatgtctcctaatgctatccctcccacctccccccaccccacgacaggccccggtgtgtgatgttccccaccctgtgtccaagtgttctcattgttcaattcccacctatgagtgagaacatgcggtgtttggttttctgtccttgcgatggaatagattcttacttagtttggtagttaagtatgttgagggaaaagcgctgcaaccttattccttccttgttttaaatttgtaatttctgtagttgattaaagtcgattattggttacaaaatggtctcagtctctagtcctttttctttggtatgccagaatctggacttggctcttttatgtaaataccaactatgctcttggatggtgacaactactgccataataccagtttgattctgttttgtagctaagagtagcctggcctggtctttgagacattaatataatttgatatctgtcagtatttggttgcattttaggtaattttattcattcacaataagcaaagtgtctttttttttctttgtaacacaatggggcttttgttatactaaatagaaacatttttactttttttttttttttttttttttttgagacggagtcttgctctgtcgtccaggctggagtgctgtggcgcgatctcggctcactgcagcctctgcctcccggtttcaagcaattctcctgcctcagccttccgag

SEQ ID NO: 76884 - DNA, 1776 bp, Homo sapiens
ttctccagcatgggctcgcctgtcaacgcgcaggtaaggctggcttcccgtcgccgcggggccgggggcttggggtcgcggaggaggagacaccgggcgggacgctccagtagatgagtagggggctcccttgtgcctggagggaggctgccgtggccggagcggtgccggctcgggggctcgggacttgctctgagcgcacgcacgcttgccatagtaagaattggttcccccttcgggaggcaggttcgttctgagcaacctctggtctgcactccaggacggatctctgacattagctggagcagacgtgtcccaagcacaaactcgctaactagagcctggcttctccggggaggtggcagaaagcggcaatcccccctcccccggcagcctggagcacggaggagggatgagggaggagggtgcagcgggcgggtgtgtaaggcagtttcattgataaaaagcgagttcattctggagactccggagcggcgcctgcgtcagcgcagacgtcagggatatttataacaaaccccctttcaagcaagtgatgctgaagggataacgggaacgcagcggcaggatggaagagacaggcactgcgctgcggaatgcctgggaggaaaagggggagacctttcatccaggatgagggacatttaagatgaaatgtccgtggcaggatcgtttctcttcactgctgcatgcggcactgggaactcgccccacctgtgtccggaacctgctcgctcacgtcggctttccccttctgttttgttctaggacttctgcacggacctggccgtctccagtgccaacttcattcccacggtcactgccatctcgaccagtccggacctgcagtggctggtgcagcccgccctcgtctcctccgtggccccatcgcagaccagagcccctcaccctttcggagtccccgccccctccgctggggcttactccagggctggcgttgtgaagaccatgacaggaggccgagcgcagagcattggcaggaggggcaaggtggaacaggtgaggaactctagcgtactcttcctgggaatgtgggggctgggtgggaagcagccccggagatgcaggagcccagtacagaggatgaagccactgatggggctggctgcacatccgtaactgggagccctggctccaagcccattccatcccaactcagactctgagtctcaccctaagaagtactctcatagtttcttccctaagtttcttaccgcatgctttcagactgggctcttctttgttctcttgctgaggatcttattttaaatgcaagtcacacctagtctgcaactgcaggtcagaaatggtttcacagtggggtgccaggaagcagggaagctgcaggagccagttctactggggtgggtgaatggaggtgatggcagacacttttactgaatgtcggtctttttttgtgattattctagttatctccagaagaagaagagaaaaggagaatccgaagggaaaggaataagatggctgcagccaaatgccgcaaccggaggagggagctgactgatacactccaagcggtaggtactctgtgggttgctcctttttaaaacttaaggggaaagttggagattgagcataagggcccttgagtaagactgtgtcttatgctttcctttatccctctgtatacaggagacagaccaactagaagatgagaagtctgctttgcagaccgagattgccaacctgctgaaggagaaggaaaaactagagttc

SEQ ID NO: 76885 - DNA, 1299 bp, Homo sapiens
gagctggagcccctgtgcactccggtggtcacctgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgcgtgaaacacaccaggctgtgggcctcaaggacttgaaagcatccatgtgtggactcaagtccttacctcttccggagatgtagcaaaacgcatggagtgtgtattgttcccagtgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcgaccaaccttgtgctcttttcattctggaagtcttgtaagtttctgaaaggtattattggagaccagtttgtcaagaagggtagctgctggagggggacacaccctctgtctgatcccttatcaaagaggacaaggaaactatagagctgattttagaatattttacaaatacatgccttccattggaatgctaagattttctactgcttctggggacgggaaaccgctgtgtaacagcttttgtgggaatacattttttctgtttcagtactcgcagggggaaatatttaaattttgttgtgcta

SEQ ID NO: 76886 - DNA, 1876 bp, Homo sapiens
acttgagcaatcagagccagggttgagggcaagctacattcttttctgcctttctgctgcaggatgcagtttgctttttttccatgcgaatgaattatgtttgaaaccgaaatgggaggaagagaaaaatggagtgagtgtatatgggtatgtgtgtgtgcatacctatataggcaggggagggcagcaggcacattatttttccattttcctttaattaaggctctgtggaggtgtgtttgaaaacagagggtctcctatgcctttgaggagggtgagaacactgttttggctgcgtcccgggccatatgcagcgtatggtggccaatgaaaccgggcctggctcattctgttgcttgtcttggcagtcggttccgtggcttgtattaccagctctggaacttaggggctgccaagctccatgtgcctgtgtatgtgtgtgtgcgtgtgcatgtgtgtgcacatgcgttcttgtgtgtgtgtgtggtttggcctctcggaactcagcagagacaaatgccttagcgacccagtcttggaattttcagactgtgtttctttacttattgctggctgtgggaggcctggccagagcccaccattcttagttgttgttgttttttagtctgttttcttgctgcagcccacgggatttagttgcagagctccatttgcaaagcttcagctggccagtggcattttttaaaaaaaagaccagggcgattatcacaccttgtgtgtgtgtctgtattaggtgtggtagtgttaacccctgccagccaccaaggaccagagctggcgtgaagtagaagggaaaatagaaagcttgtccaatggttgtacgctcccagcttcctcttgctgcctgggttaaagattcctggcagagataacttcatatgtatttattgagcgcctacattaggcagaggacaaagcgatgttataggcaaggccttggaagcatttctctggtctccagggaagagcaggagttccctgggggttggttccaggttcttctatggctgggatggctgtgcagggatcacggctgccagtgttcagtggcttctcttgaacccagctaccgctccttgtcttcttatgaagcagtgcagggatggagtagagggcacaggagatgctggctgtctgccttggggcagaaatggaaacctagttcttgatggcaccttgttgccagtgtctgtgcagctgtgttctggcctgcagggtggaggagaccttagaggaaaccgaggccgagggcaggtgctgggccccatttctgcaccttctacccagccctgacctggcaccctttgtttctgttctgcagtcaactgccaggatgcaagatggtcctgcccccttggggtttagagctggaaagtgggagagcggagaatcctctggggagaatcctcttcatggctgcaggaaacagagactagtccagaagggaccttgaggggtcatctggcactagtgcccctccaggaaggaaggccctggtggccacactgacttcactcttactatgtgcaggcactgttccaggtactttccaagtattaactaatttaatcctcttgacagccatacagggcaaataacattgttattctttacagctgaggaaagagaggcacagagaggttagggaacttgcccaagggcacacagctagtaagaagggacagagctaggattcacactcaggtgatctggctccaaaaccgccactcttaacccccccttcctcttggcctgcagagctggggacagccatctgaagagggccttttgctgctcgccttcactctcagtcttggggccttccccatcatcttgcttctcgccttctggatct

SEQ ID NO: 76887 - DNA, 3351 bp, Homo sapiens
agtgtgggagatgatttcacctcttgtcatctttcctaagtcttccttgaagtgggtaagttccttctggctgttactggttccttggtgctgccacctccactgccccccactcccccttttttatagatccctaaatcacatcaaattgttttatttttcaaatcactaaagttgcctttctgccttagatcgtcagccagctctttgcagttaatgaggatccaattatgaaaggcagctgctcagctcctccatcttctatcccccacccccagaaatgtttaggatgacttctggctggtgaatatcagctgttgtggttgtctcctaggaatggcatggctgagggctttgtggtttatatctgagcagttaggggctcttttgcagggggaggaaagacagggggacttttgcttctacaaaggaaagactagtgccttgtctcctgggtgaggcttgtcattgggatggattcacaggcgagcagaaatggcaaaatttatggggcccgtgctcccagggggtggccgctccttcagggggttccacagtagcagaaaatgcattatattttgggatcatttgttagtgtctcatttctaccatctgtatgagaataaacagaagctgcaaacagagcctatcattcccggaacagaatggggtctggcttccatctcccagagatggaaggcttaggcagggaaatacacagaagcctctggagtgtttttcttggggtctactgtgggaatgaataacttggaggtgaaattacagcctgataacgagcatctaagcttccagagatggattcttacaccatttgctgaattttgctctgctgtgaatttgctgtcatttgttcattcatttattcacttagttattatttcaacaagtattattgatgatgctttctgcgccagaaatgatgctaagcactggggtcacccgggcaacaaccagccctgactgctgcttaccacctggaatcacagcgctgctggccgcgtggccacatggtttgttcccggcacagttttgctacaaggaataggtcttcctgctggccccttccctgttctccttagaggaggccaggggagacgtgcagctcatctacagggccctggagcggcctcctagcgtggcaggctgcagccctctctgcattgcaggttccattccagagggctgagagggagctctcttactgccactaggctccagtccagctcagagtttgggggatcagagaacattgaacacccacatgcgagaggtctcaggggctatttctgtgtctgggctcccatgcaggctaccgtggagttattcagggaacttcctaaacctggatctccatggggggtggagggtcctctgtgcaagacaatgaccctctactgtgggctggtgtctgaaagcccaccgtgagaaagtcattccttctgctgaaggcgtcgttacctattggaccccagaaagggaaacaaagaaggaagggtgagaaagctttggtctagaaccctgggaccaggagtcgagccctggctccaatcctctccagctgtgtgaccttggggaggccatttagcctctctgagctttagtttcctcctgtcaaaatgaggatgtggtttagatgagcacagggcctccttcagctctaaaactgtaactcaatgtgattgagcctcagatctttttctgatggcccaggggacacggggtgaaggaaggagagaaaggatgtgagtgggaaggagtgctaagaggaccgggtatgggaggcacagtaggtagagcacagttagaggagcctgaggacaccaaataaaaactctggggcaagccagggagctatgggcagaggctttatgacagatgcagcaggcatgctgaggatgaaatggcgggtccacttcccattcccaggcacctcgctttagacaccttgctttagacaaagtgatggccagtggaaacctttgtgcttgagggtgcaagttactcacatgctttttctcttagagaaatagaacttattgggaaatagactctggacttggacagggaaccaaatttcaccttcaaaagtgaaatgtagatggagaatatggcttgcactcttggccaaaacaggttcacaaatgcccctctctggaatgatctagacctgggaagctgaatgggggcaggtggttgtgggtcaccctccaaggccactcctgcaggagacagagagcccaagaaccatgtggccatctgagtacattaactgcccaacggagaagtattgtccgatggacatcagatcttccctcttctgccaaatacatctctctccatgggaagagacaggtaaagatggaaggataggccaaagattttccctcaggagtgctaagccagcgaatattttgattttatggccctgggcagaaaggtgaaaagagggagaaatgatttcctttccaggactagaatctaagagcagttttgtactaacatgctacttaaaaggctgcttcaaagctaagactgcacatctgacctccatattcctagtgcctgctggcctatagtaggtggtcagtaactggatggatgggtaggtaggaggagccctttaagggactggctttattggcagaccagctttcttcactgccatctgtgccttgaaatgaccatttcttacccatgagcttcccccagtaaagggaaggaagaattcccttggtgttgacctgtctaatttacatccttcttccatgtctgaatctgtcttcccttgtacacctttttggttgggcagagctggaatatgtgtttgctctgagaatgaagagaacatggaggtagccgggcgcagtggctcacgcctataatcccagcactttgggaggccaaggtgggcagatcatttgaagccaggagttcaacaccagcctggctaacatgatgaactcctgtatctactaaaaatacaaaaattagctgggcgtggtggcaggtgcctgtaattccagctactcgtgaggctgagacaggagaattgcttgaacccaggaggcggaggttgcagtgagctgagatcgtgccactgcactccagcctgggcaaaaaaaaaaaaaaaaaaaagcatggaggagttttctggtactgggttccacagggaaagcacatgctaattaattccacctgctttgcctcagtcccttcctcatagatagcacacacactcacctttaacttagatttgcttcatctcctactcagggtgtcttaacaaatatgcagaataggatgtgtgattggaggggaggcaccatgcca

SEQ ID NO: 76888 - DNA, 1067 bp, Homo sapiens
ggccatctctctggggtggtgggaggattggggagataatgggaatgggaatgtgtacatgttttgaaaagtagacaagagaatgccaatattaggttatcttttaaaattgttatcattagtcacatcgtgacctccacccctcttggccctttctgcagctgaaccagggaacttggaggaagagtagcgtggcctcccttcccaagcagctgccagagctaggcatggcctcggtcagccagcagtgtccgccttagatggcgtttgcccgggacccacacgtggagcacccacatgtggcatttgcaaggaattcctcctcaggtcccttgcacctgcagctctcatgagccctttttctcggggcactggtgagcagcagcagtccccggcatggctgaggatctgtgcagggcatgcccccggcgacttgcccagggctggccgtttctctgaaggcctgtcccagcaaggttcccagcagcgccgtttcttcagaggcctgccagagtagctgccccctggaaaggaggagcctgtggtgggaggtggggaagaggctgggatcgggagggcgcaggaagcagctgagcatctgggaatggtagctctgcttggagggagagttcacaggcaaagatgagcctggggggagctcggagggctgaagtgctggaagtgctggagagaggactttcttcgtggagaagggtgtctgggtacccgtaggggagagctggggatattaggcaactatctctcagctccccttctcctgataggtacctaaaaactgcagaggactgctgggggcttggctgtggtggcaaactggccgtggtggcaaactggccatttgcaggctggacctggctctcagatgtattttgtttggccggctcagtgttttaaaagaaacgcgaacccccatttcatttgaaaattttgattaaaaaattgtaagatctcatcatacactaccctgttctggcatggtaatggctaagtggggtggacagaggcacttcactgtttcctctttccagtgggccacaggcccctgc

SEQ ID NO: 76889 - DNA, 1080 bp, Homo sapiens
tggagtccaggttacccccatagtagagaagagtttgaggtctagggagggggttcagtcactcagggtcacactgctgggaagtgatagcgctggggcctggtgtggtggacgatggctgccgttacagccgggtctcacttgtgctgagctaagccctaggcacggtactaggtctctttgtgaagtaccttgtttaccctgcacaagtaccctctgaagtaactagtgttgttgctgttgttatacccacattacagatgaggtcaacaaggctgagggaggtccaaggtcactggctgggaaatgagctcaggcagtctgccttgagcccaagctttaaccacatgccgtgtggcctcccatgcctctataccccttccaggcttctaaccagagctctgttgagctggggaggctggatgaacctggccgcagaatgttcgatcattttgatgacattgtctgatgagtgctgagccctgcagtcctgcagccttactgtctcctagttccgagagagagagagagggagagagagagagagagcgagagagcgagccggctgagccgctgtgcgggcagctctgtcagagctggttcttgggttgtttgccttgcagaggccagcagtctcctgggctctgtccaaacgcatggagcaattcagtaaaagaaaatgggaggaattaagttcaacgacaggttttgtgaattataaagtgctttgtgctgatgtcattattattacatggtcaacacatgacgttaaactgttttggtgccaactgcttgcctgcagtccctttgttcaagccatatttgttaagcatctactatgtgctgagcactgcaccaggcactgggaacagagctacagataaagcagtcaaagccttacatctctcggcaccgtatattgcagtgacggcatccaaaagtaagcaaattaatacacgatatataaggtgagttagtggtcagcaccacgaagaaaaattaagcagaccaaggacgtggcagtggtaggactgctcattctgatggttggccagggaccctgggaacgtcatttcctgg

SEQ ID NO: 76890 - DNA, 1017 bp, Homo sapiens
ctgagcagaaaaagttgccccaaaccagctgatgtgctgggtaaatgttggcctaagcatgcttgtgtttttagtgatttgaaacgtaaaggcagcccactgacattttttagcaagctttgcataattggtttttaattgtggctctttggaatagcattggccttcttccccctgactcagatgctttttttgtctcatacttgtttggcagagaggtccaatctgtcctctcttggaacagaatctcccaactcatctttgaaatccgtaatttccactttagttccgttactttgttagcacattttcgaaagctgttagcttaaaaaaaaaaattaaatttgagggagaatgagtgatagttaaaggcagctatgagtgtgtttaacattggcccctgtggtgttgagtcttatttgataccatatccagagcattcacaagggttctgaagcttttatttaaaatcagaagtcggtcacacccactgttatcctagcacagggtcccttggagaggtggtggtgaggacgtggctggatctctatgtccttagcagaaatcagacacctctgaaaagctcaggaagtcttacagcttcttaggttttctattaatatcttaaagtgaggataataataatacctacctcttagtgttgttatgaatttttttttttgagacagattctcactctgttgcccaggctggagtgcaatggcatgatcttggctcactgcagccttgacctcttgagctcaagaaatcctctcacctcagcctcctgagtagctgggactacaggcacatgtcaccatgcctggctaatttttgtattttttgtagagatgggggttttgccatgttgcccaggctgtttttggactcctgggctcaagcgatcctcccatcttggcctcccaaagtgctgggattacaggcgtgagccaccaacccctgttgctgctatgataatgaaatgaactaatgctgctaaaggtttcacatgatgcc

SEQ ID NO: 76891 - DNA, 1050 bp, Homo sapiens
gtaggcttgtgactcacttttcaaatgtgttgatcgtgcaaagtagtttttataattgaatcaaaaacctgtttcttgggcttgtattgacctgagggtattttgtcctcggagatggtgggtggtctgaggcgttgcaggagcagggcacatccaggcttcctaaccagaggggctacttctggggcctgggaagagttctgggcttgggtgcaagttctgggttcaaagtctggctctctcgctcattcccagcacaaccttgggaaagttagctcgtttcctcatctgtaacaggagaaaatccaaactgccctttccaaagtagtacagtttcctgcacatactgcacatggtgactggatccacatcctcatcacagagcttcatcgcgaagattaagtgaggtgctgtgtgaaagatgaccttgactgcagtgcagtatgtccgtaaattacctttgttagagactgattccatgtgtagtgaactacctattctgacagcactaacctttctgaagtattagcctatgacctgggtttcagggaagcaagcagactttccagtttctggttgtttatgcagtttagacgcagctggagttttaattatcataacaaactataaatgagaaggcttttcaagcctctgttttcccctaagctgccttctgtgaccccttatcttgtttcctgtggtgttaatgtcatcgttgtattcccatcaaccaacaatcttttagcagccttaagaagggctgtcaagtcttctgtcaatcctaccatcttactttgatgtttccaggtccaccggcaacatggactcagagttgggaaactgagtcctctcctgggtgaggctcatctggctgaacaactatgaagccatttaagtctgttttccttctactgtgcccaaaaggcacaaggcaacctggcctgaggttggagcatggagatctagaggaactcatggatggattcaggcgggatgtgaaagtgctgggagtgagggcctgggcctcctctgggtttagccacccttcca

SEQ ID NO: 76892 - DNA, 1505 bp, Homo sapiens
aaacagagttcccatgcgatccagccatttcactcctacatatatttcctttcccaacagaaaggaaaacatgtccacacaaaaacatacatgagagtttacagtggcattattcataatagctccaaagtggaagcagctcaaatgtccatgaattggtgcatgaataaataaaacatggtctatccatacaatggattattatttagccataaaaaggaatgaagaactgatacatgctgtaatatggatgaaccttggaaacattatgctgggtaaaagaagccagccacaagagaccacagagtgtgtgggtccatttagatgaaatgtccagaataggcaaattcatagagacaggaagtagagccagtactgtggttacctaggggtggggagatgggaggagtggggagtgatggccaagggatatgaggtttcttttgggggtgatgaaagtgttctaaaattgtagtgatagttgcacaactctggatataatacaagttggtgaattgtatactttaatggacaaattgtatggtatgtgtgagtttgatctcaataaagtgcttttaaaaatggagaataataatatctgccttacagggttgtggggaggctgaaaaggaataatgtatacaaatcccccagtatgtaacaatgttccagaattagtagctagggttattaaaacccccttttagaccagcggcagtgaagaagccttttttcctttttattgctagtatctatccaggagcaaggagaacaatctgataggatttaatatagaactagggaggatatatggtatagaatagcagtttctaactctgactactgattagaattccccggaaagtctttcaaaaatattgatcctgattcagctggtctgagtggggctggcaggtgttctaacctgtagccattagctgaaaacctggtaatccagttaagaaaccagcccagttctttgaaggagcgaggacatctgtgttcaggtcagaagtcatacacaagcaatgcactttatagtttgcaaacttcttttgtagacgtcatctctgatctgttccaacaaccctatgaggtggtgttagtagtatgagttgttagagagctgacgctcagaagattaagtcacttgccagggtctcattttttaaagcataattttatctattattaaaaaaaggcaagatccacacacatgctcatacctattagttatcagacctaacaccttggagagcactgccaaggtgacagctggtgccaggttaatctattttacatagacttcagcacaaagctcttcctgctacttcgcattaactgatgagcatcctgagagtggaaagcaagctgatgaggcactatctattatctgtctatgttttttattttttttgagttggagtctcactattgcccaggctggagtgcagtggcgtgatctcggctcactgcaacctctgcctctggggttcaagtgattc

SEQ ID NO: 76893 - DNA, 1009 bp, Homo sapiens
gagaatggttaaaggatctaaaaccacatttttctcaacacctatctcaagcttcctagatggatccacctgccattggatactcattaatgcttatggttccccgaatctgtgtaaggcaggggttgctttctgaatcagcaaataccttagcgtttccaaaccagttatttccatgtcttgagatgctcaacattgccacgtccacgccctaagggacttcccaattaattacgctgccgagcttgtcaataggctggttccttcattgttttagaaggaagaatcagagaagctgttctcatgccaaaggaaccctcatttgctgccactgacccagagttctcagcagttctggtctgataactgaggatccactccatagccctggcaatggggagctctgtgtcccactctatctgcctcagtgtggcaaagcccttccataccttctctctgcacctaaattgcatccatctccttaaataaatcactcttggtaaaacccctcttccatcctccgggccagatatccctggctgtgaacggtttggccctttcacctcggtagggtttatattagctggtgttcagtattcttgatggggaggttgcctttgccgggagatttgtctgttatctgtgccttgtgcttgaaagaaattggatgaaatgcatgttttagccacacaccctgcatacagattaaatggaactgccttggtagagaataattaagccaaggaccttgtttttcaccttcatgatgaaagacaaatgacttccaaaggctttaataagatggaacttgaaatgttctcctactttggccagcttgggactttcagaacagccttgttcataaatattctgtgcaacgactgcattttcatttaattgtagatagagtcattttgcaggagctcttgtctccatttttgacccagtgtaatcaaggcatattacaccatttgttgttgttaaagagtcagtttcagctgtattatta

SEQ ID NO: 76894 - DNA, 1045 bp, Homo sapiens
ttggcatttattcgagggccagcaaagtttcagaccagtggttctcaactaggactgatttttgcctcccaggagacatttggcaatgtctgcagacatttttgattgtcacaactcagagggagctgtgctaccagcatctagcaggtagatgccagagatgctctaaacacccttcaatgcacaggccagccccacaagtatttagtccaaaatggcgatagcgtaagagattgagcaacttgtatcagtcaaagagcaagcagtagttgcaactgcgtatgtgacaaccagagggcccgtaagcccataagcctgccagtcctcctggcagggtacaggtggagcggcctccccagggggtccccagaaccctcagtgggcccaaccctctccctccaggggtcccgtcttcctcccacagctggtctgaccgaactgttccttggctcatctctgaggtggcagcatgagtgcccgggaactctgagacgggcaggcctcgtgaccagacgctgagagaaaacagcctcactaaaggaaaaaaaaatgctcggggaaaatattaaaaaccagctctggtggtttttggttccacaggctgggacgtgactgggaagctggcctggtcctctgttctgagaattccaagagaggcgcatctcggagggccaggagagacccctcgtgaatccatggaagcctgtgagccctcgggctggggcagttaggtgccaatgtcagccccctgctcactggtgactctctggtgaccttgggaacttctcacaaaccctctgaccatcacggtctccccagcccaagggcttagttccatcttcaaactctcctgagcccctgcctcaaggggtgtcagggtaacccacccatctgtgagtgtttgctgaggccctgctatgtacagtgaatgccctggggaatccaagagccatgagcccccaactggctcttgtggcctttccactgtaaggggaagaagcaatctgtgcaacaaggcagagcttactactgtgtgaccaacagc

SEQ ID NO: 76895 - DNA, 1049 bp, Homo sapiens
attctcacgaaggagaagtgctccgttctgcagtgagcctggccaggggggccacaccacagactcccaggaggcttctgctctgcgtggttcttctgctctcgtttccttaacgattgggccagagcatctctgctcttgtaaaatagcaggcaattagatctcgaagtctttgaagtgggcagattcaccaggcgttggactgaagtttctatttgtcctggcactgagaatagcaaaggaacagggggactgaactggtaaggatatagcaggtttgttgcacttttaaaaaatatgttttcaattaccttaagaacccatttatgtgcagtatatcctgctgctgattttgaacaaggatgatccaataggcactggtattaaaacgctgaaatagaggttgacaagtagctgcttccctaaatccttggagtttccttcctccctccttcccctcctttggcaccaacccccttcccacctccccaagatccagcaactaaaaggttatttgcttggcacggcagggagtaggggctgtgctgaatggtgggaacccacgctacatgggttgtcagctgtgtcacccctaattagacatcatttcaatctactcatgaaagcagcttgctgcaggactctgtgctggccatatttaattagagcagtataaggttttttttttttaagttaaaaactcatattgtattgcccatgtaccagagactattctaagaactttacaaacattaactcatttgatccttataacgaccctatgatattggtggtgtgatatcctcccgttttctaggtatggaaagaggcatagagaggtgaagtctcttgctgatatcttctagaccgggctggctgcagggtctgttgctctcaaccagaggaaatagaaccatgaaagaacaaggtagggttttcctccttctgccaaactgagattcacaaagtggactctagcattcttcctctctgccattccctcccaccaaatttacacctggggaaacagtggcccagagagggaagga

SEQ ID NO: 76896 - DNA, 1109 bp, Homo sapiens
ttgaaacaccacaaagttggtactatttaggcaagtctgcacactccagtccataattctgttgctataaatactgctctctaccccttggccagcatcatttagatgtttgcttatacctgctagtgaataactgatctagcaacatggagaataaacaagggctccaagacctcaagtggaggagaccaggctagagtgaaggcactctgccaggcaagctaccttgggacatgtagtcgaggtttggcagggggtcttgggactgagtctgcggatgccccagaaagaagcaaggagagtccaaggtggctgctggggctgagagacactgcaaaactaagaacccagagcttgagcttaatcatgagaatgagccccgagcacccaggaatgccaggcggctccacggtaaccgataatgtccaggcaaagaccgctcatatgactgttatttgtgaaatctccaaatccaaggcttcttttgaaaaggtcaactcgggatcaaggaggtagcaggccttcaaagacaaagacaatctaaacaacctcattgatttggtggaaaatcactcaggaagggggtttatggatttaaaggctaagctaagatctctaagaacttagggagtagggttacagctggccaactccagacttccttcaagctcccgcccccgtcacagggtttgtcctgaaagctgtgattatgctggtggcttttactgccctgactcctggattccctcagttctttgggtgaaagaggttagagaaatgcaggaagcagcagctactgaaattaggatagcctacaatcattgatccctagggaagataataatagcgatgagagctgatacactgtgctcaaagcaccctataaatatatatactctttgaatcattttattttttaattattaatttttttcttttggggggcaacacttcactccataaaatagaaggcgtgctcccctaatgtctattttaaagtggaggaaattggcatttaagtagcttgcccaaggtcacataacagtaagcgatgaggctaaacttcaagctctggccatcagtactcatctgtactcttatccattagg

SEQ ID NO: 76897 - DNA, 1086 bp, Homo sapiens
cacgatcagaatcacctgggaggcttattcaaatgcaaattgccgggggcctcactcccagagtttctgctgcagtaggtctggggtggaacagagaccacactttggaaactatttcactaaaccattgagccccagaaaaaccactcagcttcagcagtatgggccaacctgttcaggactctgttccccaggtctttatcaggaccagtgagcactggtgtattttttttgctcccagtccttctggataatttcctttctttttctgtggattctgccatccttggctcatcccagttagcaaagcagctgttcccctgaagctaagcctgagttggaacattccttgccctttgcagtatcaggctagggcaggcaagaggcttagagaggagcgggaggaatgaatgggaagacgggaggagactattttctttcttctccttcccacgctccacctcacttggcttttcaggaatgtctccttacgggatctcttcactcggaaatggactttctaagtggctgagtatgtactatgaagggcagatgggaatgctgcttgaatgagatgttgctgagagcctcatgatcattgcaaccatcagcctgtcagttgtagtgatgtttggggacatgtctgggttggttggcccactgtggctcactgtgctgctcactgtgtgcacagttggcccactgtgctgctcaggagactgcattgagcccaaccttgtagcatccctggggtgaactgctgggagaggctgggacatgaggaaattgttcatgacctgagctgggaaaatctgattcaataatcagctttgtgaggatgtaaagcagagtgattaagatcaagaaatctggagccacagggcctgagttcaaatccagctccatcacttaatacctgtgtgattgcaaagcaaattatttcccattttgcaagataatttgaccttcgcttaactttgtatcttttactccctgggaacctgataaagggagtacgtcaactacctttaggcaacattgcttatgataaaaatgtcctctggtgatacaaatggacagagagac

SEQ ID NO: 76898 - DNA, 1048 bp, Homo sapiens
ggaaataaggaggactctaagctcctccttccaggtcccagagagccacggagatcctgctcaatatccaggaagttcccactcccagcacagggcctgtgtacccaggacatagtctctcagctgaaggttgaacacaccaggcatccttgccccttctgtaaatgctgactggctgtcactgatggcaagatggagaagcagcaagggatcccagaggcctgctgagcacaaggtctccctgtgaacttcttcctggccttcaggggtgcccgtctccttggtatgatcacatagaggatgcccagatcattagagggcctagtatgtcttggtgggaagaaacaaaacagcaaagggagtcctaggggaggaggtgggctccccatccttcttgttctggaagttcttcatccccttgtttctctggtctggtcttcagcttctttatgactggctatctcccactgggatttgagtttgctgtggagctcacgtacccagaatcagaaggcatctcctccggcctcctcaacatatctgcacaggtagagctcgtatttcctgtttgtttcctggctgggaaggcattgcatcatggcagctcagttcttcctcatgagttagttgactgggcccttgtttcctatcttctttatgcctttccaggtatttgggatcatctttaccatctcccagggccagattattgacaactatggaaccaagcctgggaacatcttcctgtgtgtgttccttactcttggagcagccctcactggtgagttggagcctgagggcaagatgaggctcaggttggccatttgggaccctagtgtctcgatggagcaacagatagggagtacgtacgtagggggacagatggaagggtttgttggggaatctgttgggaggcagcacattgttttggtagaatgagcatgggttttggagccagaagactcatgttggaatcccagactgtgacaatgacttccatagctattgaccttggataagtggaccaacctctgggaacctcagtttt

SEQ ID NO: 76899 - DNA, 1017 bp, Homo sapiens
caacacagcaaatcttatgtcacttgacataatacgtcacgttccaaactgaaacctttcactaggctatacatatatttacccaagtgtaccaaatcatttctctctctctctttttttttttttcgagatggagtcttgctctgtcacccaggctggagtgcaatggcatgatctcagcttaccgcaacctccacctcccgagtagctgggattacaagcgtgcgacactagcctggctaatttttgtatttttagtagagataggatttcaccatgttggccaggctggtctcaaactcctgatctgcccaccttggcctcccaaagtactgggattacaggcatgagccatcgcgcccggccagtgtaccaaatcattatgtccccttgtacacagtgtgggtgaaaaatccatctccacagtggccatactatggccctgacacagaattaaagaatgtcattcctgctgaaaggccttccctgtctccccagtgaatttcctgttctaggctccttcttccacatgcttttctgctgctgcctgccaactctagaacgtaatagcaaaagacaaatagtaaagacctaaagattatcatctatctgccaacacagatccttcaaacactaaaaatatcccttacagatatctcttgccttagaaaattggcgaagatttttcaaaatgaaaaatactcagtgttggcgctcatatgactgcctagcaatagaaattgctagtactcaaagtacctttctagaggacagtttagcaacacataccaaagtctttgaaatgggcatgaccattattccatttctccaggaaatatggtacttgagaacatgcacaaagattcagcttccaacatattaatcacaatattatttgtaacaattcaaaacaaccttaatgtccacagacaggaaaattgctaaataaatcatggcttatccgtataaaggaacactatgcaggcattaaaagtatgttgtaggccaggtacagtg

SEQ ID NO: 76900 - DNA, 1180 bp, Homo sapiens
atctcctgggtcatcggactgattgctcaagttctgcaggagaggaagcaccattagaacaactccatcagaacagctccaccgggacttgtgggcctaaattttcctggcctaacgggtctgtctccaaaccctctttcctaagagctgagcaaaccaaccataataaacttgacaaaagactttgttgtggccatgacagagataccgactcaggagggctacctacctaggtgtgatcatgctgggggctaccttctgagtatatttgtgaaagcacatatttgggaactctggtagcttgagttgggaatgggaaggttcttttttacagaagtacttccccagggacttctgtgtgtcacagtcacctctgatgcctttatcttgatgttgcattgggaatctcagccatcagcccaagtgcttgttttattccaaggcagggtaatccccgtcaacttactctaacctttgctgaaaactaatcttgattcattctactctgaaaatccaaaggtgcttctgagagataagagggaaggggtagaaggaaaggtgccccttgaaatgggaattgagcctgttagaattaaaagcttatctcacctctgctggggacagtatttgcaccaccaacccctctcctcacctgctttgagcgataatctttatcagatattctaaacttaaagggattccctttaaaccaactcaagctgatctttcctatctagcctgctgtttggctgtactcatgggctttggtaatatctcctaaaaatgaggttttggtaatttttcctatgcattgggcaactgtgatcgtgaccactgtgctgtcttgctccagccactgccctggcctcagcatatcagggcagcctgtgctggctgcaatactgtggtgcttgggccactgcctgagaggagccaggtttgtgtgtgtctgcatgtgtgtgtgtgtgtgtttgtacagattcaagcaatggatgcaaggaacatgctgtatgtaatagaagaaagaagtccacgttttcggcagaagtagtgagtcagtgtggaagagaggtgagggtgtgctttactttttgataaagagaaagatgtttactcataaacccttcaaaaggtattaacaaaatgtttaccaaacctattgctttattttaaaaacata

SEQ ID NO: 76901 - DNA, 1862 bp, Homo sapiens
ctcagtttagcagttgaaaccttcagttttgccctagatgagaatatcgttgtgatcaaataaccagctcttcctcaggaacaagtgtcctttcttttaagtcttaatgacatcctgggttcttatttgtctgtatgaagtctgatacttttcctctgttctgaacaaacagtaactttggttcccatttctgtctgcttccttataggctctatcacatcacactctggaccttcctccttgccctggggcatttcctctctgagttgtttgtctatggaactgcagctcccacgattggcgtcctggcacccctgatggtggcaagtaagcatccaaccaccctagacctcctacaggagctgtgccagctctagagctagtacagagggtggacacaggagagagagagaagaaaggtaccgtatgtatgttagtcactagtctttcctctgtatttaaggtttctccatcctgggtatgctggtcgggctccggtatctagaagtagaaccagtatccagacagaagaagagaaactgaggccagcattatcacctccaggactttctcgttttccaccttggccatcttcttccttcgtcgtctctcctctttaatttcttttctattccatcatctgcccttttattcacttttagcctctttttttaatttttaaaatttaaagatatgcatactgaaaagtatataacatgtacgtacaatttaaagaataattttaaagtgaatactacgtaactccatccaagtcaagaaattgccagcttctcggaagcccactgtgtctccttcccctacctgcaacctcttccaggctcccttttccagccttcccctttttcccttttattttcatgccttgatttgacttgtgtggtgggaacatgtgaactatgaaacttaaacctgctgcccacccagagcagctgtgaccaagggctgcctcaaggggttgtccacgcaggttgggctcctctctgctgctggacccaagactctgaaccttccaagggacaggcagttcttctaagaagggctcccctgtgtgtgagcaagaccacagctctccttctatctacagatgcatgagggttggaagagtctgggctgtttttagaccttctggtcagctgtatttgtgtaacaacttttgtaataaatagaaaaaccctctgctctgatcagttcttgtactttgacctctgctaagacaagagcatggctgcctcctctgagccctaggagaatcacagctttatgcctgattgaatacaccatagtgagtaggacagctcatgacacaggtcagcctggctgcctccggctccttactgtcatttgctcattcctcttgtattcttgaagtcaaatcttcttttttctcaccttcaagagtctgcgttcacaactaaacactaagtgccctttcttatttcctcctaaagaagaaacagattcttgagagagcagagacaaaaaaatagaactaggcagcatagatgaaacaactgcatgacatgggaagaagacaactaaaccccgaggagaatgcactggaatggacagttgctcttaaaccctacccagagggcctcccccagctggaccctcatacacagtgtgtgtatccaaaaggccattgctatttcagcaaatatttgttgagtacttctccatgccggacacttgggaaagagaaatgaacgacacaggcaatgcccctgccctgtgggccttatattatagtcaaggtaacagaatcaacaagccaacacaaaaataaagaacttcaaatagggataagaactctaacaaacacaaggtattttggtcaagaa

SEQ ID NO: 76902 - DNA, 1536 bp, Homo sapiens
cactcacatatcttaaagaccatatatgggcatctaaattggtccccagtatctctgagttctctcctggatcagccttgaaagtctgctggcctcctgggcatcttgcatttccagatcagtctctacaacgttccccaaaacctgtcctgatccagaccctctaggcttccaggacaaaaggggtaaattactatatctaggagttatttgcctaactgggctctttgtgggtttccactcttggaacttcccttccaactgtagacatttgaagagaatctgagaagttctcattctggaattccttctattccttctagttcccatgttgccactaggacctccatcctgcccagccacagagaggtcaggtccagctccctatctcccatgaaccaccagtgaaataggaggagtttggaaggaacctcaagtctccccttctgaacactcttgcttttttctgctacacagtgaatggcctccaagctcggacctttgggatctggacgctgctctcatcagtgattcgctgcctctgtgccattgacattcacaacaagacgtatgtaagggaaggaagagctttagcatccttttgttggaaatcagatgcgaggcatacctgttaccttgagtaatgggaactgttaatcattttaatgcattagcttagaatgtgaataataaaaaactcacaggttacattccctccaagcctagaaaacatagtagacctaacaggtcttcattaaagtctgaaaattctttggaactgacatagcaaactggcaggccattatccagtggcctgcatcatgcccctccacttctttatgaaagaatcagcccttcttctactaaagaagtagagtggtatgctctttttagagtagccacccacacatacctttctcacattcctccttaagaagcaggaatgaacagaaatcacaatccatgaaaaaagaggaacccacaagtaaactgttgtatgtgtatgcagcatcagcaggtgagggtgaaagagaagctagggctcctgaatctacctgtcttgggtactcaaacagaccagggtggaacaattgcaggcaatcagaagccataaccagtgctggccactagagggggctcgagctttcttcccagcgggagtcatcatcacactctaggtggaaacagtttgttcaggtcaccgagggaggctatctgaatgccaacttcacattaaaatgtttttctgtcttatccaggctcttggcatctggggaaaacaggaggcgataatatttattgagcccctcttattatgctgagcttttatctacgtgatcttgattaagtcttttcttagcagccctggaggtcatgattttcattcctgattttgcacatctaaatattagagatacagttagtttaaagaaagactgactcaagtgagatttgaagcagggctattagccgtttgatctcttcaaccttatttttttttttaattttttttcaaacttgaacctgcagtttact

SEQ ID NO: 76903 - DNA, 1040 bp, Homo sapiens
tttaatgctggtaagttgctgtctctaaacctgaaaacacaacgaatataacagggcatgtcagacctcccatcttgtcatggccaggagctcagttttaggatttttctggggtcccctaggccaagaggggctctgttcagtccgtgatgggcttaggattttatttggagttgacacacagcagtttatttttaacttttagattgttcttctagtttatggagcatggtatacctgagaaccagagtccagaaaacctagggatgtaaatagtgacctcacaccataagtcctactcaaatttataaagttccatacacttggaagaatccgtcatcaatagccaggcaggtgtctgtgagtatagttataatcgcctttgagctatttgcattacgaaggaatggcatgaaaacatgaaggtatagaagtaaagatagaggactgattccaacccagaaaaaggagttctgatttagggtaatattttggagaaattgcttagacaaggataagtactgtgccacttattgcaaagtatactgttcattcaccactattagtgtgactgaatttctttttttggcctgcttcattcttcctcccttcctgcttatggttaacatagactggccctcattgtctcatgtcctctgcctttgtttccaaggcaaaaagccctcccacgtttgaggggagtcatgagccgtttcctgaatgtgttaagaagttggctggttatggtgtccatcatagccatggggaacacgctgcagagcttccgagaccacacttttctctatgaaaagctctacactggcaagccaaaccttggtaagaaatcaaagaatttctgcatcctttataggacttataggactggccctatgctgtggttcccaaaccaggctgtacatcagagtaacctaggaaacgtcaacaaacacaggtacccatttccctcaccaaacctatttattgaacctgggtggagctcaggaatccagttgctaaaacacttcccagatgattctgat

SEQ ID NO: 76904 - DNA, 1683 bp, Homo sapiens
catgagccaccgcacttgtccgtgagggaagttctgataccagtttgtatcctgtcttgttgctgttttatttctggcacttaacatggcgccttattgttgaattaatggacaaaagaattttaatggatgaatgggtgaattctaagtcggtttgctactataaggtttatctctgatcagcacttcatactcagtttctgcaaggataaggaaagcctgagaaagaaatgcaagaatattaagagacatcatgggtttctatagaagggttaatttattttagtttctgcatcggggatttgcccaaccctcccattccttgaacttgttctgtgatacactgcttttgtctcactaggctcacgtactaattgggccaccccggtgagtacactgtggatgaaaaaatcactgtggctttttctgccattgcttttcctggagaaggggtatctctgatgtttttttgccttcttgtctttctgtctgccctcaggttcacccaagcagcactgactataacctaatgtggacaggatcccacctgaagcccttcttactgcgcaccctctctgaagcacaaaaagttaatcactttcccaggtaatgctctttgtagctgctttgcttcatttaaaggtacatgacattggggcatgtagccagcaaaggtaattagtgtccttaaagaagaggaagatgaaaatgaagaagaagaaggacttttttttttttttttgagatgagtatcgctctgtcacccaggctggagtgcagtggcatgatcttggctcactgcaacctctgcctcctgagttcaagcaattctcctgcctcagcctacccagtagctgggaatacaagcttgcaccaccatgcccggctaatttttgtatctttgggagagacgaggtttcgccatgtaggccaggctggtctcaaactcctgacctcaattgatctgcctgccttggcctcccaaagtgctgggattacagacatgagccaccacgcccggccagaagaagaaatttttctggtacggaacagcactctgcaaatcaaactgttgtgttcatatccctgagcatgaatgaacactttctaagggctatatagacatggatggttttaaaggagatagtttctggttctctttcctaaagttgagctgcttgggagtacctcatgaggatgggtttgcctttcttacttccccttcacagttactgttttttcacttttattaaagaatggctcacctagaatcttagtctggtatattgtccttaggtgtagaaattttcagggttccaaagaaaggtagaaaaaaattagtgtctaatttaattctagtaatagcataacaaatcctttttgcatgatggtagtttctatttctttgtttttaaaataattgaaggatgatataatctagctattagctgatcattaaacataattttgatgacagatcattttataattttttgatgtgtaattaggaaggagttcacagagttgagcgtcattggtgtttggatgaattgtatactacaatacttgcaatgataatcagtcatgtatatataaacagttatagccttacggtcacagggaattaaaaatatatgccaattcctatgtataattttgctgtacagaaggtatgatatgatg

SEQ ID NO: 76905 - DNA, 1050 bp, Homo sapiens
cttcctctatatcctttgtaatatcctttttaataaaccagtaaacataaatgtttctctgagttctgtgagctgctctaacaaattaattgatcccaaggagggagtcgtagggatgcctatttatagccaggtggttagaagcacaggtaaaacaacttggggcttgctattggcattggaagtgggaggcagtcttgtgggactgagccttcaacttatgggaactgacactatctcgaggtaggtagggtcaaatttgagttgaattagaggacacccactgcaagattgcttgctttgtgtgtggggaaacacacatttggtgtctaaagtgttgagtgattatgttgaattgagagtagagagtaggaaaaacactttggtttttcctcaatatctcagaatatagcaggagaaacggagcttgttttcctcagaataaccatttggcagttcattataaagtttaacatatgtggtgattgtaaaatgtgtccataaattctttgacattgttttcaaaaggtttaacttaatttttctgttcttgagtgttgactggatttagtgacttgcctctaactagtggaatatgacagaagtgattatcgcttctgagactagattgtaaaagacattacagcttcttgctcactttcttggatcacttgatctgggagaaaccagttgtcacgtcatgaaggcacttggccttatgaaaaagttcatgtggggaggaactgaggcctcctgccagcaggcagccccatgtgagtgatgagccatctggaagttgggttttccatcctctcttgagcctgatgactgcagtgctggccagtatcttgactgtaacctcataaaggaccttgggacagaaccacctagctctctcactcccacattcctggccccagaaactatgaggtcataaatatatactgttattttaagctgctgtgttttagggtaatttgttgtacagcaataaataactaaaacaacttactgaacaaccaagcagtcccacttctagagaaataaaaa

SEQ ID NO: 76906 - DNA, 1035 bp, Homo sapiens
tattctgatatgttcagtaaacttgtcagtatcatttatgtaagggcacactggcatcatataagcatgcccctgtcttatgtattttttgcttgaatgtcccttctctccattgatgacttagtgcctatgtaagtattatttttttttttttaagagacagagcctccctctgtagcccagaaccacagtggcacgatcatggctcactgcaccctctgcttcatgggctcaagtgatccttcctcctcaacctcccaagtagctgggaatacaggcatgcaccattaggctcagctaattttttaattttttgtagagatgggatctcgctctgttgcctgggctggtcttgaacacctgggctcaaaggatcctccactcttggcttcgcaaaattctgagatgacaggcatgatccaccacacccggcctgtaaggatactttatattcctgcatgtgaattatacatgcttccttttcggtatccctttttcgcttgccatttaagaacattctttcagccttgatttcttgtcttctgtaatttatgttctttgagggtagagatatcgcatatctttggatgttagggtttggagctacaagttagtcacattctctcccctttgagttcagactaataaaaaaaaatacacgtaggagccaaataggcacctaagtgtcagctgtatggctggtaaagtgacacagaaacacatggcctggatccagatctaaaatgggcttcttatttattttgcatcattgtgaacttacccacccaggccaggcagaggcgctgggctggtttcaggctttcctccacaggggcagagcctgactcagtaggcttaatgcacagaagagacatgagtacagatgagatgtgaggcaggtctcttgtgaaagtccaaattacggtggtaatagctaacatttactgaatgtttactttctagtaggcacctctactctggtagtattttagatgaggcgactaaggtacagtttggttaagaaactttccatga

SEQ ID NO: 76907 - DNA, 1232 bp, Homo sapiens
tatttagtagaatagaattagaggtctgtgaccctgaagaccgtgactaaggatctgttgccaactccagccattcccctcaaggggacagctttctaagcagaaggaagaaagaagcaacaaagaagaagatggggtggtaccagtatcagaaaagcaaaactttccccagaattgggctctatggccatctctagttgtaagggagattgagaagtgattctaacatgtgaattttcatgtccgccaactaattacagatgactagatttcaaagcaatgggtaaatttgtagaattacgattttagaattataagagatcttagtaaatcaggctaaattttacaaatctcattttaaagataagactaggtgatttaagcaaattacctctagagtcatatacttgaaaagccagaattacaactcagatctttctactccaggttcattgctgtttctgttagaccaagcctgctgccactgtaggaactggaaagcacttgaaagaactggggagcctgttttagtacatcttcatcctgaagcagagagtcctgagcaagactgcccggcctttgcctctgatttttcttgcttcctacccacacatttagaacctgtaaaagagaacaatccttgttctgaaaatatcacaaatcaaggagaaaagcctagcatgaaagacagtctttgatatttagaatttcaagaacattcaggattttaatcatagtgaagcaccagaagaagcattaacttctttttttttgagacagtcttactctatcgcccaggctggagtgcaatggtgtgatctcggctcactgcaacctctgcctcctgggttcaagcaattcttctgcctcaacctcctgagtagctgggattacagatgtgcaccatgcctagctaatttttgtgtttttagtagagatggggtttcaccatgttggccaggctagtctcgaactcctgacctcaggtgatccgcccacctcggcctcccaaattgctgggattacaggcataagccactgcgcccagccagatgttgtgggaagtcagggaccctgagcggagggactggctgaagccatggcagagtaacataaattgtgaagatttcatggatgtttattagttccccaaattaatacttttataatttcttacgcctatctttactgcagtctctgaacataaattgtgaagattttatggacattta

SEQ ID NO: 76908 - DNA, 1097 bp, Homo sapiens
tttgtggcatgtagaaatcatatgaaattcagtgttcatacataaaattttatgtaaacagccacacccctttgcttacatattgtttatggctactttcaagctacaattgcagagttaggtactgccacagaaactgcatggcctgcaaagcctaaaatatttattctctggctttttacaaaaatagtttgccgacccttcatacagatgcattgtagtgtatttaattaatattttgctgttataacacagcattgaaaatcttatatatgcaatattttacacatgtgtgagtagaactagaggatatagttctagaggtagaattgctcacagagttttaaattctgtgcggcacattaaattttttctaattctgttaattctgcatcaagggaaaaggcagaggaagatgggggagagtggacaaaagatctctttctttcctcctgctgaaatggtttgtggcattgacaaagtcaagtttgtgtgggaggctttgaagagactggctcatgtcagagggagaggaaagaaaaggagacaagtagttgctggcaagtcatctgggaaaaggagctgagcctagagagctccttctgaagacctgcctggtataggcccaaatgcagggtggagggaagtgtgcaaaacttcaggactccagtatctgaaagtcttgttctgatactggagccctagaaaaggacttgcctcttaataggtccaaccagaagaacagaaactatagggaactttcttaggtttatgctgttgtattctagataaactgggactgatatcttggcgcacagcaacctaggcaatttggaaaaaggaagtctttgtgagatctgctcagaaacatttgcatttgcttgatttatttccccacactattccttccctttctctcttccttcattgaagaaaaataccaaaaacaaaaaattctctcaatttttacctttcatcccatctctgctttgaaacagtactgactgctgccacctgacgtatttcatcaaaagtggaagaggcacagctgggaccagtgctctctctccagtctgggatgtgagaatcagcagcac

SEQ ID NO: 76909 - DNA, 1029 bp, Homo sapiens
gaatgaaactggccgctggtctgggtttctactgtggttgtgtaggactcttttcctaatatcttctccctggaagaggctgactgtgaattttgtgtaagggcaaaacatgttgactctcaggctttactttaggtggacatggtgagaagcactccccttccaccttgccaaaataaagtgggccatattgtgaatgcagaggaggattttggtgatctccctcttgggcagagctacctttcttttcctttttgtgtgtactggtgataaggtagcctcaagttctactcttctctatcagatttctgcacccacacgtctcctggcctcactgttccaaatgctgtttgttaattatctgattctaattccttggctgatccctgagcttcatgtttgttgagtacaagcttggaaatttgcaggagcctccttgggaaggtcactcttatctcttttggacttttctggcttcttttactttttcctagctttgatatcatttcattcttttgaaaatattctttctgtccttccactggaactctggaagggcaggggtaggtagatgtgttgtatgtgggaccagaaccctatcttaaattccccacttgtcttttcacattgagctgtttgccatatgtgtagaaactaactttctgagggatctttcacattggaaagtccttaaattcagtctggactcaaaacagtaccgtaaacaatgatggccagacccttcatgccaaagaaatataggatctggttttgatagagcaactgctacagccccaggcattggctgcaacttctgttacctggcctaggccactctggaggccttttaccctgagtctcctgtgacataaggccatggtcatatgccttggctctgtctcctcttgtctctgctctgacgttggtgttgaaggcccctctccaacagcttttccttcagctctgtgccaggagctccagtgttgtttgaatctcatagacggcactagtttgggtttaggttttagc

SEQ ID NO: 76910 - DNA, 1983 bp, Homo sapiens
aatacttaccattgtgttccagttgcctacagtattcagtatagtacaatgctgtacaggtttgtagcctacaagcaagaagctgtattatctatcctaggtgtgtagtaggctataccatccaggtttgtgtaaatacgctctatgatgttcacacaacgatgaaattggcctatcaatgcatttctcagagcatatccccattgttaagtgacgaatggttgtatgtgcaaacttggtcctggggtacctagtaaatagtgctcttttaggttattgttaatagagaaatggtgttgaaacttcagacctagagaagatgaaatttgataatatgtgatggtctaaatcaaaggtcactaacataaatgctcacaagtacattcactgaaggaagagtggagactggagaatggagagtacatgtctcatctaaaggcatttactatttagtgccagcagctgatactggtattgccagatctggtttgttaagtgaggcttgaacatgtagatttttactgtgaaacaaagcacttttttacacttttaattttgaaaccgttttgaacttatagagttgtcagagctgtaagaattatatgaaaaattaccttttaccctatgtctagagatctcattccaattctgccaattgtcctaagattttttttttttttaattacaaaaggatccaatcaaggatcacatgttgtatttagccgtcgggtctccgtagtctccttcagtctgaaacagttccttagtctttctttgactttcatgatctcagcatttttgaagattacaggccagtcattttgtggattgtccctcagtttgggcttgtctgatattttctcatgaagagacctaggtaatgcatttggggccagaataccacaaaagtgatactaattcttgtcattgcattatatgtgatggcacatgctagtcatttagtggtgtttgaccatttgctttaggtcatctgctagattcctccactgtaaaattatttggtcttaccctttgtaattagtaagtattttataaggagatactttaaatcatgtaaaatttcattcttcatctcatttctcatttttaagaaaaatctattgatttttcttgccttaatgaattattgctgtaatagttgccaaatgatgattttttaattccatcataacttttatttcttggcatttttctgtgaggaagagctttatcttctcgtttatttattcatctatttatttataccaatgcagactcaagcgttcctgttttatttaatgggttataattctttactatcatgatttattttgatgctcaaattgtcccagatttggccagtgggagacctctcaagctggctttgtgtccttttgacatgtctttatcattctttgagcacaagatgtttcaggctcatcttgttctttctctattctatccctggaatcaaccatttctccaaggagcactggttgctttttcttggagtataatatttagaaatcaatatctgggtgctagatacgctcattgttttggggcatttctgctttcagaccctggccatgagcagagttaggaaattatgtatttatgtacatatacacttgtacatctgtatttctatatctgtctctaatgtattgttgaaaaatagaagtttatactagtacgcacaattctagttcaaaactacagagttccttcttgttttttgcttttcatattttaaaatctcttttccaacagcaggaaatctggctcgcagtatctttaacatatttatttatttgctcaattcctttgtatgtggccagtttcctgaccccactgggccactgtcccattcagatgccgtttttatatggatttatacccttatttggtggcctccctgcttagaaaacctccttgtgcttctggctgacttcccaccctactcaccatcttccttttttt

SEQ ID NO: 76911 - DNA, 1049 bp, Homo sapiens
tttgtcaggcttttcatgttgaccaagttagatcaagtacttgtagtaactacaagagatgaaaagcctctttttctgaagcagaagctttcccctccttctaattcattgttctttgaggggagaggatgacaggagggatgtcaccttgaggtaatgtctggctgaggcaggcagccagcacggggcccctttgcatctcacaagaattcagagaatgacagtctgcaacttgcttggacaatctattagaggaagattgggatgcataggcaagggttactcaccagggcactggggtgtgacatggctagaagttaagtgataactactggaagttggaagtttctagaaaatctggggtccttctcaagcacagacataataatgctcatcaaactcttgtcttttagcctagtcatcattttctctttgtccacatcctttttcctagcctcatgtttgtttattttagttttttgggtttggggttttttttcttttcactattctttctttggctcttgtatatttctggtacagggaattagggagtggagatagtgggtggatgagaagaaacagagaagaggaaagttttttaatgctgacctttaatgtggtgaaaattcatgttgacttcatagtctgagtaagcatatgtaaataatttgtaagtcatatgaaaataaacttgtggccttcttttttttttcacacacttggatatgcctcttgggaaaaccactctagtgaagggtgatatggttacagtggtatgtaaacaggggttgatatctaccataaccattcgccttgagtgtccttttgttgatactgagcatccttttgttgatattgagcatcactggaaagttctctctttccctggttacttccttcagaggcacatgtattttatactttggtcttcttttgacaacagtccgggatatcaaattgctaccctgttttcagtgggctccatgtttaattcctcttttgccttcatttcaaattcaggactaagtctcttgcactgtgcccat

SEQ ID NO: 76912 - DNA, 1833 bp, Homo sapiens
ctcactcacccattccaactcagttctggtctgaaaatggcatcagaggttgttttgtggactcaggtgacattcacctcaaaggttaattgtcttttaacttgttgtaaccattcttaaatttgtttgccttctttcacacattgctttcactctttcttgatgcataattgtttggttaagaaagaatttgccgccttcttccccaccctcttgaaaaaggcaaactgtatgcattttcatttccattgaagaaattggtatgaaaggatatatgacaaaaaggaccaagaaaaaatgagtaactggaagtcagcaaagtgaattaaaaaaaaaactttttaaaaagacaagaaggctatttgcaaagagtcttgttattatagccaagcctagttacatatgtgactttgatttattaatttgttttagttgtgacgatccagaagtggaggattatggaaacaaatggagcatgagtgctatgcttaggtacctgaaacaagaaggcagagatacaaccggtgagtactgggcctttttccttcttgacttctcttctttggataactttatcattgtctcttgccaggaatcattctctgttgctttgatagtgttgctgagacgggatgattgtccttggtgttactttttcctgcagttgacaagctggggaacaggttttccattaccctcaaaatcccttttcttgtttcgggtctgaaagacataactttttccttttaatccttagtgaatttacccttcttgaatgttgaactgctgactaaaatatggtcagctttttatataacaaattgcctgtctccatattggccccaagtttcgagttttctaagttaatctctctcattcatgttgctgagttggagaatgggcactgtttgagcacagggcttcaaatcaaaatggacacaattgctgagccttgagcagaacgggaaactgtgtgccaaaaaagacttttcatttcacaagggaaagggtcataggggaagtgtgagaagggaagtgaggctcctattccattatgtgtctgtcttttgtcataagaggccacctgagggtatcccttggcacctacattcttgactgtattgatctgttcacagatatgcctgcctctatagcacccattcagaagtctgccatatagaggcttttttgaatgagcacacatgcttttatagttatattgttatctggaatccagttcataatccatgtattttgatattgagtctgaaatttaaaaatttttgtttgcagcattgatggcccatgtagaagacctgatcattaagactataatctctgctgaactagctattgctactgcctgtaaaacctttgttcctcatcgcagcagttgttttggtaaggagactcaagaagcttaacatgttttgtgaagaggatcttgggaagttggacgggattttagggtagagaggcttagtgattctatagcagtaagaggtatgtgatggactcttctttctaagctcatgtagcatatgaagagcctactaagaggccaatagtgagcttggtcagaagtcccctgaggagtaactagctttctgtgtgggaagcagggattggaacgaacgtgttggtctttctgtcagagtgcagtcagaaaaagtctgcaacggactgtacaggaatccagctctaacaaatatattccagagctccttggcagccaggctgggaacagttccaagaagctctggctggtaccagtatgtgctttctcccattttccgatgactcctcctttttgtttgagtcttctttctagtg

SEQ ID NO: 76913 - DNA, 1074 bp, Homo sapiens
tttgcccccaccatgcatggcagcacttttttttaaattgagacagtatctcactacgttacccagtctggccttgaactcctgggcccaaaggatccacctgcctcagcctcccgagtagctaggactataggtgtgtgccaccatacccagttgcatgtcagcgtcttttgctcttagagaatgttcaggaaatgtttcttgaatgaatgattggcacttgctttaattgctttttggtggcctgacagtagacttcccaatggatctggtttggtaatggcctagaactcttagaattattgcagactgtttgaagatggggatgaggggttgggactaggagcgtaactccaacttccaaaacctcattagatttaaataataaataaaggtttatttttctacatctacttggctcttatatgagggtaaatttctgatatcccttgctgtaaaaatctttgttctaaataattataaaaccttttctgaatgtttccttttgtttgtttgtttgtttgttttataacttgattgccttttggaagcttgggagcttcattattgaacttattggcaatagaatgttccgacgtggaagaagctgtgactttctctgactcagtgaaataccccttaagtccatttcatcagccatgggtctcctttcttcctccctacttgtgttcagttttaataaactgagtgcatctggagttttttaagttgttgactatcttcttggcttttgtggttctaattccacttcctgtcagccctgggattttgtgtgcttcattaacctcatcccatcagatatgattttgtatacgtgtgtatatttgtatgagtctctgcctcccactgactcctaacttcccctggggtttaagtcacaaggaataagctagttgtttttttttttttccatttattttagagtaaacaggaattgaaagcttcccagaagattttggctcaaacagagcattggtgcttttaggggaaaccaacagaccagacatggggttcgctatattcttttggtggttgttcctgtccttccatctt

SEQ ID NO: 76914 - DNA, 1049 bp, Homo sapiens
tccacccacataaagacatgtccttatgagtccggccacttttggcatgccccatatcctggattctccctctgctctcccgtaactagatactcaggaaaaatgatatcatcctttctagcagatcaggcctgaaaaggacactccttttgctctagttaagcatacccagtcctaaatactcctttcaaatctacctttacatctggtaaccagatagcatattgatttcttggactagttaaccaattggctgtgggcattttcttttcattttcttgtgggtctgcttttttccaaaattctccttctggaccccatataaagacttcctctttagctttttcaatttgaatccaaagccaaggtaaaaagaatttccttcatacaatagcatttcagtgacagtgagttctggctaatgtcagcactttccattgcctcagggaccacagcttcagctgggactttatttctggggagagttagtggattgatccaaaattagtggtgtgacatgtttagtaatctattaggccttggatggattattattttcttgagaaaatctttatttcctcctctctccctaaactaacttttatcaggttttttcttaatacagctttaatatgtaaagtttcctaagaatctctcttattttctttatgattggtggctttattataaatatttcaagtgttgtgatcagggttattttgtaggaagtggctgccaattattttgtctttctcaaaaactatgcattgtttttcacttaaaatatatttttttcattcagtatttctgaagtatttcctatgtgctagttatggtgcaggctacttgtaatacaacaatgaatgaaacatggaccctgccctcaagtgatagggaggagcagacatgaaatgataaatgacattacaagtagtataagtgactcaggtgctctaggaatatataagatttactagctgtgcctaggggatccacagaaagccatttttaacagcaagaatgtagtatgcaacatacagtgtcatgac

SEQ ID NO: 76915 - DNA, 1101 bp, Homo sapiens
ctgctaatttcttagaaaatggcaggttttaatgttgcccattccccattcaggatttgtgtgccaagatcctgcccagcgggcatcaactcggccaatttatcccacctttgagtcttccaggcgaaaccctttccagaaacctcaggtaagccaattccacagcagggagcctgaaggaggcttactgggaagtggcggctgatgtaactgtgggagcagaagcactgtgggtatgaggtcacttagagcaggagaatttggggatcactctagacaggaggcagttatattcagctgtggctaatagcttatgctttcaacattttccaagaaacttactccctgttttttgttttgtcttttctcttggctttttttcattatcttccttctttctgtttttaaaaatcacgttttttccgcctcagattgatatgctcagaaacaaggcacagaaaaggagcctattaattcttagtcattactgcattctttctgatcttcagactagctttgtaaagaagatgctttgttgaaatagtatcttctctacaagtaattctcctcaaaggaccctccatgatcatgagttattgattgaggctaaatgagataaaagcccaaagaaacttatacttgtctaaaatatcatttgatcaagcattgcttcggtctttgtgtactctgcatttttgttccagttaaaccaatcagctgatccttctatttactcattccatcatcttgtcagtccctgtctgttttgaccctgctaattttccacttttgtttcttggcctttaacatttcttcttatttaaaaaaaaatccactttgctcttctcttcccatctggtttgattgctttgcctgctcagacattttggaagtcttttcttattaaatccatcgtcacctttacttttcattttaacatttatttacttgttctatattacattgttttgcattcattgatttgttgcttttaaattgttctgtactctcctgccagattgtaggctctttgaaggcataagcagctttttcttcctactccccattttctctttccttttcttctctccttttatccct

SEQ ID NO: 76916 - DNA, 1049 bp, Homo sapiens
ggagtagtgctattttctgtttgcgaaatccatatactattatttattcagataattttttattagaacagggttttcaaactcaaatgcttagagggcctgcaggcaggtaatataaatgagtaaatagaggcaggcataaaacagccaagagtgatatgactgaggtaaactggagagtgcatacctcatctgaaagggatggctgttttactaatgtgctctagctaattactatcaggcataagtgtgggccaggtgttatgagatcttgctattgtcaagagaaatcagaaatcttacttttaagtattggcagccacttcattagaaacaatactttgcaggccaagcataacatgtctttgagctagattcagtctatgcctatctatgaccccgtgctgcagaattattccctaattaatgttgggatgtggaacagggtgtactgtattttaaaggctattatcttggattaaatataaaatcagttaccagggttgtacttgatcagtgcatcatcagagatcaaagggttttctttaatttttagtaagaaaaagtagaggattaacctaggtgtactagaaaaacttaatttaggcagtcacattcctttgcaaattgtttcctgcagtatctgtggcaagaaccacagaattatgtataaaggatcatgaacatttctgtgcagctttaacacagtttctgccaagtttcacttctagaggtagctgtattgccagtcttaaatgaattggtcccttttcttagtttgcctgtcagctttattggcaactctttgcaaactctagaaaatctgttcaatgcttgttttgccaactggtaggtaatggcatgattacatccataagcagcctacaggacacttacataaaggctaaaggaactgtagattggtcatgtgtactgtgtgaaaccagtttgtcaggtggactagttgacttcaggatcttcagtatctggcagtaggattgtgccctcagtggtgagaagttgaagctggaatatatatggcataggag

SEQ ID NO: 76917 - DNA, 1003 bp, Homo sapiens
aattttttttttcagacatcttatgaaacatactgttgtctatagcttaatattggaaatgttttcacattgggtgtagggttgtatttgagttccttaacaggtgacatttcaaatatgtagtgatctgcagtttataaatcttagaagctctgccacaatagtgtctcagatgctacctttgaaatacaaacatctttctttctgaatgatcagcatttgctttcttactgtttttgttagcagtatttgagattaaccattgctttcttctgcacagatttaaaaaattctttttgaagtaataggctagcagtgggggtcctgtgcctgctatttgatgctttagtatgagggatatagatattctcatatataaacgtgtcactgcaactgttgtttagcaaaaagctccagtatatttattttggcgtttgtactctctgatgcaatttctggtaagcttgaatgcttgacatgtaacttttcttagctactgtttctgataaagtgatttatatggtttatgtgaatccaagaaatgaaaaataacttactggatgccttgtctaatatttagtaactgattaatgtggctctgtagtatgagttttggtgcttagttggtggaattcgaaactctataatatgtagtattttatatttagtaaatacctaagtatgctagttgctcccatggcagaaaacaaaacaaaataatgctgttgacttcaaagagcttatattctaaatatacctggaactaatgtactgaaaggagtacgttaggaaaggggtactctttcatagcctgtggcatttgactgtaaagaagtgtctttgataggtaattctaatttatttttacttacttatttgagacagcgtgtcactccatcacccaggctggagtgcagtgacgcgatcacagctcactacagcctggacttcctgggctcaggtgatcctcccaccttggcctcctgattagctgggactacag

SEQ ID NO: 76918 - DNA, 1518 bp, Homo sapiens
tggctgccttcttggagtacccagggtagtcacgtttgtgccaggcctcttgaagtccagcaaccacagtgatagccttttggccacagctcttttctgtgttactgatgtctctcatctcaatatttccccctcaaattgtaaaacatttcacagcccaactttttcatttgtgatataatagattgttccttggttttgtgtcttatgtctcaattctcttaattgttcatctcctgtgctaaaaatatacccactgaaataaatacacatttatttttctattgagggcatcttcagatttttccatatccttgaaatattggatgtgctctaaaaccaaggtttgggttaaatactagcttagaaagtcacgtggacctcattctttctttcttctcttttctctctcaacccatagtgttcttttactgttctgttttctcctcttgcctttgagtttattagctttcgtctgttttccagggttccaggctgagattaattacagaaagtgggctatgaatttgagcttataaatctttagaaaaataatgatgttgagggaatgaacagagggtaatgaggagtaatgaaaacttaaaaaattttttttactattttcattttcttctccttagcgttgccgtccactctctgccagtgatgcggaaatgaaaaacctcgtgggctcagcccgggagaaagggccagggaagttgggtggttctgtgcttggtctgtcaatggaggaggtaaagataagttcattttaggcttttgtgggttaacacagggtttagtgaaaattagtgagtgattgataatattcatgacaaactcatgtcttacattgaaaagagaaagattcaagattggagaaatgttttctcagggaagaacattttaaatggaattaatttctcccttcatgctactttcatattcttgggtcataactatcttcctttgtcctatagccacatggactccggttttcaaaataggtactcattttatcttatttttcatctagatcaaagttttacgaagggtgaaggaggagaatgatcggcgaggtggatttattcgcatatttcctacatctgagacatgggaaatatatgggtgaggtgactaccttttttttttattctttacctgaggtccatagaattagattaattgtgatacactgtcatcactgctccccccgatgatgcttttcttattttgtttatttataatatgataaatattatccaacccgagaactagattattgacagtaatttaatatacctgtgtattatttctcccttttaatcctctgcctccctcctaactagcttcctatcccagggttagggactgtcctaaactttgtgtttatcattaccttgatttgaaaaaaaaaattgtttatctatatgtgtatctaagcaatatattgttttattgagatctagtttatatgcagtaaaatgcatctattttaaatgtacagtttgaagatga

SEQ ID NO: 76919 - DNA, 1232 bp, Homo sapiens
tcaagaaatatgcttcctataacatactgctgttaacttggaaattgagaaaaaagaaaaaaatcttaaacattaagaataaatgaagagcactgagttctgttgttcattttttggcactcattttatattgccatcaatagggattttgggccctgtagaggtgtaagcagatgcaagctggcatatgatagaccatatgctggagcatgaaacaagtcctaatatatttaaaaggattaaaatgatacagagtatgttctttggccccagtagaattgaatatcaataacaatagaaaatcttcacatatttgggaattaaacatttctaaataatccatgggtaaaagaagaaatcatgaggaaaattagaaaatactttgaactgaatgatactaaaaatatgtcaagatatgtacgctacagctaaagtagtgctttgggggaaattataagtttaaatgcttaccttggaaaattgaggactgagatcactgttctaatgtttgttttaagaaactgaaaaaagtagagtaactccaaagtaagtggaagaaaggaaaggcagaaatcaaataaaaaacaaacagtaaagaatgttaacaaaatccaaagtgtgttcattgataaggtagcataattgataaacccttaggtagactgatctagaataaagagaaaggacactaattaccaatatcatcagatagaaaagagaggatttcactatagattcaacagacataaagtggatgctaaggtgcggaaaaaggatattaaggcaatattattagcaactttattccattactttgacagcttagttgaaatgacaattctttgtggtggtgggaaagttgggggcaacacccaaactgataccagctgaagtagaaattttgaaaagccctgtatctgttgagaaaattgaaattgtcctgaaaaactttcctatagagaaaactccaggctcactggtttcactattgaattctgtcaagcatttgaggaataataacaccaatcttatacagattcttttaagaatataggaagggacacttcccagttcatcttacgatgccagcatgactatgattccaaaacctgacaaagacattaaaatagaagaagaagagaaaattacaggctaatatccttcatgaacatagacacaaaatttcttaatactagcaaatctaatctgccattataaaaaggataatacat

SEQ ID NO: 76920 - DNA, 1050 bp, Homo sapiens
gtaatcccagcactttaggaggccaaggtgggcgaatcgcttgagcccaggagttcgagaccagcccaggcaatctggcaaaatcctgtctctacaaaaaatacaaaaattagctgggtatggtaacatgtgcctatagtcccagctacttggaaggctgaggttggaggactacttgaccccaggatgtcgagctgtaatgagccgagatcctgccactgccctccagcctgggcaacagagcgagaccctgaatcaaaaaatgataataaatgaaaacaaaaataaataaaagaatatatgagattagagagtgacatgtgggtgctattaattctgtgccttgtttgtggtttggtttagaaatgggcttttactaaaaagagaaaaggaaggtattgggagagaggaacatttaatccttttttcagcaacattagtgattcttcgtatttagtgattacccaaccagctgaaatgaatgttaaaactgagacagagagtgaagaggaggaagaagtcgcattagataatgaagatgaagaacaggaggcttcccaggaggagtctgcaggatttcttagagaaaatcaagccaaatatacaccctcattgacagctttggtagaaaatacacccaaagaaaattccatgaaagttcgtgaatggaataataaaggtggacactgctgcaaacttgagactcaggagctagagcctaaatttaacctgatgcagattcttcaagataatggcaatcttaggtatgtatcttttataattatattagtaaaactgataacagctaacttgtactgtgtaccagctactattttagtggttttacagtcatttttcatttaatatttacagaagtcctatgaaataatgactgtgattagatactgttattattaaggaaactgagccttagagaggttaggtaacttgtctaaggtagagctatgatacaaacccgggtctcattggttgggcatttgtgtcagtcactgagtataaggtaactgggacaaggagctcaagcagctc

SEQ ID NO: 76921 - DNA, 1092 bp, Homo sapiens
tggaagctagactggagccctcttaagatgtgcagcttactttagccaaatcctacctcctaaccttgtgaaaacagtcagtagaaagcattcagtgattgcatttgtggggattgtaaacaaagtttgtgttgggccctaatcttcgctgatataattttggctacagtatcagaaggccgatcagctgaagtaaccaaaatctggcctgaaagaaaacagatctgccatgaacagcagctgaggtgaaaatcatcagtgtctctctggtacttctgtcttccaaactatagcttgatcagatttccttatttccagcctaggccaccaggcagaaaatagctgcgttctttaatgatgttgctaaggtgcttttcacaagacttgaggatttctttcgcccactgaacatctgggcttgtcctgcctggcccatcagttcatctgtgccaaactctgttggacctccctcatttgctctgggctccagccattccatcttgtagttgagaacagtgtggccttaaatttggtcttaagagtccctttataggatttatctatttcctgctttggacacttttatatactagaaatattaattgccattgcaaaatccacacttttgcttttgtactaactgataagttcttatggacctccaaatgtaaaaaacattttctcattaatacagtggtttttgtgaagattgagtacttctcctgtctgttcccccaagaaagttgttaaaaagttcaaagagggtcaagcacagtgactcaggcctatatgtaatcccagcactttgggaggccaaggcaggcggatcacttgaggccaggagttcgagaccagcctggccaacatggtgaaaccccgtctctactaaaaatacaaaaattagctgggtgtgatggtgtgcacctgtaagtccagctagttgggtggctgaggcacaagaatcacgtgaatccagcaggatggaggttgcggtgagctgagattccaccactacactgcagcctgggtgacagaatgagaccttgtctcaaaaaaaaaatttcaaagagaaggagtaagaaatctaatttt

SEQ ID NO: 76922 - DNA, 1091 bp, Homo sapiens
cagctggtctgaaaaactatttattacttctgaaggcccagtggccatagttaattcttaattcttatcaaaaggcatattccttttgagcactgagatgaatcctaggctgtgtgagtctgcacggttgttagtgcctgtagaaagtggcaaattgaccattggagaacaaatttgagctgtggattgaatgtaatgacatattctttcttgaacgagttatactttcatctttaaaacattttatacattacagaattttacagtcaagcccaagaaatatactatttaattagaatattttgcaaagcattctatatcccgggatctcagaatgcattaaaaatatcattttgggtgtttgggtttgggaggtttggtcagtttgcagaaggaaaagctgatagaaatttaaatggcttttctaaagttgcatggaattgttggtagaatatcagtgcaccaaactcatagccacaatttactccagatctgttgagaattttgttatgtcttatataagtgaagaatttattcagtatggaagctggtataagagtaccttccaagatctgtctttcctctcctaattggaacaaaatactgtgtctctgttgtcatattgttaaagctacaagggtgatcatagatattactaagctactataaaaacctctttaatcaatgggctgtgtaagtagaaagtaaaaacatgattaaaatttacattcattctgcaacttttacttgggaatttcaaaatgttttacaaaatcatggccaaaagtaatatgtcaaatttataggtggcaaaagtacatacaagaattaaatgtctttactataaggacagattaactcaaggctattgaaactacatgatgaagtgcatatttattaggagtcagttttatcttgttgtttttctgtggggtttgggcactgggtaggaaacagaacaaatggctgaaaagaaatcaaagaagaaagttgaggaagaagaggaagatggggtgaatatggaaaactttcaggagttcatcagacaagcaaggtagtagacattcttgattgataaaagctgtcttatt

SEQ ID NO: 76923 - DNA, 1044 bp, Homo sapiens
taggaccaaaactaaagctaagcctctcatggaattagttttacttcagcctcatcccagcgtgtgaagcagtaattattttctttctcaaatccttagttgtttgaagggagtaaataagaaggcctaatgtgaaataggaagcaaagaatattataagaacaatgttgattcttggagggagttgggtagttagattttagtgatagaattatgggaagagggaataggatactaagatatgatgggaaggaattttcaaattaaataagtggctatgagacgggaaaggccagtgctctgctacacttttatcattgggtcactaactagattatatgtttccggtttataaatgggcagctagaagcaccaagacattgagattttgtgattgtagtaaaaaaaaaaaaaaaatacccaaaatagccaatattagtgcttacctatctagctcctatcgttcactagactgcaaagcctacaaagtgaaaagatcctaatcctgtaggaatccaaggtgactgtatcctgattgggaagtcatcccccttcagttcatttttttcgtctataaagaacttcagtgccagcgaattaaaagtccattagactatggtttgtagggatctgaacttgccattagatgtcagtgttaacttttagagtcttggtaatagggtggtcagtactgagggaggtgctgtaggatgtaataagcaggatggagtagtggagaaagagctagattagccatccagagacttgccactgactcctgtgtgatcttgagcagttcactccattgttattctgacactgactcctgtatgatctttggcagttcatgccactgttctgtcactgattagctatgtgatcttggacagttcactctactcttctgacactgactagctgtgtgatcttgggcagttcaccccactgttctcctgccactgactcctgtgtgatattgggcagttaattccattgttctgacactgactagctgtgtgatcttggacagttcattctactctt

SEQ ID NO: 76924 - DNA, 1064 bp, Homo sapiens
aacatggcaaaaccccaactccacaaaaaagacaaaaattagccaggtgcggtggcacgtgcctgtagtcccagctactctggaggctgaggtgggaggatcgattgagcccaagagctgcagtgtgccataactgcaccactgcactccaacctcggctacaaagtaagaaagaccctgtgtcaaaattttttcattgataacaccatacctgcccttcataattaagcagttgacattaatcagatgcttactttgtactaggcactgtgccaaggactttatatgcattatctctttaaccctaatgaggtgtaggtacttactttttgccaattaagatgaagaaatagaagctggtaggataagtgactctgctaatgtcacacagatggcaagttactgtgctaagactcaaactcagctctgtctgactctgtgctctttacctcagtgtttttctgtctctttcggtgtgaataaggactcaaacctctcattagacgaaagtgaccgaacttcaccctgtgagcttgttgttccatgatgttgctacagagttgtagccaagcctatacttgtgcctgctcagagaaacaaggagttgaactttgttttcttgatttgaaatgcttctctagttcttgaagcagcttgcaaaacatgtggctctgttgagaattatcagttatttgttgggcaaactcctcatcagattattttatagtatagtcaactgattcttcgaccagacaaaactcagccttgttaatcactagagatgcaataagaatagatcttatgatggcagcagcaactccccctgtcaacacacaaaatctacatgtataaattggaaaccctacgaagagatttgcccattttgtcaggtttcccaggaatgtctctggcaaatcttgatctggaactctgtctggattttggaacactaaatgtctatatatatacgtatattatgaaaatgatggagctcagcagaaagagaagatatgccaagagaatttagtgctgaggtattggaactgcagagattccctgctttt

SEQ ID NO: 76925 - DNA, 1144 bp, Homo sapiens
ggaggaggaggagagcaaggggtgaaacatctgccaagcaggccccaaagcttaggtggaggtaggatcttgtgaccagatttcccacaggcagttactcacttagcagcagccagctagagggaggcaggggcagagacatgtggaacaagttgactgtttttaggcttaaatttcttgtttttttgttttttcgttgttaccactatttctcagggcagcatagcaagtaatcttggaattttctgaagtttgtcctaagctgttttgtccacttttgcattcttggcatatttaatgattactctttttaatgtttgagcatctgaacaacattgagaaatagtaaaaccttaaagttgctaatgaaactattttcccttctcattcccctttgttgttttgtaacttgtcttcaccccatcaaaggcatttctgctgttttttggaaaatcccctgcccgtgagctttgtggaggagaggaagcattgaatggttccttttacctgttctctcgtttccttagctaccattcctggtaacaagtgcttctcaaactctgcaatgcaagtaagtttcccgtggatcttgaaaatgcaaattttggttcagtgcagctggggctggggctggggctggggctgtggctgggccaagattctgcatttttaatatgctcccagtaatgcaggtgctcttggtccagagaccaaattctaagtcgcaaggctcagtggtacaaggcagtgagataacacagtgattaaaacaacaagattgggagaattttcatcaggcagaccaggaattgaatccaggggctgacacataataattatttgttcttgagcaagttattttatctctcaacctcagtttccccatctacctgtcttgaagactaagtaggttaatatacataaaatatgcttagcatgttgcctggaacaagctgtgtgtgtgtgtgtgtgtgtgtgtgtgtgtttcagacagggtcttgctctattatccaggcactgtgtgtgtgtttgtgtgtgtgtgtgtgtgtgtgtgtgtgtgtgtgtgtgtgtgtgtgtttgagacagcgtcttgctctattatccaggctggagtgcagtggtgtgatctcagctcactgcagtc

SEQ ID NO: 76926 - DNA, 1053 bp, Homo sapiens
attacagaacatttccattatcacagatcattctagaagatagaaaatgatttatttcacttgtttttctgatagatcagtgatggctacttggagaaatgtgtaaagaagattctgagaccatctccaagtcagccccgagttgcttgattatgggttagcagtatgagtcctaggaagagactgctgggtgagggatgtaggggtgttagctctggcatatgtgctgagtgtcttctagacaaaaaatccacaagtctaagaatagaatatttaatctagaggggcaggttattatcatttggtaggaacagattttttgttttcttttagcaggaatcctttagagagaaaggtgagaagcttttaaagttttctcattccttgtatagtctctcatttaagtagcagtcacttttgctgtttctcaaattaacaatgatactttgcttttgcataaaacaaaatcacagtggctgccacttcttggtttatccatcacatcaggaatggttgttatgtgaataaacgtaaccctccaataatccaaaagtaatttcatgatcaagtcactttttacctgccaagaaacaaaactggccgaggatgtttttctttgttttacttctttaatgtcttctgatgaaagataacaagtgggaagtaaaatcaaagggaaagaaggaaaagctggtatagttttgtcaatctctgtataatcactgttttaagaatttgaggtctgtatctgatgatattttaaaaatctctaataattaagggtaactaggattgttttcctactagtttccaaactagaaaagatttttaaaactggagtaccagttctgcaacttttatgtgactttgagcaaattgcttatcataacctctctgagccttagtttctccacttgtgaaatggtgtggaacagtatctacctctgtgaataatgggtaaggactaagtgaaatataaaacccagagtgcctaacaccgctactgtaaggactcattaaaccatattatttgggaaaagtagaccacatgcg

SEQ ID NO: 76927 - DNA, 1080 bp, Homo sapiens
gtgcctttgtcacagccacagcttcagctcagaggggtcagcatctgttggccttgacttgattttgcctatatgttgttaatgatgctttttaaaaactctgtaaagtcaggttatttccctcgctttatttctaggtaacaaacctgaatttggcaactggcatcataaacagaagcagtgcttcagctcccccaaccctccgacccatcatcagtcctagtggcccgacatggtctacacagtcagacccccaagctcccgagaatcactccagctctcctggaagcaggtatgtgaagggccctgcaactagcatttgggttactcagggatggcctgtgtcccaagcaagccattcccaccttgagttctgtatggagatagcactaaggcatatgccctttctccacctgcctcgatcctctggcacctgactaagagagcctcattttatttgtaagacagttttcaagcatatcaaatgaaaaggacatttctgagatagttaagaaaatcaccttagggtaaaagagcaagaatttacactatgtttaaaccttgcttatagtcatcatttttatgtgccaactttttgcactttgtccttgtctcttagttttttttttaataccttgtgttgtttatagttttttttatactacattgtgtttcagtaactgtagactctgttcttttgaaggacatatttgtttcttatttttttatctagtttcatataactgaactcaaacaacctcgctgaacaatgctcatttgggaagtgggaaggaaatttcctttatgtagttgagagatgtggctaaagataaaatccacgtagcttctggcaataatgtaagcagcttccaaattaaaaaagaaaccactgtattgaattctggtcttgctgtgtgttttaattacccctgtattaaaaaaaaaaaaaaaaagaaatggattcccagcacatcttgctttagtgcctattaaatatggattaaattgcatcagtccctgagtcgaatgcgctagagagaaatgtgactgttacagtgaagtattttgaccagctgagat

SEQ ID NO: 76928 - DNA, 1027 bp, Homo sapiens
atatactgttcagagctgaagggctccctgagcttatgacttccagctggtcaagaacagtcatatgcctcttggcctaaccattcatccaaggagggagaaggaaagggggttactaaatgaagttcctggttcagctggatcttcacatccatctagatttaaactttgttgagacacctttaaaagttcatcttacacaagaaggaaatgaaatcttattttttgttgtcaactatttcccatttcagaggagcagccaccacatgtagggcaatggtagcaataaggcaggtagcactgcagagcagatgagtgctcagattctgcagttagctatgcctcggttgcctcatctgtaacatgaggcaaggttaaagtgagataaagcacagaaacatttagcgcagtgcctggcacctcctcttctttttctcatcattgtcctcatgtggcatacaactgaaatggaagcatctcctttgtttgaaatgtttttagaagtcatctttgggatgattttatagtttctcattttatatttattttattttgttttgttttgttttgttttattttattttattttattttattttattttgagatggagcctcgttctgtcacccaggctggagtgcagtggcatgatctcggctcactgcaaccacacctcccaagttcaggagattctcctgcctcagcctcccgagtagctgggtctaccactactcccggctaatttttgtatttttagtagagatggggtttcaccatattggccaggccggtctcgaactcctgacctcatgatccgcccgcctcagcctcccaaagtgctgggattacagacgtgagccgcctggcctggctcattttatatttaaatctgtgatctaatctgagttaatttttgtatgaggtatgagattttggttgaggttccttctttgcctatgtatgttcaattgctccaacttcatttgttaatacacaaatggtttagaaaggttattgttcctccatt

SEQ ID NO: 76929 - DNA, 1035 bp, Homo sapiens
tccattgtcaggtccagctggctggaatctcattgtacttttaaaggacagacatatcagcttctagctttttgacatgatacctcaatgcattcttcccaaatttatgtaattgtcacacagttatttaataaaatcaaagtaaagttagccaaaacatctccctccccagcatcttcccatcatcacttctgctgctttttccttttctgtatctctgcttattgagtggctaatcagaagtctctcctcaagagcttgtaattctgtgttttaaattagatattttatttggatcctacccatattcttaatctttttcattgagtcaaccttattctctctgttgaatttactatatccacaaagagcagttcttatgatggctaatttctgatttatgtttctggtgcttgtgatagtgattcagtagatgatttaatgcacaaagaaggaggtcatatgctgggaaaagaaggaagagatagaaataagttagacgccgaatatataaactggtaattgagatgtcagttttaggccaaaatctaatagatcagcaaaccaatgagttggcagtccttagagaagtagaagggaatcatttaagcccagcactgattcatgaaaaaagtaagttatgctagagtaacttcatttcccttcaaggtagaattactttggtaagagaagaccaggggactacaaaggaatgactgtaactaggtttccccaaggcataatgaaatcttgtgagcacaaaagagaaatgtgaatgtggtaatactgtcattaagaatatttggtgactggtcgggtgtggtggctcacacctgtaatcccaatactgtgggaggctgaagcaggtggattgcttgagccaaggagttcgaggccaccctgggcaacaggtttgagaccatcctgtctctaacaaaaatacaagaaattagctgggcgtagtagtgtgcacctgtagtcccagctgcttgggaagctgaggtgggaggattgcttgagcccaggaggcggagg

SEQ ID NO: 76930 - DNA, 1030 bp, Homo sapiens
tactgacagttattaacagttatagttaatttataatttaccttttacattaagatttcttagtagactgtttcagtatgtattaagtttatatctaagtgcaattcagcttttcttttttactaatgagagtagttatcaatcattcattgaacgcatttcataaacagatttattctttacagagcctccactgtgcaatttcagtgctaaatttaactattatgacccttgactctcttctaactacatttgacttttattatcaatatatcatcaagcttactttcagagccaaccattctttctgcccttcatccacaggactcatttacaccaagattgtcactgtctttgcatttctcacttcttcagaccttcatgccagtttactgggtcattcggactaacatgattttcatcactaatgttaacatataagctagctccccttgattctgcctaacatctcctgggctttaaacccctgtgttaataccacctattccagagtcctgctattcctgacattttttcacctcctcattcttcctgtggactcgcctgacaagtcactgctctaggtcatgagcttttaaaaagcaggaactatgtgtttttcttcttggtagtccgtaagcacctaggaacagtgtccaataaatgtggattgaattgcactgaaatgaaataactgcttaggcatgtatctttacatatgatcccagtattgcaaagtacaagagagaaaaagttattttatagctaaaatcaggaaattataaaaacaggaaataataacaagagttttaatgaaagataagtgaaaatgctgtaactttttgtttgcatgtttgtctgtttaaaattgaggtataattatgtaaactaaaaaatcatctattttggctggacgcagtggcttacgcctgtaatcccagcactttgggaggccgaggcgggcagatcacttgagatcaggagttcgagaccagcctgaccaacacagtgaaaccccatctctactaaa

SEQ ID NO: 76931 - DNA, 1034 bp, Homo sapiens
taaaagttcattgcacgtgtctaaaaaaattctgcctcctcctgcaggaatgaattctgtttcgccaagccttcagctgctgtgtgtttgtgttgtggaggaggggaggggaaagaaagagaaattcagcaggcaccctgtctttttccaagcagctggcaataacatgctagctcctcagcgtggcacaaagagcaggcaaacagtctagccatgcaggaggtgtcttgatacatctttataatggcgtatcagagaggaaggttggactggggacatgagaggggaggagtgtgtgtgtgtgtgtgtgtgtgtgtgtgtgtgtgtgtgtgtgtgtgtgtttaagttccagagcatattgactccggaacttaatgtcataacctattgcttcgttgtttttttgtttggttggttcttttgttctattttattttcccacttgacttttagcaggaactcatacttagtgtctagcttttagttattattgattttcctaggaccacttgatttagtagattttgccaagccaaacttttattcttatttaatgaaaatacatagaaaatacatgaaataatactgcattcggttgttttggaaataggccactctagacaggctttggagtcagataacccacagcttaagtcttggccctgtctagtccgtgacttaagacaggttattcaaacttttaaaacctcattttccttatctctaatttgaagatgatgatatatacctgtgtattatcatgattgtagttctcaggatgtgatattgatattaccatatgtcaagcaccaaagtggccatttttttgtattatctcagtggatctttacagctgccctcttattagcctcatttcacagatgaaaaagcatagtatcagttagataactttctctgtgtcacataagtaataaatggtagaactgggatttgaacccaggtctgtcagcctgcagcatccaagctcatggctattatgctatatgctgcctcctgctgctaataaggcattc

SEQ ID NO: 76932 - DNA, 1030 bp, Homo sapiens
tttgaagtgaaaactaatcttatataaaacatcagtatctaaggtcctaccataaattttgcatttaggaaggtgtgaagttatttttgtttgagatctgcagaagggctgacatattttgtgtctgagtatgagttggacacaaataacacactaggcactgtttaaagtccagaaaatggtccttttacaagattacatctggatataaatacacatttgcctattttgttgtgtaggaatttagtttttgctaaaaaaaagatgaatagttgggattggtgtttttatttttaatttttaattttttccatttattaagcacctttctactagtcactgtaggggaaactaaaattaatcatatataaattcagccatttccagtgtgaatcacccagaagggagaaaaagtacacacgtaagtggctataatacatggtagaatgtactgtgatgagtcatacaaatacatttttctaagcattcagaagaggaaaagattatttctgccagagagaattgagtaaatatgatctggggagcctaaacatatgtttccgttttaagaatttgctttcacaactagtgagtgtcataagtctggaaaaatatcttgaagaaatgcataagcaactgccattcacaaaggattactgataggtggacttcgctgtcatcccatcctttagtttctcagtagaactgaggtaggtagaggtttgggaaggaatggaacatttgttgagtgcctactgtgtgcctaggtctttgctttatttcaagaaatccttattgaatgcctaggctaaggttacctacatgatgacctccaaaaatccaatgaagtaattttttttaattaagctcctcatcttctaaaggtgaagtaattttaactgcttatgagacagctctgagaagttaacttgaaaagatcacccactttgtaagtgacaaggcctacatttgagctgaggtacatttgaccgcaagccatgtcttttccatttactctgggtctctctgc

SEQ ID NO: 76933 - DNA, 1048 bp, Homo sapiens
tgtggagccaaaaccctaaggatctagatgtcactttaactttcaagcaaaattacttgcctggcagctctcaacagaatggcctattttcatgatcagattcttactcttttcaccacgtgttgtatagtttttggagctcctgggtggatctggagtacagtcacataaaacccctgattgctccccagattttctttccagagccagaggggtaagaatttgggttgatcacccacttttacgctgttcaaaagcaaaagagagactgtgaattggaatttgacaggaagtggggtggcgttatctgggggaacggtgatccccttaacctagtttcagattttaccttgtgtcctttgggccaaaatcaaatgtagtgttaagtagagatacttttttccatttttcaggatctttggatactccccaagttattttcgccacatccaaacccttgcccacacaatctgaagcccttgctacagttataggacagagaaaatcaaagtcggtgaagtcagggccaatttaaggtaacggtaagaataagagcatatttttatcattttcacttgctgactttatactacagcaagagacttagtggctaccaaaagaagttctagcttctcaaaatgacagtgaagttggggctttataaaccaaaacttagaaggatgctcccaaactgggtcaaagttgagctccaaatagtttgctcctataatggtctaccagtaggtggcgctgtggcagtaagaactttctctactattactagaggcttttgtttaaaaatacgaggattttaagacaattcaaataaagaaactaaaaccataattgagttatcacaaagtataacataatatatgggaaaacatgatatttgaaggtaaagttgcagtagttgcaaaagagaatggatatttattattaaggcttttagactagaatttataaactggactttcagattatgggaggcagggagggaacaaattttttttcaaattttggtgaggttgatgaattgtgtttttgc

SEQ ID NO: 76934 - DNA, 1101 bp, Homo sapiens
acacgtcaatgaagacagttttgtgaggggacaaaaggaatatagtctaagtttccttgtggtcttcgtaatccaagggtaagataatggttatttagaggattgggtgaattgcatgtgtcttaggcaatcctaaatataacttctctcaattgattgcttgataagaactagttgtgctcttaggcaaggatccagatacctggtcttttatcttactgtttgaagatgcgtctattaatatatgcttgggaaagcaggtggcagaggtaacatcttctgaaagctttggcagctaagcagtattctcgctctatcatgtggcatgttgattgtctgctccctgactcccatacacagtttcctctgcctaggcaccatctccccacttttgctccctccctccccaatatgcctattcctgtttgtcctcaaccacttttctcctgtccagccctaccctatgttaatctgatttagatgcttttgactctgctctttagaactctgtaattacctctatcatggcttttacaatactctaggatctttatggttacttaactgctccctctactaagcttgaaatttcctggaatgcgaggatcaggtccaagtggactctaaaactctagggtctagcatagtgcccagcctgtagtaggggcttaagaaatcccaattcagaaaagaaaacaaaaaataataaggtgacaaataaataaccaaaaataaaaaagaaattctgattgaatagatgaatgagtaaattttcatatttctgcctttttttattcttctactgacatttggaatacctgcctacatatgcaaattcttcctattcttaggccaagctcagtggctcacacctgtaatcccagtactttgggaggccgaggtgggcagatcactggaggccaggagttcaagaccagcgtggccaacataacgaaaccctgtctctattaaaaatacaaaaattagctgggcgtggtggcacacgtctttagcaccagctactcgggtggctgaggcagaagaattgcttcagtccagggaggcagaggttgcagtgagccaagattgtaccactgcgct

SEQ ID NO: 76935 - DNA, 1026 bp, Homo sapiens
aattaccatatgatccagcaatttcattctgtgtgcgtatgcccaaaagaattgaaagcagagacagaaacagatatttgtatcctcctaacagcattattcacagtaatcaaaagacagaagcatcccaagtgtccgtcggcagatgaatgagtcaacaaaatgtggtctatgtattcagtgaaatactattcagccttcaaaataaaggaaattctgcaataagctacagcatggaactttcaggacgttatgctaagtgaaatgagccaatcacaaaaagacaagtactatatgattccacttatacaaggtacctaaagtagtcagaatcggaaaggtagaaagtagaatggtggtcagcagggggtggggagagaggggaataggatgtttttgtttaatgggcacagagttgcagttttgcaggatgcagagttctggagctgaatgatgggatggtcgtgcagcgtgaatgcacttaatgccactgaactgtacacttgaaattgttaggatggtaaagtttatgttacatgtattttgccacaatttttaaagaaagattatagattgtgtatgtattataccccagattaggtgtttttgttttctcgattttgcatttgaggaaactaaggctgagagaagttaagtagcttgtccaagccacacggtcaatgatggagctgaaattcacacccaagcagtttttttctagaagctgctgaactgcttcttcatctgaaaactcggcccgtcaaggtgatttcattttatcagcttcctttcctaatggagctaagcggctggtgatcaggccctgtggcctccgcctccctgcagtgtctggttgttatctcaaatggctcattagggggatgcctggcagtaggggggcatgtgtagtttaggctggctgtctctttatccagccatttaactttctcttatttagatggagccagacctggagagggaggataaggagcaaggtgggccttctgcctctactcccctgggtgg

SEQ ID NO: 76936 - DNA, 1936 bp, Homo sapiens
caggaaaggtggtgtgcctaggggacagcagctgtccctgggcctggcctcactctctttttccctgtttggaaaggtgtcaggctcccgagtatttctgttgctttcgtcagcacagagcaaggaggaccttgactatagtttcacagccttaagcttcacctcatgcttcaaatccacgaaagagcagctgagaatggggctagctgtgccaccaattgcttctctcccattgttaatccctttaattctgctgttcctaggcacccctccctgacaccatcctgttgcccacttgtgatgtgattgaacaagtggtttggcctttgaaaggtgattcttagagatacctcaagtgacccagcccctggtttgctgggatgctcttggtgttcgtttccatggagcaccagagattgtctgtaggcgaaaccctttccaaccaaacccaactcaaaaaggaggtaactgccactgacctcctctgagatcctggcctagccgccagggtcattagggaaagcagcatttcattgcttagcaaagatagtgagaaagctccagttctttttggctcaaacagaagagtttatgtcctgacacctgagttattaaattatggcacagctagctctgtgatgaatgaatgacaaaaacatatatatatatatatatatatatatcactgtatttctgctttactctatcatttcctgggcaaaatgttattttatttataaaattcatccatctctttcacaaacctcagcttttatggcaaaacacacagacacgcactgagccacttttcagcctatatgtactcttttcagagagcattagaattaaactaattagaattcctccctccctcccctgagattgatgtatttctcagcattctacgatgcttattacactaaaaaaaagacaacttcctaatggcgtgaggacagagaaagtggcatgtgtgttgggggtaaaagggaatattcgagcattaacctgcctggtgatcgcagggcacaaggaaagcctcttctgtcctgggctgtccccttagttgtgataggaaggggagtagcaggaaatggaatctgccctggtcatgggattttttgaaagaaacaaagcatgatctgatgaagagcaggttaatcctgctatttcatttcccttgcagaaagggtgggggcaggattgtgatatgaagtatttagtttcacatctgttccaggaattatcctcggcataaatccatttttcttttaagcatcgtaaagcatcccagggagctcctcctcctgcccaccctccccacccccacagtttatttcgtggccacggagcagctgacatacttccagagagatcatcttgtcattgtacacaaggagggaatctctgagtcttagaagtcagaatttctgtggatcagtggtatcaattttgtgtactgctttccatgaagtgtttagaataaaactaattagcatagcagcagcgtagtataatgaaaagagctctcaatttaaaattagaactgattctcatctcagctttgctaccatttgtgtgaatttgggcaagtcaccaaacctctttggtctcagggtcctcatggtttcccaaaatgtgttcacaaaatacaagtcttcacagtcaaataagtttgacaaatgctatttaccctatgccacttcttagagttgtaatatattaacatattaaagactctgaaaagtctttcaataaagataccttttttttttttttttttggtggggatggagtctcgctctgtcgcccaggctggagtacagtggcacgatcttggctcactgcaacctccgcttccgggtttcaagcaattctctctgcctcagccgcccaagtagctgggattacaggtgcccactaccacacctggctaatt

SEQ ID NO: 76937 - DNA, 1051 bp, Homo sapiens
taccacagtgggatccacggcctcactcaaaagagagctatggttcccagatccctgacaagagggccacaatctgaaaaggggttcctggttagctcttttaggcttagcctgagaacagaattagcctcatatttttaggccatttgccatacacattttctctcattctcaactgatacgggtggggggagattttcgaaaacagtgatgttggtaatttatagttagtaaataaaccatgtttccatatgcaaggattcacaccaggggatcctgcccacaggtatctggaggtcaaattcgtatgtgctttctgccaatctgagccactgcctctgtgtctctgagaataatatactctgcaagaaggaaagacgcacaagcaatagtgcagtcttcttagcaggcggaagtcagcacggtgtgccccctgtgtaaggggagttgcgctaagcaatgtgtttggtgattgacagattctctgccccagattctggttacctctgattagtagatgcggacatggaattaagggtaattgaaggatatttatcgagtcagacatacaccttagaataaggcttttactgttctagaaacaatattccagaagatgaaatcatccaggatgccccaaaaatatttatttatacaaagattttgagagtaatattcatacttgtctttatacctcagtctatgcgtctggggccaagtcactgtgtggcacatgtgcagcttccccgaatgcctcacatgttgtagcacctgcttccaggaacaccaaatgaacacagggtcttggaggggaagtgggggaagaacccataatgccccaaggctgcatggaaccacaatccagaaatgtgcatcctgacctggaaggcgtctaaccaagtgtccaaggggaaatatgatcgagggagaggtgagaggagggacccagagggcagacaggagagggttgatttccaccctttcttctgcgttcagcatatccaaaaggcccaatacagttgatgggccaggaactgcatgacctggattt

SEQ ID NO: 76938 - DNA, 1064 bp, Homo sapiens
ccaagttcagtgtctaccttcctcctttgtaacccccatcaggcctttttatctttaaaactggttaggatcgcacttactaaaagattgggccccagagcaagtctttagtgtctgctgtgaaatctctaagtgttttgaaggtcaccaggcctgctgatacgtgaatgttttttagtacctggggatgtgaatgtagttattcattcattcaacaaatatttattgagcccctactgtgtatcaggcagtgtcctaggtgctggagatacagcaatgaataaagcaaagttcctgccctcatgtgattatgttgtagtgggagaagatgggcaataaatagactacatttaacatacacaaaaatcaggcagtaaagaagtttttctaccctatggatctatacagggtcttcaaaaagtttaaaaccttgaaatacttaaaaattattagagaaaacacctgtgaacagcatttagcgacaagatcattgaatttttgttttagcacaaccgccatatgtaggatgctgtattcagatactcagtgctgtgacaaatggaaaagggcaaccatggtgaagggatggaattgtctgacttgagaagaaaataagctgcttattatcagaaagattgtttccaccatccctgaaacctaaatgacactacaatttgaagtgtcgacattgcataagagtttttacgagctcttctgtaacccctctcagtttagtggggcagtcagtccttagaacatcttaaaacaagtttcagcagggtagagtggaaagcacccaggaaacccaggatctgaaatcagaaggctttgctcctaggtttatgtcagccacttcatcaccttcctaggcctcagtttcctcctttgtaaaatgacagcagtctcagtttctgtccattattgtgagaatcaaaggaagccacattaaatgagatctaaaagtgcttatattaatgctgttttttttaaacaaagtaagcaaaagtataaatatttcagcacccaagagtctgactaaataaagttttgtttatgtgctggga

SEQ ID NO: 76939 - DNA, 1026 bp, Homo sapiens
tctactgaggttgaaaactggtggccttcaggctgaatttggcctatagtcatgttttatgtgatccatacagggttaagaatttttaaatttggttcgcatttataaatcaggaaatgtaatatggaaattcagatttggggcttctctttaaaatcagaagccctggcacagtgagaatgctgggttgacattcccacatggcggcaattggctggtgctgcagctgctgatagcttacatgcatccatccctctccagttaactgcttagtactttgatacacctggtcagatttactcacatttgatctgcctggttcccatttccgtctgaattgaaaactcctgtcttttaggatagattaatttttcaagtggcctcctctatctatcagtattgaatctggttgcctacaacagaaacaacttcagtacttgaatcaaacaggagcaatttttctttcacatagcaaagagtccagtggagggcagagcagagtgggtgcagtcactggagcatgtcctgcattactctagctccttccagcttcctgctctgctatctggagcctgtgacttttgttctcatggttgcaagatggctggtcattctcctgggatcagatatgcattctaggtgggaagagagggaattgttgaagagttcaaggtgcatgccagtaagaagggtgtaccccttcttatcaggaaaacagtagccagagtcctcactaaggagagctctagtttcatttcattggtcagaactggatcttacagccacactctcagtttcaggggagtttttaatgggcacattaccacaccatagcatcggggtttcttggtaagggaggtgagtagaatggctcttgagtaggcagttcaaaaatgacatgtcaatttaaaacaaatagaaattatagaaagcccttttttttttttgtagccctgggtatgaagagaaaattattttagcttaaaaaaaatgtacattcttctccagtttttgttttggagttga

SEQ ID NO: 76940 - DNA, 1065 bp, Homo sapiens
gtgctggggccacttttcaaatggtatatagtagggatagtgaaatgtgtactaatttgctagccatgaccttgctctgtacttatagtgtcttctccttgggctcccacaactaaggcaagattaagaactgcagtgtgaaacctgcagtgtccctggtctcaccactgcgtgatacagagtggggaatgaagccaggcatttctctctaggtctcacatgatgggggccgccagcccatgggttaatgcttctctcacttcttttccattatcacccttgaggagtcttgtgagagatcaggtttcctaaagcatcaaggttacagcttgcttctactgctctcagcttgttccaagtcattccatcctggctttggttgaggtagcaaggctagactgtgcttatacaaagtcactaagtcatgtgccaggaggggttgcttcttagagtgttgggaatttacaccttcaatattatgcacatttctggctacacacatgctgggttgattttaataaacagaaaggagttaagagaatgacagaaatgtataggttttggtttatgatgaatgttgaaaagaatttttatgttggctgaatggcagaaagtatagggaaatggggcatgtctttataagtgtctgaaaggtatatagacccaagaagaggaagaagggagagctgatgtaggatgacccaaaaggatgtaattgagattaagaagatgccatccaaggtgggaaagtccagggtgaatttgaagaatggttttcagggctgaaatctgttctctttggatccgcctcttcaacaaactactggcagccctatcccatgagtcacttaaattgggcagtttgatgactctgtattgagctgtgggatatggctctttttattataggttatgtgtgaacatttgggaagtgcgacaccagtagagcatttgccaaacactgtggctgtcctgagcatcatgttatgtctcattgagctacagaactgtggtttcctcttcttgatttgggcagctttcaaggatatctctctcttcagggaa

SEQ ID NO: 76941 - DNA, 1053 bp, Homo sapiens
tttggcactgtgaaaatgcccagttgcccaccagtcagtcttgtacctaatggctttagcactcactgatgatcagctttctttcttatacgtaaaatagactttgcgttttgatatgtccatttcagcttgagagaactatgtttattcacaggagttcacttataagattgagtgatccattaccttccatgaccttaaatctactatggagaaactcagttctctgagggattagttgtcagacccagggttgaggcaggaggaagaaactgggagagttggaactgtgcgtggaggacagattgcaggagtagatgccagccctgaagcgtatgcacataccgtattactatcagtcttttcacttgccaagcatataaagaacaactttcttggatcttctctaagattgctggagaaagaaagggaagtttgtttttagtcagtaatgtaagattgaatgtgggagctgcattgcccctagaagctggaagatggatatgtgtgaagtttgcaattgatcttgcttaactaaatgtctttctgttggaatttatgcatgtatttggactggctttttgaaacaggttgcaatttggacttagaactcttggcctgattcatattttggggttagggtggagtttctccaggacttctgagagtgtgtgagaagtttctaaactcagaaggctccttttttggcactgcagcatcttttctgttttggcatcttaagaatctgggggaaccatataaagatcagaaacaagtctggccctaaagactccctctgacatggtaattccagttattgaatcctagcccattcggatgagaccatataaagaggccatttcctgaaattcccgctctctgcctctcacaggctcctttttgtagaaagctggtatttcaggactgcaaccgccagtcacgtgcttccaactctttactcacagtcattcctgccccctgtttatttttggagagaacacatttttgctgcttttcaggagctatgcagggtcctgccccctccgtccatca

SEQ ID NO: 76942 - DNA, 1003 bp, Homo sapiens
tcagtgtggggctgtagatggcagatgccattctctctgagctggatgatgttgggtaagatgtttaccatggctgagcacctggatggacacattgatgatccctacagggtgattcaaagactgaaggaaattacatatgtaacaggaatgttgctgttgtgtttagccctcccagcctttccacagcttagactagatgctgatccctgtggttccatattgaggggcggcagagtgtggtgacagccgcaggtactggagccagctgcctggctttgaatcctaactgtgccatttattatctcagagaccccaagcaagtaatttaatatctctggtctccatttctgtatctctacaatggggttaaaaatagttcttacttgaaaggatcattgtgaggattaaatgaattcgtatgtgtaaaatatttagaagagagatgcatttaggaagcacttgtagatgttggctattatcatgatgatgatgactgtttcttatccccattctgtcctcatagataggctttgaccatattcttctcacaggcattctggcaggtggtgatgtttgtgagttgcaggagctttgggatctttatggtgccataaatgcttcatatgaagggtcggtttgggagaagtaattccagatcaagaaaagcaatggttattttgattatgaagaatcttctttaattgtgaactacattaaagccttaagcataggaatgtcagctttccaaagctgtagtatcagaagtattttttaaaccttatgatgttaagaattagccaggggtgttcaagagagagaatacagacacagattcttagtttctgtttctggttgggccagtaaaaccccttcttcattcctcttttctgcttatcactagagacagaaactaaaaactacgggttcaggctgctaaaagcctaaaataaaacaaagcagaacaacaacaaaataaggcaagttggacaagtttgaatta

SEQ ID NO: 76943 - DNA, 1008 bp, Homo sapiens
aggctaaaaagtgtgaaaagcaaaaactcatggagccagagggctcctagatctgtaagcacagttgcaaacatacgttctgtccttttaaaccggctctgttataggctgtccatccccatagaagtcaatttcccagaaaggtgtcacagagggaaggttagctggagctgcccagctggtgtgccatgtgctgcactgtgggtgccagtgtgccatgatgtgggcacaccctgcctgtggggtagacctagccaaggcccctaggctggtcacctgtggccatgagaagtctcatctgtccacccatttgtgtgttatttttaattgcttcatgtcttgaaaaagacagggaagtactatgtcagacatatataagggcacacagttatttagtctcaagaagatatacctatggatgtgaacacgctttatcctatatgaggccaaggatgagtagaaaagcttgacgatatataaataataaataatgcaattgattcccttcctcatacctttcctgctgctgctggagataatttttattaattgataaggactgtttttgtttgttaaccatcatgacattaggatgcatatcaaaattaataattccttaatgtcatctgatatccaggtcatattgagttacttccattgtctcaaaaatgtgttttataggtggattgtaaacagaacaaatcaaggtccatatattgtatttagccatttccttccttccttccttccttctttccttccttccttttttttgtttgtttgttcgttcgtttgttcttttgttctttcgttctttctgtctttctttttttttttttttttggtggagtctcactctcttgcccagcctataatgcagtggtgtgatctcggctcactgagtctccgccacccaggttcaagcaattctcccacctcagcctcccaagtagctgaaactacaggcgcgcgccaccacacctggcttatttttgtatttttagtaga

SEQ ID NO: 76944 - DNA, 1052 bp, Homo sapiens
tgttggtggacatttaggttctttctttctatttttgccattatctgtcccctgagtttttttagacagctctagactttaggaaatttgcaccttcatcctcagaaacagattctggcttccacgaaagtgctgcagaacccatttgtggagagcccacgtgtcttgtccagtccttgtgttgtatggacgaggacacacacacacacacacacgtacacacattatttattgtgacttcttttgctggccactgtgctaaacacagttatctttttcctcaaaacaaccctatgaagtaggtgctgttattatccctgcttgcagatgaggaaactgaagagtaaaaaaaaaaaaaaaagttaagtaacttgctcagagtcatacagctagtgagtagccagccagaatttggacccacgtaagtctgatcctagggatcatggtcttattctcagtgctttgctgccttctgtttttatgccccttgacacctgatacagcatctttgcccgtggtagaacctcagcagatattccctgagggctcttttgacaagaaaccaacatgttcagcttgtgagaataatagcaaggagtgcatgcatgacctaagcccttcctagcatcctttggcctcgctctctgcagagttgtgctccagccagctgcctgacccaccagaagaaggtgagtgcagaggatgcagcctgtgcttaggggtactggccaaggccctgccagccctgccattaaaaggcttaattaggctagtcattaagttcaattacgcattggaaatgattgtcccttctaaccctgcagtgccctccaagaactggatccattcccaggcagcccgctcaggagccaggttctagttacaggtgcacctgtaaaactgcttctggtttcggggcctgtgatgccatggcagactagggcagagtagcccagagcgaggcactccaagtacatgttaaatcgggttaggtttctgcctttgaggccatttcctaagtgccaccttctcttattgggccaccttttccc

SEQ ID NO: 76945 - DNA, 1571 bp, Homo sapiens
agaagtcatattaagcaggaagaaaacaaatggaaatgttaagagcaggttaactgtttaggagaggagtataaagggggaagtaacatttctgtggaaagttgtagcaggtctgacaacagctaagaaaaagagaaacagaacaaggaggaaaatgccttaaattcttaagtaggaagagagtttgggtcaactttgttttgcctaaaagtaattgaaaaagggaagaggcaggactgcccgcccgcctgcctgcctgcccgcctgccttcctccctctgttccttccctccctcctttttttttttttttgtcattgcagtttccaaacctgcacactacactgtcttgattgagatttttagggctggataaaccagttgcaaggaagggactgcgtgggggttgtcagaatggagagcagtattaatggggaacagatgtgggtgggggccagaatcaaggggaggcagggttggtgatcattcacagagctggggagagacctgaggagctatggagtctggccccttccgtttggagatggagaaaatgagaactagggaggttaagtgacactgagttatagaatcttagagttagaaaggcccttaaatgtcaccttgccccactgcccaaggtcgtacagctaattagtataatagaatgtgcctctcgttctgcagccgtgcccattctcaaaccttgagcgctgcacgcatttatctcaagttcacaaaaaggccatgcactatactatttgtgcaagagtgagtctgttagaataaaattgtctttactgctaccctctgggaccctcacagaattgagatgttgatcgtatgaagcaatcttattgaacaaaaaaacttccaaggaaaaaagttgtgtcccctgagccagccagtctctgctaagggggacctgctgctttgcagagtgagcagctgaaagccaggagggaatgattagagaggccaaccattggttaaaattctccgaacataaatgatctccttgttctccctttgatggattcggtctctcaaaaataaaatgcatctgtgaacatcacacctacttctttccttttcttttgagtcctgtatggagaagtacccaacagcaattttaatatagatgaaacaggttgggcacacataggtataaatatgcataggaaatggaggcccctcacatcatccgagttttttctggtctagtgggtcggtcagtgattttaccttttgacccatgctgcccccaccagagctgaatactgatggctacaccagtttctccaggtttcacagcacccattgtaaaagagcccacgtgttgaagtggcagggtgcccttggttcttatttaccagggattcaccagggtgggccctgagcctcccaggaggctgccacacatggtcctgtgctcccccagtggctcgcatgccagcaaccagaactgaggcaccttctcttcatgtacctcatgacttgggtgagtctcagtgtatttatggggtttcggggaaatcacagaatgtaaaagaacagaagcagagaagatgg

SEQ ID NO: 76946 - DNA, 1069 bp, Homo sapiens
acatttggaggagggggttggggacgaagagggaagcctgtggggagtgagagtggacatcgggcagaagtgcaattcctcagagccccaagacgctgggcagagttgacaggacccaaatgctaaagttgtggagggaaaggggagtttgggaagaccctgtcctgagccctaaactcagcacagtgcattttcttaccaacttctgaatattcatctcaggctggattctgcacccgaggagagccaggcacactccaaaactgtcacactgccgatggtgcgtggcacagccagcttcctctctgtccctccatagggcctgtgcagtcttaccagcctggggaacggcattctcagcagcctgcacaatggactgtattaatcacgtagaacgagagggaaaaagaaagctaaatttctattagcataagaaatagaatcttagagcattccatctccaattctctagcaggatagagagatataatctaagctctgaacagcttctttctagctataagacttgctaaatgtggttcattatttggggggtggtggatgtgtctctgctttattttccctagcagcaatttctttctatttttatcccttttcactctttttatcccttgttttctctgcctgtctctttctgttgaattttctctgtgtctgtctctcctttgcatgctctctttttccaggtacaacatctgtgcctccacagtcggaagtcataataaagacaccaggcttggaactgacatttccatcctctggcgtcacttgactagagtgatcaaaagtcgaaatcacgaattgcctgaaagtggcaagggccttctcagctgttgttgaaatgatttgcacctctttgaaaactaagattgaattcagtccatgaaagcagaaatgaaagatgtcttcaccagtctacctttgggatttctccttctttccgtgtttacagttgctttgggaattccaggactgtctcaccccaccaggccttttttcttgcaccatccctcccttctcccccacccctgaccgtttaaaacaaaat

SEQ ID NO: 76947 - DNA, 1041 bp, Homo sapiens
accccaggccagggcgctgtgcaggctcagagctagcctttcagcatgctggaaggacaggcgtctgtttgactcttttctaatgacctgctgggtaagaaagtggcagagggagcactcgtcttctgggatggtttttccaaggcaatgggggtgagggggagccagaggggctagaccacgtggggaggacacagtggcccatgccggagcaaggaggcctggcttgaagagctaagccagtctgtatttggggtggggtgtcatatttggacttagaaggaaaatcagggttggtatctcctgagggccctttgagcatttgtttttaatgcatattgggaagtgctctgtggccagacaccgtgttaggtgctattcacctagatggctttgcacgtggttaagactaagagtaaagtccctgcagggcccgtgttagctgtgtcttccttcatccctgcagtgcccttgttagctatgtcttcctgcatgttaccaacctccaataataatactaacgaacatgtctgaagctcttaccagttgtcaggcaacgtgcaaaatgctttctgtacattatcccactcagtcttctcaattgtgaggtgggtactgcaatcatgcccatttcagagagaagagaaactgaggcttaagcccaggcctttctcattccatcctcaagaagcaccagatgagtgagtagtgtccgtccctgttttgtgtttctgttggtgatctgctggatcctcttcctgacttggggtgcagcaaagttctgtccctcctctggggtctccctcagtgaggaacacacatccatggtcaatgccgggtggctctgccccttggaagctctgcccattgactttgcataaagggagcactgaacccagggagtctcaccttgcaccaaggacatcaggttttccttctgaccacctttaagtgggccactaagttgttttccttgagtctagaggcaaaatggcaacacctgccaggaagggtttctcagaggtagccacctggccctgg

SEQ ID NO: 76948 - DNA, 1053 bp, Homo sapiens
aattcacccactcatccatttgtaccctccttccatggactaaataaggaatcacaaaatgatgaattgtaattttgttaaatgccatggtgtcttgagaccatataatgggggcacctaattgcccattactttatgtcacaaacacacaaggtctctagggaccgtgtctcccagatcgccaataccatcgagtgcatcatcaccttgttcctggcacttccccgtgcacctctgcctgcgctctctgagttctaggaccttgccctcacacacacctgcctgcatttatgcatataacctatggcactgggccaccctcgagggcatggcagcacgaggggccttgttcatcttcctgctattttgccacatcaggcatacatgagtcccatcagagcattcctgtgtcaactccagacgtgtgtgtgtgtctggataggtgtgtatgtgcctcttggatatgggtagttatgttcttggtctgaggactggggggatactgaggtccttctggagagtggtgtgagcaactccaggtgtgtgggtatgtctctgagcatgccctgggccttgaatcattcccagcccatcaccagaaccctccactgtgttgtcctgccagtaattacagcagataaactgctccagttgagggctgctgtccccggctggctgccagccatgcggccccaggctgcgccgtgggagtccattcattttaataagaggtacaccctgtgttattaagaagagtgtttattactgtcgccacacactgacagcaacttccatcatcgttaaacggcagatgcggggagggtaggggggctgtgcactgcagctttgcagaggcacaggcccagctggtgaggctgaggagggaggggttgtctgtctccctctcttaccgcagaactgcatggcaccccctttcccagacagaattgagcttctgctgagcctgaccctgttcgaggtgggggttggggccagcaaagggatgcaggaggggactctgctcgacatctgagtgctgtcccggagagggcg

SEQ ID NO: 76949 - DNA, 1054 bp, Homo sapiens
tctggtgggaagagacagatctagaatcagaatctctgggttctatccctttctttcactagccagctccatgggctgaagcaagccagttaacccttcagactcactctccatctgcccaggtgcagggagtgctgtctgctgggggttattgtgaggctcaaaagcagtaaaagctataaatggtttgaggaagttaatgcatggggcagacagatgtaagaggctggtaagagggggtgaggtggaaaaggagatgcaagaagaatgaagggctgaatgagaccacccagaagccaggcctgggctgcaggggcttccttggggtcatgtttcttgtggagaagaggtgggtgatgtcaatgactggagctgggagggagggtgagatggcaggtgtctcacggagtgttgatagcttggggcacggagtgttgatagcttgccctgtctgaagatctgctcattctaatctgataaaaccaatgcagatcaaatattgacagacacctgtggggctatgtttggcttatgggccctggtttgcacctcctgagttagactcagggagtaggtaaagaagcacttggaagcctgctggtgtcttgcaaacgagtgtgtttaaggataatcaactcatgccaactcaagggtacacccacagaagggtgatatgactacccaggccagggttctaggccaacagcattccattctttgtcctgcaccttggtggagacaggtgtcttcatcctaattagtgaagcttagagaaaggccccgatgagtgctacagacaacatgtgacatcatcctcatcagtgccctcagtccagctggcttctcaacatgtaggaagcatcacacccatgcctgattctcctgccctgtctcctacttggaagaagttcctgattgagctcttcagagaatcccatccaaggaggggctaggccagggattgctttgcctaaggctggttctccttccttccctcccctccgtgatacagtaaagccgcctaagagccagcatctgtggtcctgctgccctt

SEQ ID NO: 76950 - DNA, 1042 bp, Homo sapiens
cattccagaaaatatggagcaatagaaagaggggaaaatcccctaaatacaaagctagcattttgatgtgctttcttctagtcttttctcctatatttctttaacttattttcccaaaagcccccagcccagagcatgtactatgtcaatgaatgtggagtcagggtggaaacctcatttttctcctctgaccccattcagagtggcccctgaggacatggtttcattctgcctggtgcccggacacagcaatggtgatacaggcattcggtaggctgatctcttaatccagattggtgtagtcctttgaaactgaaagtagctcctttttatgtcgcctgcttctcagcattaacttctctttgatgtaatttttgcttccgttgctctctcccttcatgggttagattagtgtgaaattggcctggctcctctggagactgcagtattaagcttcaaatacttggttcttattggaaatccttaacccacatcaggggagaaaagtggcagcattacttgggaatgagagagagagagtgtgtgcatgcacacacgtgcgtgtgcatatgcttacaaacgtgtgcaggggtgggtgtagactaagaaggagagaagcacactggcaaggggaaggtggggaagaggagattgagattcttctccatttattgagtgctgaggatctgctcatcttaatcttaggaggaaggggtaggaatgggtcttagggaacttgaaaacgtgataataagggtagaaagcctgtttaatttgctggcgctctcagtggagctgtccaaaagtcttggtgctgaagggaagaaagaaaggtgccagtgctggagaaagtaacagggcagttacgtaacccaacccacttcactggggttatgtctgcctctatgggtgtggcgcctggttcagatgtgaccttgaattgcacacaagacatggttaccaacattatgagaggactggcaggagccaccagtcctgctcttacttcttgttactcaggacaagaaattagacttggcac

SEQ ID NO: 76951 - DNA, 1097 bp, Homo sapiens
gacaaacatatttgggggctagaaaatttgacctggagaagtgacttttgcgaagttttcactcacttttttgcattcttcccaactctagctgtgagtgttggggactgtttgaaagtgagtcctggggagaggggctgagaaggggcaggaaagcccatctacaaggccagtggcttttcccccaacccagtccttcccaaattcccacagcctccagatccctgcaaccctccctcccgcttagctcaatagctcttgaaagttctctaatcacctctctgcttcctgcattaataagcctctcatctcactgatggcaatcagaatatttgcttatgaaagggacacggttaataacacgattgctcccctccgcctccttccttcctctccttccccctccctttccctcgccctccacacaattctctcaattaacgataggcagaaattaatttttcccctcgatcgaaacaattgcagggaagcggattgccagtgtggcttcagatagggacggctcccagcagagtggagagaaaggagcgagatgcaggagataagcaggctctatctgcaggcacaggacagagtaatacaaatgttatccttagaaatgtacttaaagaggatatgtttataattcggaggggattttcgggggctctcctgccctccctccctctccagggcactccactcaactcacttctgcatacagaacccagagtttgttgggaattttgatcctgttgtctcgaaatgagtggcatgggcctgcggtgagaagggagatcaggttatgcagggggtcttggccatggtctgggcccagggcttaggccactattgatagggctctctttgtggccaagtgccaaacaccaggtgtcaggtctgactgttgtgtgggcttttcaggtgagggcctggcttatctgccatctttaccaacccttctgcaccggcctgcactcctggcatgggcctccctcccagcccactccaccacccaggtagagaagcagagtcccgtgtggaagccaagatcatatcccagcacaatgggcttaagaacacagactctaaagccc

SEQ ID NO: 76952 - DNA, 1022 bp, Homo sapiens
acacccctccttgtcccctgccccatctcctggcttcctgtggctccgcccaccgcggggcggaagtgggtgtggccacgggcggaagcactgggtcaggggcccaatcgtgcagccagcccctcccactcgccaccgccccacccctccggcccagaccggaaatgaggtcagagagggaagccccggcggtgagagtcggcccaaaaagcggcggccgttggaggtggctgcggcagctggtgagggggaggaatgggttgagagtgttggggtcctgggggctagtaccagaggggatcggagcgccaagccgcggctgagcggctaagggcgtcttggggctgcggcagacggccggagggtgagggtggtggggccttgcttttcagggcccttgtccccatccctggggatgtgggtcgggccgtctccggggccacagccccctcttcccctttcttctttctgcctctctggggcgggctgcagcctgagggcttggtgtcccgagccatggtcgccccagccctcagggacgggccggggcgtggtggagagtccttcgaaacacagtttttgtcatatatgtggccatgttgcgacccccgatcccggagggagctcagtcgccaagacttgcattttggcagtttctgccctagaagagccgatccccgcccctcgtgagcccaaatgagcagttgcctcctgcctctcccacctcctactccgcccctcacttccaccctgctcctgtctctcttcttacttgctgtccaccagctacccgttccttcctgtgcgtgactcagcctcatctctgcccgggtgcgtgcctggccgccgggtcctctcgagagtgtgcatccgcgactggagatggggagttctagggttcttttgtcactactgttggaattacaggctttgaggcaggaaaggattctgcacaggcattcgactgcaagttgtttgatgacttcgttccatgttcaagtttgtgctgttctgcctgaggt

SEQ ID NO: 76953 - DNA, 1039 bp, Homo sapiens
ttccctctgtcaggaaggctatatgtaatagaaacacagttgtttctaaaaactgtttaaaacgcgtacctcaaatgcaaaactaataattttattttaaaaaacaatttgctgcttattatgccatacagtttatacataaatattgttgtttagaactcaggtctcagcagaggctggtgtgtgtgtgtgagagagaatatgctagcgccaggtatacggagtttataaatgttccattaagttgcctgtcctcattaagaatcatggctttagatgctttttggctataattctgttttctgctacttgtggtttgattatattgaatttatttttttatggctgacattcaaattgtctgaacacatggtgggctttgaaaataacagtaccgagtcccattagtcttacatcagatgtgatcaagccagaaaaatttgtctctaatgggtacatgtttaaaaatgtaagtgtagttttggtgactttttattttttacatctcagatagtcctaggaacattgataccccccagcttgatactttaatgttattaatattaatctgtggttatctttttcttaatagtgaggatgccattggtgttttggatgggacaattctttatggtgcattgcagaatatttagcatctctgcattattcacacccccttttcattgtatcaacccaaaggcctccaggggtgatccctaggtggattgagtactcccagttgagaaccagtgtattctattattgttaatattagttggcatttattaagcactcaactatgggccaggcactgtactatggacttagcatatactcttatttaatgttcacaattccactatatggtggataccactatttgtatttacagaagggaagttgaggttataagagcttagataatttgcctaagatcacccagtgccaaaactgggaatcaagcctgattccaaagctcattcttaaccaccatgttgtgctgccctttgagttgttctgtctcaatttaactttccca

SEQ ID NO: 76954 - DNA, 1915 bp, Homo sapiens
caagtttgttttaatattgagcatatataccaaatagaagtcttcttagtattgagaatggtgattttaaaagtagccttttgggatagtagctttgtgtatgtttcttccccttaatttcttgttaaactacgacataattgtatgtgagagagcgactgttaactctgtctgctctaacagcccaagtatggctccagatgcagagcctgttttctagcatgagatgcttcactcttttctgttccttcttactccagacacatctattgcacattctagtcaggatgtaataatgtaaattctcgttatctgagagtctggataacttaagtggatgggaattcttatgaaattcttactcttttcaaattgaggagaactcattcacccatttgggctattatcctggcccctcacttcagagttctttcaatatgtagatgctaaagggttgtagctgtgaaggaataatgggcggagtggtggcacacacggcattgaggaaagttctttaaaatcttctagttatttaggagttctaaattccccttgacttgtctcgattcatttgtagttacaaacagaagtgctttgtattttttccccctgaatccattctgtggggaaagggggtgattcttactctttgactgaatgttgtgttcagcctctcttcaagaggagagtggaactaaaatctcccttaattgttaggcacacctttaaaaagggctggcattagagtgtaaggagataatagtatatgatttggatattatactgtcttgatgagttgattctgtcaataattttctactttattttttccctgcatttttaaaagaaatactttcaagaatcttcttggttaccctttcataaatctacttggatgtgccactgtttattcacatacagatcaaaatgtagaattttactttttagcagtggtattgagggttgtcagagtaatgatccacattgtaagattattaagatgaagttgattgttaagcttagcttagcctagtcaatggtagcgttttttttttctaaagcatgtattagatgttttagatttgaaaatgtgtgtctcaatcagcttatttctaatttccttaaactcactctttgcgacctaaacatggagtatagacttcatcaatatttgtttgcttttctgtttctggtcttcctttaatattacaccagccaatccctcacaagttttgaggaactaaaaatggttatagtatagtagtttttttctgcttgcatagagatcaaactattattttaatatttttctgtgtatgtgtgtttgtgagtattctaaagcagaacaactactgtaaaattattttctactgatctttatttaaattgtctgtatagcaactattaatagctattagctattaggtgactgtagcctaattttgctctattctttactaacacatcatttgtttgttccccttgaatatagtttagcttcttttttttttcataagtgaattggttgggtgatggccagaggtcacattcaggagccttcctaaggtgatgtattagaggctgatctcacaggaaagaaaatattctcctctcttggaaggcaagtgacagagatagagtgctaaacctacccactccttctccagcccaggctgaccttctgcggccctttggtgcctcttgttttcttatttttatagaaaatcaatatcccttctgatacaaacaatagctcagaagcaagaataagtgggagaaagctgagatctctgtccatcacctctcactttaactcccccaaactctttaattatgagtgtgctttgctccaggtgtttgtgacagtgaaattgctaaatgaggaccattttaaccaaagattgggtgatcaata

SEQ ID NO: 76955 - DNA, 1694 bp, Homo sapiens
aaccagataaatcaaatttagaagcacaccatgagaagaaacaaaatcaactgtgagcaatagctcagaaaatgaaactgggcagaatttcgtgggacaaaagttatatttcaatgagttcaaattaagtttgtttttatatttttgtttttaactttagttccttttttcagaatgagttttgtgtatctgctcgatatgaaggaggacagtaaattcagaaaacataagttttgtcatatttttttcttgttcatggatttttgtttacttctttgtagatgggggaaaacttgaaagatgctagatgtcttaaaattacatagcttcatttgaaactgatagttggcaatatttgagaataaaattgtttggtaaatttgtaaatttgtgttgttgaatataccaaactaggttgagattacgtctttgagctttaatagctttctagtcctaaactaacaaagtgactttagatttttttagtactttaaaatataagtgaaaattttagaattctcctcttatatttcttttgtttggggaggaaaataaaactttgtagcttcctgatgaaatttacatatctgattgactaacaggttggagtgaaattagggaagcttgaaaaccaaaataagtgtacagtgctttgtttttgactggagctgatgagttctcttgtgttttactctttttacagtgaaaccagcagtgtgtgtagcagcagtgacactgggctctttaccaatgatgaagggcgacaaggtaatgtcgatcccagctttgggaccttggttccgtgtttatggaaatatttgaataatcataggagtgactcatggagaatatggtgactgtctatggcagtggttctcaaactttaaggcatatgagagtcacctagggaactgttaaaactgcacagtcctgagctcctagaaatcaaataggtctagagttggcccctggaatctgcatttttcacaagcacctgaagtgattcttatgccagtagatcagacttgggaatcattggtctaggtggtcagagtgttgagcctgggacattgggaagtttctttttattagaataaagaaataggttcatgtgttactgtctttttttaggtgttaagacattattttcatatagagaaaatcttgtcacttttgtagccttatttataaatgattatagtgtcctaggtgaatatattatataaaacatcatcttcctcaaagtaaaactggagtatagagtcctgtgaataaggctggtatagttaattaccagttctttatttttactacctaaacactaatttaaaactttgcctatatataagggtattttagaaaatgtttgtcctctagacttgtgtggggccacatgccaataaaaattttatgtagcctttttggactgtggttttcttaatctaaataagggatttagggatttctaaagtctcttctcactccgaagtccaataatttttctccacgggttaagcaattaaaggacagacgtagtggctacatgtctaggttgatccaagtaggctccccagtaactgaagagatactggggctgtgagacttagcatccaagtcctgatttttggagaaggactgtggggccagcatcttgttcatgcctcgaagttgtaggcatagaggcagtttatcct

SEQ ID NO: 76956 - DNA, 1397 bp, Homo sapiens
atattgaagtacagagaaactagttattatacactaatgcctgtattcagttcatctatgtatctggtttcgtgagatgcttttagagtagcggttctcaaaacgtggtccccaggccagcttggcatcatgagggaacttgttagaaatacacatttttggtcttgcccagactagaatcagaaactctggagtaagggctcagcagtccatgttttaacaagccctcctgctgcttcagatgcatgctcaaagttgagaactactgtaagagagacagctgtttgtggtgtgtttttataagggaacactttgagtaactttcttagttgtaatatctcctgcttttcaccagaatgcagttttcattgcccattttggagatctccacagtgatttaagagttattatcctgcgtgttaatgacccatgaatctcatacttcatgggattgacatttctgagcaacttgtctggaatccagtgtacattagagactgactacattatgaactctttagatattcttgtaataatttccttcaattttgctattttgcaaggggtatgtggtggcagacatacaattatctattctttgttggcaggaataaactctagtggaaactgagatactatcactatagccagtagaaagaagtttgtactaccaacagtctggatatatggatctggttgtgactttgctgttaattaacaaatggccttgggaaaatggtataacttattgaaaagccttaggggattatgttatttgttgctgtggttattttttttttccgcagtagcttggatttctagtgtcaagatgatttctgtcccattaatgagataccaacgataaatgaagtatggacatatattctttattcaccttttatgataaaggcaaatatagcaagaaatccctcaggtatagctagctttgaattgagaaacatttatgggttttgaacctccaagtttataccactgagaatggtataggggaggcagtttgtttttgtaataaagatctcaggcttttgagttagtcaggctttgggttcagatcctggcttcattgtttactaaattgaccttgacttctctaggctttagttgccttgtttgtaagttggagttagtgtagggcttggaagagatgacatatttacagatttttagcatggatcctggtaggttgtaagggtttagtgagtggtagctttatttatttatttttagctattaaagcggtccagtctaacacagtatgacatttatgtgaaaccaggttggtgttccagttttcattgtaaaatgaatcaagaaggaccagaacaatgccttgatttatttaaaagtataatcagcctgtaattccagcactttga

SEQ ID NO: 76957 - DNA, 1168 bp, Homo sapiens
cttattgttaacagggatagctagcagaatagcagtacatggggtggaagaaggagaggttttacttttattgtttaggcttgacagataatgttccccctgccacctgtgttactttctttcagctcttataaaataagagccatccacttccatggaaacaagtcactttatcttgaaggtttccctttagcttgcctggaagggagtgagggcctgttggatgtgcctttaatgatttcaaatgaataggataatatttacttgtttaattcatcttcatcaccttaaagggatatttatcatttctagaagaggtcaccgctctgccccccttcttccccctcccccatctctcttctgcttttctaaattgtaatcataaataatgagtttcattcacagctccctgccagtgagctgctaattacacaaagtactgcttgtaatttacacagtaataaactgtaaatttaaacattacggcactttaagttaataatttttctgctgtaacaaatagctcatttttcacccatcttttcccttggcccccctaccatgtctgtctgtgaccaggaggcatagctataagaaatgcagaacatgaagaatatagtatatgaaaacttctcatttaactccactaccgcccggactctgacctcagagtaatttttctacagccagttctgctgaaatgtgtagcctgatgtttagcacggtccacacacatagatgaatatagacacaaatgtgtttgaagaacagccttgatgttcttggcattcacgcccgtgacttgtgttctctcaacacaacagttactcagatgtgtgttggtatgctttcccaggtgccatggtaggtaagcattgtgaatgtactcaagttaaatgaagagtgaattgccgttttccaattttttggaaatggttcgtttctgaactctttgtggtgttatgggtaagcttttacactataatcttgagaaccctgaatttaggaatcaattttatacaaatttctatttttatttcatgagatgatgtttgagggacaaagtacagagtaacaatttttgcaagtcacaaaattctcttgatgtatttatatttagtcagcagatatttacattttaccagtgaggatttggtaatgtcccagg

SEQ ID NO: 76958 - DNA, 2035 bp, Homo sapiens
ctttatgtgtgaagctttgtgatttttttggaggattgcattatcttggtgattagttgtaaaatagatgaacactgacaggtgaaaagttgtaggcttcctgtttgttgtgggtttttttgttttttttttttaacaacttagtagcttactgagttgatatacacgatccacattttagacttggaatcttcattatgaatttgctgtttcaaaatgaactagagtggtagaagacataactggtgtatatgtatgagatgattttagatggcatatagatgcccaatttttaagttatgtattatagtgtacattggaaaagatgtaattatggtatcaagcctgttatttcacggaaatatagtaaggacaaagctgagcaaaaataattgatatgaggaaaaataataagtaaacagtagtacaggttgtaggcagataaggaaagtcatgaaggtggtatgtgagagactgcagtttggggaacactaagctagagcactaatcatgtttgcatcagaggatccaaaggcagaaggggacctgtggcagtcacctgatccagatccgttatttgcaaatgacgaactggagatctgtaagattcaaactatttgcccaaagtgatacagctaatagaaccaagattggaacctctgtggcagatagaacagttgcttagtttgtattctcataaaacaagtttgaagttatcattccgggttcttccagtctttgtatgtcagagggtattaagttctaaactttttagagaggactgttatgttgtgggaaaagtccaaagaaagctagcaaacataaagtgagggatctcctttgatcctcacagccaccttttgaagtcaaatagatgttttgcagatgagaaactgaaattatactctgaaagcaatatttcatttagccctcataataaccctgtaaaataggtagggcaggcctggcacagtggctcatgcttgtaatcccagcactttgggaggctgaggcaggtggatcacctgaggtcaggggttcgagaccagcctggccaacatggcgaaaccctgtctctactaaaaatacaaaaaaaaaaaaaaaattagctgggtgtggtggtaggcgcctgtaatcccagctacttgggaggctgaggcaggagaattttttgaactcgggaggtggaggttgcagtgagctgagatcacaccactgcactccagcctaggtgatggagtgattaggtaagacagatagtgatatattcatttaacagataaggatagtaaagctcagaggttatgtaatttttaacacccagtatctcagtggtagattggaactaaaaggtgttctgattcttagtctagttctctttccacaatactatgctgctgttatgtgtcaaccggttattcttggaaacatttgccaggataaggaaatgaaaaggtaatttcatgctaatcttcttgggaacaagggctgatacatagttgataatcagcaggcacaagttcctgttatatcatgtggaaaaaactgtcttctgccatttaagtgactattgtatgtcagaagtttttgaaaaattgttgtttaataaggaatagctttttttttccgaggtgtgctagatcaggtttggtacattcataggcaaactatgaaatatgtgtgactttactgaacagtgcctgtgtttggtataacaagagttggatagtcaaaggggaaaagtaatcaaatgtaggttaccctttaggatcaggtccgtttcatgtaagccttactaaaatagtcttattcattcctgcagttcaatcccctgtctcccctttactccctggatgttcttgccgatgcttctcaccgaaggtgttcaccagcacactgctctgccaggtaattgtcttttagtagcggttatttgcttctggacaatactatattcctttctattacccctcaaattatagagtatgcttgtgtacagtatccaatttgatcctgacaatcttttgaggtaaat

SEQ ID NO: 76959 - DNA, 1659 bp, Homo sapiens
ggtgattaatatgccagccagggttaagaactgttgtcctaaatgcatatggttttgtgactggtgctttgtaatttgcttaatagggtctcccctttcataattggtgcaaactctgtactttggtatggtatgcaccattccttacgggaggtagacctctggacttctcttagctttggagaacctactgcaggtagagaagagtgttagtatctgcacggtgcccagcacatagttcttaataaatggatcaggggcagagttttgtcaggtggatatatggatagttggattgttggctgggtgtgtagatgaaatccataaaccaagtgttttggtttggttgttttggttgctagtattgggatttgctgttaaaggtgtgatacctggtattggtgttaagaattgctgctgcccaaacagcagatggtgtgattggcgttctggtagaggcagtggtattgttaagggcacagtcacaaacttgtaataagaagactagtgctgcaagcagtttttcccaaaatgagagatttgttgattgtgaaggatagtttttcttactattattaccaaagaaaatgatagctaggatttatcaattgctacatacaggtcagttgcatctatgtgattcatcaatcaccagttgcagtttttgagtgcaaaaacttttcatggcagtgttttagttttctccaactcaaaggaaaggtcaacttttagtgacctttcctttattttggaagataatttggtcaagcattaccattttaatttattctttctttaagctctgaaatagcaaagcactgatatcttcttttcatataggtcagcttcctttgtaaataaactgttttttctttgagaaatcttatttttagttgtggtaaggatggcagatatcagcctggtatgcaaatgttatacgtgtttcttaatgaatggatgaaaagtttcatagcttctactttcttcatagtccattggcataggtggtaggagattaagagtgtagatattagtgtcaggcagacctgggcgagaatccgggctttacccaggcaaatgacttaatcttcccatacctcaatttctacatctttaaaatggaaatatcaatactttttaaattggttgaatggggaccaaaatgaaataatatatgtaaatattgagcatcctggtaaccaatattatttttgttatgtagttactgccctaccccatccttaggataattgcaattttaaaaactttgagttggcttccagagtcatttgctaattagatgtaatactgattcttgaggtgcttaaatgacctcaaatggtctataagaggaggcatttggacagagttggggttaaaaaaaaagagagagagaccttcctgcccattagagagttgaaataggataggctgagctcatttgtaattcattttatctgttcacaaacgttatgatctgcatatcagagttgtgtgcccagctggctgtgccacttgacaaggagtttcaaagagtaagaagaagactcacttcatgctattaattttgacctttggagccataataaacagcctgaggttttacctcagggcttgggggaaggaaccttttattagtcctgtatctgttgatgctgt

SEQ ID NO: 76960 - DNA, 1050 bp, Homo sapiens
taaactagcttgccattcgcagacagactgttttctctccttaggagtgactctaaagatctttgttccaaatctaacgcagtcacttcagttattttttgccaacattggttctattaaacatgcatgtatttctcaaagtatttttttttccctaaaagtacattcctgccccaaggacatagtgatctgcccggtttcctaagtaacactgcagttttaacaactcacctgatctttcagttacctgcagtaaaaaagaaaatagaaatgttgtgtttatgcttggatagaaagaatcctctttccattaattgttaatttcagcattcaccttcacacttgtaataacaatttaatgactttttctgagataagaattttttttaaattcttatttaaaaataaaaattttttgcttttagtgctcattcttccaactctgccctggcaaataccaccacagtggggaaactatgacactcttaggggaagtactgatcccacacttacactatgaaagaagcgtataccccaggtttcgctggcctgagtgaagattgtccctgaggccctgatcagatgaaacagaacaggcatagcctgtcttttctctaattgcatatatactggggaacagtatttttatctaaatttatattcatttaatcattctattattctttaggttgaatacttagatctctattattgactaggttggctctgggaatttggtagatttttcaactcagtaattttcgaagtaggtaggtgcttatcagaattacccagggaaaaatttcaaaataaatatgttactgattctgctcccactcctccccagcctactgaattaggatcttgatagggacatgtgtatttagtaaaagctccttatataattcggataaccatttgccactccagttgagaatgaagttttaacttggtggagactttaacttatacttagccttttatacaatgtgcctaattgaaagatcacttcccttaacgtattacatggtttgcaacccaagaacaacc

SEQ ID NO: 76961 - DNA, 1080 bp, Homo sapiens
tgataccctagtttctttgttattcatattctgtaacctgaaaagctgtgcagctgcagataggacttggctataagatccatcaaggcagagattgtctcttgtttatcactatatccctagtgtttagtacagtgcttggcaagagtaggtgctcagtaaaaatttagtgaacaatgaaagaagcaacaaaactgcttagtagaaaggaaatagtccacaaaagtatatacttttacaataaaataattcacttaacaagtttctttacttgatttccttagaaagtcttcagttctttcctgttataaccagaggaatttacaaaatctgaaggatttaagatattcaaggcaacagttagaggtaggaatggggtggtagaagtagaccatttaccacagagagaagtaatatgctggaggcatagcagtcaagggtcacttaatgtagagacaattgacctgaaggcttaacaatatcgcctagaggagcagggtggtggtggaaggaccacctgagccattgaacccacaatagcaccctaagatgttgtggtataataacctgtgtgcgtaataataggtaagtaatacttattctcagtttgctaaagtaaataagcatttccattaaaagttgttaaaaactttaacattttagtgtataaatggtttttttttttaaattccaaaatgacactgtcattcctcgaaagtgtgagataagtagtactgactagatccataaaagagttgataatatgggccttttcccatgttactgacatatatcaaacacgcaaaatggtgaaaatgatggatgggggcaaataaaaggcagtatttgtgtagttcagctcaagttgatactccaagaattagtatcttaatatacttcttgagtacttatgcttctcattttgcatctgtctcatgaaactcagcatattgtaaactgtgatcttgaagaagcaatgttttaaattaactttttattgaaggataaacatacagggaagagtacaaagaaatatacacttgataaacagtcacaaagttacagtcaagtaacaagcat

SEQ ID NO: 76962 - DNA, 1025 bp, Homo sapiens
taaagatttttattttacttcttaatttgcatacagtacaatacattcttggggaacagtggtgaactaaaatagcataccacgtagttcagtgttaatcccattgtctttcacagaatcgtttgcttttaaaataagctgagtattcagatgaaggaacatattgtcacataattaatatttttatttttttacctgtaaaataaaaagcataattaatatttttaaaagtcacagaaactaaacttacttaacttgtgatgtagacagtattaaaaattcagatttacatgacaggaggttgaacttcctattaaaattctatgcaaatatctgtgttcatgcagcattaaacttttcaatgtattacctcttgggagtaagtatttcattagtgagtttagagcaattgtggttatagtttttatgaaaaataattgtataaaaataagcatgtaatgcaacacatatttattgaaattaatcttgaatgtctgctacactgaaatcaggtaaaaagtttagaatgggtgtgtattgtggataaagagtgagttattattaattctgaataatgttgtcccaatgcttaatggcaaaagatggtgcccattttgtttatgtctgtaataggttaaggatttaatctgggctacatgtaatgtcttacaataagaattaaaaagttcaaaccatttttcttcttcttacatctgcagacaggcaaatgtacactggggaccaccatgttcacgtgacatcaagaggaagcggaaaccagtggccacagcatctttgtctagccccagtgcaggtgattacatgcagttatcatttattgagcatgtaccgtgtgccaggcactaaattatgtgttttgtataccttttcatgtaatgtttgtgatagtgtaggtcattttattcccactttacatgggaaaactgagactacaagaaataattagcctagttcttgctgactctgaagtctgtgctttttcactgttacatggctatctagag

SEQ ID NO: 76963 - DNA, 1102 bp, Homo sapiens
agtccttatcaatggaaactccagatttctttatcaaagggaggtgggtgggcatgaatctagttggaaaaggggacttgaagctaagtttacatggcactttaagactgagaacatatcaattgttcataatcaggaatatggtagagggagagcaggtgtagatgatgggacgggaaagtgctgaaaccagcccagcagacctgtgagtcgcctctggttctcacgcagcagtgtgtgtgtgctcacagggatgttccacccctggttctcatgcagtagtgtgggagagtgctgaagccggcccagcatgcctcttagttgcctctggttctcatgcagcagtgtgtgtgcttacaggagtggagatgatgggatgggagagtgctgaagctggcccagcatgcctctgagtcacccctggctctcatgcagcagtgtgtgtgcttacagggacttcccaggctgcacttcccttccctgtgggctgcacccgtagaagtatagaaaatgtaatgtctgttgaatataaaatcgtaccactgaattgttctagtgatgaggttagattttgttgtcatgtgcattgtcaccatagtgacccgtggcatatatttttaacatacttggttgggtttgagagaaatctgtggacgtaattttttgtttgtgtcaagctctatgactcatgcagtgattggtcccatgatcatggcctattagtgaaaacctccaaaggtcaggtggccaaggtgttcccacattttttctatataacttgtttcctaatagtctgcctttctacctatgattaaaaataatttttatatacaacattatttacatttcaaacatctctacgaagtcatgccattttaaggagatgaaaacagccacagagttgagtgacttgctccaaatcacataactaagccaggactagaatcccagactttcagattttctctgccctgggttataatctcttgtttttcagtgatagacctgagtcagtctgagatgcttatttatgaaacagtataccatgaatatttattatctttcttgggcatgcttttctacacattttgaatactttcaa

SEQ ID NO: 76964 - DNA, 1033 bp, Homo sapiens
tctgatgccttgatcttggacttcccagcctccagaactgtgaaaagtaaatctctcttctttgtaaacgacccagtctcaggtgttctgttatagcagcacaaaataaactaagagagttctgtttgtaaaagagagtgtacacggagctgtacacttatgattgtgcatttttctggaagtgtattgtattcaataaaacaaggcaaatgaaagcccaaaaaagtgtgtgagcatggagaggtgtttctgagtgtaaggggatgtctgagagctgagcggagggcatgtgcaatcccagctctgctttaagcccagggcctcagcaggaagtattgcacagggtgcctccctcctggactgtctgagagctccagccctcctgcaatttggggatccttgagggcccatggcattttcttttcaaataggctgtcaggccatgtatattctccacgttgtttgaaaagaaacttccacagcatcagatacactgggattctgaccctgagtcttctggccggcatctgttctgattaggatactcaccctcctacacgatatcactggtgtggtgtttctccctcttctcctaacctcaaaaggcctgagcccctgactggccagtgtggagtggaggaaagaccccaggctgcagggaaatgagaccagtggagtaccagagtccaggggggagggactcaggcaggaatgattgtgaccagccgatggggtagaacccaaagtatgaagttgattccttgtggagagacgaatccaggggtgtgcagcaacactgtgtaggatgtttgcaacccacagcttcagtggcagcatccttgcaggtcatttgtgaattgcgtaacacgaaatgaatcatgctcctgtgaagacatatgcttttcgtttaagatattaaacagtagctcctgtgagtaacacagatataatcctatacatttatgaatgcattggataaagtactacttacaagaactccataggattgatatccacactgcataggtatgta

SEQ ID NO: 76965 - DNA, 1022 bp, Homo sapiens
tccccttcctcagccctctgctgaatgccttgtttcttttgagcaaagatctgcctacttctgatgggccggaggaaggatgcgtgtgacagagagacattgagggagcatgtacattggggagggcggtggagttggccatgaatgcataggattcagaaggagacagaattcgaagacagtagacaagcaagaaacaggatgcttttggcctgactctgcagcgcccttctctagaacttgtctccccaagtcctttaagcgacttcttaaaaatgattaaaattctttttggttccaaatttaagggaagagatagcagatatttagaccataatgtcctccttcaaagtaaagcccacaccacaccttgactgcctccattctggtgttccccaacacctaccggccatcatcgagtctctgtccatttctttctgaagtgagaccctcgtaatgctcttcctgctgagcaggagctctgcccagaattagcgaggatgccgcacagctcccctgggagcttctgtcgtagagtctggtggctcttgactgaatgttactggggtggggagccccagcttgacttgaatgttcaacctctggggtcctccagtgacactacagcccctagaggtgctgccagtgcagggtctaaggaaggaccccaggaagccaggagagtacaaattaagaatgggctggaactagccaaatctggcccggaatcttcctgaacatcctgcctgtttgcccttgaaggctttcaccgatttctagagataaatcaaagacgtttttagcatgtatgcactggtgacccctgattggtctctgtctctggtgagtttccccttcctcagccccagcagccttagacctctggggacagtcacagacatggtcttccctcagaggagaggcccataggctttgggtggccctgatgtcccctgtcccctggcatgggtggggtgggattatatccttttagccccgtcagctggtatggcttcgtccct

SEQ ID NO: 76966 - DNA, 1838 bp, Homo sapiens
actagggttccaagcataggcggtgagatgaggggagggatttaaaaattggttttgcataaagtttagtgcttcttcatatcctcacccatacctgcagcccctatcaccacgcgcctcagataacaaacagaccacctgaaatttgtctgtaaacagcaggtctacacccttcttgtttttttcaccaaaacgtgagccagccagcggccatgaataaaggtattgatggctgaatcagaacaggggggccaattataggcattctgctttgggactttacccaactaatcatgctcagcacctctgaacagctcagccagccatacagacacacacacactcacactcaggcagaccacacacctacactccttcctccaaaacagtcaaggagggacaaaaggacaagggcaaactacagcaagctggaataaaaatagaggggaaaaaatgaagacaaaggaaaatgctaaattgtaaaacacgagagaaatctcatctaaaagatcacgcttcttcaccccttccatcctctcctatagcatttccttacacctgtatttccttgttctttgcccttcagaaaccaagaacacatcaaaaggccaatgattctcaaagaccctttatcaggcatcatttttaaagcataagccagatgaaaatgccaaaaaaaaaaccaataaaaatttcaaaatgaattaacaaaaagaataaaacataaaaactaatttatgaactcaagccaattcaagccattaaaaataaaagaaccaagttaaaaccacatttggtatttggggtttttaaactcatcgtttccttgatagaaaagattgaattcaatttgacacttcacattcgtacagttttaaatgcaggattttggtaaacaccaatggtcaggcacaaggctgactgcccctataattggtaggagaggtctctgatacgattttaaataaaaattgatcacatttgaaatcagaagataaaaacaaaggcttgttggagtttgtttaactgccttctgacctctgaatgaaatgacattgagaaatataataaaattttccagaaaaccattccctgaaaaggttcagtcccggggatgctgaatgacaatattgaatagagtattttaaagtcctaaggaacaaaggaaagacattttttttttaaaaaagaaactttcagaccaaaatgtgtataggtttaaaagcacagcaaaatgaaatgaaaaaattctatctctgagccccaggaaaacttttgttttagatttatacaattttaactcaaactcagacaattctgaatttaaaacatttggccaataatttttttccacctagtccaactccatagtgaacatcccatgggctgattaaccagtatgattttccttgatttaagaaaagagttgactctttaagccacaacctgtcaatggctatttccagggagagaaggggaagtcgggaacctggaacagaatggcccaaattctcctctgagtgtggccatctgttatcctggagaagggcaggacttccttctctccctctctggggtctgccccacccctacccaggccagaaaattgcagagaggctcttaagactgaaatcctctgggcaaaccagagggacagccacctagcaggtgcccctgcagtcccctttgcaccatggacgaaccaatcccaaggcacggcagcccctgctggaatgtggtcacagccagacctcagcccagccaaggggtatagcagtcagcaggaacatgtttaaatagcagagacccctgtccactgtcaccccatcttaaagggg

SEQ ID NO: 76967 - DNA, 1005 bp, Homo sapiens
taaaaaccccaaataccaaatgtggttttaacttggttcttttatttttaatggcttgaattggcttgagttcataaattagtttttatgttttattctttttgttaattcattttgaaatttttattggttttttttttggcattttcatctggcttatgctttaaaaatgatgcctgataaagggtctttgagaatcattggccttttgatgtgttcttggtttctgaagggcaaagaacaaggaaatacaggtgtaaggaaatgctataggagaggatggaaggggtgaagaagcgtgatcttttagatgagatttctctcgtgttttacaatttagcattttcctttgtcttcattttttcccctctatttttattccagcttgctgtagtttgcccttgtccttttgtccctccttgactgttttggaggaaggagtgtaggtgtgtggtctgcctgagtgtgagtgtgtgtgtgtctgtatggctggctgagctgttcagaggtgctgagcatgattagttgggtaaagtcccaaagcagaatgcctataattggcccccctgttctgattcagccatcaatacctttattcatggccgctggctggctcacgttttggtgaaaaaaacaagaagggtgtagacctgctgtttacagacaaatttcaggtggtctgtttgttatctgaggcgcgtggtgataggggctgcaggtatgggtgaggatatgaagaagcactaaactttatgcaaaaccaatttttaaatccctcccctcatctcaccgcctatgcttggaaccctagtttgggatcttggtgatgcacagtaaatgagctgttgtatgcttttgtttttgtcttcctaatcgatcagcagaaaacatttccttttgatggtgaaacaggacttcagcatgcagagcgcagtatttatcctcttacttttagcttcactctttgtcatttgtctcttgggtttgttgacattgtctacctaa

SEQ ID NO: 76968 - DNA, 1059 bp, Homo sapiens
gtaaatttctggtcaattacttcctgagaaagaaaggggagggaaaccaagaaggactccatcccatcaacaaatgggcttattcataatgcaaaggccaggtcagttgctatttggttatatgccacttacacaggaaactgtcttaatttcagtgaattatcactggcttggagtacgggatggtgggagagcagtgggtaggaaccccgtaacagtcagcagtaagctggccttaacaactgaggaagatgtgttatactcaggataatcaacagctcatttgccatgaataaaggcatcgctcaagccacccccaaacactcggtgacagtgacacacagattccaaatgttctctgtaagaaaaaacaccctttctcctaatccttcttaaactcaacaagactgattggtttttattattcatgaattaattttttactcagggtccaacaagggaattgaagatataaaatttctcaccgattgagggggaaagcagatctcaacctaagcagcacagccagagtcttgcttgcattccttgggggtggaatgatttgtttgtaaaatcagttaataatcaattaataatccaaagctttgaggtttggttgtttttttttttttttcctgaggaaaagaaactatgagtaagaacatgaataagaatattgagatggaaaaaaaatacagacagctatgggaccctggaatattaggtgaagcagagctgcttcttcgttccacgatacatatacaaaaaaggaaatgagagaggaaataacagaagcattgatggattctaaagtaacgcacagatgagcatggtctgtaggtgagcaggcttcaggtctgggagtcgccatgaagcatcacaagaagggacatggaaattcagagaggtcagttccctgatgacctccctctaatcacctccatagtgcaggttgaggtactcaggagcagggacaacggcctcatagaagccaaatggccaagaaggcgatcaagggtggagagatgactttgcctctctcttcacacagttcttctc

SEQ ID NO: 76969 - DNA, 1557 bp, Homo sapiens
tcacgcctgtaatcccagcactttgggaggctgaggcagatggatcacgaggtcaggagatcagaaccatcctggctaacaggatgaacagtgaagccccttctctactaaaaatacaaaaaattagccaggcatggtggcaggcgcctatagtcccagctacttgggaggccgaggcaggagaacggcgtgaacctgggaggcagagcgcgcagtgagccgagattgcgccactgcactccagcctgggccacagagtgagactccatctcaaaaaaaaaaaaaaaaaaaaagaatgaaagaaagctgaaattctagatgcaatgagcgacacataacatcggggtgaggagtgcaggcacacacccagacagcctctgtgcaaatcccagctttgtcagctgtgtgaccttgggcaaatgacttaacgtctctgtacctcagtttctttacctgtgaaatgggggatgataataatacctacttcctaggattgttgtgaggaagtgatgatttcatacatgaaatattcttaggacaaagcctgacacacagtaaatgctcaataaatgtcaattactacaactattactattacaatcgcccatctctggccttacactttatatttagctctcctatcccccctcagacacttttcttacatcaaatcctaaaatgattccccagagaattaggtggcttggagaagagcatctgaacaccagtatctggctctgaaaatggtgctggctgcacggcttctgcatattcagcagctggaggtcattcctcaaactgaatcagacctgagcactttccagcccgtctggaggtcaggcaagccacggaggcagtgagtgtgtggtgtgtaggtgtgcatgcatgcatggtggggcttgggaggaataccacactacaaggcagctgcagtgctaaattgcatggagcagggctcggaaaggtgaaaaccagagctgctttctaaagccagggtcctgagctcacccctgagcttctgaaggctcaccccctgggattctccatacaccccaccaagggaaggctctgttgcagaactgtcacccatggggtgcagtgccagtgagtgcctgtagggggctctagagctcttccattccccgtacccggggctgtgagggcatcaggcttaaaacaatggttgtgtttaccaaggctgtgcgactgtgctgttctgagaggtgaatgaggggaagctggggtccgctggtaccctgttggcgagacccggttcatccatgctctcaactagctctgcttcaggtttggagtcctaaccctccctgatccaccacctaacactgatttgggctgcttcccctcagcctcctgggagaccctcacaagggtcagcctcctgtccttgtgtggggaggtagggagagctgctgctttggcctccagggtggggcaagggtaacttccagtttctggggtctcaggttctggcagtccagcaccccaacccgtttgtcagggaaacatcaggcacagacaggttcccaaaaagacttg

SEQ ID NO: 76970 - DNA, 1036 bp, Homo sapiens
atctgcccacctcagcctcccaaagtgctgggattacaggcgtgagccaccgcactcagccatgtttatcaacttttaatctttacagcaatctaacgtggaagatcacagcagaagaggaatctgagatacagagagattgagtcatttatctggggtcacagagctgggatgtgacggagccagtgcagtggtgtggtaataaatgtttaatggccagctgggggacggcggatctgtagcatttgccaatttccgtggtgtaaatactcccatcatggctgttctcaaactaccagtgtgtcatcatggaatgcaggcttgggaagagacaggcagcagctcagcatcgcatggtttttccaccatacattaggtgtaaattgatggcaagaacgtaaagtgaaatgtactaagatatgaggaagtgaggagtggtatctattacctttgtttttaatacaatgtatttaattataagtttataccatttaatttttaataatgattgtgtttgaccatcagcccacaaaactgctgaatatttaacagtgagctctcctgagctggtttgagctggttccagcacaccattgggaccaggatttcaattcagttagtctggagctagggttttccctcttaaccccaacactgcattgcctcccagaaggatataatgctccccaagccagagctgcctccatggctcaaccagggcaaaaatgtggcagaaccagtgctctcctggttacctcttcccaggcccttctttctgcctcttttcccccaagggctcccctttaactacttccaatcccctcaggttagctcaaccaacatttattaaacacccactctgtgtcactggggacacagagatgaccttggactctaggacctcatgatctaggagaaaaaataagcaaatattcaaatccaacagattgtaaaccagtcaggggcatgagacagagaacagctgcaaggagaaagactaattcccccagggagaagtcagggatgcctccacaca

SEQ ID NO: 76971 - DNA, 1025 bp, Homo sapiens
cgctacattgcccaggctggtctcgaactcctggtctcaaacaatcctcctgccttggcctctcaaagtgctgggattagaagcacgagccaccatgcctggcctgccccaaattattttgtctcaatttttgcccaaattttgtccaataaatctattttggaattactttaaagccagcaagcccagcctccgtaaagaaaatatgactctgtgactgaagctgggattcccagggtaaggtcaaactccacacattactgacaccctggatggggtacctggcgctttggctgttttgcgtgggtagcatcagagggcagagaaggaaagtcagagcggtcactccaggaggttctgctgcccagactggccctgggggactggcctgctgggtgccgttgactggggtcttggccgctagggggtcctgggtcacctctacaagccccctcctgaggcatctgtaagatggggggctcaggccccacaggcagcctctggaggtgcaagtctatctgtgacctgaatccgaaggccctgccaaaggaataacaatgagaaatgtcaccaggcgcactctctttgatgtgtcccgactaggggaattggtgtcagaagacacacagaaaagccagatggtattttccagggtcatggtccaccatggaatgaagcccagggcccctttcatgtcctttcccgagtcagtccgtgcccgggcggctggcgtgggaggagaggccgcagagacacaagattaatggcttcctgggcaggtgagcaaccacccactcgggtagtcacgatcctccagcgactccctcggcctggctccatgaggcgtgaagtggagagagaatctagtggtgaggccaacccttgccaacccaggccgagcctggctgctgcatctaccgccagcgctggctccgggagttgagcctccggaagttgagcctccgggctaagcctctgtctgggtttgtcctgctgcaggcagaggcacaggcttggtagcatgt

SEQ ID NO: 76972 - DNA, 1045 bp, Homo sapiens
aatcagggacagacttcaatggaagcggttccttttggaaggcttccggctcttgtcatttccctcattttgttcaaatctgcaacggtcttcagatggaagtccatctgccactattcagagttctctgccctgtgctctttctccccagattatgttctcagcttgctattttcttattcaaaacttctaaatctctacctttcccagaatggcttctctagaagttttcccagaaggaaaatgtcaaaggacggcagtacacgaagtacccagttgaagggctcccactgccaggctaattctcaagagcagatgaggtaccaggagcaggagggggtgtgtatccttcctcccttctgcccccagctagactcttgcaagctctggctcattcggccctcccagccaaagcagcatgggttctgttgggtaatttgcaggtttggctggtaagatgagaaaggtataggcatcttgctgggccattatttattccgcatggatcagggactgagcctgacctgagacggccacaattaccccagttccactggacacctatatgacctcccaccgagtttgctccttgaaacggcagcatctggtcaggagcagcagggtgtgactgtgaagtcaggagaccaattgtgaccaaccggtatttatacaccctagtgagcgctgtccccttcctcatggtcaccctgggcatctcttcccaattcccagtgatgctggctttcgtcaaagcatttttggagttcctcttgggagctgcctttcagcccagattatctgagaaatagagtcacatcctcactttctttgtaatcaaaaatctctttgctcagctctgtcacccaactaattccctagacttgcctccaaatgaccttggctgcattaaacattaaatccacccggaatggaaggagacttgccatcagcgagcatattcaaaggggatgatgtgggctctgagggcataacgaggaggaatgagcggcggggacattgctaggaagcctcctggagtgcacat

SEQ ID NO: 76973 - DNA, 1027 bp, Homo sapiens
tacatttgtgtcccgctcagcaaaatgactaaaaagtgacagctagttgtcagcaaagtctcctcccagcataggctgatgaccagcagcatcagtatcacccaaagagtttgttaaattcagatcgctggtctctgcccccaaccgactgactcagaatttctgaggatgagcttctgcctgcattttaaggactcctagaaagagaaaatgtgctgtgactcctggggccgacggcacatcagcttatcctttgaagactgcattttctctcacctgattctcccaacagccactggaggcagggagggccaagattcatttattcatttgttcattcattgtgccaacaaccacgcatttattgtggagcctttaggtgccagacactggtgaatacaacacattccctgcccgcaggaggcggatcaagacagagcacgcacaagtaaacagactaatcaataacagaggactctccctacccaattagtctgtttatttgtccacatggcattaatggcttcttagcactacatcttgtgttagacaaggatgggcaaggatggggcactggttttttgtttgtttgtttgtttgttttttgacgaagtcttgctcttgttgcccaggctggagtgcaatggcatgatcttggctcaccgcaacctctgcctctgggttcaagcaattctcctgcttcagcctcccaagtagctgggattacaggtgcctgccatcatacctggctagttttttgtatttttagtagagacggggtttcactatgttgtctaggctggtctctaactcctgacctcgtgatccacctgcctcagtctcccaaagtgctgggattacaggtgtgagccactgcacccagccggggcactgttttaaccaatgtgacatttgagtagaatctttaatgaagagaggaagggagctaatgggtatctggagagttaggggaagagctccccaggcaatggggattaaatgaactagatatcagaaaaccattgag

SEQ ID NO: 76974 - DNA, 1037 bp, Homo sapiens
tgatctgcctgccttggccttccatagtgctgggattgattacaggcgtgagccaccatgcccagccttgcatcctgtttttaggatgcttgggtataagtggacaaaacgatagcatatggatggacccaagaagaaatgaatgggccaggcgcggtggctcttgcctgtaatcccagcactttgggaggctgaagcaggcagatcacctgagatcaggagttcaagaccagactggtcaacaaggcaaaaccccgtctctgcgaaaaatacaaaaattagccgggcttggtggcacttgcctgtaatctcagctactcgggaggctgaggcacaagaatcacttgaacccagaagggggaggttgcagtgagctgagattgcaccactgccctccagtctgggtgacagagagagactctgtctcaaaaaataaaaaaataaaaaaaaataagaagaaaagagttggagaagtaaaaactcaaatatttgctgtgtttatagctctgaacagccccctctctttctgggaaaggcacataagagagcatatgatttcacagaaagaccccaggatataaagccagaccaccagatcattcacaatttggatcctggcccttcaccagtgggcacttaaccaacctgtgcctccattctccatctgtaaaatgggaacaccaagtttcctctgcaggtttcttggagggattaagaaagctgtgtatgagtgcacatggacaatttttgaaaatattgtaaggttcacagaaaacttggtaactgtggctacttttagggattctgtctaggggaccaaggattaggggaggaaaaataccctaccagtcactgcctgcactctcatagtgtttgacatttttgttacacatgtgaatgtattacttttttttaaaagactgaaaaaatgaaacaaaatgtatatataatggctcaaaaatggtaagcaatacaccaagtctttgtttgtttgtttgtttgttttgagacctgtcttgctctgtcgcccaggctgg

SEQ ID NO: 76975 - DNA, 1055 bp, Homo sapiens
agttagtttggaggccaaggtgggcggatcacttgaggccaggagtttgagaccagcctggccaacatggcaaaacactgtttctactaaaaatagaaaaattagccaggcatggtggcaggcacccgtaatcctagctactagggaggctgaggcacgagaatcacttgaacccaggaggtgggaggttatagtgagccgagatcgctccactgcactccagcctgggcaacagagcaagactccatctcaaaacaagcaaacaaacaatcaaacaaaaactgtcaaggttatgaaaattatggaaagtctgagaaactgtcacagacaaggggagactaaacagacatgacaattaaatgcagtgtgggattctgcatgggatcctggaagagaaaaaggacatcaatggaaaaataaatgaaatctcaataaagtatggaggttagttcatagtaatgtaccaaggtaagtttcttagttgtgacaaatctatcatggtaacataggaagctaacaaaagtgaaaaccagataagggttatacaggagtcctctgcactatcttggcaatttttctgtaaagccaaaaaacaatttcattaaaaagctttttcaaaagtggaaaaaggtcaggcgcagtggctcacgcctgtaatctcagcactttgggaggttgaggtgggtggatcacctgaggtcaggggttcaagaccagcctgacaaacatggtgaaaccctgtcttactaaaaatacaaaaattagccacgcatggtggcgggcgtctgtaatcccagctaatcaggaagctgaggcaggagaatcacttgaacctgggaggcagaggttgcagtgggccaagattgtgtctctgcactccagcctgggtgacagagccagactccatcccccaccaaaaaaaaaaaaaaaaaaaaaaaagtatgtaaaagccccacctggctctgcctcttggaggagagaggaggcgctcacttggcccaccgcccacctgtcctcacgaggcacctgcttctccagtggctcctcccttatgg

SEQ ID NO: 76976 - DNA, 1568 bp, Homo sapiens
agaagacctattagctcatgcacttagaactgtggcctcccaactctcccattaatgtcggaactgcaactttgtagtttacatttcaagttttaaaatataataaatagcacgagtgtcttctgagttcttattatgtttggtagaaagagcccagtgactaactgatatggtgtctgctctgaagctgtgtgtcctagagacagccacttgccctgtctggcttcagtcattctttgtcccttcctggaaagcagagagccctcaccatctgctgggggggcctgaagatacatgaaacaggaggtaagacagttggctctctggcaggaagctggaccattggtcctgagatttacctgggaagctgcccgctagtcatgagccttttgctcatttgctcatgctggtttcacaggtaactcaagggttaaaaatgaaattacctagagaaaaaaagtctacattacaaaatgaaacactcactgtaatgcaatggcctgagaccaatatggtgtgtaaagactgagaatccataactctagcctcttgccccgtgagtcagacccctagccgaaccccagtcctcctgacccatgagacagaccctctccatcccaggatccagggctctgggctttcctgcccacatccaccccagagctgcctgccccctctgccgggcagctcaggccagcctaaactggaaggggcacagggtctcatggcccatgtgcaagtcttgactttgcccttctttcctccatgaccttcagcaggttcttgaccttctatgagcctacagtaacccattttactaccataactcatggagttattgtgaggatcaatatagaatacgaccttcaaagtgcttcctgccaagttgtcacaacctccccgccatcctcactctggcatttcacagccccagctcctgtgagaggaagtgaatgtcttcagggtaatcagtctcaccaggggcttacccagcaatgaaactgagaaggaaccccaagttcatgagaatttccatgtcttatcccagctaaccctcatgaggctcgggggtgaatattctcacccccaggataagaatgaagcatggaagatttccttgttcaatgtcacttagtgggtagggggcaaggccaggactgaacccagcaccgtgtcccccacccttgattcctgagttcgaagctcgatctcaacattttgcagactctcagccgtgtgcggtggctcactcctgtaatcccagcagtttgggagaccgaggcaggaagatcacctgaggtcaggagttcgagatcagcctggccaacatggcgaaaccccatctctactaaaaatgtaaaaattagccaggcacagtggcacatgcccatagtcccagctactcaggaggctgacacaggagaatcgtttgaacctgagaggcgaaggttgtagtgagccgagatcgtgccatcgcactccaggcagggtgacagagtgaaacctcgtctcaaaaaaaaaaaaaagtttacaggctctcaacatcatgattccagataaaaatagat

SEQ ID NO: 76977 - DNA, 1123 bp, Homo sapiens
tttaccatcttggcaatcagaattcacctgaaatcaatggcatgtcttagtttaatttaattagtggttccagaaatcatggtgtcccttgcaatagatgatgtcataaattcaatgacatgtgataaataagtgtagctgagactgctaggagttcaccaaaagttaattaattttcttgctagacaccaggaggactacatttcccagtcaccctggcagttggctatggccatatgactgggtcttggccaatgggatgtgggcaaagtaatataagccactcccttatctggcccataaaaatctcccacagactcctgccctccttccccactccactccctcccctcctgtctcctattcctctctcttcccccatcttcaggccagggggctccaagaccctgggggatagcagagccacaaattagcaggagcctgggcccctgaacaccttgtgaaaggccacctgccaaacgccctcaccaaaatgtcctctgggcaagacctgcttctgccgtgttaagcaactgaagcactgggattgtatgaaataatgacaagtgtcatcccccctaacatgataagtaaacagccaaatagtatcaatgcagttagtggtgagtgctatgagaaacagcagggagggctgggtgtggtggctcacacctgtaatcccagcactttgggaggctgaggctcccaaaattagctgggcgtggtggtgggcacctgtaatcccagctactcaggaggctgaggtaggagaatcacttgaacccaggtggtagaggttgcagtgagctgaggcggaggttgcagagatcacaccactgcactccagcctgggcaacagagtgagaccctgtctcaaaaaacaaacaaaaaaccagcagggaggacacagcgtggtgggtcaggggagtgtccagatagagctgccagagagggcttctctgaggaagtgacatttaagcagatacctgaagaaaagagggaggggccgcacagggaaagctctatgttggagggacagcagggaaatctgttgctggaagggaggaggagggggaggaaggaggtgaggagggaggggcaggcagaacccccacacagccag

SEQ ID NO: 76978 - DNA, 1813 bp, Homo sapiens
ctctagtatccttcttttcagtagctattggagttctgacatctgtaaatttagcttaacttttcttaaatctgtttttattttcactctatatcaagcagtgatgtggcataaatatcctacctcatggctgggtgcagtggctcacacctgtaatcccagcgctttgggaggccaaggtgggcggatcacctgaggtcgggagttcgagaccagcctgaccaacatggagaaaccccgtctctacgaaaaatacaaaattagccaggcatggtggtgcatgcctgtaatcctggctactccagaggctgaggaaggagaatcacttgaacccaggaggcagaggttgtggtgagccaagattgcgccattgcactccagcctgggcaacaggatcaaaactccatctcaaacatatatataacccaattactgtcattgaacacactcagtagcctccagatggctttaatcctcatagtagccatggcgctgggccagagagctttgtggttagagctggactgtttgggtttgaatcctagctctgccccttatgaatggggttatttaacctctagatgcttcagttttgtcatctgtaaaatggggatgtgaattatagtattcatcgtagtattcatctcacaagatggtcttgggaattagtgagttaatgcagaaaagagcttagaacaatgcctggcatacaggaagtacttaataaatattaagagttgtttttagcatccctatttggtaatgaggagacagcttccatttagattctttaaaatgtttaatgctaaagcaagtaagactgtcttgctccctctctccttctgtcattcatccatccatgcatcttcccacccacccatttcattatgtatttgcatgcctgttactttcactgacacagtcccttttcaggcaaaggggtcccatattcaggcactgctagaactgactgccaagcactagcttctctcctgtgaaggacgtctgaccccaacatacattgcctgtctttctgtgcacatgcatgtacacgtacacacacatacacacacacacacacacacacacagctcctgcagaaattgccatattcttagagacatcctatatctgccttcctggctcagcttattgacccagggtgtgctcctgatccaagctgggccagtgagtctctcccattagatttttggtgtcagggctgcctctccagggacagaggcagtaagatggacagctcaagagctgagcaaggtcattcttccctcccatgtgcagtgagagagaagaatatcgaagctggcagcagagagaaggaacggttgaggcagagagtcctagaagccccagttactgttggcaattcctcccatgcccctgcagcatctctgttcaggtgaacgagcatggcctgattccctgacactgtagtttactcaagggggcttctcgcacttaaacaaaagagtagctcacacactgtcactcattcaactaccattgtctttaaacaatttttttgtttgtttgtttttttgtagcgacatggtctccccatgttgcccagactggtcttgaactcctgggcttagaaaatcctcccacttcagcctcccaaattgctgggattacaggtgtgatccagtgtgcctggcctcaactattgttctctgaatatctactgcatgcttgacactcttgcagctctgggaatatgttggtgagcaaggtgaatgggtccctgtcctcaaggagagacaataccatagttcattgactccgagctgtacca

SEQ ID NO: 76979 - DNA, 1043 bp, Homo sapiens
caggcagaggaatggactggcctgataagcgtccagcttgctttcctctatggggtagaatctacccaccacacccaagaatctgggtcaggctgaaggacggcccccagagcctcatccctgctggggccatgcatttaagaactggaacaagcagctgggccacttaatggctacaagcctgcatgctggtagcagacgtgccagttctatccctaattgctgctggctttgagtaatcaggtcatcctctctggacctcagggtcctcatctgtaaaatgggctcaatcacagcacctccttcacagagttgagcaagagccaatgaaggcacaatgcttagaacagcgcaggtgacaagcaggcactcagtggatgttgcctgaggctgtgattcttctgagaaagtccagcagtgggcaggcctgtggttaaacccagcaaaccccttccctcatccaaggcccccagacctagaattgaggatgattcttcaaggaacttgccatagaccaggagggaaagaagctggctgggcaaattaagaggataaacaaaactgacatgggaatccactccacagaagaaaaatggtttctgaacacttgagagattcttatgtacatttcaataattaatttgctaaccaggggccatcaagagctatccattaaagcagatcctcagaccctccagcaaggctttatgagtcacaaatcagcccctcaggcacctagaactactatactgtaactaaatttcctttaaaatagtattaaagattgcagaatgcccctaacaggagggtaggatggggaggaccatgtggctagatgcgaattactgtcaaggttccagttttcctgttgaatatggattcatgggcacttattacatgggagggagggtagggaaggaagaaaggaaggaagggaggcagacaggaaggcaggaaggcaggaaggcaggcaggaaggaaggaaggaaggggcaagtaggccaatggttaagtgttacgaaccagcgataatgaagaatcca

SEQ ID NO: 76980 - DNA, 1609 bp, Homo sapiens
tacagccttaaactcctgggctcaagcaatcctccctcctcagctcctgagtagctgggactacaggcatacaccatcatgccaggctaattttttttttttttaacagatggggtctccctatgttgcccaggctggtctcaaactcctggcttcaagcgatgatcctccccgctcagcctctcaaagtgctgggatttacaggtgtgagccaccacacctggtccgctgaagtttattgatcaaaataaagtttctttgaggcctccgaaggttttggaggtaatgccagaaacttgctcccggctgcgccgaggggagaccagctgaccttctccaccgttgttttatcgcaccaaagccttagcatagagcccttcccagccaccctacctgcggggctggacccgcccaccacacccacagcaccttgctggggctgacttcccgatttgtgtccacaggctgctgaacaggatgtcctcggacgacaggcacctgggctccagctgcggctccttcatcaagactgagccgtccagcccgtcctcgggcatcgatgccctcagccaccacagccccagtggctcgtccgacgccagcggcggctttggcctggccctgggcacccacgccaacggtctggactcgccacccatgtttgcaggcgccgggctgggaggcaccccatgccgcaagagctacgaggactgtgccagcggcatcatggaggactcggccatcaagtgcgagtacatgctcaacgccatccccaagcgcctgtgcctcgtgtgcggggacattgcctctggctaccactacggcgtggcctcctgcgaggcttgcaaggccttcttcaagaggactatccaaggtgcgtggtgggcctcaaggagcctgggcgcagggttgggggtggcagccgtgcctgcgggtctggcagaagccctaggaattcccagagactgccaattctgggcgctgttggagcggtacttctgtggggcgccttttcccttgctcagggcttctcattctggcactggacagctgcaagactgttgttgagatgacacgcgttccccaccccctcagctcccccatgcacagccccagaaaaccaaaagaaaatccacaggaatgccaaaccctgggtgcttctcactggtatggagtacactgtcaaatgtgtgtccctcaaaaagtttattttgtgcgggggaaaaatataatttgccctgcaattccagacttacgggacatagaaagcgtccctcaccttgtttttgtcttacttatacaagtaaaacgccagatgtggtgactcatgcctgtaatcccagcactttgggaggccaaggccagaggataggtcaagccaggagttgagaccagcctggacaacacagtaagaccccatcattattattattatttttaaattaatgcatggtggcacacacctctagtcccagctacttgggatgctgaggctgcagtgacctgtgatggcaccactgccttccagcctggaagacagagcaagaccctgtctcaaaataataataataatatatgagtattttctcactgtagaagactcagacct

SEQ ID NO: 76981 - DNA, 1062 bp, Homo sapiens
atccacttgggcccactttggcctcccaaagtgctgggattacaggcctgagccaccgtgcctcgccgatagctgtgactgttaattgcgtcaggccctgggtagagcactttcattcagttagtcaagtatctgttgagcacctacaaagcaccaagccaggctgtaggtgctggtgataggatagacaaaatctctactcatgcaggtcactgcgatgagctggtgccatccaactggcacagaaactgcagaccagacaggagaacacccaggaaccacccatcctgcccctgcatcagatccctttccagggccctgcctcactgtccccagaatgtacctaccccattcatttcccttttagaagaggcaggctaagcttccccgggatgattctgtttattcaacaaatatttatgtgtttaagtttcttcagatggcaatctatttatgaaaccaattgaagacattaagattggatatatttccacttccacatatgagttgagatggtgtggtgcattggctaaccatcagggctcctggtcagagagttccatcgtccccttatagctgcaccttggacatgctccctgtttctctctgtgcttcagttacttcatctaaaaagtgagatatcagctgggcgtggtggctcacgcctgtaatcccagcatttcaggaagccgaggagggtggattgcctgagctcaggagttggagaccagcctggccaacatggtgaaaccctgtctctactaaaaatacaagaattatccaggcatggtggcaggtgcctgtaatcccagctgcttgggaggctgaggcaggagaatcccttaaacccaggaggcagagggtgcagtgagccgagatggcaccactgcattccagcctgggcaacagagcaagatcccgtctcaaaaaaaaataataaaactttaaaaaataaaaataaaaagtgagatattgttcctaccttatagagctgttaagaagcttacgtgagttaatatatataaagcacttagaatattgcctagcacctagtaagtgcca

SEQ ID NO: 76982 - DNA, 1365 bp, Homo sapiens
tgatttatttcttaaatgagcccttttaaaaaaataaacatgataaaaaaaattctagcagtgcaaaacagtagagcacgttttcctgaaaccccagacctcagttttcttaactatcccagaaggacccctttaccatctttgtcaagcaaatattttttgagcatcgtctttatcaggcactgtgctggcctccaggacataaaaatgaatgcaccctggtctctgcccgctttatacaccctgagtctgagtctgggggaaggccctgggatctctgtatttgaaaagcactgcatggtgatgctgtctcttgcctcagccaagaatgagaacctccagtatgatggtttttacacaaatcatcagatatttgacaaacacaaaatgtttaagtcaactgaagttaccaagataacaacatttttctttctaaattggaaggttgtcttggagaggttgccattattttagactctttgaggtcagtttttgaagaattgcttgttagaagacagtcacattttcttctcaccatgttgttcttagatgggctggagagttttgaatcacattttttgaaagcagaggttaatgtgtgtaaactcagaaatcctactgcatgcttgacagaggcccaggtgtctgcgaatgttctcagcaagtcaggagtccacatgaaagattcgtaaatagtcttaattatttgctaccgcgaataggataatgatctcttcgtagaagtcaaaagacaaacagcagcatttgtgcagttggaactgaactgctgcagcctcttctctttccacaaggagagtttcaagttcgtaaccagaaagaggtttatattcaggacagggaaaagtaaactcaaggctgacagattgctgtggttattttattaactctttggttttgttctaacaaagatttaggttttgttgttgtttttttttttgagacagagtctcgctctgttgcccaggctggagtgcagtgatctcactgcaacctccacctcccagctcagcttcccaagaagctgggattacaagcctgtgccaccacacccgactaatttttgtatttttagtagagacggggtttcgtcatgttggccaggctggtctcgaattcctgacctcaagtgatcctcccaccttggcctcccaaagtgctgggattataggcgtgagccaccatacccagccagattttgttgtttctaaacgtagcaactgtagaacatctggaaaactaggaaaagtacagacaggagaaaaatgacctagaattggacaaccacagagacaaactcagaactcagtgagcattctttgagtccctctctgagtaaggtgcaga

SEQ ID NO: 76983 - DNA, 1629 bp, Homo sapiens
gctctgaaaatcatgttaatcgtgttacctcacaccctgcctcttccttagatcacttccttctgcgcaatccaatggttgtactaatatgggaagaaattttgcagaaacaaagatgtcatgatagatttagggagaaagactaagaccgagtcattccttctccaccaatcttttttttttttttttttgagacagagtctcgctctgtcacccaggctggagttcagtggagcgatcctggctcacttcaacctcggcctcccaggcttaagcaattctcctgccacagcctcccaagatagctgggattacaggcgtgtaccaccacacccggctaatttttgtattttcagtagagacagggtttcaccatgttggccaggctggtctccaactcttgatctcaagtgatccacccacctcagcctcccaaagtgttggaattacaggcgtgagccactgcgtccaatccaccaatctttattgagccctcactatgtgcttggctggtagtacaatggcgggggagggaagagggggaagatgggcaaactacggcctgtaagccagccacccttggttgtataaatcaagttttgttggaatacagccacacctatttgtttgtatattgtctatggctgcttgagcgttacaacagcagagctgagtagttgcaatagtgacggcctgatccacaaaacctgaaacactcctctgcactacattgaactaggcagattcagtctcctggctctcagagacctataatcaactcctagtagtgcatgttagtgtttattccaaccctgcccaattctatgctatgaaagggaggtttttttctgttgttcgttttttttttttgttttgtttttgtttttgtcgctgggggctgtgatgacactcactgagaatagatgagctcatagacagatgaaggcaccttcctgaaggaacagaatggctccaagtcagaagagatagacctcaacctgattgcatttactcgcatatctaaagaaaaaaaaatgccaattaacaaggattggctagccctggaggcatagaaaaaacagacatacttaggcaaagccaccactcctaggaaaagggagtcttagcctagggacagcctgatgtgattaaacattccgtttatctgattaatatctttctggttaggatctagttcccctgcaggtcttctgcaaggagtgaatttgcaggtcaggcagacagatcaatttctccttgtatgtgtgctctctttgcatggcatccctgagcttatacatcaggttcctgaatttaggcaagaggagtgcctctgagagatggagccactttctgtggctggaaaagtcagctgcttctgggacttagggctgagtgacactgactccaccgtaatgaaaacctttgtaataaccttgaccctgtcaccctgtgtctctctcagcaatgactctgcctcctgttttattgagaaactagaactccctcagcttcctgccgccaaaccgatgcactctcttccatgttcgcagctgcttccgttcactgattccgcagctatttcttgcaactcactcactgctggaagagatgtctcctaccccaggc

SEQ ID NO: 76984 - DNA, 1022 bp, Homo sapiens
atgtagaaggttctcagtgtgtccaaatgcaatgcaatccccaaacaaagtgatctcccatttcccagggaggacaaactgaagaagttgggccagtttgcatatgtgtaaactttaagggatctaggtaaaatagtcagatgtctgcttataacaatatattatttagttacgcttgtatattttaaattaccttatggaaaacaatatattatttttgaaaagttgtttttctacacatattttgtgaaggaagtcttatcaaatgaatctttgatacaaatgtctttgttttccttctctagagttttttgagtcatttaacagtgtttcagtgtgctgccttcatttccatcagttaattgaaattttatgagaatgtatgcgctgctatccctaaagtttttttattttaagccataagtatacgtcctacaccataaggggagttctttttttatttgtgttgacttatgatcaggatatccacaatgtatcaggtacatactgcttttgacacccaacacttgtaagattattttcctgggaataactaaatttgtgttaaatttctttactcccaggccaggcatggtggctcatgcctgtaattccagcactttgggaggccgaggcgggtggatcacttgaggccaggagttgaagaccagctggccaacatggcgaaaccccatctctactaaaaacacaaaacttagcttggcatggtggcacatgcctgtaatcccagctacttgggaggctgaggtacaagaattgtttgaacccgggaggcggaagttgcagtgagccaagatcacacactgcactccagcctgggtgacggagcaagactcagtctcaaaaaaaaaaagaaaaaaaagtttgtttttatttactccctttgtagtgattcactcaggcaaggagcattgattgcggtcttcttaggaccatgtgtcttcccaaattttagattgttgttcagtacaaagtgattgacttaatagcacctctgatgt

SEQ ID NO: 76985 - DNA, 1774 bp, Homo sapiens
ctctctttttttctttcctttttttttttttttttggtccttgggacagggtcttgctctgttgcccaggctcagtgcagagacatgatcatggcttactgtagcctcaaactcctgggcttctgcctcagccttctgaggagctggaattacaggcatgcaccaccatgcccggctaatttattttttaaaaaaattgtaaagcggagtctctctatgttgcctacactggtcttgaattcctgggctcaagcattcctatggcccccaccctagtgggcttgcattgtagggggaaagctgacaataaatatgataaataatgaagcatggtgacagactgagacaggtgttatgaaggagaaaaaacaatgatgagaccagagagtgactgagaaagggggggggtctcatttagaaggaggattagggaaggttgtgctaataaggtgacttttaaaggaagctgaagctcatcaaggaatcctgggaccagcgttccaggcagaggaaaaagccagtgtgtttcaggacagcaggagggccaacatggctagtgtcagtgagcaaaggcaaagtggaaggggctggagaggatgggcaaagtctaggggccatggtgaggggtgcacttggatttttttccaggtagagtagcagccgttgactaacatgtgatacatggccatgaggggctgtacggttaggtaaagccagtctgcactcctccttgagttcccagggtagatggccaactttgcacaggccactgggagtcttttgagcaattcctgggtctctaacttaaaacaagaaggaacaagtaagaaagaggcctggcacagtgcttcctccattcacctggggcccagatgcaggcttggaagaaaactcccctaggagaggggaagggggatgattgatgggttattccaccttgggtcgcctccaggtcttttgtcctggagaatgcagctggcggatctggatcctggatcccgggaggcacaagacaggggtgcagagacaagagcaggagagggcaggagtcaggagctaggtgctggtcccggcccagtcactagccaactggctgaccttgggcaagcaaggactgagttcctctggcctcagtttcctcatctctacaagaagagtccattaaacccacaaaatgttagctatctgtagggcactggcaaatgacagaacaaatcacaattcctctttttggagacacagccaggatgccagtcagaatgtggtcagcctgtgacttaggtgacacatagagtccagagaaggtttataccttctggagggcagggagggcttcctggaagaagggacactttctcagaagtggaaggtaaacatgcttggcagcaagagaggagggggctcagtggtggatgatgggctgggaaaacagcatggcactggagtgcaccaggcttcacaggtcatggtaaggaacagttaagtaaggagtcatatttaagatttgagggctatttaaccaggcttagaatctcagcttcacgatttcttagttgtatcaccttgggcaagtgacttagttttcctgagccttaatgtccgtatcagtaaaatgttaatagttcctgcccctacagtgttattgcaaaaatgaaatgagacatgcatgtgagggtgtaactaagtgcctggcacatgaaataaatagtatttgttttgttagttgtgcttggcaatgggaagtcattgaaggcttctgagcagggaattaatc

SEQ ID NO: 76986 - DNA, 1134 bp, Homo sapiens
ccaagatcagggcaaaagggctagaaggagaagttaggcttgaggaactttcaaaagtggattcaggctgggcacagtagctcacacttgtaatcccagcactatgggaggcagaggcgggtagattacttgaggtcaggagtttgagaccagcctgaccaacatgatgaaaccccgtctatactaaaaatacaaaaattagccaggcgtggtggctataatcccagctacttgggaggctgaggctggagaatcgctggaacctgggaggcagaggttgtagtgagccgagatcaggccattgcactccagcctgggcaacagagtgagactctgtctccaaaaaaaaaaacaaaacaaaaacaaaacaaaacaaaaaaaaaggtggattcattattaaaaggatagtgactggattgtggatgctaagggaaggaggactcttagatttctaatttaggctactagggagatggcaaggccattagggggaaaacataaatacccagaaggaacaatttcgtcagctgggagagtcagggtgggaaggagcatgagataatggataaagttttggacatattgagtttgatcagttcacagagaccctggagagtttggaattacagcccagaagcaaaatcttgagtggggttttaagtctaaggagagcctctaagactgtggttctcaaagtgtggccctcaggccagcagcaaaggctacacctgggagcttgttagaaatgcaaattttgggccccaccccagacctactgaatctgagactggggggcaaggcccagcaatctgatttagcctttcaggtgagcttcattcaagctcaaatttgagaactggtgttcgagagaaagctctttagaaggagaagggttgagggaccctgcggaacagaaggagcataggaggggccttgaaaggagattgaggagtgccatatttcatcagttctaagatgcacattttctccaagtaacatctctgaattgggctgcctgtcacagttaccattgaccaggtgacagccgttccctggttgtcactgcactcaaacgcacctcaaaagttgcagagtaggggccagtggcctgagacaacagtgaacactttctta

SEQ ID NO: 76987 - DNA, 1053 bp, Homo sapiens
aagagtccctgcagagagaagggagatgaaatctaacaaaatagcctgttttaagagggtggcaatgggtgtctgctgcttcaggaaggaccaggaggagaaagaccaagaggagacaattgcatttggtagctgaaaggtcactgttgtggaattctaggattctctgggtgggggctcttgctttcaattcgtttgcattcattatctattcaacagatattaatcgatttccaggattgagatactgtacttgagatacagaaatgaaaaacataataatctccattcccaaaaagcacacagttcagaagggaggcccacaggtacacctgtgattatgaaacactaaggtagctgctttgagtgtggggatggggtggtggcgagaaacatgcgagcctatctggggcagaagggaagaaagtgtcaccaaggaggccatgtgagagctgtggctccaaggatgtggaggagctggccaggaggaccaaatgaggagtttcaggtagagggaggtatgggagggccgggggctccatgagatccatgaactattatacttactgacagttcagatctgctggagcctacaaactggaggcctcagtgagaggggattagggtggacaatttggaaatggtcagatcataaaaggcctggtaggctttgccctggagtttagattttgttctctgctctgggtggcaagagttggagaatttcttaaatttatactttaaatttatttctaattcttttcaaaataaggtatacaaatagtttaaagagtataaaagaaacataacttttaggccaggcacagtggctcatgcctataatcccagcaatttgggaggccaaggcaggcagatcaccaggagttcaagaccagcctggccaacatggtgaggagtttgagaccagcctggccaacacggtgaggagtttgagaccagcctggccaacatggtgaaaccccgtctctactaaaaatacaaaaattagccaggtgtggtggcgggtgcctgtaatcccagctacttgggagg

SEQ ID NO: 76988 - DNA, 1062 bp, Homo sapiens
aaactcctgacctcaagtgatcctactgcctcggccacccaaagtgatgggattagaagtgtgagccactgcgcctggcctgaatctggggaacttttagataagaactttatgagatgggggctgtacccattttacagattaggaaactgaggctcagagaagttaggtgatgtgcccaaagtggagtctgcacctgtctatactgaatacactcccaggttagaacctggaatttatgctaaccattggccatgtccctgtcctgagagaactcatccccaaaactgccacacctcagctgcacgtgtgtgtgctgccaatgtcctatccctgttcctacacgctcctaggcccgcctcaagagaccacaggaattctgatgaattaatctcatcactttatcgaggaggcacttaaaaaaattacaaagcaaggccgccagcctggctttgctggcagctagccgctggggccataaaataaattgaaaggaaccaaaataaacaaataattaggtctctctctctgacacacacacacacacacacacacacacacacacacacacacacaaacacacacacatgcatgcaggccaacccctaaagggtgaagagcctggttggggacttgctgttagcacttggtcctcttgtcctgggagagcaccagttccagctctgcacacacacttcctgactccttgctctgagcagcagcctgtggccttatccttcctcaaaaagtgacaggttggctgagcagctgagagcaaagcatgggaaaagtgaagagtgtgcaaagggtgtcccaggcagctggaggtgtgaagcccatggagagccctgtgagctcctggcacagtggctcagagcaggctggagctgacgggctgggtcccagtccttactgtcccataccctggattctgttcaccctctccttttttttttttttttttttttgagacagagtctcgctctgtcacccaggctggagtgcagtggcgcgatctcggctcactgctccctctggctcctgggttcaagcaatccttct

SEQ ID NO: 76989 - DNA, 1292 bp, Homo sapiens
tttgttttgttttgttttgttttgttttgttttgttttgtttgagacagagtctcggtctgtcacccatgctggagtgaagtggcgtgatctcggctcactgcaacctctacctcccgggttcaagcaattctcctatctcagcctcccgagtagctgggattacaggcacatgccaccacacctggctaatttttttgtatttttagtagagacggcatttcaccatattggtcaggctggtctcgaactcctgacctcaggtgatccaccaacctcggcttcccaaagtgctgggattacaggcatgagccactgtacccggcctggtagccattcttataacccatgaaaggagtggcctgaaaaatttatcacagattccctccgctgaatgaactctgctcataaaatgaccccctcgcattgaatagtgtttaaagcagttgtccatatgtggtcttggttaattcttcatttagtagattatctcactgttttgaagatgaagaaatttcaacttggtcagaggaaagtatatcctcaaggttagcaaagccaggtggcctgggcccctccagtgggatgcagaacccgggccttgatcctggtggacgcagagtttccaggaggcttttcccacatgttggggtcccaggctggaggctggaggagcctgtggtggtggtggtggtggtggtggtagtggtggtctgcactaatgttctggtcagcatagggggcgttctcctcctggagtaaaaggccagcttagtgagttttgatgtccctgcccagaagtggcttcaacactgtgggtggccatcctctggagagtgtttccccaagtagctgcctggtccacccagacctgccacctggagtctccatatggaagagttcaaaatgttctgacaagcacctcagagcacctgctttgagaacactaggggggagtggcagctctggcaaattaaaatccccatccagccagccctgcgctggcaggtgggggccctgggcggccagcacccggcaaccctctctgtgtctggttgcagggaacattgagtacagctgcccggccaccaacgagtgcgagatcaccaaacggaggcgcaagtcctgccaggcctgccgcttcatgaaatgcctcaaagtggggatgctgaaggaaggtaagagaccccaccgagtcggggttcactgtgaggctctgcttgctggggagtttttgtcccctgtgagacacccacaagctgtggacctgtgtcccagggtgagacccagtct

SEQ ID NO: 76990 - DNA, 3803 bp, Homo sapiens
tccaaacagaggtgtgctgagtgtacaacacatgcctgctttagaggacttaataggaccataaaaggcagtgtaaagtctggtggtgatccttttaaaaatgtgattgcatgcagaaaggctaatcttctggacatgttaaataaaacatattgtgaaattagcatcacatgcttctttgttttttttttttttttttggagacggagtcttgctctgtcacccaggctggagtgcagtggcgcaatctcggctcactgcaagctctgcctcctgggttcacgccattctcatgcctcagcctcccgagtagctgggactacaggcgcccgccacctcgcccggctaatttttttgtatttttagtagagacggggtttcacggtgttagccaggatggtctcgatttcctgacctcgtgatctgcccgtctcagcctcccaaagtgctgggattacaggtgtaagccaccgcacccggcctctttttatctattcgttaatgtgactactagaaaatttgaaatgacacgtagctctcattgggacaactgctccaggtctcctcttcctcactttctctactgatttgctcctttttttatattaaaatattattgatagaggcaaggtcttgccatgttgctcaggttggtctccaactcctgggctcaggcagtcctcccacctcagcctcctaaagtgctgggattacaggcatgagccactatgcccagccgatgttttcagtttgaggaaccttgttcagtaccattttggggatgggtcgtgagtgtatgtgtttccctgcttctccagcttccaaggggagccagtgaaaattcttagagatcaacttttaagctccgggcctggaatccttctagaagtgggaggaaacaggaaaagaggtgtgtgggggtgatcagaaggggctacagagagaacgaagggacaggtttggaatccagacccttcctggagggggaaggctaggagtgggcttctggaagcccagcccagccttgggagccccagggcactcctgctaccccctctcccagggccctctgaagataagggcccagacctaagacgctttgtcaatacaacttggaccatcatgtgctatagaaattggaccttccacttccgtttaccatttccaggtcccccacttcacctcagctcagcccagcacctgtatccataaaacagaagctcttgaagcaggccctcggcggcctttgtgtcgacatggcacactggcttttaaaatgctcctcattcggggcttcatttaacccctttgtgatggagtggaccactcagctcttagacaggccagctgcttcgttaggggctcaaccgaaaaaacagtctcctttccagattaaaaatgggctacatcgagcccgcagaaaggctgtctgttggttcatttttgactctatataattttggtcttgctcctggataggatgacccaaactagtggctgaactgggtcccctgactcctatgttgggccctttctgctccttcagagcctcctggtattcacagatgggaaaattgaggcaaaaggcccatagaagcatgcctgagtgctggtctcttgactttctctccgtgtggtgctgggaatctgagggtttctaagctttggagactcattcattcctcttaagcccaagagacagagctgcttgacctgttgttctcacatacagagctggatgtgagaacagcaggtcaagcagggggccaggggccacttggtcacagcgtgcagcctccctgcctacttgacagtatccgcggcacttagagcagccagaagcctcattgttttcaatatagccctgaattttacaggtgacaaaatggagccctacaggggctggggtgagatgactcctaccctcagtcacacattcatctgaggggagctgggcccagaggctggaactttccttgccctgttcagtgcctgctccccatggcacagcacagggatgggggaggtcgagagggaacctcccactcaattcctggaccatcttgtaacactgagcagagtctctttaggggctatgcagtgctgggaagagagaagggcactttctagtggcttcccagaaagcaggagatggtgaaggggtgcactgatggcagggagggaggtggtgaggcccacaattgaccggtggccactcagacatccagactggcacttgtcagagaaacgaggtggacactgtgtgtcccaggatgatggtatcgggggtgctgggaggacaggggcatgagacccctgctgcctcaagtggggaggatgttcaggggaagcctcagtgttgacacccctgccccgctgcaaatatagccctttggttgatggtctttacccagggtggcagctggggcctcccaggcagacatgctcggctcgaaaaggccctttaaggagttctgcctgaaggaggaagggacagccactagaacgctccctcccccactccccgccagtgctggcaggtccagatccaagagcggggagatgacacaaaggctcctgagtacggacaaagcagggagccacgtttagtttctgtcccctgcagggccttggagagatcctgggatctgaagctccgtggggaccgacccccttgggaggagcatcctccttcaacagcctgggcccctgccaggtgggggctcttggcagctgcctggcttggcttttgtttgggtgtccctcctggctctgcaggcaaggcccaggccccccaagaccagcgtgggctcatcgcccacctcagactctgacgggactctaaaaggcaaacttcaccttccccagggctgctctccgctttagggtcccatagtgggcctctgttgcttggggggctttgggggtccaggggcttggggagggctgcagacggagagatgtgggtgcctccgccctctctgctcccctcgcctgcacgtctgaacaccaccctcccgccctcatccagccacattctccttgtgttttatgatttttcctttcttaggtaaaataatcagagatcgtttcccagtttgggggcccagcaacagccacagaagaaatcagacttggggcttcctctggctctccctctctcttaagactgtggccagctcagggatctaagcttttcagattcctcacgtggctggggacagatcctatggccacgtccctgtgactttctccctggaacatccagagcagaccatggaaaacaggagctgtccaaaggcctatcttgctttaagcaaatctagtacataaaaatctgtattttcagagaaaaggtaatttttctcttttaaaaactgaacacaaaatctgggttaggagttgatggcctgtgttctgcccctggttattaggtatttttgcccgtgtaattttttttttttcttttgagaaagacaaaaaaaagcctcactctgtcgccaggctggagtgcagtggcgcgatctaggctcaccacaccctccacctcccgggttcaagcaattctcctgcttcagtctcctgggtagctgagactacaagtgtgcaacaccacgcccagctaatttttgtatttttagtagagatggggtttcaccatgttggccaggatggtctcagtctcaaccttgtgatctgcccgcctcagcctcccaaagtgctgggattacaggcgtgagccactgcccccagctgctgtttaatattattactcacgcccacctgcttccatttcttcactg

SEQ ID NO: 76991 - DNA, 1069 bp, Homo sapiens
ttgctttgtgcttgttgggaaggtggagggctcctccggggattctgggtaattgtgttagtggccagctcatgtcaggaaattaaaaggaggccctgatcaggttcccactgcatgggatttaatggccttgtatttatagagtattctgcctctagcccatgccagaaatatcactttttttctggccctgtgaatgaagaaagagcaagagagatgacttgcctttaaaaattctttttcttttccaaaatatattagtgttttgaaacaaaccaactctttaccactttatagaatggtattgagctacagcctgagaatgccaatgtgtgttgcatccctttcgagccactttacattctacacacactgccccccccccaacaccaccaccccccaaacacgcacacacacacatacctgacagctcacaggatcttcccaggcaccctgaagcctttgggccactcagccacaatgacctctggttggagaagtgttgattgaatgaagacgaaggagatgatcttgtctgtgctaaatcgttcttactgttccctgcaggcttttggataacggtacggtggtcacgtaggcctggttaaacctcatcttcaccacttatcgactccttgggccagttacttaaacccctgtaagcctccctttcctcctccataaaatgggaatcataatagtgcctatcttcatcttgctcccaatcttcagggaaagctcctagagttatactgtgaagtctgattgttgattggagatagatattcttcatgtacaaaatggatattcttctgtgatccagaggcaattttgaatctcctgtagcctcactccctactcttgtaatcttgcttcacattttcatgaaaaaatagaaagtcaaatgggacacatcttaccctcctaccattgaatccacaaacctaccagtttgtgcacctgttttctgccttcttcttggtagaatagaggtattcccaatcctgacaaacgctggtccccctcctgcccttctgtgctctgaatcgctctcttctttaccaaggac

SEQ ID NO: 76992 - DNA, 3618 bp, Homo sapiens
agcctcccaaattcttccctagatattttagacctgaatatctaaccacactattggcattgccacttgtgtcctttatgagacatcacagattaaacatgtctagagaggaactctaggtttgaaccattcctccttctattgcttccagtctttcccatctcaggaatggtgatgctagtcacctattgctcaaaagaaacctggaggtcatccttgactcctcccaggtcaatgtccaaaatgtatttcagattctcctacttttcttcatctccatggtcatgaccctggtccaaggaagcattgttttttcctggaccactgtggcagtttcctaactggacttctgattccactcttagtcctgtttaatccccctagcagtgatcttgttaaagcactggtaagattctgtcattttgctttacatcactcagtggctctccatagcacttaaaatacaatccaaacactttgctttggtcttcaagaccttgcatggtctacccactccctacctcttcagtatcatctcataccattcctttcctgtctgttcactcctacccactctgctccagcctccctggcttatttttgaccctcaagcatgacaaactgtttcccatcttaggactttcagggccttccctctgcctggaatcctctccccaaagctggctccttcttatccttccgacctcaagttaaatgttatcttctcagaaaggcctccctatccactctattacttgctgtcatatccccttgtatgcttcttcattgaacttctttcagtctgacattatcttatttatttatttatttgcagacgtgtttgcactggctgcctctaacacagttgttcttaattcaggctccaggatggcaagttgcctttagttgcactcagctggagtgcatgattgaaaggcttcttaggcagtgtctgggatcagcaggtaagagtgccatgattgattagcaatgtctgccacagactaagaaatggaaggcaggggcacaggtgataagtctttgccatgcctgatctggtcaactgagtttcagcgatttgaccaaggccagacagctagttaatgacagagctgggtggaatctagtctccttggctatgtggaattccttctaagaagcctattcgaacctcacggttgatgccttggccagtagtgaagcctgtagccctttctcaaaggggaaaaaagaaaggaacggaaagggaagctgggctgaaataacttctctgtgtcaggcgtacagttttggagacttcttggcagttgggaatgcaggcgtaacacagttttgtcaaaatgcccttggggacatggtggcatggtaagaagtgtctagaggagcccagcatgatagcagacactcctttaataggcagaattctgagagctcatcactcactaacacttatccaccacagtgcccggagcccacagagcagctggcaaaagccctggaatattaggtgtcatgtatgtctgtttagctacaaggctctctctcttagcttttaggaagtcaggtgtgaggcactctgcctttacggtgtgtcactggggtaagaggcagcccaaatgagccattgtgtctgaggcagcaaggcaagcttgcctgtcacccagaaacccgcacaggacaggtggctgaaggaagtccagtgtatacaagggttgtggctgagagttcagggcattgcactgggctggaatgcccatcagcatgcccacacaacttccagaacctcaggggctcatgatacccacatcaccttctgggtggttttctcctcctcctggagatgggtcagctatagtttggtagaacctacaggcagggagttcacccccaagtttcctgggaagaacactggccacataaaagtattgaaaaaacgggtttagcacagtgctccccagacctggcacataattagaattagtagaggagctttggaaaaatactcattcctcgacatctccctagacctactgactcagagcctctaaatgagtaagtcctcaaagtctgtgccgttcaaaggcttcctagggcattctgaggttatatgggactggcgtcacaagtttagggcaaagaagataggacttggagatctgaaaatcaaggttcaaaatttccctgtgacgtttcttggatgtgtgatcctgaacgagtcgcctgacctttctgagcttcagatcttgcatggaactaatcataatcatgtatattcttcctcctcaacattgttgggcagcttaaatgagatacgggtatgaaatagatttgtaaaccatgaagctgcttatttcgttaataaaccagggatgttgaatttggtgatgggggaaagttctggataaggggaagagaagggtgttggtcatgaaaaccttgcaatgccagtggggatcttgacctcagacctggatagtagctgatgggagggcagaggcctttccctcgcctgccctgtctgaacctttcctgttggaagagaaatatgatgtgggaagcgcctgggacaggcttagggccaggtgcagggccacgctttgcagagctttagccggctatttttagtgcccgggtgtaaaagaaagaagcttaaagtggccccgctgcggctgaccctgcacactcggctatttttacttccgaaagactgggatcttgtccagcttaggcagggaagatgagaagaaaggagggaggtggagggaagaaggaattattttacttccattaagaaaaatgtcagaaacctgatcttatcaagtcagcaagtgggtatccaatcccggatgtgtaaggtgccggctgtggacgctgtgacgtgcctgcagtggattggagaggccagcagagggggagccccgctcccctcctctcaaggagtttctgtcccagagtggccccgaagcttctttgctattttttgtgccctgagctgggaagtgggcttggcccccacaggcacgaggggcaccagcctggtgacgaggccggtggaggtgggagcagttatgactgcagccaagggtggaacctctgttctcaagttggacaaaggcagccatcagacccactggcatattccagagagtcccagtgttggggctgtgtgccctgggcacaatatttaacctctctgaaccttaatttcttcagggattttgtttaatacatctgactgacagtagttacaactgtggggatgtgtttctctcttccatgaggaaggcagttcaagccagactctatgaccttcaacaggcagatgaaaggcaagaagttactactgagtgcctactgtgtaccaagcactctgttacgtttcaatattttatgttgttaattccactaacctgagaaaggatacatatttttaaaaaattttaacagctttattgaaatatagttcacccatttaaagtatacagtttgatagcgttttgtattcctatatttgtaaattgtggcaaaatatacgtcaagtacaacttggcattttagaaattaagtgtacaattcagtgacatcaaacacattcacaatattatgcaatcaccggcc

SEQ ID NO: 76993 - DNA, 1106 bp, Homo sapiens
aagcattaataatgctcaaatgtaaagtgtcacatatttccaaatactgcaataaatacagatcctttgttttaaccaccattaacaccgtttaatcccttaatgtgtacaggtcaaaattttaatatttctgagtgctccatgaatagaaaaaaattgataatccctggaatacatgaccctgtgcagacggagatcttgagttgagatcacaccatttcactccagcctgggcaacagagtgagactccatctaaaaaaaaaattaataaaaaaaaaaacccacttcactcttaaagattttctgcatcttgaccatatcaatgtcaattgactgtatcaatgtcaatatcctggttgtgatattgtactgtagttttttaagatgttaccattaggggaaactgggtaagcgatgcatggcatctctctgtattatttcttacaactgcatgtgaatctgcaattatctcaaaataagaagtttaattaaaaacttaaaaaacaatgctgctggaaaagtaaaatggtgtaaccatgtagaacatagtttgatggttcctcaaaaagctagacagaattaccatatgattcagcaatcccactcttaggtatacacccccaaaaaaactgaaaagagaaatctgaacatacatctgtgtagtgtggggaaaagaagcaaatttttaaaaaataaaaagaaggaatttgaacagacgcctgtaggacaatgttcactgcagcataatcacaatggccaaaaggtggaaacaacccaagtgtccgtggatagatgagtggagaagcaaatgtggtatatacatgaaatgttacttagtcatagaaaggaataaagttctgatatatgctataacatgaatgcactttaaaaacactacgctaaggaaaataaaccaaaaggacaccaaaggacaaatattatgtgattccactttttctttctttcttttttttttttttcgaggcaaggtcttcctctgttgcccaggctgcagtgcagtgagtccatcacagctcgctgcaacctcaaactactgggctccagtgatcctcctgcctcagcctctccaggagctgggactaca

SEQ ID NO: 76994 - DNA, 1040 bp, Homo sapiens
acaatatcacaaccaggatattgacattgatacagtcaattgacattgatatggtcaagatgcagaaaatctttaagagtgaagtgggtttttttttttattaattttttttttagatggagtctcactctgttgcccaggctggagtgaaatggtgtgatctcaactcaagatctccgtctgcacagggtcatgtattccagggattatcaatttttttctattcatggagcactcagaaatattaaaattttgacctgtacacattaagggattaaacggtgttaatggtggttaaaacaaaggatctgtatttattgcagtatttggaaatatgtgacactttacatttgagcattattaatgcttttttgcattcagaaaattatcaataagatgataaaatctaataatcctagacagtaattgtaagttaattagtattttaatgtgtttcctgagtctacttttagatattttactaatgtaaggacacaaacaataaggcaactctcatttcaagttcaagtcttcttgtttatttccagttagtgtttgtaagtcttaagcatcctaattttaaaagtaattgcccattgtatcagtcagtgaaaattgctttctgctgcaagttacggagaacctgatagctagcagcgtaagcatggataaatgaagttggtttttccaccttacaagaagcctggagatgcgcagctgctgtattgcacaaagttctcagccatggcggcaggggcgctccagctctttctttcttctctggtgttctttggtgtcctcagacagccatgtcatggctgcaaggtcgttgccacacctgtaggcttcaccttccaggctggggcaagagaaaggcaaaagagctgcactgaacatggctgtcccttttctcagaaaagcaaaaccgttccagaagtcctgccatggacttaacctgacatcccattgccgtggtggcacgcacctgtggtcccagctactcgagaggctgaggcatgagaatggcttgaacctgggag

SEQ ID NO: 76995 - DNA, 1047 bp, Homo sapiens
cagacctgaagatgcagctgaagcccacttgtccaaggccaaataacctgaaataacccgtaagggacagagatgggcatgggaccttcattatcgagcccatgggctgcagtgattgtgggctgtgcttagggcaggctcagaagagcagacaggaagcaaggggaacagacacatttcacatcaggtgtcagtttgtgcataattaaacccaacaggctactgtttttttaacagcgtaatctgataattgatacacgtattgattggagccattgaccactatgctgtaaagatcaggaggagaaaatttagaggagaatttaacatttgctgtgcgctgggaggtcataccatggaatggcaaaaagcttgggtcttttattggggaaatcactgaatctctctgagcctcagtttttcttatttgtaaaatgaggataatagcacctgccttatatttttgtgggttaagtagggtaatacatacagagagtcctttacaaattatgctgttatcattatcattattcatgtgatttaccaaaaacttggatgcaatgctggggaacagtaataataaggatgatgataataaccataataatcccattttctaagcacatgctgcatcttgggtaccatgacagactttggggcaggactgtgagccgcccctggccttaacgggtgcctagtcagtaggggaagcccagtgtgctctgggagcccatgaagaagcccccagcctggcatggggatgaggaggacagaggtacatccacccctgtattcatcaagtctttcctgaacatccatgaaaggtcaggccctatatcaggacacagaacatcccagatggagacatcggcagaggtggcagctgcccatctccttgccttgccgagggacagacacctctttttattttgtgttgagcatgcctcactctgattgacagctgcttgccgggaagcaggctggatgggaagcgagagttcattccagtggtatctaggagagaaggtcagtaaagtggggaagggg

SEQ ID NO: 76996 - DNA, 1442 bp, Homo sapiens
agggtttggtttggcctgggtatagtgaacagaggaggcttctatgtagacatgtcacaggatagagtcagaaagcttttctagacagggaacttttcccaaaagacttttacaggaagaatcatccttcctgtgtttgtgtctgctccttatgctgtcactgaaggggcttgcagggggtgagggagcaaatgtgagccaaagtgctagcagcacataggttcaggtctggagctggatggcatctagctgtccctttagggtccaaggtacaggcagaagttgatggtacagctgcgtttgctaggatgccttagtgcagtgctcctcaaactctgttgtccgtgcaaatcaccttgtctgattcctctgtggccaggcctgagattttgaggcatctaacaagcctcaaatgatggtgatgatgctggcctgcagaccacacttgaggaggaagacagcggagactgctcctgcccacacctactcagcactgtctgtttgtgtgtgtgtgtgtgtacgtgtgcatgcgtgcgtgtgtgtgtgtgtgctgatctgacgcctaggctttctttggccaccagagtctgctcagcctggacctgggaggcaggcaagaagcgccaaagcagccggtagctgggagcctcagttgcccacagcagtactgtcctcaggaacacatttgttattggctttcttccctccttggaaactgctcgcatgcacagccttgtctcagattctgctcctggagaagtcaacaacaaatgtcagttacaaaacctgaccttctaggcagaaggggagtttattggaagcctatcaggaggttcaaagagtacatttagaaaccagacaagaaccaggagaatccctggagagcccaggagcaggaaacccagtagccaggacatactggccaggggctgcctacactctgctggggaggcgctgctggtctgatcagtcctcaccttcgctctgtccttgtgcctccgtttgatggtgcacttggctgagcctgtgtcacgggtccatgccttgacctccagagagcagagagaaggagaacatgtacttctcagatatccattgaggggtgggacacagacttccaacagtttccgtattcccaataggggaattacattttttaaattttcttttgagatggagtctcactctgttactcaggctggagtgcagtggtgcaatctcagctcactgcaacctccacctcctgggttcaagcgatccttgtgcctcagccacccgagtagctggaattacaggcacgtgccaccacacctggctaatttttgtatttttggtagagatggggtttcgccatggtagctaggctgatcttgaactcctgacctcaagggctacggcctcccaaagtgctgggattacaggggtgagccaccgcacctgac

SEQ ID NO: 76997 - DNA, 4431 bp, Homo sapiens
gcagcaggagctgtgggtgaggcaggcttccggaaggcaagttggattcagtgacaatgacagatctctccagggtaaactctcactcctggaagtggctgtctacgtggagtagccacagctgcttttgaacctactttcaagatatttccaggcactgattttccagtccagaggtggccagcccaactgttgcattcccatcccctggggacttgtgtaaagacagactctagagctttatgctagaacctcagagagtggggtctagaaattgacatttgtaatgagcgcctcctcagatgcttcttgtgtgaaaagtctgaaaacccttgaagtgcctgtgaatgaccgggattcctttcttttgttggcaagttaaccctccctggattcaaagcagatctaacataatgtgacttcttccgccaacacttggtagagtgcctttgttgacataaggagaaccaagggctgagggttgcttgggatgaatttcagaaggatgctgaatccagagagacaggaccaggcctggggcaacgggatgcgccattactgttagacaattattttaggattgtccagccacctggcctgaggctggccgtggggcagctgtcgaaggtcatccgagcaaggccctgaaggacccagccagtgctgaaattccaaagtcagtgcttctaccctggtgatgttgaacaactgctgagatcttttccctttcctccccaataggtgtgcgccttgatcgagtgcgtggaggccgtcagaaatacaagcgacggctggactcagagagcagcccatacctgagcttacaaatttctccacctgctaaaaagccatgtgagtgtcagggcagtccctgccccttttgccagcatctgtacctggaacatcaggcatcccttagggaaacatcatcttcccaccactgggtcatgagacaatgtggatcttggggaggtgacatcagtgcctggcacatttagaatgtggctccaaatgaagcatggtcctgacaagccacgggccccaatgtccagaacatgctccccttgccacccacccaaagttgctctgcaggttcctcctggagaattcgtcaggcaacttcccttggagggatatttctcaacagcccagatcaccactaccagcaacttcatggagccagaacaggaggggagattatagccgctttgaccttcctggagctcttaggaacccaactttgcttcctgacccatctgagcctccaccccggcccctttcctcttttcccagcatttacctttccctctttggttgttgcagtgaccaagattgtctcatacctactggtggctgagccggacaagctctatgccatgcctccccctggtatgcctgagggggacatcaaggccctgaccactctctgtgacctggcagaccgagagcttgtggtcatcattggctgggccaagcacatcccaggtgagcatgtgggaccaggggagagtgtggccagggactctcagccggtatctccgcagcctacccaatggctgtgcttctgatgcccggatcctggaccccagaaggcctgtgaaatcctggcaggcctgtttctctgagctcctcttctctccttgtagcattggagaggaacaggtagttagaagacccagtgaggcttatacactgctgcaggctcttcagaattagttatcattcgaggcggggccatgtttggatctacaatcagtgtaatattcaaagaacaagttccttgagcccttaaagggcaaagagtagggttttcttgtagaccttattggaaggatgccagaaaacaacagaagaaagactgaccctctcttcctattggaggcagcagaatggagcagtgaagagcatggccttgggaatcagatcgggattccaattctgggtctgcagcttactagctgagtaaccctaggtaggccacctgacctctctgtcaaatgggaatacaagagtcccccactttgtgagctttgatgtgagcatgaaatgagatcctgtgtgtgaagtgttcggcacagtgtctggcatgtgctggcatcagttgcatgcccactattgccattcgcctgatctctaagggaggcctgtctctggattggcttctgagattttaagggcctttctggtgcggaaagtgtgtgttccatgtttcaggctgtgtggacttctcttcgctgtgtgtggacccaaaccctgctttcaccctctctaggtctgggcagatggcgggagcttttttatttttgtagacaccaacacccatgtattctacattacatacacattgggggcctttctctgtgcaatttattcctcaactcctttaagactctaataagttgactcagagtgtggtagaaacatccttttatccttctggtaatgacccaccatgaacatgggacaagtcagcttcctgtctgtagatccgtttttggtttgtcatggctctgaaaggtgattacagcagacgatacagcaaaggtgacctagactttagataccaagacccacagttgtttgtttgtttgttttttgagacagagtcttgctctgttacccaggctggagtgtaatggcgcgatctcggctcactgcaaccttcgccccccaggttcaagtgattctcgggcctcagcctccccagtagctgggattacaggtgcctgccaccacacccagctaatttttttgtatttttagtagagacggggttttgccatgttggccaagctggtctcgaactcctgccctcaagtgatttgcgcacctcagcctcccaaagtgctgggattataggcaagagccaccatgtctggcccaaggcccacagttgattgagagaataaaaaatgtccttccatgtgagaccttacatgcccaagttgcaggaaggagccttcctgtggacagggacgcacagagacatcagatggcccagaggctctgctggcagggactgcctggtggcccctgggcattctgaccagggatctgggctggtacgcccttactaaggagctcaacctctcggggattacacactcagtagtttttgaatctgcccagtgctggttcagcacagatgtggggtcaggccactgcttaagacacttcagcctggattgctccactaacccagggccaaattgggtacaggtacccctgcccccgccccacactcctgttccaggttgaacagatcctgcatcctagcaatggctcacgagtggcgcctggtggtcccctgggtcaatgcttccttcttccacaaccccacccctgcaacaccacggaggaagtagataagaccaggagaccctgtctcccctgcactcatttttctctgtgcctttccacctcccagctccatctcccatctgtgaccaaccaagagggcatggctagagcagagtgagtgctaaaggcatagactttggaatcaggcagcctgggctttcatctcagctctgtccttactggccttatgcaagatactgaatttttcggagcttcagtgtccttgtctgtaaaatgggaatcacgatagagccccttcacgggattgctgtgaggatgtagcgcgcttagtgtgtacaccgggtgaatggcagagacgcttaccagcgctgttgtagttgctaatagtaataaaagcctcctttcatggcttcatttatccttgtccaaagccggattctttttggtaaaaaaataaaataaaataaaaacgggctcagttgtccatcttaaatgctaatttgcctattttgcataaatctgcatgctgaattctttgcctcctgaccttccagtgtttaaggtaaaattaattagtggagtctcctgccactgcatgtaaactcatactaagggcaatgacacaatcaaatgcctgattttttttttttttttttttttttgagatggagtctccgctctcttgcctaggctggagtgcagtggtgcgatctcggctcactgcaatctcctcccaggttcaagcgattctcttgcctcagcctcccaagtagctgggactacaggcacgtgccaccacccctggctaatttttttttctatctttagtaaagatggggtttcaccatgttggccaggctggtctcaaactcctgacctcaagggatccacccacctcagcctcccaaagtgctgggattataggcgtgagccaccgtgcctggccaggtgcctgatatttttaaactaatcaacttaatcccatctcagattagatggaaaatgcatctgaagatgggctccctatccctgagagagagagagagagagagagagagagagagaaagaaagagagagagagagagagctggttgagtagggaggataaa

SEQ ID NO: 76998 - DNA, 2028 bp, Homo sapiens
ccagtgtccttaaacgcaaggtaccgcatctcacgagagggcattgcacacttagctttgcatgcacatattgagaagtcactacacatgaggtcccctgataggagttgtggctgagacaaggaatttattttgccccaaggatcccatttggaacaaggctgacatccagggggagcttggttcactcagaatcccagccattgttcaagtcagtctgacattgtcctaccccaaatgcaggttttttaccttgagttgaatgttccaagtattgggttccccatagggcaagcccaagtcttcagagtgtccatttcttattccatgagatcaagagctagctgactttaataggcagtggggaatcacttgatgaattgcagcctcctccaaatgacccgagcctgccatcctgcctccctcggcagcctcatgcctgtgccagccaggaaagcctgcccagggagtttccaccaccctgccctgcccaggctcccatgtgcagggcatccccagaggcctcctcacaaaagtccctcagcggcactgctcccaggtagcccccatctgactcaatgaaatatgagctgccgagtgacagcagctgtgtctgaagtggccccagatcctataattacatctccctttattacctctgctaatggccctccaggtcgacagaaacgatcataaattaacagattatgaactccacttgccacaaattacgtgctttttttttttcccccttcaattctaggagcttgtggtgccaaatcacggatggggggatggggagcttggggagagcctgaatgttattagatgagttggtgcagataaaacaattttcctggggcagcagagctccaagtgggagcatgaggagccagaagctctgggcaggcccgagagccttgatgaggcagtgctgcctgcagtgagcccggcacagggacacccctgcactcccaggggcacggggcacccccagaccctcccggtagcctcttcaggggcctcttggtcccagagttactaataacttgagaatgagacccagcccagctgagagaggcaggggtggaagcgctttactgaagggcagggaggagtgcctgggctccttctgggttttaaataaaagaatctgtggttttagtaaagatatcagatgggacagatgggtcgaaattaagagttccaaattccccatcctaaccttccttctgggaatttcctgggcagatacaaccactgtgtgaggtgtgtgtgtgggtgggggttgtgtatgtcccccagtccatgggcttataccataacactgctttacacctgctttttccatttaattatacaaaatagtagcacttacctggcaaagcagggttctaagtgttccacatgtcagctcatgtaatctgaacaaccccatgaggtgagtgctgttatgatttccattttacagaagaggaaaccgaggcactgagaggcagacttgccagggtcacagctagtgaacagcagagttaggaagctgatctctgtgctcatacgattacaccctttttgcccccttggctgtctttccacgtccacacagagttctaacttatttggcacattcatttaactaaaaattacatctatgtaataatcacatgtattacattagttacctttttttttttctattttgaatcatttcaagcagtgatctaatacccttttacatttatctctatgtctttattcatacttttctttctaggataaatttctttttttttctttttgagccaggatctcgctttgtcacccaggctggaatgcagtggcatgatcttggctcactggagctttgaccacctgggttcaagcgatcctcctgctgtagcctcccaagtagcagagatcacaggcatgcaccaccatgtccggctaatttttaaattatttgtagagatggtgttttgccatgttgcccaggctggcattacactcctgggctcatgtgatcctccc

SEQ ID NO: 76999 - DNA, 1387 bp, Homo sapiens
attcactgcacaggggacttttcccctgcgtttccagaagcctagtccttacctcatcctctctctccaccaccttccaattcagttgtctgctaatttcacccctgccctcctcctccatctcccctccagtctgtctgcttttagaccccctccctagagctgtccaacactccccccaacacactctccggtgctggctgattggtatctgttaattaatgttgcccaaggcctctctcctactcaaagacctgataagggaaattggatgtccatttctatctatcttttattacctcccagctcccccggccaccacaggcagccacacaccctctcccatgcagggaatctggacaaccacacacacacacacacacacacacacacacacaccctgatcccctgtcacagcctctcccctgagaaggtgcatcaatcaaagctcccccgtgtcagtcggtgtaatcactcctgctcttttgttgatcacccatggattccattagccagtggtgatctgaggcccaagttgtatagatcagtcttgggaactgtgataattcacttggagaatgctcacagggtaagggtggtctgcctggtcagggaccttcagctccaggagtgacccctaaggttcaactgccatgccctgtgtggaagccagggaagaagtggcatttggagacaggacagcagatggatgggggagaccacacaagccaaagagctgggtggtccagaagctcaggaccacccaggcctccaggcaagtccagagaggagaagtgagtgatgccaatggtgtgccaacaacaacaacaatatttagtaacaacagccacagccatgaccagcaccctagcatgttgagtgctgatggcgccgggagaggtgcccagcactgtacatgcatcttctcttttcgcccccacagcaccccacatcagaaagtggcttccagccaaggatggggtctaagtcagcaaatgaagtagaaagtccttcctaggcaaaattacccctgaaaaaaatcccttcatgtcagttacccatagtgcatggtgcaaacaactttgtggatgcccttccttctttgaataaatccagcatgtccgtgttagaaccaatcactgagtttctgtttgaatctccagtgaagttactgccttgtgtttggtggttaagatgcttgaaaatcagctgacttatttatttacttactctctcttactctcctataaatcaagatgttaattgactttgcctaatttaagtgcatgtataatgcaattccagtacattatcattgttctgcagtgagaactttcatctcatcattagtaataatagctcagtaaatactttgtatattctggaa

SEQ ID NO: 77000 - DNA, 3677 bp, Homo sapiens
tggaatcagcctcctcaaatagcagggaggggggaactagcatgattccaagctcccggaacaggcctgctgggtcatcgttaagcagagagttatggcccgggaagaggggctccgaccctgggagagcaggctgtcctgtgagaaagtgcccctgaccccgggggctcttgatctcttagcagccccaggctatggtcactggggccttcccctgtggctttgaacagctgcgtcctcgttcttggtcaggcccgtgggtctctgcacagctgagactgcatcaaggatcaggtgtcattttcaaataccaaagcctcccctggtttgagcagagagtgggccctggaaactccccagagtggccgagagcacgtactgctgcctcctggttccagtatgtactcagtcactcctttaactacaaatgcattgaattaaacaaaaagcctctacagacgtttggaaaataccatagagctaacaatcataatgataacaacaactgtcaacattgactgagctctcattttgtaagtcttttccgtgaattccaagtctgaggcattccccaaggggaggacagtgagtcttacgctacacagggaaagcctgggggcaggatccaggggtgccagggacaccccgcaaccagccacgccctgcaacctctgcccccagcgagccccagggaggcccctggtccgccctcctgacctgctgctgccctctgtgccccctcttcctgcaggcttctcaagcctctccctgggggaccagatgagcctgctgcagagtgcctggatggaaatcctcatcctgggcatcgtgtaccgctcgctgccctatgacgacaagctggtgtacgctgaggactacatcatggatgaggagcactcccgcctcgcggggctgctggagctctaccgggccatcctgcagctggtacgcaggtacaagaagctcaaggtggagaaggaggagtttgtgacgctcaaggccctggccctcgccaactccggtaagggcggcggcggggcctggaaggggagcttctagggctctgcatgggcctaatgagcccatccctggggcctgtgggcagggctggctgccatggatagagatgaaaggaaaacactgaaactttttattactgaagattgtccaaggggtggcctgcagataaaaagctggtgatgaaggctgacactggctgagcatttcctaagcctcagacatccagactggcacactggctaaggacatgggttctgaggccacattgctaaggagcaaatcccacgtctaccaactgggcaagttgcttcactctgtgcctcagtttcttcatcagtaaaaggagggcagccaaacagtccctactctacaaggctattgacaggatttctttatacataattatattgcttgcaacatgcttggcacataaaaagcactcaattatttatttatttgtttattatagacggggtcttgttctgtcgcccaggtaggagtgctgtggcttgatcctagctcactgcagtctcaaacttttgggctcaagccatcctcccacctcagcctcctgagtagctggaactacaggcatgtgccattattccggccaattcttatttctattttttatggagatagggtctcactatgttgcccaggttggtcccaaactcctgggctcaagcaatcctctcacctcagcctcccaaagtgttggcactacaggtatgagccaccacgctcagcgtcaacttattaaattagctaggagtttattgaattcttacaaacaacccaagagtaaaattcttattgttgcaaccccattttacagatgtggaaactgagacctgaaaaagtaaagaaaatcacccagggtcacacagttaaaaagtgtcagagttaagagtcaaaccaaggtcctctgattccaaaatcaacctgaacctatacccactccttgaatctttcagtcaaatttcttgaacacaggaggataaaaccttcccaactgagtggtttaagctggagttacaaaggaggactcactccatttcattagcatccaccaacttctggctagattatctgaggagagaggcaggcgttgggtaatgccagtaagtgaacttgaatgtaaccaacatccacacttagagagcttccacactattcagggaatggtgctgggtgccagggggctgcaggagaaggataaatacagggtaccctccctaaagagaacacatgccaggaatcacacacataattctgttgcagagcagtgtgtggcagagttaactgcccaggtctgggtcagatagacccaagttcaaattctatctctgacacttcctagcagtatgaccttgggtaactcagtgtccttgtgtgttcagtggggatattctgagcacctcttccaagcactttattttattttatttttttttgagacagagtctcactctgtggcctgggctggcgtgcagcgatgcaatctcggctcactgcaacctctgcctcccgggttcaagcgattctcgtgtctcagccttccgagtagctgggactacatgcgtgcaccgccacactcagctaatttttgtatttttagtagagacggggtttcgctatgttgcccaggctggtctcaaactcctggcctcaagtgatccacccgccttggcatcccaaagtgaggggattacaggtgtgagccaccacgcccagccccaagtgcttttgtgagtattaaagattgactgacaataaagcactcagcctggtgcctggcctagaggaaatgttcaataaatattaattattatcattactattaatgatagaggatacaaagtgttattagcatatggaaaagggagaactggctcccagatgcagacagtacacacagggtaaccaactggtttgctcaatactgtcctgcttttactgaaagtcccatatcccaggaaactcgtcagtccctggcaaactgggacagttggttgccctagcacatggcttcatggtgcatgcagggggtgctgttgatgacccacttggatcccttttactgggttagtgcatccatcccctagctgctaacagttcagaggtacccctttgcagggcctaccctcctctgccttgcccagagggttatgtggccctttccttggcaccaccaggcaatggtggacccacatgggtacaaaagttcggatcagagccctgcatgggatcaggctgaagccgaggtcccatctttgccttgctttctccttccctgtgcttcctgcctccccacttcctttctcctgaacacatgccccccgtaaatgtctgtacctaaacccttgcctcaggctctgctcccagggaacctgatctaacacagaaaaggatgccacttttttagttcaaatcttttattaacaataaatgaatgcaaaataatattaaaaattttacatacgtccacagagaatatttacacattgaattccaaaattgtagtgcattctttgttagagaatcctaatgctgtttttttaaagtatagttttagatttacagaataacttttttttttttttttgagacagaattttgctcttgttgcccaggctggaatgcagtggtgcaat

SEQ ID NO: 77001 - DNA, 3292 bp, Homo sapiens
gccactgctgaggctcagtgcacgggatgactcaggtgtggctccagtggctcagggggctgacgctgggcagaagtgcccaagcacatcagaggcagactgtgaccccacaccatggccccctgggagcctgctggctgcggtttaccccacatcccagccatccccaaagctccctgacagcaggaaaaattcatagccattgattttgtaattaacagtttatcaatgccatcgatacagaccggctgatggattgcaaagaaattaatcttgcaatgttattttatttcatttttggtcgaaggcagctgccaattttgtcctccttggggagagtcgggggaggatggagagggcggggagagggagctggcaggagtcaggagcccacatggcaatgcccagccatgttaggtacacactctgtaagtggccgagagtgtaggattagggccttgcttcatctcccacctgatgacgaaggagtgctcactgccttggtagcagggagcagaaaaatgtggaggaggcttgggtgtggggccagtgaagactcagccctgcaaggacactcacccccagcctgagtccccacaggaataacactacctgacattgaccaggtgctgatcacgctctgggtaatgtgctgcttcagtcaccctcaccaccaccctgtgagtcctcactcctgtgttttacagccggcttagacccagctgtaacgtggccgtcagcaggtgcctccctgccgtgctgggatgtaggtaaattttgtttgaacccctaggtcatggcctaagttcaaaacctttcccaagattttagagaactccctatagctccctccatcaccgtgcctcatgccgccaccttgacacagtgctcagcccctatatctgtgcctgtattctgtgtcctataaccagaattttgtcaggttagcgattgcactgaagacttggggagctggtgcctggcagcggcagctgcagtggttgtcatggtgatagtagtgatggggctaggggcggtggtaggggtgataccgctaccagggcactgacttgtgacaagttctgttataaacccttgacctgtttaactcctttaagcccttgaggtaggcatggctattatcccattttacaagtgaggaaaatgaggctcagagaagttaataacttgcccaaaatcacacagcctgcaagtaagggacacaggattccaagtctggctccagggtctctgctgccaccccctggtgacctcttgagaaatgtcccctgtagacgccagtctctccctgggtttgagtcccagctctgtcattagcttctgtgacctctctgggcctcagattggctctctgtgaagagagggttctgaagatacccctgcctgcctccatgctgcctcctggaccccaagatggcccccacaccaggcagcactccctggccaagcctgctaatgctcgtccttgtgcctgcagattccatgtacatcgaggatctagaggctgtccagaagctgcaggacctgctgcacgaggcactgcaggactacgagctgagccagcgccatgaggagccctggaggacgggcaagctgctgctgacactgccgctgctgcggcagacggccgccaaggccgtgcagcacttctatagcgtcaaactgcagggcaaagtgcccatgcacaaactcttcctggagatgctggaggccaaggtgtgatggccccgcacacggaccaatgcccacctacagacagacaaacggacagaccgaggtggagacctccacagccaccagcctccaccttcaacccctgtatcatggctctgagctgtcccagaggcgggggtttctcacctcctggctgtgtgcagactcccgggtgcagtggggtgggggacggggatgggggggcaggggtgtggggctcgactgtaactggctttttctttggtatgtctttccttctccatggacggtgcggaggcctgggccagggctgactcccttcaggagtggaggccactggagcaagtgccctctcccctccaccgagccaccaagaggcagcatgtgcatttcctaactcccttgccccctcccccatctgtggcctgggtgggcactgctcaggctggataccacctggaggttttccttccgcagagggcaggtacgcaagggacaacagtatctttcttccagaggtcctacctgctctgagatcctctggggccggtcaagaggccccataccttccacagtttccactcagctttcagccagggggtacccacaggagagcagcggctagagctcaagtgcttcctgggcaccccacccctcggggcctacccccctgcctgtcacccaccgcgccggtgtccacctgtcctcctcctcttctcctccccccgggagtcccccgctacttcctgaccctacctcagagctcactcacccagtgggttcagccagccacagcgactccaggggctgtagacaggaacgcgctggcacagagaagagcggggaccacaccatcctcccaagaaccctctccctcttcctgccttccccctctccctgaagggcaggtccaggccaagtgagcctgtgagaagctcaggagcctggctccatccaagagcaccccggggggaggatcaggacaggatggacagaggcccagactcatctttgccaagcacagaaaggccgagcagctgagataagtaggcaggggagccccaaagggagggaactcagcggggtggcctgcctcatccttcctggcttcccttccctgcactcagcatcatgccacagggctagtgtaccagtgccacaggaggggtgccctcctaccacacttgggctaccagaggtttggtgtagctcccctgggcaccgcgagcacgccagctctctggcaggacccctgcagtccccctggctgtgccaggtaaccaaccgtcttggtttgtccaggacgtttctttatcccaggaaactcctctaccccaggcacacggggacagtgggtcactctatttctgtggatggccgtgaaagttttcactaactcaaggggcagccctgaacacccatttgtgctcacaggttggccaagagcagcttagaggatctcccaaggatgaaagaatgtcaagccatgatggaaaatgccccttccaatcagctgccttcacaagcagggatcagagcaactccccggggatccccaatccacgcccttctagtccaa

SEQ ID NO: 77002 - DNA, 1671 bp, Homo sapiens
tctgcacaccaggcagctgcacctcactggatctagtgttgctgcgagtgacctcacttcagagcccctctagcagagtggggcggaagtcctgatggttggtgtccatgaggtggaagctgcttttatacttaaaactcagatcacaacaggaaatgtgtcagtaacaatggaactccatccaatgggaaagttcctggtactgaaggggtccattggacactcagaaaagaagttcaggggccaacttcttagctggaatcctggccagatgaggaccctctccggggaagggagaggactgacttagtggaaggtggtgaagtgaggagagtttaggggaaccttcccccagtggaacagatctcaagtttaccctaaacctgccatttctggaaaatctgtaaagaggaaacagcctgtctcagctgtactctcatgatacaggtcatttgaaatgaaccaagaaataaaacatgaaaatccaaccatggagaaggtggtatggctgggttttgtttggtccccttgtccttatacgttctaaagtttccagactggctttgtcactttgtgaactcgtcatgtgtgaaaaccaatctttgcatatagggaacttcctcgggccacactttaagaaccaagtaagaggctctcaagactccagcagagtcgggaggccatggcagcgccttagaggagctggaacctgcacccacctgtgtcggtggggggggcctcctttccccatagactctgccctccctctgtgcagatggaagtggcaggggagggtgaccagcttgtgacaagaagactgaagggtccagagtccatgctcacggaacagcaccaaagaaaagcactatgtggaaagattgttttattttctaataatgataatatggctggaatggcttcttaagatgtatatattttttaaaatggcagttccccattgcagcatcacctacttgtatgtctttctgcctctgtatatgttctcccagaaacccccatgtaaatcaaatgccctaggatgcttccatcctggtcccatgtatctggaatctaataaataaggaaaggaactattgagtttcttcacacattgtctttctgggctgactgtcccccagacagcactgcccttgggtttcaggctgaggctaggagaggccgttgggagaggcaacccagccttagtgttccctgggaagtcccatggtgtcattttaaaacatgttcaccagcaaagctcaggaatgcaactggagaagtatgctgcaggtctgagaagctccctgttgcttttatgcttttaatattaatggtaaggcaatcgattactttcattaatgccagagaaatgagatatcagatatatgtgaatgaaaaccaattcattaccttaggattttgaattgcatctgtgacacacacaacaccggatagcacagcccacatgttattccaggacacactcaggaccagtgagaagcagaggggagggcctgaaagagatcaaagaagacatttcaagatgccttttgtttcaagtaaaagttaccttagcttatactggcttactggatttatatgtgagtccggaagtggggtaggcatcaggcagggtttgatccaggggtttacaaagtcaatagggttatg

SEQ ID NO: 77003 - DNA, 1074 bp, Homo sapiens
tgccagctcttacaagaggaagataaatgataacagcgctgggaacaaaaccaaacatccttcatgttgtcagagcaatgaagccagcacattgcaagtcatgggccccagacagtgccttacttttggaaaaggcttgggttcttagtccccttctgctctcagtgaacagcacaattcatcttccttggggtgtctcctgaaactgtgggtagatggtaccctggggttggctagagggaggggagtcaacatgagccagctgtccttctcaacgtcccctctctgggccaacagtggtcttgtgtgactccctgggtcccttctgtgtcccgggtcaaccagacagggctggcttccatgtacatttagcaggttttgtcccaccctctttcatagagcactcaaatattaatgctgctctaagaggaagcaaactgaaacacaccggcagggggtgctgagaagatcacagagacttagctgttgcataatttctggctttgaatgcagatagagcatgaagaagaagccctgctctgagagtcagggaacccgcctgaatttggggctctgctttgccactgaagaggcaaggagccaagtcagtcacttaacctctctgggtcctaatccctaacttaatgttaggaatgtcctaatccctaacttaatgggttgaccaaatagacttcaagttaccttctaattttttcactctgttatttcttttttttttgagagtgagtctcactctgtcgtctcactgcaacctccacctcccaggttcaaacgatcctcctgcctcagcctcccgagtagctgagcttacaggcatgagccaccaggcccagctaatttttgtatttttagtagagacggggtttcgccatgttggccaggcaggtctcgaattcctgagctcaagtgatccgcctgcctccgcctcccaaaatgctgggattacaggcctgagccacggtgctcggcccactcttattctttatgcaactcagcatgtacatctgtggttttcctgagggcagcatccctttccttccttaggataacagc

SEQ ID NO: 77004 - DNA, 1099 bp, Homo sapiens
ccatgtggggagggagtcacacctcacacaatgccacacctgggccacctgccagcctcccttccacagcaacggtccataccactcacagttcacaaaatgtactctctgctaatccccaccacaaccttgccaaggggtgtctgcatggcttcctagataaccaatcccatcaaacacacgccaggagtcacaggtggatgccaggagttatgagtgaacgccagccagcccagggtgcatcttgttccagtctctgagccccggggtccttgtgtttctctgcctggtgggggatgcataccacataaaactgtatgttccaggtcttttctcactcccattattcttcattaagcctaattggaatgccactgaataatcatattattctaatgctccatgtaattattaagaataatggtgatttccatttctcttttcctcttgtattttttctttcctcccacacaaaagctacgtttgcttcttcaaggtgttgtgcttgactttattcccttccctggggctgggaagaccttggctgggtgatgaccatgacggccacaccactctggcaattttgtcactggattctccatgccagttccagaacatggcatcaaatgttgccagtggggatggggacagatcagagaggaggagagtaatttttatgtggtttacacattgtgctctcctggacatttgctcatttaatcttaggagcaaccccgcagggtaaatgatattataactatcattcctattttacagatgaggaaattaaggttctatttccttctttcatgagttttctatttcgagagtttttaagttgtaaattcaatttcctcaaaagttatagggctattcatattattttatattgggttaattgtggtagctggtgttttttgaggaatggattcatttcatctaaggggtcaaatttatgtatgtagagttgtacatagtattctcattctcttgaggtctgcagcatctgttatggtatcataccctgtttcactcctgatattggtaatttgtattttttttctgatttttttctgtcagtcttggtacaataattttt

SEQ ID NO: 77005 - DNA, 1003 bp, Homo sapiens
agttttgttgttgttgttgttgtttgttttgctgttgttgttgttttagcagagtctccctctattgcccaggctggagagcagtggcacaatctcggctcattgcaacctacacctcccggatttaagcgattctcctgcctcagactccagagtagctgggattacaggcgcccgccaccacacccagctaatttttgtatttttagtagagatggggtttcaccatgttggccaggctggtcttgaactcctgacctcaagtgatccacccgcctcggcctcccagagtgctgggattacaggtgtgagccaccacacacactgcccttgcttggattttgacaaaagctttctaaatttctcttctcccccgtccttcctcctcttcacatccagattctgtcctcgggtgctttggcccctcctttgctggcctggctcttcctttctgacacttgtttcggcaggggcagccaccgcctttccctgaacatcctgtccccttcctgctcctacagttctgcccacctggaatatcttgcatatcttcctgtcaaattctgccagtccctccagatagctccagtgatcttcccctcacattagttatgtagactagagtcacaagccccaaatcgcagtggcttaaacaggaaggttcctttctcccttacagtacccgtgcgtcgtgtatggtggcacaggttgggtgggtctctgctctagctcatcctccagggagatacaggctaggaggctccctatctagaaggtagccagtgagcactgtccattccaccggaaagaggagtggaagccatgtgttatggtctgaatcccttgtccatgactggttcaaggaccaggctgggcccatgttagccagagagctgtgagagtggcttgcttggggcttacggaaaagtgacttcttcaccctttttttttttttttttttgagatggagtttcactcttgttgcccaggctggagtgcaatg

SEQ ID NO: 77006 - DNA, 1091 bp, Homo sapiens
ccgtcttaaaaaaaaaaaaaaaaaaaattagccaggcatggtggcgggtacctataatcccagctactcaggaggctgaggcaggagaatcgcttgaacccgggggtcagaggttgcagtgagctgagattgcgccactgcactccagcctggacaacgaagtaagactccatctaaaaaaaaaaaaaaaaaaatcagattttatatagaaaagctggatctctagcttctcttggaaaatcaaaagatcttataatggtgggctctccagcttgccccagttccccggaactcacctgtctttattcgttgatgatattatggagtatctctgagaaaatggggcctcctcagccagatgctgcaagaggaggtgaggggcagtgggcagccaaggggatgcagcctgcagaaggcgttcccaaaggactctgccactgcctgcccatgcagtgtggctgcggctgcttttacccattggcttctgctttgtgccccagatcacaggctgtatcgagatggaactctcaagctcctgggtcgtctctcccttctctctgaagagatactctgggctgccaatggcttacccaaccccttctgctcttcagaccacctctgcctgctagccagcttcgggatggaagtcaccgccccatgacagggctcccaggggaagagagcttctcttccagaagagctcactggatcagagactgtggaaaaatcccatgcatctagaaacttagatccaagaaacttacatcccctcccttccccctcctcgttccctttttcccacggttagactttctccaggcctggctgcgttctctgcctgtggtccttgccccaccccagcctcttcctaatcctgtgccacacactcagtggccctgggagaggcagaaggggggctcccccttccttccatgtatccagcgctcccccttgatttttaattaccagggttatgggagttcttgatttcattggttatttgctttcaggccgtttcttgatgtaccttctgacctgaccttttccctgccttcaggacttctgggcccagccctcttgccaggcatgca

SEQ ID NO: 77007 - DNA, 1006 bp, Homo sapiens
cccatgttactgcaggtgaaaaggctatgtactctttcctcagagggtaaagcctcacagaagaggcctgggccccagacaggggtacattggggatactttaccaggtaacaagcagatagtgggggattaggagtgttagggagtctcagtacaaatgtgtgtttctaggctaattttagctaagactgccagccccttcttagcatggggaggaattggctgagattgagtcatctgagatcatccttttaaaaaatcttcataaaacccatagaaaaagtgatctagggaaaatttagtaatttttgttaactaatgtttcccccttcatccctgtaggactgtaggtaccatccagcactgcctccacctgacgtcagtatatacccacttcctgccccagcgtggccgcccagaggtcactacaatgccattgggtcttggaatgacagtagattacatcttcttctcagctgagtcctgtgagaatgggaacagaactggtaagcctgatggatcctgggttcctccacccccaggtccctgggaacagctaatggtaggtcaggcatttggtagcatgtcttcagctgctgggatttaaccagcaaaggagcagatttcatacctcccttgcactggtcatccttatcattctccccataggccacttgcctgccttgtctctttttacccttgcagcattaaagagaggagggtaggacagtcactcccaatccccattttagaggtaaaaatagagatctaggaattggttgagtttgtttaatgacagccactgaatgagggacttggttaggtaagagaccttattttctgtctcctctccccataccagtgggcacagtatagcaatctcccagccccatgcctgtattgtgtaaagaatgtttctttttggccaggcatgtgtattactgttatggccaggcacgtgtattactggttcacaccggtaatcccagcactctgggaggccgag

SEQ ID NO: 77008 - DNA, 2161 bp, Homo sapiens
ccagcttgtctgactctagattctgtgctcttttctatcatgttacattgcttcatacccttccctccttgcccttccagcccctcagtcagctggttacgatgtaagggggaacctgctgaaccaaggaagtggcaaaggctcctttactgagtagcaggaacaatgcctcaggggcatacactgggactgctggtgctggttggaagggattcaggctttaaggactctgacccatctctttggtgggattttccttgcaggctttacctgtttctacaagaggaggactgggtgtaaaaccgatggctgtgctgtctgctacaagcctaccagattccgcctgctctgtgctagccctgtggagtacttccggcctggcttggagctacttaatcgggataatgtgggcttagtgttgctactgcaaccactcgtcccagaaggcctgggacaagtctcggtggccccgctgtgtgtggcaaatacccatatcctttacaacccacgccggggcgatgtcaagctggcccagatggccattctcctggcggaagtggacaaggtggccagactgtcagatggcagccactgccccatcatcttgtgcggggacctaaattctgtccctgattcacctctctacaacttcatcagggatggagagctccagtaccatgggatgccagcctggaaggtgaaatgggagaggccacggtgtgggtgggaacatggtctaagagagattcaggcgttagcatcagtgcttcttctgtggcagggacctcagtacacctgctctggcctgctcctcctttttcttgttatgttgaatagcttgtacccaagcctggaagttaagaattcttgagtacttcggcatattggaatttttttcagtttttatcattaatatttttaattcacaagtaatacgtaagtacatacttgaaggaacttaaacattatacagtaagacacaggcctgttttattacccacattccctattctattctcttagagtaacataatgaccgttctaagtttggtggtagtcttttagcttgttttctttgcatttacagtgatatctatgttcctatgatattgtaatcagtgtttacatttgttaagcacttaagtgtgtgccatgtgctattttaagcactttatactcattaactaattagttttcacagtttccatcatggcttccattttataaatgaggaaactaaagctcagaaaagtgaagtaatttgccctaggttatgcgggtagttagtggtggagccaggatttgtaaccaggtggtctggctgcagagctcttaccctcaaatactgtgctgtcattgcttataacagccaatatgtaatctaccatgtgtgttttataaacatgatacactactgtatgtttcatttgtagcttgttttttttcactcagcaatttgcatatggatctcattccttctaactgttgagtgttgatgacaaacacctcgtagttttatcagcttgtgctgatttctttatgtcacttaatctccttgttcctctattttgcccctactgtttcaatttattgactaacttttggcaaggcacaatggtggaaggacacaaaacgattgtattactgttgcgcacatgggattttatgtaaatgagccagatgtgtgcagagaaaggcatgatcttgccctaaaggagctgtaatcaaggaactcagggaacgaggaaaagaatttactgactgcctgccacatgacaggcactgttaggcatagtgaatgagagcacttgctttgaagccagacagtcctgagttcagatccgtgctctgccaccttgagcaaattacttaacttttttgaaccccatttgcctcatctatacgatgggggatataatgggacctgcctcagaggtgtttttttgggtggattaaataaaataatgcgtgtaaagtgttttccagtatctggctcaaagtcagtaaccggtagtgattattaagattcttaattgtacatggtattattatcccattttatttatttatttatttatttatttatttatttatttattttttgagacagagtctcgctctgttgcccaggctggagtgcaatggcacgatctcggctcac

SEQ ID NO: 77009 - DNA, 1011 bp, Homo sapiens
tcttccaggtttaggggtcagaaaacacccagggctgcaattactctaaaaatgtctttaacctcaggtgactgttaagcacactcatctgagtgattctccggagattcatggatttatcaaaaatgagagtgtgtcagcttccatatatggagcatctattagatgctaggtgctggggatgtagtggtgagcaggccaagattgtctctggccttgtggagctaaccatgtcatctgaagaatgtccatagaaatcaattccccacagagagggatgggtgacagggaagatggaaaaaggaacttcaggcataatattactgagtcaggagtggagatggcagcacctctgcattactcatacttgccattgagtgcttctcccaatcctttgcagaaattttgtggcgagaatgggaggatttctccacccagccagatgctcagggcctgaaggcaggagatggccctcagttccagttcactctgatgtcttataacatcctggctcaggacctgatgcagcagagctcagagctctatctacattgccatccagacatcctcaattggaactatcgcttcgtgaacctcatgcaggaattccagcactgggaccctgatgtgagtgaagagggggaattgccatcttgcattgttgctggacctgggctgttgcccagtgctcttagaagatgagttcaacccatagttgttcaaatgattggagtcctatctagggctggagcttgcctgcctggtgtcagtgagttgttggcagatgctgagaagaatctccctagatgtgcacttcccagcacctttatgcaggaagggaggcttgagggattcaaggagcaggaaaatccagtgcacatctctaatctcttcagcttaagtctgggcctgttcttgctgttggtgactctgggaagtttcagtgtgacccagcagcttcccacctggcctcaggacctgctcctagagggtgggggtcacattccagca

SEQ ID NO: 77010 - DNA, 1093 bp, Homo sapiens
tctttaaggaaggtttcctaatcctgggtctatgaaggtctgcggattggctgcagagggccagcaaaccttctgaaatggatacagaactgagtgtgtgtgtgtgtgtgtgtgtgtgtgtgtgtgcgtgcattgcatttttctggggcaagttcatagctttccaaagattctcaaaagtgtctgtgacctaaaatatattaagagacccttaagggcaaggactttatcttagctgtctctttgttccccatggtaccaccaagcgtggtgctttgcataaaacacatgtaaacatgatgttcactaaagttcattgcttctgttgaagggtgatggtctccactccctggatacaccagcctgggaggtgccttctcaatggaaagacaaaaagagcattttctcgctccctttctaactccgctgccaccatagctcctgtgaaaaagcttgtggcgaagggggacaaaaaaaagaagaaggttctgaagttcactcttgattgcacccaccctgtagaagatggaatcatggatgctgccaattttgagcagtttttgcaagaaaggatcaaagtgaatggaaaagctgggaaccttggtggaggggtggtgaccaacgaaaggagcaagagcaagatcactgtgacatccaaggtgactttctccaaaaggtatttgaagtatctcaccaaaaaaatttgaagaaaaataatctatgtgactggttgcgcatacttgctaacagcaaagagagttacgaattacattacttctagattaaccaggatgaagaagaggattaaatttcatttatctggaatattttgtatgagttcttgaataaaacttgggaactaaaaaaaaaaaagagcattttctctctaaaaaaaaaaaatccctgtcacctggagagtccacacatcacgcccgggctcagtagtggcacgtcctctctccccaagatgggtggggaggtggagtgggtggacaagaaagacaccatcccccatccctaggcaggtctgaaattgaattcacccccaggaggaaggagaaatttgccaacctaatagctttcattctgtgtg

SEQ ID NO: 77011 - DNA, 1070 bp, Homo sapiens
cggaggtgatgggaacaggaagcatgttctggtcttccatgtgcacacacatttggacacataaacgtgcatgcacaggtgtccaggccaggcgtgtaagcccccaggagtgcatgcgtgtgtttgcgtgcagtctacaaacatgttttcacaaagctcaaggagaagcaatcagtcatctccaaggaatcttagcaacagccatccccagaaaaggctcctgccagctggggcagcgatgagtcagcagaggcgtcgtgggggaggcgggaggcgaggcagcctcagccctggagcctgagccggcctctcccttctcctgggaaggcctccagacccggcctggccgccacgcctgggtcactgctttggcactgatgtccgagaacacattcctggaactggccagcacaggcggctggagggtttttccctcctcctctctctccctctcaccctcctgtccgggccccacacccgcccttttatttttccttcttgctgcaaaaccaaaacaccgtgttcacgagttcaggcgctgtagccaagtggcaggagctggcagagcaattgggaaacaggagctgcctggcccaagcaggccaggggatgaggacacctctggccagccacagagagggccctgctagggcttgctgagccctggttaagtactgcagggcaaaaatgtcatcgcctggggccccagggaaccggagttcaaggtggcagctcccagagaaatggcctgtgtctctctgccccagtagcagagcccgaggtcactagcagaggatggcggctggaaggtgaccaaaggagcagagaaccacaattattaatcatgaatccattgcctgagtgcatacacagtcttcagagccacctcagggtagaattatgtccttatacagacagggaggtgaaggtgtgggcaggtgaaggaatttggcacaaggtcacgcagctagcttttagccacggagcttgatggaattaatccagcttcgagctgacttggaggctttaactgatgggccacactggcttttcttcctgggctgcagcta

SEQ ID NO: 77012 - DNA, 1072 bp, Homo sapiens
cctaccctcccccacccccacggtacctgggggtcatcctgaagaccgtatgcattgccatggactccccgggcaccaccctgcagcctgcccatgcccctctccagcctgagctgcttccctcccagcccagagccctggtgaattcccccgtcaccttccatcagggttcatgttagagctccagtttggaaaaggacttccccctcctcctcccccaaccccctgcccagatggcagttccccttccccagggaccagtgatgcagcagctcgtgtagcctgcagttgccatggtgatagccctcctttggctttccatggggtgggggatgacagggagggtgtgagtgtggtgagtgtgtcccattttccgctccaggtgaggagagcttatggagtggaatcctaccctcctcgagtggggtctgctcctcctcccagctgggacccagccagctcagtggcatcgcagcagctgggaagactggaagacagacagggacactggactgaagaaagatgtcccagaaggagcactggaggtggggggtggacatggccattggcacagttgccaaaggatggaggccggaacctggggtgggagccaaggcatcggggagctgggaggagggacaggctggagcctcagagcctcggaagagacccggaaagggtgggccccttatttctgccatccacccaaggagtctcccactgcgcttccccagtcaagagaaggcccctctgctcttccaacatgatctgtaatttccggcagacatttgaggcccctgacatctgcataatgtgggccagtctcttagcaacggggaacagctgtctggcatttccaagattaaactgtaactatacgcggtccttgccagggggagggggtgggggaaggggataaacactgcctcctggcattttcaaactcatttagcttttattcatttcctgcctccagtaaagaggccagggattcgggctgggctgttactgcccctgccaccgccgcctgccacgccgctgccaccacctccgctgctgaggttgcagatgg

SEQ ID NO: 77013 - DNA, 1050 bp, Homo sapiens
tgcagttttagtagagacggggtttcaccatgttggccaggctggtctcaaactcctgaccttaggtgacctgcccacttcagcctcccaaagtgctgggattacaggcgtgagccacctcacccagcctgctattttcattaggaggaaaagagggatggtagctttcatccagatcccccatcttcagaatgttttcaactttccccagaacctccacagcgttaagtcagtcaaaatccttggatggacccttccaagtagcaagggccaccctgtcccctttcccctggccatgagaccacgcagagcgcaggggccggagtcagaaagggcagtttggcccctgggcagtctcctgagagtctttctcctcccagtttctactatttggcggaaccttgaatgcaggggggcgggacagagaaaaaactagaaagctcgacttctgcctgcggggccggaagccccgctgcggccccagcccgcggttagcccctgtttgtcattttgcaaatctggtcaacccacctccggtgaaaactcccaacctcaccccagggggcaatgactaattacaaaacacattttctctcgttttcgtcaagctcgctgtcccgcccacacatcccccgcctatcccggcacccgtcggcttcctcaggagcctcactcaactgtgttgaatgaactcttggcctggtccctcccccagagacttcacaccgtggggttctttcctccctgctcagctttactttcactttctagtcactctcacttctctgtcagcttcagcttctcaccctagagcttgagccctggtcctttcttaaggcaggggctattgcccaagtcctgggctgcacccaattcgtcaaaagtctcgattcatcaatagtcaaaaatatttatcaaatgcattctgttccaggctctaggaatgcagtgcaagacaggcaaggttcttgctcatacagagcttctagaaacctgggatacagagatgcaatcaagtgataaaacacatggatgaaggctctgccattg

SEQ ID NO: 77014 - DNA, 1162 bp, Homo sapiens
cgtatgtttctatattttgaaacaaaggtatgtaacttcttcatttgaaggataagctggtttgtgttaagcagtatagtattggttgggtcatttgcatcatatcgttagcatttatttggtggcagaatgtttgcctaggtacagaattaatagcccttagcaacgactgctgctggtgtgtatttttgtaaatgttatgcactctctgaaaggaaaaacacacacaaaagaaaaagacttttttttttttttttttttttttgccaaggccagtgttgctgcctaaaaaaaaaaaaaaaaaaaaaaaaaaaaaaaaaaaatgctataaaatggtgaaagcttccttctaaactgccccaagtgttgaagtcttcactttattttgttgttttgttttgtttttctgttttgtttgcaaaatggtaagggggtgtcgggggggatggggtgtattttgttgcaagtttgtgaggggaaaatgttttggtttgtttctactgacctgaatgtgttggatctacacgtgttgttttgtttttgctttattgatgcacggatgcttttgaacagtagagcgaaatgctagacatggagaatctgctctgtttgtcctttatacatttctgtagttaacagaacactgtaatgtgccttggagcttagtaacttgtaataaattcaattgatattaactgcgctgagtcagcaattttgtctttctagggctaaggccatgcaactccgacgtaggcgacaccctccctacctccagtatagaacgaaaatcctagtgcttttgaaagccctgggagctggcctgtgggaaaggccctgtgctgccttgctgcccctccccctcggtaccaggctatttaaattcacctcttggggaggcgacagttgctgactaagcgatttcggtttactcttcagcatctctattttcccccggatgcgggcccagctgcaaatggcattgtcaagaatgctttctggtgcctcgccctgtggcggtgaacataggctgacacccagtgcagctggtgacttgacaagtgggcgaaaaagtctaggagaaaagctaggatgctttgcttcttagatatgacagacatcagtctgcatatttaaaacaaaactgccacagagctgggagcaa

SEQ ID NO: 77015 - DNA, 1048 bp, Homo sapiens
ggagaggaagagacagcccctttcgagcttccacgcaccagccactccggggagggggccaagaggcaacggcggccaccaccgggcaccctcgccccctcccctcgggccgggagcttccagcccaagtctgcagcaccaggaagaaggcgcctgagctcccctcgcgacgagtcaaccgcagtaggaggtgggggcgaagagagggctgaacccgtccgctgcccgggcggtggagcccccacggcgaggcgctgcgccggcggtggagactcgcgttccctccagcccctggggcagaactttctcgccccccctcctccctcccccgcagtcggactccctccccagccggccagtcctcccggaggagaaggcgccgcggagacagcccgggcgggggcctaccttccccagggcaggcatcatgtcggcggcgcaggtgtcctcgtcccggagacaatcttgctacctgtgcgacctgccccgcatgccctgggccatgatctgggacttctcggaacccgtatgccgcggttgcgtcaactacgagggcgctgatcgcatcgaattcgtgatcgagacagcgcgccagctgaagcgggcgcacggctgcttccaggacggccgctcccccgggccgccgccgcccgtcggggtcaagacagtggccctgtcggctaaggaagcggcggcggcggcggcagcagcggcggccgccgccgccgccgcgcaacagcaacagcaacagcagcagcagcagcagcaacagcagcagcagcagcagcagcagcagcagcaacaacagctcaaccacgttgatggttccagcaagcctgcggtgctggcggccccgtctggcctggagcgctacggcctaagcgctgccgccgccgccgccgccgccgccgccgctgcggtggaacagcgcagccgcttcgagtacccgccaccgccggtgagcctgggaagcagcagccacaccgcgcgactgcccaacggcctggggggcccaaacggcttccccaaaccaacaccagaggaggga

SEQ ID NO: 77016 - DNA, 1029 bp, Homo sapiens
ctgtgatctcactccatgttgccccagaaggcggaacaaggccgtgatttttttttttttttttttttaagacggagtcttgctctgtcgcccaggctggagtgcaaaatggcgcgatctcggctcactgcaacctctgcctcgcaggttcaagcgattcttccgcctcagcctcccaagtagctgtgattaccggcacccgccatcaggcccagctaattttttgtatttttgtagagacatggtttcaccatgttagccagctggtcttgaactcctgacctcaggtgatcctcccgcctcggccttccaaagtgctgggattacaagcatgaaccaccacgcccggccaaggccgtgatttcttctgccttacaagatcactgctcatcagtattgcttatggcacgatggatatgttggtcatagctctagttggggcatttctattgattattctaattattgggtttgcttttttttttttttttatttcatgaaaactgagataatcccagggaaggctggagaagggaaagcaatataatgggatttcggattctgaagtgtggcccaccagattgaaatttcctctccatcactaactggctctccacccttaagctagttacccacaaaatctctcttttccatggaaaagagaatggaatgatagctcccaggttgttagggttgtttgagatttcaacttcggttttttgtttttttgagataggatcttgttctgttgcccaggctggagtgcagtggcacactcgcggctggcagcagcctgacctcccaggctcaagtaatcctcccacctcagcctccctagtagctgggactacaggcatgtgccattacacctggccaatttttttgtatttttggaaagggatggggttttgccgtgttgcccaggctggtctcaaactcctgggcccaagtgatgcacccaccttggcctcccaaagtgttgggattacaggcatgagccacctcacccggcctcaatttgtttcttgt

SEQ ID NO: 77017 - DNA, 1045 bp, Homo sapiens
tcccactggcccacaccgacctggggatttccaccgtccggctacggagacccgttgccgccggcgctttcctgctggggccaccagaaggcggggcctcagagcgggaagcccctccctgcagcctcgccatccctcggtcaggtctggtacatggggcagctgtcactgctgtgcctggttgggatggatgggccaggatcttcaaatattttggcttgcgtgagctgagtagttcaacccgaaactcaggagagagggaggaagggagggcgcttagcatttgggtacatatttacattatgttgtttaacttggacttggctgaccctaaacagctgtgtaaacttgagcaaatctcttgaatttcggtttcttcatccgtaaaatgggaaaaagttacactgcttcctttgcctgcctcgttgatctgtgtggaagacaatgtaatgtgcttaataaaatgtaagaaattattaacaatacaatgaccaacatttgtctagggctcggaagagcattcccagacattatttcaccaatccctacatcaaccctgtgaagtaggtgttactttcatcaacctcctgtataggtgaggaaagccaagtccagaattactggaaaccaggttccctggctgtaaaacgcatttcttctttcaccccgcctgttgctatacctttttgagggtctcagatgctcctcagaaactgcaagaaattaaaacctctctccccattggagtttacaggttcatgtcccagtagatgcaaggttatacataaattagcacaggttattttggagttaaaatcactatccagctttgaagcaaaattgagtagttatgctttcctggcatcctgtaaaaccattctctttcttcctgcctttttttttcttttactttctttctttttcttttttttttttttttttggagaaagtctcacttcagttgcccaggctgagtgccgtggtgccatctcagcccatacagcctcaacctccctggctcagatgattctcccacctcagcctc

SEQ ID NO: 77018 - DNA, 1011 bp, Homo sapiens
ggcgaggtagctcatgcctataatcccagcactttgggaggctgaggcgggtggatcacctgaggtcgggagttctaggccagcctggccaacatggtgaaaccccgtctctactaaaaatataaaaattagctgggcatgctgatgggcaccagtaatcccagctacttgggaggctgaggcaggagaatcacttgaacctgggaggcagaggttgcagtgagcagagaccacgccattgcactccagcctgggcaacaagaggaaaactctgtctaaaaaaaaaaaaaaaaaaattgaaaaagtgcctgacagggtctggcacatagtaggttctcaaagattgaagactctcctgctgagatgttctgggatgaatgcacgaatgactatgaagagtggtccagagaacatggcagatggtaataaaggttagagcagttcagaagtgggtgggtgctagaacgatgaagatgacaatgacgatgaaattcaaacattatgttagtaaatgtcctaatggaacttcttggggctgtaacaatggttctcctttttacttctaatgccttttcttacccggctcagaattagacattgcatatacaggcttttctaattgtaagtggccacgcttgtacaattagggtggtccttaattaccctggggcatggaagccctgctacaggataaaggcaagagtgtacttttttttttttttttttttttttgagacagagtcttgctctgtcactcaggctggagtgtagtggcacgatctctgctcactgcaacttccacctcccaggctcaagcgatgttgtgcctcagactcccaagtatctgggattacaggcgtgtgacaccatccggctaatttttgtatttttagtagagacgagattttgctatgttggccaggctggtctcgaactcctggcctcaagtgatccaccctcctcatcctcccaaagtgctgggattacaggaatgaaccactgagcccagac

SEQ ID NO: 77019 - DNA, 2001 bp, Homo sapiens
tgttggccaggctggtctcaaactcccgacctcaggtgatccacccacctcagcctcccaaagtgctgggattacaggcataagtcaccgcgcctggccactgacgctcaagtctgttcaccaaatctttattgagaatactttatgtaagatgccatattcctcctggctaatggtggggtggggtgagagataccgagagcaagatcagagtagaaaggacctcagaatggcctttaaacttgggtgcctcagaactccaaagcccaagtatttaagaaagaaaaaaagactgctgcagtttaatctagggcagggatagggtcctgtccactctgccttgagtcagagactccatggataacatccaaacaaccctgacccagaccagggggggatatagaagcccagagaggtgaaatgacctccctcagtcacacagcaagttggaggcccactcaggttcaaagtcaagcccagtgcctcgtccattgtactgtcctaccccttggcacttgtttcagagatcagctgcggagatggggcgagtcacccaggaacagacagacacacttgctacagactaaagagaacaagtggttctaactcaggatggcaaaggctccccggaagaggggcagggagccgggcctagggcagcatgggcaggattgctcatggcacatggcaggggtggggagagaggtggatgtgaggaaggaggcaattccaggcctcagagaacatgatctgctagcgcctgaagaaagactggcaatccagagagctgggttccagccctggctctgccgtgacaagcccctgggccaggggcctcccctttgggccagtttccttgcatgtaaaatggcaaagagggtgggctagttggccctactgtgacatgctaggaagccttctctcctcccaccaccaccaacaccacccaggacactccccagtgtgtgccaggtgtctggaattgacaccaggagggagtgtccctggctgccctgtggcacagcatggagctggcaggcctgcccaaggtgtctgcccagagctctgggaaacagtgacaaaccatgaggaggcaggaactggagaagaacccgggcaggagccattcctcttctgagaagtggtctttcccatctggccctctccagaagctcaggcctctgccaggacttgttagggtcccaccaccccaaagaggcgaggcctcaagggtagaggggtacgagtccctgaacaaccccaagcctcagtattctcatttgtaaaatgggtaaaaatagcactttagtagtctcatttgtaaaattgatatcagtacctcagatgatgaaatgagataatgcgtgtcaagggcctagcacagcgcctggtgtaggagccacacgtcccagagggctgcctgctggggaagaccgcataatttgaagcctcctgacataaaacaggctggttgagggagggccctttctgtctaatacaccactcgtcgggacaggattgcaaagggggcctggggaggtgagcccactggaaaacaatgtgtgcgcgccccctgctggctgcgagcagaggtcccgcctgtccgctgggggtcttcaggtggttcgtgttagcaccacctgctgctgccgggtcaattgacccaatattcacagatcaccccccaggtgtcaggtaccccgccaggctttgggagggatgcaaaatgagtgaaagataagctaggtttttggagccaactagttttggtgtcgaccacgcatgggttcaagcccagagactatcaatatctgcttgaatgttcattcattcaacagaaatggttctgcatcgggatatagcaatgaacaaaggtcctggcatcgtggacttgcggtaatcttagacagagaacataatccctcagagcttcaggttctcatctgtagcatggaagacttctctactccttcccctcaaaccagagggtagagaccctgg

SEQ ID NO: 77020 - DNA, 1081 bp, Homo sapiens
ggtgatccacccacctcagcctcccaaagtgctgggattactggtgtgagccaccacgcctggcctaatttttttattttttgtagagacaggtgttgtcatgttttccaggctggtctgaaactcctgggctcaagcaattctcctgcttcagcttcccaaagtgctgggattacaggtgtgagccacttcagcaaagaaatttgtaagaaaggcaaactgtcaggccccaccccagacccactgaattgggaactctgcggaagaggcccagaatccgtgaatgagcgtaccaggggcttccgatgcatgttcgagtttcagaaccactgcttgcaagtctttgtgtaacaaaggccccgaggtgggcaggcgcaggcacattagagtacccaaggggggcctgcaggtggggcgggagtgggggtggggctggatggtggtttacactggccttgcaggcatgctcagcagttcagcacgcatcatttccagtcaccaggaggcctggccagaggttcctctgccctaagaaccctcaaggagtagcaggtcacctgtgtgtccaggctggccaagttacgtaaaagcatggagatgactatgacaaaggcttctagaggcccctggtcacctgatcttgaccatgttttgacttccaggaagcactagtcagacagtgaattctgttgctgtgaaaatgccttagtcctcaatgccgagagaggaaccccagagggaaacacctccttatcctcaagaagcctttgcaaagggcctgtgggtcctgtttccccttggatcggtgctagcaagggacattatctgctgagcagagggttgctagaggtggcttctaccctcctcaggaggcaaccctgaaacagacacattgcattaaagaccctgcgcagcagaaggcaggtatcacccgctgagagagctggttgggtggagtcaacgtgagctgctggagctgggctcattgcacaggaaggactggctgctagttctttggctaagcctgaacaggctgggtgtggtcacacctgcttgctggacatgttagcccagaaataca

SEQ ID NO: 77021 - DNA, 1020 bp, Homo sapiens
ctgtcacccaggctggagtgcagtggcaccatctcggctcactgcaagctccgcctcctgggttcacgccgttctcctgcctcagcctcccgagtagctgggactacaggcacctgccactacgcccggctaattttttgtatttttagtagagacagagtttcatcgtggtagccaggatggtctcgatttcctgacctcgtgatccacccgcctcggcctcccaaagtgctgggattacaggcgtgagccactgcacccagcctgctcacagttactgttaaacaccacagtagaacctgccagtagctgagcacacgcagggcgccagccactagacagcatggttatccagccactagacagcatggttatccatctcacttcctcctctttccagctgccccgcctctccatggggtttttcacaagacgatcagagacccagagacccaaaggaaagggagacaatggggattggaggccacgggctttaggggaaggtagggggcaaaaaatagagcatatgcaaagccctgtccttgttacttccctccccaatctccaccaccacccaactggcatatgaacttgttcttcttgtatacagctctgagcaaagcaccatatggcagtttcatcaggcccacggcctggtttccatccagcccactctaatttccttccagtcatggatctgcagaataacccatcctgtggaaggagctcagaggaagaaaaagataacaataacagtaaagatatacagagcacaaaccacagcggggagctgttccaattatgtgtatgtttgacgcttgcaacagctctaggaatatcgctgttagcatccccattttatagatgacaaaactgggagacagatgttccgagacattctcaaggtcacatggctagtgatgacagagctgggatgggagccatgttaaccgtcagactttgctgattcgctgaatcttggctaaaagatgttggcaggaagggctgagagcttagaag

SEQ ID NO: 77022 - DNA, 1030 bp, Homo sapiens
aagagttgggacatgccaaagtccctcttcaaggggagagaggcagctgcatggttacaaagtagacaaagaaagacaaggggcttcttttaaactggaatgtgtgaaatagaagcagggagctgtgaatgccacagcagcaattatgcagaaagactgcagtgcagacactgagcagcaccatcctatctgataacatcagcagcggcagaggcatattccaacaagagctgtttaagagctgctaattacttagattccaataggagctatgtcttaaaagtgattacaatttttgattacagctttttgaactgattgcagctgtaagctatgaaggcagtaatctaaatacaagcaaaaattcctttgatcaaacacaaaggaactcttccaaataaagatacctttattttacatacatatatagctatgtgtttcgcatgcgtaaacaagtgagttatacacatctattaaacatataaccatctacactaaattttaggttccctgagaccagggaccacacttgtgcatccttataattccttacagtgtctagtagggtatatggcacatagaagatgcttactgaattgaatgaaagtgaaacaattgctgtattaatgatttgatcagataattgttgtttgttacaataatggcctactatagaataaatactgggaaaagcaatacaaaagtccattttactaacctcaaatccaggaaatgtaccttcttttctagaaacccaaaagaagtatggaaatacattcttgaaaagaaagctaaccactctacattccacaacagagaccatgttgactgtgctgtgtgagttgctaggcaaccacttggtaattccccatgtaatagagatgaacctatcatctgctttcttagctatgtgtgacaagaagagacaacaggtaaaggacaaccaagaatacctgcacctggatgacacagtcactcctgctgaagtatggtgacaccggagaaaatccccatgccctgtcagaaattg

SEQ ID NO: 77023 - DNA, 1028 bp, Homo sapiens
ttcggagaaaagctagtaatgtatttataattctaacggggattactcaaggttttctttctgtgaccttatcactttattgtatttaagcctctggttgggcttttacctcacacttctgtccaggcacacatgttatacacgtgacacattttaaagggaacttgagcttccaggaatgttgccaagtgtctataaaaggagagatctgaaagcagcatttcagatccttttcttgtaaccctggatctcctttttaatcataaggacaaatcttcacaaagattgtttgtggattagatcaacccttaatttggatggtggatttgtccctgacgtttcaacttagaataaggggtagatcaaatatctgtttcctgcaggggaccagacgtggaggttagatcttaaggtgaccgtggtgtttggaaatgcagaatcttgaccttcaagctgttcaggtatttctgtgactgctaagctactagagctgtcagagactcagcaggtcagagatttgttggaatttattactctattgaatgcctcatgttaattgttgggggctgaggttgcaaagatgaaaaaaacaactcgaggttgaggagacaaataattagactaatgtcagaagtgcaaaaagagtagtaagagctaaatgctttggagcacttgctaggattttgaattttgtccccttatataaacttatatatttattgattcactttctttctttctttttttttttttttttttgagacggagtctcactctgtcacccaggctggagtgcagaggcacaatttcggcttactacaatctctgcctcccaggttcaagctattctcgtgcctcagcctcttgagaagctgggattacaggcacacatccccaagcccagctaatttttgtgtttttagtagagacagggtttcaccatattggccaggctggtctccaactcctgacctcaggtgatctgcccgcctgtgcctcaaagtgctgctgggattatagacgtgagc

SEQ ID NO: 77024 - DNA, 1025 bp, Homo sapiens
tattttctgagcctcaaaaaccgattgtcagtgtttcagtattttgactccatgatcaattatctcttatcctacaaattctcaataagccagaataaattcctgtgtattttctgtagctctattgactacactttaataataatagcaagacctttttcattgttttgccgcaaggattgtagaagactaaattgggatgcattatctaaagtacctgtaaaataatccatgtttagtaagataatgtgaaacttcaagaacctaagaacctaagtaaggttcttaattagttgcaactaacatgagctaccctcctaatctaaatcaacagcctggtccgacatgaattagtttgaatgcccatccacaagcctcatctacttccattttggagatggcttctattcacttttggacagtattattttaggaaaattatactatgcacatttgttgaatttcatacaaaaggatccaatttaattagagatatagttttacactttagtctactttttaagctgggccgtccatgctgtcaaatttcatagctgtcagatagacattgcttttgcatagttctctgcaagttgtgacagtgccactgtttatcttttatgcacataggattaaacgtgtgacctgtggaagagtgcttgatttgatgtcagttgaatgaggaagccagtccccttaaatgagttagatacggggcaaaatgatttttacttggaattgtgtttaaaattcattctcattcagttcagtttgtgttccctttagtctgctcctacagtatgcaaaagtacgagcaagagggttgcttataagcatccttgtcttctatttaattttattttgaactgcttctagggtagttaatgttcttcactagatcttatattagcaggaatgtccagacttggcactccagggtattccagatacagtggtatttggcagggggcttgtgtttttcttcactcaaagaacaacaggatagagtcaggagtgcatcgtga

SEQ ID NO: 77025 - DNA, 1247 bp, Homo sapiens
tacacgaggaaagcaagccttgcggtgtctcttttctcctctcccctttcccctctccccctccttctgccctctctcttctcctgtcttccttttcccttctcttcactcccctgtcccctctcccctctggtgagttcatttcgttacccattggaaaaagcctaatcaaatgtgcctttgttagcagtttacaaagcgaatgctgaatgtggtttgtgtgccttgaatttgtaatggaattagagggcagccagaggactgtgaatctccttatgggtggaaaccattctgtttagtaaacttgaagcttttgtcagttgaaacctctgagaaaataaagctgaagtgggtgaggccagtgttctttgcccatactttattcactgtttggatcacctgtttcagctctccaggcagtgacttcttatataattgtttttcatagggcagtccagatgaaaagagtaccaatgaatctgcctccagctgaataaaccatggagaggaaaaacccatccagagagagccccagaagactctctgccaaagtaggcaaaggcacagagatgaagaaagtggctcgtcagcttgggatggctgctgctgagtcagacaaggactctggcttttcaggttaaaaatatcttatccttcctctgttttgtgagtgaatgctttgcgtgaaaaatttcctccccaaaactcatttatgtgataaggatgggatgctttcacacacaggataaatacttacctgctttaaaatggtaattctgatgccatatgtcagggtacccatcaaagtcaccacagggttagttctgaaagaattatttaacatcttttttcaacttagactctgaatcttacacttccaactattgcaattggtcactggaaaaaatatttaaatactcataattctgttgttttacttcctttttcacaggaattattacattgtaggggaaaaattgctactgcatgtagtttccatgtaacaaattggaagactgccagttaaataaaagtaatactgtatataatttgtaaggtaactttttcattgagaaagtagtttcgctgtgtttagaaatgtacgcctccaacaacccctccccccagtctctatgcattttgtatttggactgtgagccacctggcctagctctaaacttgagtatctattagagataagaaaatagaacagttttccttacaagtttttcttaaaccttacccaa

SEQ ID NO: 77026 - DNA, 1085 bp, Homo sapiens
gttgacattttgacacttctaacaacttcaactttgtcaggccagttgttttaagaatattgtactactcagatataaggtggtattaaaataatcaaactcattatgccccagaaagtagccccagtgaatgccactggaatgcttcgagccactcttgggccaggtgccagtgatttcctcactgcctgagttattccagttaccttggagtaggatgaaatttgcaaaatcaagacaatttttcccattttaattaccacatttgtagttcaaaaaatttcaaatctatacaaaagcaaatgaataccccatatgtctatctttttgccatatatgctttctctctctcgctctctttacacacacacacacacacacacacacacacactctctctctgaattatttgaaagtaaattgcaaacacttgacattttaccccatgtagcttcagtacagatttcctaaaaacaaggacattcttctatgtagttataatatcattatcatacctaagaaatttaacactgatacttatcattagctacactccatattcagattttcccccattgtcccaataatgtcctttatagctgtttgtctttttgtctgttttggatccagaatccaactgaagattgagcattgcatttagttgtcctgtcctttagtctggtttagtttataaccactcccctatcttttctttcctttttttctttcttctttctttatgacattgacatctttgaatgagtcaggcctgttgctttgtagaatgtctcacactctggattttctggtagtgtccccattattagggtcaggattagcatcttgaccagaatactatgttgttgatgttgtatccttcccattgcaacacatttggagactcataagttagtcttactcttggtgatgctctggttggttgatcacttggctaagatagtgtgtacagatttctttaccattaaagtacccttttctctttgtaattaataagtaatttatgggataatactttataattgtgtgactatcctattccccaacaaactgtttaccagagttag

SEQ ID NO: 77027 - DNA, 1008 bp, Homo sapiens
cagctgtttctccaaggacccctcatttcctttatgtgcagaatggcatttagaaaccaagatctgggcactcaatatgtacattgcttctgggctcatttgttttcagtctaatggttcttaactagaggtgtacatttggattacttgtgttttgtgaaatacacctaccatggaaccaggtaaatcacttcagtagatcaagggaaggatcccaacatttatggttttttaaaagtatcactggagattctaaatcatatttccattgatgtatatccttccagtcatacagtcttccttaagctggagaaaatgcaattgttttgaggtttacagattggttttgtttttttaattgtaattacatcttgtggtacccagagcctctgaaggtcttaatcctaccttgggccatactcgtctcctttctcaacatagattctcgaaagtaataaactaactttgaaaccttgaactcatttctcctgtagactgatgatgattactttcatgtgagccctaattgaggcaggtttttgtctgtaagagagttagaaaggaagtcaaactcgtcctagggcaataattcttaatctttggtggaggagggattaattatagatcccattgaaaagccaatgaaagctaaaagcctccttctcaataaaattcacaaaaacacatcacaagtgttgcattcaatttcaagaggtctgtagctccttaggagcctggttaagagcccctagtctagagcctgagtgagttgaccattcttctgcccaccagatgggagctcggaatgtctgagctctgcagagcagatggagtccgaggacatgctgagcgccttaggctggagcagagaagacaggccgaggcagaactccaaaactgcaaagaatgccttccctaccctgtctcccatggtcgtcatgaagaatgtgcttgtcaaacaggtgaggaggactaatatcacctaaagtctttgcaaataaaaatctc

SEQ ID NO: 77028 - DNA, 1058 bp, Homo sapiens
tacctacccatttatttttctgagtgatagcacttgaataaaaataggtatttcctccagttttcccttagaaaaagtttaaaaagtatttgtgatatcagacacaaatagatgttcaaaccactatgtgagagaagcactgtccttgaaattgttctaagcatttgagtatccacttgcccctttgacagaagcttcactcctctatcctttcagcagtaatgagtagtgtgctgctctcctcctttgtcttcagggcagcagctcatcccagctccagtcgtggactgtccagccctcctttgaagtgatctcagcacagccacagctcttattccttcatccacctgtaccatctcctgtcagtccatgtcacactggtgagaaaaagtccgactccaggaactacttgcccattctgaattcttacaccaaaatagccccacatccaggcaaaaggggcctttcccttggcccagaagaaaaaggaacaagtggagtgcagaagaaaatctgtactgagagacttgggcctagcttgtcttccagtgagccaaccaaggctggtgctgtcccatccagtccctcgacgccagcaccacccagcgccaaacttgccgaggactcagctctgcagggtgtgccctctctggtggcaggtggaagtccacagactcttcagccggtatccagcagtcacgtggctaaagctcccagtctgaccttcgcttcccccgccagtcctgtctgcgcatcagacagcactctccatgggttagagagcaactctcccctttcaccactgtccgctaattatagctcacctttatgggctgcagagcacctctgccgcagcccagatatcttttcagagcagcggcagagcaaacataggcgctttcagaataccctagtagtcctacataaatctggtttgctggagatcactttgaaaaccaaggagttgattcgtcagaatcaggcaactcaggtagaactagaccagctaaaggagcaaacccagctgtttatagaagccaccaagagcagggcccctc

SEQ ID NO: 77029 - DNA, 1339 bp, Homo sapiens
tgaaagaatttcagaaatcagagcaaatgtgtctttaggcagattcagctccttttaatatttttctcttggcccactctctttgcttcccctgaatctgtgtggtactatagcagctctactctgtgcaccatgctaggaagcttcctttttggcagaatatgtttggcagcaaagctatagagacaggtgcattcagaacatcctgggcaccagtcatgagtcttactgtgtcaaaaatctgaaaacacttgctgagaaccaaatttattccattggaaaaaccctctgtggagctataagcctcttggactcttcttcctagattaaggcttgcatttccctccctgtttcagtaaaagatgatgaaagccactatcaatcctcactgctgagtggcagggagaagcagcaccactctcagctcttttctaatcttgtaacttagtgctagaagtctctccaggctattaccatgggcatttgttctctgttggagctgtaagcagatgaacccaagtagagaagatagatcttggaaggagagatccattgagtccagaagccagatcagcaaatggaggaacctcggaggtgaccagaaagatctccatcggttgcccaaggctgtaagtagtgatggttttagcgatgaataacgtaattggctatgaagtactgtggcagagctgctgttttctgaaggtgagaagccatttttagctcagagcaacccttaagagaacttttggcagattttgttggcattattgaaatatatatagaaaagttgctgattgcaatggttatgggaatggaatttaatgacatttgtaatttattacactcattggtttttattgattatagtattgtctgactttttattttctactatggttcctttagcagaaaagtaacttttgtgcatatattgaagtggtttttcagctatgaattctttagggtagaaatttatttagcaaatgtgaattcttttgagaaagtatgaagttttgcagaaattgactgtgaaatgtcagagaaaaataaaagtcacttacttgaaacctatttggcctttttgctttataactgcttaaaaatactgagtgaacctggagtaaatatttgaactgatttaaatgttaaacataggtactcatgttatttgggaatattgggattagacactgaacatgtggaaattcattgctcagattttcactggtgtgaacttgaaatatgagtagccttatggcaaatgagtagtcccctgttttctggagccttggaggcttatactgggcaggttgggaggagtgagaggtgaagatag

SEQ ID NO: 77030 - DNA, 1064 bp, Homo sapiens
taattttttttttttttgtatttttagtagagacggggtttcaccgtgttaaccaggatggtcttgatctcctgaccccgtgatccgcccacctcagcctcccaaagtgttgggattacaggcatgagccaccgtgcctggcctcttcatgtgttttaaggaacaatttggggctgcgtgcagtggctcatgcctgtaatcccagcacttcaggaggccgaggtggatggattgcttgagcctaggactttgagatcagcctgggcaacatggcgaaaccctgtctctctaaaaaatacaaaaattagctgggtgtggtggcacacacctgtagtcccagctactctggaggctgaggtgggaggatcacttgagcccaggaggcggaggttgcagtgaatcaaaatcatgccactgcattccagtctgggtgacaaaaaccctgtctcacaaaaaagccaaacgaaaaacagaaccacttgggttgatttaacattattttcactgtcactagtcagagatgacatagatgcagtgatactttgtgaggtctttattctggtccaagccttttgggtcaacctttcatctacaccagaagagagattagagatgagaagtctgcctgggtgacacagcacaatcagaatccctgagagaaagaggcagaagaaaacaacgactgtgccctagctcctgcagcctttacctctgctacgtcagtttcctttatcaaaagaggaggggcataatcctcgctatgcacttgacatcctgagatgaaggtgcaacgcaaaaaagtgatgtctcaaaagtgttttaaaactgctctacggagcaaggcagcctcgccgctcacagacccagtgatggaattcaagtgatggcattcagccccttcagggttgtgactgcttgggataattaagactgtcttctaccaaaatctcatttacagtgaatgagaggagagaaaatatcaacccaggatggttactctttgactggcttcctggaaggagctgttctgtgggtccatgtgtgaccattttggttttttcctc

SEQ ID NO: 77031 - DNA, 1056 bp, Homo sapiens
gaggaccaaatgcatggacagtaacaaggacagtcatcttcctaaggagaaagactggctaacagatggtccctgggacctaaggactgacttgttacagtggagggggacctgggttgaagtctcctcaagtttgttgtctttccaaaactccttgggttcctggagcttagagtgaggcagttcctgccttgcctaatctgacactagggcatgggtcaaagcagagtgtacccactttctggatggaaagcatctcactccagcacatgggcctgaggacccatgatctctattggcactgacagatgattctacccctgctgtgggagtcagagagctgtgctgtaaagaatgactggcagatgtccctgaaccccttcctccatggacgcagagtggttagttaagaatgacaccatcaactgccatctgacgggccaacgacagaggctagtgcatgagatggccctgaaccctagtgtcacaatcttttccaccccaatcctcctaacaatcaccccgttttcaccttcagggccatcttgggccccctccctagcattcctctactcatgctccatgtctgtgaagtgcctctgatatctttcccctctttaccatcccacaaccactatccccacccggatcccggttacatctcactgagatatagtacatgcctcttaccaggtccctcaacctccagtttctcccacttccagtctatcctccaaggctgcgctttctgaaatctacctctgatcatgctgctctcttgctcagaactttcagtggttccctattgcctgtcaaatgccctccaggtcccttagcttggcattcagagccctctctgcttgggtccctactctcagccttaacctcctctgcctctttgtgatatcccttataccccaaggcccaggcctgttctctgtccctggaaagccctccctgtccctctttgcctgctgaaatctcatccatctttccaggccccgtatcatggaaaggccccagacctagcagcagaatgtgctctctccctcctct

SEQ ID NO: 77032 - DNA, 1046 bp, Homo sapiens
ctatgtaagccatgaatctttttttaagccctatttgtaactctttatatcttataaagataaaataaaaacagaatctcagcttaaccaacctcataatttcataaatagggaaacctccaaaatcacatatattaataacaatatctatggtaaattatatttaactcagtatggaatataaagaatatgaaaaaaagaaaaactattatcgttattattatttgagacggagtctctctctgctggagggcagtggcatgatctcggctcactgcaacctttgcctcccgggttcaagcgattttcttgccccagcctcccaagtagctgggactataggtgcccaccaccacgcccagctaattttttgtatttttagtagagatggggtttcgccatgttgcccaggctggtcttgaactcctgccttcaggtgatccacccacctcggcctcccagagtgccggaattacaggcgtgagccaccgcgcctggccaagaaaaaattattagaacaagtgaggcatcacactcctctgccattcagtcaaaagtaagcaccaatttattaacacaaacattacataatacatgatacaggagcaatctcgctactgctagcactaagaaaatgttgttcttgcactataacattaaactgttaaatactgacagtgaaatgcaccaataaggaaactgtcatcacagagaatctctgataaaattttagatgtactcctttatcaaaggcattggcttgggcttcggctgaatacggattgtaacaattgaccatctggtgttcagccaaaatgtgtgttgagtgcatctctaactttagattatttccaatttctcactattattagcaacattgcaatgaacgtcctaacacaaacaactctatgggaccctgtgattatttccttggctgaattccaagaagtggaatggctgggtcaaaaggatccctattgccaaaccatcctccagaaagtttgtgccagcttccttcccacttaaggagtgaggggcttgtaacc

SEQ ID NO: 77033 - DNA, 1052 bp, Homo sapiens
gtggggatccacaggtagagggacttcatttatctccctgacagcatctccggatcgggggtttgggccagcaccggtttactccaagtgaaaggagttgccatgtgcctggctcatgaattgctccttttcagacaccctctgagcacagaacccctgacgctggcccctgctggcttcacaggagccttgggttgcatgatgaccaccaggagctgctggggtgacctgtgggaagggatggggttcccagtaaaccagatgagaactagctgcttgtggggtgacaatatagcaccagagaggagagggcccaccatactggagggaaaccacatggtatgtgtccctcccagctagcagagaaagggtcaggcctcagagaggccccgtggtgagaaccagacttaaagagcagagagctggaccgagtgcctctatcggcaggcactctgccctcagcatctctacctgatagctaggcatgaaaacaccttctccagatgggtgggagggctttggaaacttgtcaagtgtttattacaaatgggaagtattattcctggagtctctggtctaggtggaagccatctgtttcctgccttgatgggggaaacatggtcatttcttcttcagaggatgctctctccctctgcggccagcctagggcatccttctaggctgggaaggcaggtcagccctccccagcccgcttcaagttgtgcttgggcccttgaggagtttcatcccctccatccccagctgcccattatagttaacatatttaacaggatgttcacccccgaaaatgcaggtgtctagtggcaccgtggagcttcctacaggcctgtaccctccccactgcctcaactctcgaattccacgacctctgctctgattcttcctgggaagaggcgggtggaagaaccataaagataatgggtgtaaagtgctgggagctgtttgcacagagcgtccagtttgcaggaacccacgtggtgctcaggccatgggcaggctcacactgggaaaggctgtaatgaaagtgctca

SEQ ID NO: 77034 - DNA, 1053 bp, Homo sapiens
agaaccttccaggtggtgggactggcatatgcaaaggccctgtggcaggagggaaggtggcatgctccaggaactgagggaacaacctaggaggctggagatggaagtgagggggaagtttgacatgatgaagccagaacactaggcagggccccacacccaggccttgctggccaagttaaggagagcgaagaaagcccttctagctgattccatcacagcctggtccaggaggcctccccaggcactgcagattgggttcggttcatctgtgagcccttctcacactgcgttatcactgcctttcagccaaggcctttctcattcacctagaatgagcttgaggaggggaggaacacatctcatcctctttagcaacccctatccagtagagaactcaggaaagaataagtgagaacagtaggatggaagggagggtgagatcagcaagaccagggggtgtacccagaaggctccctgaagaaagcagagttgaactgggccttgccaatggagcattcccgttgggggaggatcaaggtcctccacagaggggaggaatggagggggcagagacaaccaaggcctttgatgggcaaggggccttccatcggctggagctgagattcctcgtggggagctgggggaggtgagactggaggggctcctggggccaagagggcctcccctggtcccagcctctgcccaggagcaggccaggagcagagagctcagatgtcaaaaggagcagggagctgtgcagaagctcgggccttggctttagatctccacccctgctgttcagctgctagctgtatgaccctgggcaggctacacacccactctgggcctcagcatcctcatttgtaaatggggacagttgccacctcttctctggcaggactgttgggggccaggtgagatgactttgtaaacatactttgtcacctggaggagagtgcacataggccctccgtcaggctcagaggtaatccagaggccaggcccattcaggaccccgccccctacctcctggaggctaccatttctctt

SEQ ID NO: 77035 - DNA, 1033 bp, Homo sapiens
aagtcaagccacaccacttctgctgctgatttttgttcccctttgtcaactttgtaataggccccagaccccacgcatcctgggagggccacagctctccctggggactcctccatcctcccctcctcccccgctcacatgtcatcacagcaaaggcaatttgctggggttgcactcctggctagctctggccttaggaggaagtcactcaagaaagctcaggctgccgctccagtgacctcagcatagaaggcctagctgcttggggactccacttgaccttgggtgtcagcctctgcctggccaggaaagccagtgagaagggccaggccccttgcagcctccaggagagcaagccagccctgggagtgagtgggaggagaagaagcaaggggaagaggatgcttgcattgacgtctctcctgccgtcctcccctctccccctgcagaacccaattgtgacccagttcttcccctctgtgatgctctggggcttcacagtgatactgcctctgattgtctacttctccgccttcctcgaggcccactggaccaggtgacctgggggcctcctctcgtagccctgtggtttctccagcctcttcccctgccctggcttccccgccagcctggcacttgggcctcccctctagcctaagaaggagaattgataagggatggttttgatacctgaaaccatccccaaagaccaacaggtgttctgtctttggaaggagggtctgggttgactctgggcccctgggttgctgagatagagccactgtctaagagtgtggggccaaagccaagccctccttgagcttctccctcagcccccagccatatcctgaaggcatggagctgtaggcatgagctaggcagtcccaggcattccatgcagaaggcacaggaggaaagacttgtgtgggaatgtcaatagaatgctttggccacacagaggggcccacaaactcactatgactgtcatcacatatggcccacaccatgccaaccttttacccaatcaggagcg

SEQ ID NO: 77036 - DNA, 1036 bp, Homo sapiens
tttttccatatatataaattttttatctctttgaacacccagccggtattcaaattgccttaattgttccagaagtatcttttagagcttgtccaacccaatatcaaatctagcacatgtgcctcaggttttcatgtcccttttattttagcacagtgccttttaaatgacttggagagaccaagccagcagtcctgcagaatgttccacctggatttttctggctgttcatgatgtcttatgacaggttccatgatctcctgaatgctggaagttagatctgatggcttgatagatgcaagttcaacatggggctagaacacattacaggtagtgctgcaatttacactcagagagatgtaacatcctgttaattcccattcattaatgatgccgtcatgaccttctaattaggggaatgacaggtggatttttccatggttcagttgacatttacccctttatgaccaaaaggtcatctagatggcttactttggcaccacgcaaatgtctagattcttttgtaggaaaaccgttccttcaaccagggctgtttggtttcactgaaataaactcctatgggaaaggtttcattccattccctaataacctattttctaagtaaggagatggtttaagagccacttcagaggatgacaattgctcttcttcctagtacatcctgtgtttttctatctgctgccgtcccaggcatggggaccattcctgggtgtgacaggtcatgtgaccaaagtctccgctagcagttccacatcttgaggacaggccaaaccagtgacagatcccgagggagttctgaatgtgctgctgaagctgtattagaaggtgcactagctcaggaaagagggtctctccagacctcagctgaggggagcctcatgtcacctcccctggatgcagcttgacttggaactgagagtgaatgggacatgttctaaaggagcagtggactaggagtggggagtcctgccactgaaccagccctgggagcacctagatgctcatcaaatgatca

SEQ ID NO: 77037 - DNA, 1889 bp, Homo sapiens
aagggtgggaatgggaagtgtgtggctgagtggctgaaagggagagttgtttggaaggctccccgcttccccagtccctggccttggtgctgggcctgtggcctgtgagcacatgcctgcctaagagggttacattcacatgttgacaaacacccctggccaaatagcccatgacaagacccctagaagggttgccctcctgggcctcttgggaagagccctttccatgattgtcattgagtcagcatctactaagctctccagctacagtgtgccccagtgggactcagacagacaaggccgtgaaagagaaccgggcttggcgatggggaatttctctggagctccagcaggaggaatggaattcaaagcccctcagctgaggcactgggggtgccaactgcctcctactggttctctctcacagcttctacctcttccaccctctggcttacgggatggttggtcccctggcccaggacccccaaagtccaatggcaggactaaggtggctggactcatgggacttttgaggccactgcaaagattccagcctgggtccaggaacttcccaggagagccagctgggaagcagtactggaccatccggccatgaggaagctgcctaaggagcccgaagaattctgctgctcaccaggacccagctctgggagtgcagctggaatggaacccagcattggagagagccgggagagagccgcagctccgtccacagcaccacggagaggacagcgcctcttgggctgctccctcgtgcacagcgcaggggaggatgggtgccagagggtgggagtgggtgcgcgtgtgtgtatgtgagggcatgttgtccatatccctgtggaatacagaccgtgtaactggacagctgagtgtcataaactctaaaatagtccaggctatagtaatattttctggtatttttttctgttggatttctttggttttggtttgtaagatccatcaaaaattctcagacctctgagagggccttgagggcagagaatactgacctcaccttgggatgtcaccaaaggcagagcagatgggactgtcaaagttgtgctgccctccctcccacaaacaaatgaatccagcgtggaggaaggcgcgccgccccgagctggagggcctggctcccaccatgccccccagtggctgcaggtagctggacttcctgcctgtgacgcacagagagcagcggactccggagcgtcagcctgccttagcccttggttcctcgttttttgggattgtcacactgtgacactcgggaggaacgatgtcctatcctgggctgctcagtgttcccaggccctgtgtgccagaggccaggtctctccaagtgcatctagcctggcctggagggcaaggcagatgcattctcctggctgctgggagagcccatgggaaccttgcttagcgcccaaggtagatgagagacagggcagggaatctgcgtggtgctgggatgtggggactctggcctctccagactaatgttcctgtcacctgctgagctttcccagtgtcacttctgcagtcctcctctgctcacccctccctcactccgtgggcaattccctttctctctgtcactgcttcagcagtgaagacccatggcacctagaaatgcatgccagcttcctgcgtctaccactctgcagctcaaacaagaagctcagagctgccccttccacttcctccccaaaagggatgaagaaaaccctgtggtagaaccaaaccacccaaggccagcccttaagcctgcctccaccttcctggtgcatgacaaaatatttcttttgtctcagaggactttgatgcttcaatatttaatgatgaatccgccacactccattttccctcct

SEQ ID NO: 77038 - DNA, 1089 bp, Homo sapiens
cttggtctttttgcctaggttggagtgcaatggcatgatctcagctcactgcaacctccgcctcttgggttcaagtggttctcctgcctcagcctcccaagtggctgggattacaggcacccaccgctacgctcagctaattttttgtattttttagtaaagacggggttttaccatgttggccaggctggtcttgaactcctgacctcaggtgatccacccgcctcggcctcccaaagtgctggggttacaggcatgagccactgcacccggctgtaagcctcattttatatcccctctctcccaccattttcacaccttgtccttagcttggcagatgggtatatattttgtgcccattggaacaatttcctctttcccttctttttccctagaaggttggaatggaccccttatgggagatggaggcttgtctgggagaagtaaagcaagtgtcgtaggtaggcagacagcagctgcctgattcttccctgcaagggaagggaaggagagaaggttctgctcggcgcttggccctatatcagaaaaacctgggccccacatttctgtcagccctctagatctctgtcttgactagctttctttgctaccttcatgcaggggaacagtggcctcaaacccaaggacaatgagttcacgtccaaaccctggcactggcctatcaactatcaggtaggatccaaggctggggctcctcccaggaaatggagccaagaacaagagcagggagaccggtggaggcgggggtgggtgtactagggcggcagggcgaggggcctcctgggatgggttggccagaggtgggagtatctgttttctgccctaattctgaccctgcttcccagagagctcgtgtagaatttgccagcctgaggttcgtgtccaggctccctgtctgtggaaggtgaccatcttcctccccctaatgggtgtggccgaggatgggctgggcctgggtcagcagggtggtctctattccacagggcctacgcttctcaggggtcaatgacacagatttccgagtctatctgcttggcaacccggtgagtgcctaaacattcccggctc

SEQ ID NO: 77039 - DNA, 1006 bp, Homo sapiens
ttggcctctggcgaggtgcattctctgggagggggatcgttttgctctggtggtggggcagtgggattcttagtatctgaggaagcagccctcatgtcttccaggttatgctacagtgcatcacctggcttgcaaattgtggcttttaaaggtgctttcaactttccaaagagaattgcaaatttttgggtacagaattttctaaggcctgagttcctatgtctgcaggattttcaggcatcaacagaggagaaaatacctaactgtgtacctttatcctatagggcaaggacagtttgggtgttcaggtatggtgaccaaaggattttatgaggcagaactcttcttgtgagaagagatttattttcttaaaggttttagcttgtactatccagatactgggtgtcagaaatggaattctttaagcaaaaagcaggcaagaaaacagactgtcagggttgctttatttagaaattaataaattagcttgttattgtgtcgtgactgctggcagaagatgagactcctgggttagagacaaaggactttattacaggaaataggatgcatgttagaagcagtttcccttgccatccaagtcccacagggtgacgctatgggtttaaatggatgactgcacaggcagtgggttgcatccaagtgaaggaacgacaagcttggaaaatctgctgttttatagaaggcagtacgcagacctcctctttgtcctggagggagacactgcctcttctctcaaagttgcttgctgcaaacacaaccatgagaaatggcccaggtgagatgcagtcagggccttgcattcttggtatacccagaatgatgtgtagaggcacgagcaatctgacagcctctctcactcctcgattctatggtcttggcttctagcagattttcacatgaatatacaactcccctggctactcacatcttttcagtttgtcccttacagcatttaattaaggttgttgtcaatgggactctaagc

SEQ ID NO: 77040 - DNA, 1021 bp, Homo sapiens
agcagcatttaccatgcttctggtcactcgtagtacagatccaaaggtgtaatccaaaggcatttagccattaggtaaggcatttcttcagggattctaagctaattaatgtctgccacactctagtggtcaccagcagtccctgtcccttggcaccaggagtccctgtagcctggctaggtaaggaaagggagttgcatctccaaataaggaagatccagttgtggccacccaattcctcctcttcgaaagacactttctgcccatcacctgctttctgtgccaggaccatctttactttctccacaaaaggtaccttcaggacaggctgggactgctgggcttgggaaccatcttggaagggcctaggttcccacttacacccttgccatctagcagactgagttggtagtacagggatggcaatagcaagttcagagagcagcttaatatgctaggggtggcagaggggagagggagctttggtgaaatgtctatagtcagaggggtagtaaacagggcatctgagaagttctttcaagttctcccctatccatagggatacacatgttttggtgggaagattcatgagtgctaatcactggcgagtctttcctgggttccactttgaaatgctggctcccgaagaagtaccagagaaattaactttgagccccttaaaccttggagtagagatcgcacacccagctgcccccaagggcccaaaggtaacaaaaatgagaaaagtgggccagatatgggccatggcagacctgagagcgcatacgctggttgatgggggccattagtctgttcccatcaattgctgctatttaggaacccaaatctgtctccagatttttttaaagaaaaaaaacaaacaggtgttgtatataaaatatcatgatttttatttttattttattttattatttatttattttgagatggagtcttgctctgtcccccaggctggagggcagtgacacgatcttggctcactgtatcctccgcctcctgg

SEQ ID NO: 77041 - DNA, 1886 bp, Homo sapiens
cagggaagggagatgggggtgggtggcaggcctggggttctcctgcttgcttggctttcctctggccaactcaggccaggccacccagcccaccagggccttgtctccacagttttctaaggacttccaggcactgaatcctatgaagcaggtgccaaccctgaagattgatggaatcaccattcaccagtcagtgagtgcagggcctgggggagggccctcatgagagcagtgccctgaatgagagcgcctgacatctcttcctcgcctgtgtacagtcaaggtgcctagcacataggagaggctcaatacaagactcgtggggagggtgcgaggttatttaggaaaataagggaagattcaagcacatggagaaccaagttctgcatgataaggtccaaaaaggcttatagggcttgagctgagcagaagcaggggggaagaggtgtagtgatggtgctggaagaggagaaggaggagtttgctggccctgtcccctctggtccaggggtcctgggccctctccctgcctcactgctcccctctggacagctggccatcattgagtatctagaggagatgcgtcccactccgcgacttctgcctcaggacccaaagaagagggccagcgtgcgtatgatttctgacctcatcgctggtggcatccagcccctgcaggtgtggcacttgtacacttgcacccttgcacacctgacacactcttacactcacacattggctgtgagctgcccagtgtgggggcgggggtgtcaagggagggagggggattctcagggcctctgacctggaccatgtgaaagaagggggtgaagatcgcaatctcagaattcagccccccagcgggtcccccgctgcgttccgagaagctctagtttccaaggacgcatgtacaggtgcttggggtggggaaagggccagaatggcaggggagagactgagcaggccccagtccaggcctcctgcctttaaccagagcagcttccgtttcatctgtgctatctcagtcatatactgggatacttgtaggattttattttttaagtgtcactgttaaaacagacaactaagtattaaaaacagttcatctgtgccagcttctactctgaatgaggaaatagccccagaaaggtggagtgacttaggagtcccacaggtaggtcataacaaagtggggactaagtcagaatccctgcatgcctatgccctctacccgcatgtcgctttaacaaaggatgttggagcagacagacatctccattttataatgaggaaacagagggaaaatggctccaggggtgccaagatggagccaggctggaaatctctggaagccggtcttgtggacctccctcatcccagccccaccctctttcacactccctctcctcacaagggaccatgcaagggagaagtgagggagacaggcctcgagttgtgggcacacctgccacagccatggccgcgtcctgtgtcacatgaatagggattcttgcacatctctgacagaatcacgtggctttttgaggccactggggcagcctgcaaaggtggctgctgggatggctacctccctccaacctcagggcccttggttgaaggaaggggctcatggagcctgggggagaagggatagacatccagccaggggcagatgggaagtgaacttccctgagggggtttggcgaaggggtagcccccacccagctgtcagcgcaatcacagattttctttgggctgcacagaacctgtctgtcctgaagcaagtgggagaggagatgcagctgacctgggcccagaacgccatcacttgtggctttaacggtgagtcctcacctctgtgagctgccccacagtggcctcttaga

SEQ ID NO: 77042 - DNA, 1055 bp, Homo sapiens
aacagctctctcgagacctggctgccacattctcaccagcagccatgcccagtctgtcactcagttgggcgcccatttcataactatggaggccaaggcccagaaagctttgtgtcccctccctgcgcccagaataagatgtttatgtggcctccccacagccctggagcagatcctacagagcacagcgggcatatactgtgtaggagacgaggtaagctgtccccagacctccccaggcccagccacagtggctgcctccctcatgctgacctccctcaagctcagagcttcctgagaaggcgtctgcagggggatctctgtgccatggggcactcctcagctcactcccactaaaccgtcttaagagggagttactcaaggtagaagactggctgtgagaggatgaggcgggccagcatcagttgagggattgtgctagatgatgtctgcgcagtcaaggcaatccatcttctctggccctctcaacccacagagttggttgtcagggcaactggagcatggcctgggagggcacttcagctccgggggacagactcatgcaggcctagggcagacaagaattggaggtgggatgggtgaaagagccgaagcagattgttggtacccccagtagagtcgcagtggacacacccagtccagccactgactctggggtatgcaccctgatgggaacccaccgggacctctttcaggtgaccatggctgatctgtgcttggtgcctcaggtggcaaatgctgaaaggtaagagagagccccgccaccctcccttctcgtggctctgcccacagtcaggccccactcagctggcgagatagcatctcatgcagacgcttcgccaaccagccaaggagcccaccatgccaggccacatagccacttctgcctggaagagggcagaagaaattggggcagtgctcctactacgcccaccacagcccagatgaacctgtatagatagccccagctcctaagaggaggtggctcacctggtggacccccaagagcacctgcctgatgtcctcaaatgtgg

SEQ ID NO: 77043 - DNA, 2114 bp, Homo sapiens
attggggggtaaatttcctttggggcctgctgtcatgtgatgctataccagagtcaggttgggatttggtattttattgccacaaagggtctgtttggttagtcttaagatctctgttttaatgttaatgctggtcagttgtatttaaattccaaagggaagagggtaatatgaggcaccctgtaatctgaccataatatgaggcaccctgtcttcccatcatggactagtttttcaggttcctttgagatcccctgggccaagacaggggtccattcagccggttgggggatttagaatttatttttggtttgctgtatatatatgtatacacacactccccgcataaatgtaaaaattttaaactaccaattcctaggcaaagatgattctaacattctgttccttttgacaagtgtccaattagagaatgctgagaatgtcccctgcatatcggctctgttggagagcccctgatttttagcagacctgtttcattcaacatgggttacccaggaggtggtcttcataaaaatgtttcttggaggccaggcgccgtggcccacgcctgtaatcccagcactttgggaggccaaggtgggcagaccaccttaggccaggagttcgagaccagcctggccaacatagtgaaactccgtcgctactaaaaatacaaaaaattagctgggcgtggtggcgggcatctgtaatcccagctactctggaggcagaagcagggagaatttcttgagcccaggaggcagaggttgcagcgagccgagatcatgccactgcactccagactgggcaacagagcaagattccgtctcaaaaaaaaaaaaattgtttcttggtctccatctttcaagaaaatacatctgtgctgtattttccccttccctcaggccatgatctctgctgttttccttactaactggcatgtcagtacaagagtgattgtgaagctgctccggaagggctttatgctaacctctgttgcttgatgacatgtcctcaggactctgatattaaaactcaatccttagataacaggtagctttatcatggaagtaggtagcaatttggaattagaccattcttagttatttttttcttaatgaattgatacatgcactttaaaaaatatttttgttattttgggaagaaaaactcagacttttaaaaaagtgtatattgtcccattataatatgtatatggaagagtgaaatctgaacgctgtcttatattaagcagtagaattaggtattatcataaaaagtcttaatctgtagggaatatgagtttatgtttatgagtcctgctcagtccctctttgagagaattagttgaaacccagactctaaagtctgcttttatatttgtttgttaagaccacttatctgcagaaggttgccttttaaccccagtggttctaaggtgtggaattgagtgaccctaatatttacataagagacttgttttagtggagcataagggaggggcataagttacaccgttttgtgctgcttgagaactgtcttttaaaattgatcacaacgagggaaaacaaaataaaattagggggcaaagggtaggagtatggggggaggggagagcaaacctatcgaatatatcttagaattttgctcagaaatcactgctgcctctcaagtgttgcattgtccctgcctaaaccaagaaggctaaacaaagcccctcctgtttgaattcttaaggtaagaaatttctaagctaagaaaacactattgcctaaaaccaatgatagtggagctcatttacaaataggcatgcctcacacacacagtccaaaggcaagacactggctttgaaattaggctcatgatgtgattcctattatatgtacctgatttttttaggccccaggtatgtggaccagagttaatgtcatgactcttcaaagatatgatgaaaagttgccctagaaatctagagatgcatgtttatttaattccatagtttaaaaaaaaatttaagcaggtagttgtggcttatctgggggcaaaataatatatgtgaaattgcttccagaggacaaagtatattttctaaagtcctgaaataggatcatgaa

SEQ ID NO: 77044 - DNA, 2743 bp, Homo sapiens
aataatctccccgctctgtgaaagccactgggtcacctggtccttccgctcaccttcaggcaggacttacgcagtctctgaacactttgccattttgctcacgcagaacccgttccagctggagatgtggagagaggctccaggagctccttgcggggtcgctatggggaggtcatgcctgtgtaccggcgggacagccaccgagacgtgcaggctggcagccatgactaccctggtgagggcatctacctgctcaagttcgacaactcctactccctgctgcgcaacaagactctctacttccacatctactacaccagctgaaggactgctgggacaggggcaggctgtatttgctggctgaagcaggctgccagctggtgcctcttgtttgggataggcaagagccaaaggttcatggggggctgctgagcctcacaccctgtctggcatgcctgactgttggcccacgtagctttttccccttcttggcttctgcaggtggtggtgtagtgcccctgttctgtagtccctgactcatacccttcttgcttcagactccagcaaattccctcttgaaggcacctatggggcacaagcctaaaaggaagcagggcgatgttttttaaaaatagattcatcttggcacaggtttatcattcagattgctgccctctcctctcccacagcccttattgccagtgcatttagtggcacccactctcttcagttgttgaggtgccagaagagggaaaagcacattgcccatgaaggagccccatcttttggttggagaaagctctatccagcctgtcaccactgccatattcctgcctgctggttattcttggtctctgcatagctgggagaccacactgcctttggagggctattactattcctgatggtagacaccccctcctttctctttcctaagtctatgtttttgccattacagcaagaacattcatgcaatctcaagtgatgatcaatgtaacctaagatcttgtgggaagaaaaactgcccccattatttcctattccaagagctggtttcccttactatgggcactggcagtcaaagtggagagagtggaaattaggtactgaattgatgtcagaacccacatatttgaaagtcgtgttacttttttttttttttttggtataatcaaagaaggaatggtatcatctgacagagaagatgaaaaacaaaaaacactccagagtccccaccgcttttttttgtctttagagtaggagtgctgtttagaaatgttgctttggaatcaaatgcagtgaaacccaatcaggtttccaaagtttctgcatttagctttcttgcattgagggcttaaagcttttggtgttcaaagtcccttagtttaggtgataatgaagcttcactattgctgctgattgtatttgttctttacctgaccaaagcttgcatttccctggtgacagcatttcctactgtgtcacccctgaggctcaggagtgccacagagtgcaggtagtgctgcagccagtggtcaccagagcaccagctgctgggcccccaggcggaggaggagacggaggtgagatgggacctcagcagtctctgtgtttgtacctccctgtctcttactcctcgtgttatgtctgttactgcctacgaattctgaagaataattagatttatttattactgtatttatttttttagcacatttcattttgcctttgaaacagtttccatctgtttctcagaaggcttcccatctgttctgagccactgaagccccctcttttatggagttaaagatgatatttttaggagaatttgggaagcgatgatgttttatttctgtaggtcagtcctgtgacggctttgcgaggagtatggcccttcagagatggatgatgccaccttactccatgtttggggtacagtccagcactccccatgaaaaattctaagttgtgagggaatctgcccatttgctggagattgagtgcagaggaattccctaaccaatcagagatatcccgtgattccaggatttcagagtcctttgtctcctctgaggtgtcaccttctttgtgatgtttcctttgactcattgttagattcctcacaccaagggtctatccctacagtagcataactcaaggaacgggactcttcccagtgggtccctagtagcatctacatcacatcaaagggcaatatatcctgcacctgctcttcccctcggagcaaagccccaagtgggataggatgttggggactgccagagcattcccattctctgagcagcatcatacctccattattttatatttgcaaatgtgttttgtagaggattacactggccaacatttatatacctttaaagaaattattttagtgactgtctgttgaggcagtgaagagctgatttgctgtgtgtcatcccattggatagctgagtgaccgctcttgcatcattgaagttgaatcatgccttagctaactgaatataatctttgtaaaataattttctactgagctgttttctagtcagctaaagccttgcttatttttcctgtttattattaacttctgcctttctctcaaattgaaacagtcaggccatacacagcaagctcccaaggataacacttgttattatttattttcaccatgagattctctgcttattttctttggaatcctagttctgttgcatcagggaagcctaagggacttgttccc

SEQ ID NO: 77045 - DNA, 1048 bp, Homo sapiens
ctttaaccagagttctgttgtgcagatggctaagtatcaagttccacagaggtctggggacatcgttatgatccagtctgaacatacaggagctatagatgttctttcagctgatttggaatctgcagatcttctgggggaccacaggaaaggtgagacctttgggagtaaaggaggtggtttgtttccagtagatactcaaagaaaggcaggcagacagacaaatggaaggaaagaaaatgacttgtgaaaggaagtcaagccagtagaaagaatgtctgactgtgccagcctctcttagcaaaatgcccggggtactcatgtttcctcatggtttctcagtgctaagctgcttgtcctttcagtctccccacctctgatggctcctccatgcatctggacctttgccaaggtgaaggaattcaaaagcaagctgggcaaagagaagaacagccgtctggtggtgaagcgtggtgaggtggtgaccatccgggtacctactcatccagaggggaagcgtgtctgctgggagtttgcgaccgatgactatgacattggctttggagtttattttgactggacccctgtaactagcactgacataactgtgcaggtcagtgattccagtgacgatgaggatgaagaagaggaagaggaggaagagattgaaggtaaatttaattttaacctaatttgcagttttctggcttaatctgatttctggtgaccattttgtgggttgtaccagtcctcctcttcctttgaatgcagttgagaaactcagcattacaagctaagctgagtggtacaggccaaagagaacattctggtggggttgatactgctgccttaattgaaagaaagcctctttttccttatcggtacctcattgttttcccaacaccttcctgggggcagggatggggcaggagcagagagagggtgagtcatgcggcagtttagagggatggtcattcaggtcgcatgtaagccagagattattttacatctctctcttagtttgtagatatttattcttggcctggaa

SEQ ID NO: 77046 - DNA, 1048 bp, Homo sapiens
tggctctcagctcatctctctgcattggtgcagtggcctccagccacactgagctgccacggtggtatttttttgtgttcttggttttgttcattcagcctcctttgcctgcagtgcccttttccacttgacttggccaagtcctggtcatttttgaattcagtgcaattgtcatctctttcaggaaacctttgatacttttattccctaaattagttaactatatgtgtatctgtgacatctagtgcataattctatcctaaaggataccacacttatattacaactgtctgtttatgagtttatcttcctcactaggctgagttccttgagggcacaaatcatgtctaatttaactgtatattccctacatggaatatactgcctgacatatagcaggggtccagtaaagttctgttgaatttaggcaaagtcattaactcaaatttccctttttcatgtggttgctgtatatacagtatattttgattttggcaaaatatttggctgagtgatatctgaaggagattcagtgggctgctttaaatggataaatatcattgttgagtggaagaggtaggttaagtagtatgtgtggtcagaattcccttattaaacaacaaaaaaggcaactgatttttatgcataaaagagcttgtttcagccatatgagctcttaaaggatgacaaattaaaacagtagtgtttcatcgtgttctatctatagaatggcagcagttataaggaatgattatatctagtgttagtgagaatgtggggaaatggttacactcggatatccactcctagtagaagtgaattttggagagaaattgggcaatgtgtataaaagtgttaatgtgtagaccttgacaaggtttttcagttctggggacttgtcctatagaaatgaagtaaaaaaaggcttaaataacaaaatgcaagctgggggtggtgagggtgcctgtattctcagctacttgggaggctgaggcaggaggatcacttgagcccaagagtttgaggctgcagtgagctctgattatgc

SEQ ID NO: 77047 - DNA, 1027 bp, Homo sapiens
catcttgggcatcatgatttctccgagcttcaatttcttaaactatagaaagggagtaatgatagcatcaacttcagtggttctataattcagtgcaattcagtgactattcaatatggtgatgcctacaaaaaacttagaaaataattgacatatagtaagtgaccactgagtcttggttataataacaaagatgatcagaataaaggtagaatagctaggtactttaattaagttcagatttctggacccagtgaaattctatccaggaatttttgtcagagttctttttacaagccatataagttaattctggctgtcttaagcagaaagaggatttattagaaggaaaaaggaggctcactaaattgttagaaggctggaggactccagaggctaagcagcaagaacaacttggctgtttggctgccactagatgaattctgtctctcatttgtcccactcctgtttcaccttttccaggtgggaatattttagattatgtgcttgttccctgacttcctggtactgcgaagagaaggatcttccattttgacttccactgagtactattgtcagtgacagttctccccaaggaggaaaaggttgagtatttttgaaagccagaagattgacagatgacttctacgtctggggtcctgaaataacttgcaaatatacttgtgcaccatctttgagggatgtcggggactagaaatggacatacctagttatcctgaagggaaagagtataatccagaatttggagaccattaaacttgatccagattttcagtagaatatgtcatttgaatgtaaagaaaataagtgttgctaggagccagcatgggcgaactaaaaacacatttgactatctaattattttctaattatagcctttctagtctttcattactagttaggtcctttctctctctcatggacttctgcagaggcctcctatctgatctcgtaaaatccatcctacctatggctgccatagaattgtaccaaaaaaatacaggtt

SEQ ID NO: 77048 - DNA, 1020 bp, Homo sapiens
atggcattgtttgtaatggtaatacattatggaatattcacccaatgaaatactaatcagctgtagaaaagaatgaagaagcttttcatgtgcagttatggaaaggtctttgagatataagtggaaagaacaaagtacacagtagtatgtccagcatgctccccccgacctttttttttttctgagacagagtctcgcactgttgcccaggctggagtgcaatggcgtgatcttagctcactgcaacctccgcctcccgggttcaagcgattctcctgcatcagcctctcaagtagctgggattacaggcacgcaccaccacgcctaagcatgcccattttttgtgtaaaaaagtgaaaaagtatacacacacacacacacacacacacttttttttatatgcataaaacatctttggaagactacacaaaaccaaataacattgattgcttttggaggtagggactgacatgggaggaaatttttcactgtatacttatatgctttttgaattttgaataatgtggataaattattcagaaatagttaataaaaatagtctttaaaatatataaatatatgtgtacatagatagacacacacacaaacttggcatgagacttcactatgtctatatcctaaataagagcctttctataggtctgtattctgtttctgctcatcaggaactgacattttctagacctttttctctcagtgaatttttttataaaaggttataagtctccttagagattaattttgttattctttaaatccactactgtctttcattatttttgtgctagtttcatttctgtctaaaaatttaacctttttgaagtcttcattacgatccaaaggacaggataagccaaagggggatagacatagtagataaactgatattattaatcaatgacagagagagggcagaattttttttttttttttttttttgaaacggagtctcgctctgtcgccttgactggagtgcagtggtgtgatctcggctcactg

SEQ ID NO: 77049 - DNA, 1046 bp, Homo sapiens
cctatccccatctcagtcccctgccccagccttaccacgcgcctctcggcccccacccgggttggcagccttgccttcctctgccagaagcccactgcgccctagccttcctgcacataggccccctggccttgctgccatcctctccatcgcttagagtgggaaaaatgaaaagcagagttgaaataggtagtgtctggggtcttttgcttgaacacagtagccaaagcaagagcaggaattaaaaatttggcctacctccctcattctcaagaccctcatcctcttcttgtccaggacgacgtctccatttctactaacgcgagttcctccgtgtgtattatttcagtgtccaaagacaaaagagtccatccatcacactttcttctttcagcctcctgaacaccacacacgatgcaactgaaaggatgctcttttgaaatacgaaagggtagaggggagagaacttgtcttatttaagtagcaaatataaattaattttctaggtctgaaattaaaatagacaccataaagtataatggttgaggcactactgtggagccagggtgcctggattggagtctgaaacgtcagtttcctcatctgtaaaatgtgattactaaaaatatctgcctcataggattattgtgaggattacttgagctgctttgtctaaggcatttggggtatagtccatggtacacactatactcgtctcaaccattgtgacagtaaggtctctttttgttcagttgaacttcctgtgccgccagaggtgttcttggatgtatggcttccaacatggtgcctttttctgtcttctactctgatcccaagtatcttccctctcataatgctgccttattcaaacacacacacaactcacccagctctttcccatgattttatattcttttactttaaaacacctgacaaattttgcctttttttcttacgaactctgctttgtattaaattaaaaatcgttggcatatatttaacatagcagtagaaattctaagcataatgtctaaaagactaagcaa

SEQ ID NO: 77050 - DNA, 1047 bp, Homo sapiens
tccttcaggactgtgttagcccatggttgttttcagaattaaaatatgagtccaggaagagaatgagcagttaaatctgtaaaactagaggggaactggagccattcaggtaacgagaaatattttataatttctttttttatttttatttatttatttattttgagatggagtctcactctgttgcccaggctggagtgcaatggcgcaatcttggctcactgcaacctccacctcccgggttcaagtgattatcctgcctcagccttccgaatagctgggattacaggcgcacaccaccacacctggctaatttttgtatttttagtagagacagagtttcatcacattggccaggctggtttcaaactcctgacctcaagtgatccacctgcctcggcctcccaaagtgctgggattacaggcatgatccactgcacccggcctataatttcttttgagaagtgcagtcatgggtagactctagcctaaattttgtattataaagacctggaaagtaccacataaaaaagcctgtaagcaaaccacagaacctatttcatagtggtaagccatgtttagatatttacatatttagatacacacatatctaaaaaaatttttttcttttaaatttttcctgatgccaaaaggaagagagaacttccccacttttttttttgcaaaacatttcctttaggccaggcgcagtggctcacacctgtaatctccccactttgggaggccgaggcaggcagatctcttgaggccaagagtttgagaccagcctggccaacatggtgaaaccccgtctctactaaaaatacaaaaaaaattagctgggagtggtagcttatgcctgtaatcccagctattcaggaggctgaggcaggagaatcacttgaacccgggaggtggaggttgcagtgagctgagatcacaccattgcactccagcctgggcaacagagtgagactccatctcaaaaaaataaacaaaaaaccaccatttcctttaaagaacttgtcactgcaaatccttttacta

SEQ ID NO: 77051 - DNA, 1038 bp, Homo sapiens
ctttaacattgattgctttggctatgtgggatctttggcggttcaatatgaattagtttacgttttaaatatctgtttttccattatgggtttaaaaattttctgtttttcctatttgttaattatttaattagttatattaacaaagcaatatgtgtctgttgtcaaaatcaaacactgtattaaagtatagaaagagtgaagttcctttttcattttctacctactcctatctcaccccctttctcaaggcaaacactgttaaaagtttaatgggtagctttccagaccttccctcatgaatttgcaaataaacatctgtacttacaaagatatggaagatggaattattttctacattgataagttcatactacaaatattaagtaagttacttatcccatttagtagtatttcaagacttttccctgcattcgtttctatagatctaagaagttatttcaaacctgattcatttccactctctcaaatcccttgatttttctgaaaaattcatttctcattatttctgtatccctcagcacccccactcacccaccacattattctggtctgatcgtaaaacatagactaacctagaatgtgttgagtgtgcctggcctacctgccgctaccccatcttcctctttcagaactggctgggctataccaagaagagagcacccattggcttccatcgggttgtcgaaattttgcacaagaacaatgcccctgtgcaggtaatgggtcctgaagagagttgggtacaggatattcttggagacctaactttaagcctcttactggtcagtgatgggagacccgatctgctcttgttttcccttaaaggcagcacaatggctgcaataggcctcaagacagaaaaggccagggagtgaaattctctccctttctcccctttagaaacaattccaaactgtcctctctgagtagcatctactgtgttagcccaagtggaatactgatgtactgttcaaatgatagaaaaggagaactcgtggagaaaagacatcaggg

SEQ ID NO: 77052 - DNA, 1045 bp, Homo sapiens
agttaatcagctatctccctcatctaaggagacaaaatacctcaaagcctttttctgctttttgtagctatctcattatcgagagcatttgaacattcaggaccctgacaaacgaaaagaatttcttaaaacctgtgttgggtaagtatgggggaaaaatgattttaagtataaatacctttacccagaaggaatgaagaaaattaaaaagggtggaatggataggcaggaaggggagggctaacaatgaatcataccagcatcattcagggtcacctcatgcagtggtgttcacacactagtccccagcagagtttccactgcttgatggtaaactgaggaaaaaaaaagacaaatgtagagagattttttttcctaaagctaaatttatttaatttgaaaggttatcttttattgtaggattttgtcctcactcttctcttcttctttggtactaaaatgagctgtacctttttttatgaccttaggtaataaaaagatagcaatactttagggacctgatgcattttttcagtgttactggtccttgaaaccccaaagtccaagaaccactgatccagggcaagctttcatccagaatttaacttattgcaaaacccagctccacatattcctgtgacaggatgcccgttgctcttgaaacagctcagtttgtttttgaacaaccttcgttattggaaagtgcttccttacgttaagctgaaatttgcttccctgtatctttcaagacaggtgtagagtctacccagtagtccttgcttcttcaggttcagtactcatggttgtttcaaccattcctcatgtgacatgatttcccggcttcatgtttagaaatttgattatatcagtgaaatccatttaatgttaccaaatactgagatatgttatatggcctctggaaaacaaggagaaaagttaaaatagtgaagtaactagaatttatagcatctctctttatctcttctaaaaattcactatggctaaaacttatctggaatagtgtaattaaaactcagaattcttc

SEQ ID NO: 77053 - DNA, 1055 bp, Homo sapiens
tatatttctatcattgactttatattctgaccatagatgcataaatgaaagagcaattcttagagtggaattactcacataggatgtttgcatctgtattgggtagatattgccaaattgacctccacaggggttgtaccaattcatactaccaccagcaatggaggagggttccagtttccctatagcctggctaacacggtattatcaagcttttggatctttccccatcttataggggactaatggtttctcattatatttttaatttgtagtactcttagcaaagctgggggcaggtggtgtgtgcctctggagggtagtggcgatggatggcttgaggccaggagttgaggctgacgtgagacatgactgttagatatgattgtgaatagccactgtactccagagctccggcaatgtagtgagaccctgtctctaaaaaaaaagaaaaaaagagaaaaaagagtaaggttgagcatcttttcatatgttgaagagccatttgaattttctgtgatccacctattcatgtccttggtccatttttctgctgattagtctatttgattctatcttttctccctgccccaagttggccaagggaccagggcttctggtgaaaagcttttagagtttattgaatgttggatgtcaaggctttattgtggatgagaattgctgatgtagttcttactatctcacaggtatctcatggtccatcagagagactgctggtaatagcggctcaacccacgaggggcgtgaacagctaaagagccgaaacagcttctcctcctatgcacaactacccaagcctacttctacctactccctgagcagcttttttagaggtaaagagagatgcttaaatggatagggaagtccttctctttttccagaaaaatcttaggccataattttcatttactttgtaagaaaaagattattgaagggtaaagcattctcattggaggtggcagctgggtgttaggagcgagataaatgagagaaattcagaggagttggactggttttctatagcatgatgaatg

SEQ ID NO: 77054 - DNA, 1411 bp, Homo sapiens
gagaaaacacgaataacgagaccgcagggcatgctggaagtcgtagtttcttctgcctctgctgtcaggcgctgtcccgacgaaccacaaggcttcttgactacagcccccagaaaccccaagcaccgtgctaggtcatttcctctcctttccgcgagaccttccgcggttatccagcgagtcacgtagcaagactacaattcccatgaggctcagcaagggcgatttagggtccagggaagcaatgagacgtgttctttgttttcctatgggtgaggaatggttgtatgagcagttgggtttcgggacgctttttggggagaacccgatggagtctgaaggatctctaaatcaggcggaacccacggtgcggcgagttgggacggaagtaaccggtgggagtggggaggagccggaagttaaggaggggagggggtggagggaaaagcaagccaggaggtgcttgcggccgcttctagtagtttccaggcgctgccgggcggctggcactaagcggtcctgaggctgtggctacggctgctccggagctggtggcgccgcgataggagagccgatggccaagtggggtgagggagacccacgctggatcgtggaggagcgggcggacgccaccaacgtcaacaactggcactggtgagggccagaaaagcaggccggccttgggagacctgcggccgggccagggtttcagggttcctagaacctcggcccggacagagctggggctgaggtagccctgtccggagatgggggtgggtccttcctgtggcaggggtccgtagccccaggcctctccactccgcggtcaccttctcagtgtttgaggggagggagatggacgtggagggctgcgccccagaggagggttgtcagagagactaggagataacgccctggctgctgcatccagcccgagcagggaggtgcttattacacgtggccagaggagtcactgagactggaacctcctttgattgtgttgggagatagctgtgaaaggcctaaggccaggggtctgtaattcctattttgcggcctgcggtaaaattaaaagtcattcataggggaccgctgcagcggtcccgcgggagattgagaacgtgttgtgcaggtgctcagagctcagatagctgcggcctctcacccggaactatcaggtcgggtgtgttggaactccaggttgccgagcagccgtggttttataacctgaccgttcttaaaataactgccctccttcatgaaatcttcccaaagtaatattagtttccttatttttgaattccactgaacttttttcgtaatgtttgtattgtaccgttactttgttgcagccttttttgctgttgttttctctaatagttgataagtaggaaggcagatagtgatgttt

SEQ ID NO: 77055 - DNA, 1364 bp, Homo sapiens
acgtttttgtggccatctaggggacagtgaatgtgtaggaagtttataatgcaagtgcgaatctgataggtcagaacaccgtgccaatgaggtcagggttattggtttaatcctttctgggccttttagctaagtactattctttcatggtccagtctgtgttcctgatctcagcaatatgtgcagttttccacttggtcaaatgggggcgccatgttaaagtatcaagtattcccccgcaccatcatgccgagaaaggagagcataattttccattgagtttataccattttctacagcagctgtctttgttgacagtgtgcaaccccttgtcttcctaaaaaagaatgacatgtttgtggacatactggagtgcgactgggagtttttgtgttcttttcaaactatttgtcaggcctcctttaacctcgtattctcttgcatagagcagcgtatcctccgtttgactgctggttcatagctctgtttctgctttgcaggacggagagagatgcttcaaattggtccacggataagctgaaaacactgttcctggcagtgcaggttcaaaatgaagaaggcaagtgtgaggtgacggaagtgagtaagcttgatggagaggcatccattaacaatcgcaaagggaaacttatcttcttttatgaatggagcgtcaaactaaactggacaggtaagtctaagctgggctgtcagagagattaactgtgttttgtttaacctgttaagtagctggagagaacagttttgaggagttacagaccttgaagggagaaggcagatgttgctgctttggagtcctatgtaaagcagtatcgagtcctggaatttctttgccattgtgggatgctaaatggatttcctgtgtctgggtctcataagtcccatccatgaagtggccgggccactgcatctttgggccttggtctttgttgggacacctacgatgatatttcttcagactagctacatgtatcttgtgagtgatttaaaaggaggaaggagaggatttttttggtcttgatctttgtgcactgtcttcagtgtgaatcttaacagattaaaccactgcgctaatgaagcttgtgtgtgacagtaatttggggctgttttatctatcttctagttttatgtcccttgtgtatgacattaggaaaaaattgaggtcatgcgtatgaccgttttggacagtcctgactgtcgggagcctgaatgtaaaaaggcactaaagctaagggagtatgagatagctactgtctgtgtatggggcaaagcatgaaatttgtgctttgataaacatttccgaagtgaacagtcatatcataaagaagggtgcaagtagatct

SEQ ID NO: 77056 - DNA, 2666 bp, Homo sapiens
gtatttttattagagatgggtttcaccatgttggccaggctggtctcgaactgtgtctggccgacgctttttttttttaatatagggactaaaaattggtagcatagttttgtgcacattaaatggtaagaaatagataaatataggccgggcgtggtggctaacgcctgtaatcccagcactttgggaggccaaggtgggcggatcacgaggtcaggagatcaagaccatcctggctgacacagtgaaaccccgtctctactaaaaatacaaaaaattagcccggcgtggtggcatgtgcctgtagtcccagctactcgggaggctgaggcaggagaatcgcttgaacccaggaggcggaggttgcagtgagctgggatcgcaccgttgcactccagcctgggcaacagagtgagactccatctcaaaaaaaataaaaaataggtgaatactacaataaatatggtgctttaccatgaaaaagacctgaagtttatttgtgaaagtgggcatcaaagccaggcgcggcggctcacgcctgtaatctcagcactttgggagactgaggcaggtggatcacgaggtcaggaattggagacacacctggccaacatggtgaaaccccatctctactaaaaaatacaaaaattagccgtgtgtagtggcacgcacctgtaatcccagctacttgggaggctgaagcagaagaattgcttgaacctgggaggtggaggttgcaatgagccaagatcatgccactgcaatccagcctgagcgacagagcaagactctgtcttgcggggggaaaaggtgggcatcagaagggttgcagcttgaggactactatggaatggtagaaggagagtcatccacaatcagagggaacattacactcgttgaggatgggtatggctcacaacacacgctgtaaactgaggtcattggcagataggtgtttgagatgtgtgtgttttatgtatcctgtgtagctgggtgaggctttccgtattcacctagtgtttctcatggatggagtcacatataagcaaacatgaacttctcattataatcaaattgttccctaatatttcagttgcactgaaataaattgatattttcaaaacaagtattctagcagaactactggcttttgacccaagttctcatggtataactcatgctagtaccaaatctgtagctctttgtctcacattgtaataacatagttggtttccagtaacctggtgaggaaagacatttcttttgggggtgcgggtgttgattgcatctggcatgtggcattctcagaataaagaggatcagttcagccatccaaaagcagcagaagtgaggtagcagttaggaccctggagcagagacctttcctgccaaggagtggactaatgacattgcattggttttgacaggtacttctaagtcaggagtacaatacaaaggacatgtggagatccccaatttgtctgatgaaaacagcgtggatgaagtggaggtttgtgcttcataactcctaatccgagtcctctatatcctcttattctcagatgagaaaagtgacctgtcattcaggattcatagcccaggcttggtccaagcattcagaaccctagcctgcagataattttctaggcatatggtgccattggaaacttctagagcaatttgcacttctttaatttcttcactttagctagtgacatgggttctaactaacattagccacttgacagagaggactcaagaaggaacactaatggggattgtacgaataccgcagtactcatgcatttcctttggaaatgtcagcagtcacctgattgctcagcccccacattccataatgagggtgcccctcaagttatttaccacctacttctcatctttcacccagattagtgtgagccttgccaaagatgagcctgacacaaatctcgtggccttaatgaaggaagaaggggtgaaacttctaagagaagcaatgggaatttacatcagcaccctcaaaacaggtatcccttgagtagttctgtatgccttaaggaggtagtttccacctgttagactctggttaagggcctggacagtcctttctttggcaaatgggtaaagatttggggggagggggcttatttcatcttaaagtcagtccataagctcggagtaagggaaagatctggagctgtgttgcctaataatgatggttgagcattttagatgtggctagaccaaactgaaatgtactgtgatggcctggcgcggtggctcacacttgtaatcccagcactgttggatgctgaggtgggctgattgcctgagctcaggaatttgagaccagcctgggcaacatggcgaaaccctgtctctacaaaaaatacaaaaattagctggatgcggtggcccatgcctgtaatcccagctactcgggaggctgaggtgggagagtggcttgagcccaggaggcagggaggttgcattgagctgagatcatgccactgcactccagcctggatgaccaaaaaacacaagagatgtgctgtgagtataaattacactacgggctgggcacagtggctcacacctataatcccagccctttgggaagccgaggtgggcggatcacctgaggtcgggagttcgagaccagcctg

SEQ ID NO: 77057 - DNA, 1070 bp, Homo sapiens
tggcataggccaaaagtaaagatgtaaaaatagcctcttccttttctggtcataacctcattctgtggtaggatggctgtgtttgtcaagctgtaatgaaactccagatctcagctactaagaagtaacttccatgagctggaattttatcttttcagagttcacccagggcatgatcttacctacaatgaatggagagtcagtagacccagtggggcagccagcactgaaaactgaggagcgcaaggtaaatggttttcctggggtgggagactgtctgcaaaggaacttgagagaccgccttcttaattccacatatcagctctctgtgtccctaacctctaagccagaccagcctgcgatctgctcatggtgctttttcagagcgcctgcaatatgcattcattcacccatctttaacctggttttaattcatttatcgcagacctttagagcaagtaggagctatcagacagttaaaagtctgactcttgattgcatttagcaccagttaggaggttatgaacaaaggatggacttcacctatataagtcttcagtctaattggtgtgttgatatttcatactttgatattagaggtcccatcaagaaatggagttacatccctgtcttcacccaatctccccaattttcagggtgagcaagtactttatctagagatggaagtttgtggttcaagctcagcacttggtttagagccctgttgctcttttgtcagcatagtgaagtggatactctggaagtggggagaaaaccgcttccagctatttaaacatagaaattgtttgagaattacactgagctcttcaaaaatatctcaatgatttgatttgttatttgactatcagggtcttccttgtagagtggttatttttactgggaattgaggaggtttccagaatcattaccctcatgactgaaacacctacacactcaaattcccttcaaaccccttggaataattacccttggaggtgaacatttttatgagaatgaatggtacaactgtctctgaagccacgttgattgaggttgtatcattactctgt

SEQ ID NO: 77058 - DNA, 2220 bp, Homo sapiens
aactgcagagcccatactcagcaaattgttgtctttatttaacaatatgtggtaccattaagtttgctgggcactgaccatgagccaagtgttggggatatagtgggttcagactgccacattgcaggaagaggtaacagtacctgaacagggagagtcactcctggacaagcctcgccctgacttcctgcaccccagcgggagtcagtgctctctaagccagacgctacctcctgcagctacagctatttccttcgtctgtttattgcctgttttattgggtggcagcaagactttgcaggctaaaactggttaaagcagagttcaagatctggttcatttacacttcccaaagccatctttggcttgaattacaagagtgctgggctgaactaatccacatctagtttgacattacatctgcctcctaggggtgcaaaatgacgccttttgatgaagaacctggagtctagcttgaatcaaatcaacaggcccttcctaacagactcctaacagagacgattaaaaatgagactttgggccgggcgcggtggctcacgcctgtaatcccagcactttgggaggccgaggtgggcggatcacgagggcaggagatcgagaccatcctggctaacacggtgaaaccccgtctctactaaaaatacaaaaaatcagctgggcgtggtagtgggcacctgtagtcccagctactcgggaggctgaggcaggagaatggcgtgaacctgggaggcggagcttgcagtgagccgagatcatgccactgcactccagcctggacgacagagcgagactccggctcaaaaacaatttaaaaaaaaattaattaaaaaaaaatgagactttggctgggagcggtggctcacgcttgtaatcccagcactttgggaggccgaggcaggcggatcacaaggtcaggagttcgagaccagcctggccaacatcgcaaaaccctgtctctactaaaaatacaaaaattagccgggtgtagtggcgggcacttgtaatcctagctactagggaggctgaggcaggagaatcgcttgaacctgggaggcagaggttgcaatgaaccgagaccaagccactgcactccagcctgggcgacggagactctgtctcaaaacaaacaaacaaacaaacaaacaaatgagccctttcggccaggcgcagtggctcacgcctgtaatcccagcattttgggaggccaaggcgggcagatacctgaggtcagggattcgagaccagcctggccaacacggtgaaaccccatctctactaaaaatacaaaaattagctgggcataatggcaggtgcctgtaatcccagctactcaggagactgagtgggagaattgcttgaacctgggacacagaggttacagtgagccaagatcacgccattgattgcattccagcctgggtgactgagcaagtctcaaaaaacaaaaaaaaagaaaagaaaaagaaaaagaaaaagaaaaaatgagccttttcacacacacctggctggaaagttaccagttccagaatacttagaatcaatcaagtagagatgaccaatatgttcattaaacccaaggcaccaggctaagtgcctgccatgtgacatgtgcagttgccattacgtgccagtattgatggctattcaattcttaccattgccattttactgataacattttggtaagccatctggacctaaaaagcaaatggcatagctagaaataaaactgtggacttcgactttgtgtttgaatagtaaaagttccacttcctaacaaattgggtgaatatccttatctgtagaatgtgcataataggtgtcttgtgagagcgttcgagatgatacatgtagaaacgctggcacctggtgtcatttagcaaatagtcgctgctgaatccattcaaaagcccaagtgtttgcccttaagccagaatgctattttgaaaagctggctaattttaatccaaattgcgtatcttgggctaagagctctccatgcctgagaggaagaacaatgcacaaaagtggactccactcctaaagattcttactcagtgggtgtggggtgtggcccataaacagagtttaataaataccccaggtgattctaatatcagggatgcactttgagaagcatctcaacatattaacaaaacaaaacctcattgtaaaggagccacagcagcacatttgggt

SEQ ID NO: 77059 - DNA, 1087 bp, Homo sapiens
gcatgtgttagaaccgccatacctggccccagcccagaccagttcagtccatacctggcatctgcgaattaggagtccccaggtgattctaatgcacctccaggccgtaagctgtgattcttgtgccctaagaggccaggaaggttagccaaaaatgtcagccaagagaagacagctggtttgaaggaaaggttgggcctctcacctctgaccctgaccccatcatccctcgtctctttggaatgcagctctaagacctccttcactggccggcctggcctgtctcctgcaggtgaccatcaaggtggtggaggacccccaggccgaggtgtcgatagacctgttggctgagcccagcaatcccccgccccaggatacccttagctggctgcccgccctctggtccttcctctggggagactacaaaggagaggaaaaagacagggccccaggggagaagggggaggaaaaggaggaagacgaggactatccttcagaggatatcgagggtgaggatcaagaggacaaagaggaagatgaggaagagcaggcgctctggttcaatggaactacagacaactgggaccagggctggctggcccccggggattgggtcttcaaggattctgtcagctacggtgagcacccccatcttggcatccccaggctgctcccctgtaggtactgagtggaaatgggggtgagggagagggtggaggcttcccaggcaagaccattgaggaagccaggagcttaggccttgttcaaacaccatcatcaactcaaaagtaacattgacaatagcttgcagagtttttccttttttttttttttaattttttaatttgagattgggtctcgctctgttacccaggctggagtgcagtggcatgatcatggttcactgcagcctcaaactcctgggctcaagcgatcctcccaccttagccctcccaccttagcctccgaatagctggaaccacaggtgcataccaccagggcaggctaatttttttatttttagtagtgatgaggtctccctatgttgcagaggctggtctcaaactcctgggctcaagcagtcctc

SEQ ID NO: 77060 - DNA, 1092 bp, Homo sapiens
gcccctcggaggagggtgggggacgtccaggtgcgcggaccctagagctgtgcgggcgcccacgcgaggagccggggccagagaggctgtgcgagctgcgcgcccccgccccgcgcggccccgtgccccgcgcgcccctcaggatcgccgggtcccgcccccggaggaggcgaggcggggcgcgactgggttcgcggccgcgtgcagaggtgcaggcagagcagcctcggaaccgagacgatgcgtgcgctccgcgaccgagccgggctcctcctctgcgtgctgctgctggcggcgctgctggaggcggcgctagggctccccgtgaagaagccgcggctccgcggaccacggcctgggagcctcacgaggctcgcagaggtgagtggcggcggcaccgggctgcggagcgcgctgtcggtcccacctccccagcccgccggctccagccgtgcggggagcgggaccgggacacacacaggcagcgaccccccgatggagagaggggccggggccggccggaagctcccggacaccgggcgttgcccaggtgcgccggacttcggggcttccactcctcgcgcgtgaccgcgagccgggctgccgcggaccagccgggtgacaagtttgacttctgtgcggagtgaggtggccgacactccacggtggccgggcttcctcgccctgagcggacctcgcctgcagccccctttccaggtgcgcgctagctcggagaggagtcccgccggtgcgaggaatctggcgctttgcggagtggcgggccagggccgctgaggttcaaacggtcaggtgagccccttccatgagacaagcggaggcacagtggggctctccagccgccggcaggggtggccagcctgagactggctctgtcctcgtggcctgtgggtgggcattggggtataaaacaggaatgagatggaagagtggtgttggccatggagagaagccatggtctgtcaaaccctgtgtcttccagtcactgaggggtctacagtccagcttattgccccctggaatgcagcggacgttcattcccatggggacaaagacagccagacttgtattagg

SEQ ID NO: 77061 - DNA, 1326 bp, Homo sapiens
aataaactgaccctaaagaatgcaatggcttttaaactgcagttactgtgttcttaatgaagcaatacccaaagctctgttcttttggagcacttgaggggagcttgaatgaaaggtgcagataagagcagtaccttgatcttatgctttctgagtgtcctgccttgttgccatctgcatggatgagtgaatgcttctatgcacgaggagactcaagccaactcagagtctgctttttccaacgctcttcccaggtttcttttgcaaagcttggtcatttggcccaggtcttcctggaaagtggagtacatgtcactgactagggtggcgtggtgtctttacccttaacattaagtcttgttacctcagtgatgtgaagccaatggttggaattataaaaagcatccttgctggttcttcacaggacactggaacccaccctgtcaattcagctagcatgtccacacagtcttgatgatccctctctgtaacaggcagctaacattaagagaagggggaaagagaagaagagagcaatagcttatgggagagctgagatcttacttcgttgacccatatttttcccctgaccaagttacctgtaaactggaatttgcaaggggatgctgtgatgataacccctttctattgctgtaatgttcatataacctgggaaactgagagaaggggatgtgtaaataaaagcttaaacattttagtaatgtgttaaaatgtcactctctcttaccctgtttcccttttttgccagatgatgatttttttatttttattttgtactttactggatgactgtgaagcgatgagtattgggttggggtaggtgtgttgattttgagagtgcatgttaagaactgaaggggaactacttgagatgacttaagaagcatcccatgcaaatatcttgttttgccctaataaaatattcagaaagatatatctgcctttattcattcaaccaatacatattgagtgctatctctctgatgggcagcacactgagctttgtggttcctacttgctagtaaacagataagcacatgaacatacatgtcattttacaaactgttaagtgctatggaggaaaagtaaagagcttggtaaaagtaaccaggccgggcgcggtggctcacgcctataatcctagcacttcaggtggatcacttgaggtcaggagtttgaaaccagcctggccaacatggcgaaatcccgtctctactaaaaatacaaaaattaaccaggcatggtggcacgtgcctataattccagctatttgggaggctgaggcacgagaatcgcttgaacctg

SEQ ID NO: 77062 - DNA, 1181 bp, Homo sapiens
agacaaatcactggaagcatgttcaactccttggtgtttgaagaggcatgacacaaacatagagcccttagtggttgtgtaggatgcttctgttcaccttgatgactacagaagcaagaatcctgttttaaaatccttgccctatcatgaatgtttacgatagtgactaaagcactacgatggctggattcttcaaacaaataagcagtactttgggggttatggagactagaagctttttttaaaggtaaggatttcttatccaaagcaaagcaaaaagttgaaaaagtgctataaagtccatgcccctgctaagttaaagcttaaaaaaaaaaagatgcgaggagaaaccgccactgctgcttggtccactcctcatatgggcttttgacatctcctagctatgcatttcctggcttctgatgtgatctgctgaaagaggtcttataaacctgaaataggtaacagcaatgctgaataaaaagaggaatgagaaaaagtgctaaggactagtcacacctctatcaatcgactcagatgatcagttttggtagtcatggttaaccggtatctgtttgaatcctatcagagtcttgaatcaggccgtgttaaactgtgtaagaaactactcttgtatgcctcaaatcgacttattctcaatgactgtatttatatatacttgtattcctccaagtacttggataaatgatgatacctaggatatgactggaccctagatttacattacagtttcaagaagagacaaccaaccatgtataatgtctacataacattttgttctttagaaagtacagaggtcctgcatagatcacaggagatttgtctcttcaaaataaacttgtaacaaaattacacttatcttgaaataactttgtaccaacaaagtgatatagatatattttaaatgccggtactgacatttgaatttgcagtgacttcatgcaagccaaaataaaaagactagcaggtaagttcattgcttataagtttgtgacttttacaaaccctacgtttacattagtaaatagtaactgcagtgcaaaagctatgtggtattccagtgggattctatggtaggaaactagatgtgcagaaaaggttgacaatgtatttgattttataggactcctatttagttaccacaacctccttcttacttt

SEQ ID NO: 77063 - DNA, 1670 bp, Homo sapiens
aaaaacagtgtatgaaagtcatgttacaggccgagtgcggtggctcacacctgtaatcctagcactttgggaggctgaggcaggtggctcacttgaggtcaggaattcaagaccagcctggccaacatggtgaaaccccgtctctactaaaaagacaaaaaattagctgggcgtggtggcgggcacctataatcccacctacttggtaggctgaggcaggagaatcgcttgaacccaggaggcggaggttgcagtgagacgagattgtgccactgcactctagcctgggtgacagagcaaaactgtgtctcaaaaaaaaaagtcatgttacacatttaagtttttgaaattgctccttttatcggtaaagattctcaatccaaattctcctgggtgtgttgtcatcagctgtgatatgtttgtgcacattacgtatagcagaggatgtaagcaatattattgtttgtgaagttttgtttttaatgtcttgagtatgagttatgtttagtcactgtcagcatctgagaactttaataagcccttgagatattccaaagttttattttacttttttaaagaacagaaaaagatgaatgaaagaaccaaggagagatgcagagactatatttagcatgtataggttaaagtaagaaggaggttgtggtaactaaataggagtcctataaaatcaaatacattgtcaaccttttctgcacatctagtttcctaccatagaatcccactggaataccacatagcttttgcactgcagttactatttactaatgtaaacgtagggtttgtaaaagtcacaaacttataagcaatgaacttacctgctagtctttttattttggcttgcatgaagtcactgcaaattcaaatgtcagtaccggcatttaaaatatatctatatcactttgttggtacaaagttatttcaagataagtgtaattttgttacaagtttattttgaagagacaaatctcctgtgatctatgcaggacctctgtactttctaaagaacaaaatgttatgtagacattatacatggttggttgtctcttcttgaaactgtaatgtaaatctagggtccagtcatatcctaggtatcatcatttatccaagtacttggaggaatacaagtatatataaatacagtcattgagaataagtcgatttgaggcatacaagagtagtttcttacacagtttaacacggcctgattcaagactctgataggattcaaacagataccggttaaccatgactaccaaaactgatcatctgagtcgattgatagaggtgtgactagtccttagcactttttctcattcctctttttattcagcattgctgttacctatttcaggtttataagacctctttcagcagatcacatcagaagccaggaaatgcatagctaggagatgtcaaaagcccatatgaggagtggaccaagcagcagtggcggtttctcctcgcatctttttttttttaagctttaacttagcaggggcatggactttatagcactttttcaactttttgctttgctttggataagaaatccttacctttaaaaaaagcttctagtctccataacccccaaagtactgcttatttgtttgaagaatccagccatcgtagtgctttagtcactatcgtaa

SEQ ID NO: 77064 - DNA, 1091 bp, Homo sapiens
acatcactctacggagcagctttgtacccaacactcagatgtgagagtggccttctcaccagggtgggatatgggtgctctgaaaacagtaagtgctttaaaaagggggtgggacgtgttacggttagagcttgggaagaaccagaatttgcgcacatcctcagactgtgaccattatgaagaagtatttgatggtaaaggaagaaatcatctggtgaccagaagaaaatggaataagaccaaacccttgggagattacacaatgagcctttcagcagtcatcgcttactgtttttcttaaaaggctaaacttaagattaaagggtgaaaacttccgttgattacttgaatggttaaataaggattccaaggttggccttgagacctctgagacctggatgggaagtaagtggaaggcacttgctccctagggaggagggccaggtaagtatccaggctgcggagccagggccagcagtagctcttgatgggcccaagtctgcaaggtgctgggagaggggaatggcctgtgtggttagccagagacaggctagggtcagcgtgatttcacaagtagaatggttgcaaaataaaatgtttttttaatggactgaaaaagcaaagtgagtcaccttcgtttttaaaggtgagatttagcaaaggaaggattagaagcagttttttactatttacaaaatgtcatttagagtggaggtggccaccttcagtagctgaggcaatgtctttcacgtgagatggccacagaagtgtggttcctggaactggctcacaaaggccacaggctgtcctgggtgagggagagttcctctgagggagcaccaaaaaggctcagtcttctgtttcttcatacgtcgtctcgtcaaagggcctgtccagtagaggtaccaaccgatgacgggaatacttcagctgcaataggtccccaacttcatctatctcctttaaagcctaaaatacacaagacaaagtagaggtctgtcagagccagtaggatgcaggcatgcctggtgttttactttgctaaaaacaatcatggcaagattatccttcggcaggacttatgtctagtg

SEQ ID NO: 77065 - DNA, 1154 bp, Homo sapiens
gaggttgcagtgagctcggagggcgccacagcactccagcctgagcaacagagcgatactccatctcaaaaacaaaagggagagatgacaaattgtattcggttttgtaagttcagagtgcatataactttttctaccaagcatatcatactttgaattatagcctttattctgcatacctggctattcacaacccattattcatggtgagcttgaaggccttgttcaaaaagcagctccttccacagctgtattgtagtctgatcttgtaaatgcactagacataagtcctgccgaaggataatcttgccatgattgtttttagcaaagtaaaacaccaggcatgcctgcatcctactggctctgacagacctctactttgtcttgtgtattttaggctttaaaggagatagatgaagttggggacctattgcagctgaagtattcccgtcatcggttggtacctctactggacaggccctttgacgagacgacgtatgaagaaacagaagactgagcctttttggtgctccctcagaggaactctccctcacccaggacagcctgtggcctttgtgagccagttccaggaaccacacttctgtggccatctcacgtgaaagacattgcctcagctactgaaggtggccacctccactctaaatgacattttgtaaatagtaaaaaactgcttctaatccttcctttgctaaatctcacctttaaaaacgaaggtgactcactttgctttttcagtccattaaaaaaacattttattttgcaaccattctacttgtgaaatcacgctgaccctagcctgtctctggctaaccacacaggccattcccctctcccagcaccttgcagacttgggcccatcaagagctactgctggccctggctccgcagcctggatacttacctggccctcctccctagggagcaagtgccttccacttacttcccatccaggtctcagaggtctcaaggccaaccttggaatccttatttaaccattcaagtaatcaacggaagttttcaccctttaatcttaagtttagccttttaagaaaaacagtaagcgatgactgctgaaaggctcattgtgtaatctcccaagggtttggtcttattccattttcttctggtcacca

SEQ ID NO: 77066 - DNA, 1050 bp, Homo sapiens
aagttagaagatgtaaattctagttgcagctatgccacttgctacttgtaatgtgccacacactattgtgcaactgtaggcatgtcactaccttggtgagagtctccccacctataatatgaagataatcataaatatcctgcctactgtcaagggatttgtggagtgctcagtgagggggtatggctgaaattctttgaggatgctaacgctccattaaacgttttttacattattataacttctgctgttaacaggtagaatgacagaatacaaaatgagacattttacatttatattccatatggtttactctgtaaaatattttatggtgaaatggaaaaaaacgaaacagaactgattagatagaatggagatagaggagatttactgtcttttttccattcctttttacttaggattattttgttttctctcaccgtgactttccaggtaaagagtgtgtacaacagttagctgaaaacaccaggtatttcaggagacgcctgaaagagatgggcttcatcatctatggaaatgaagactctccagtagtgcctttgatgctctacatgcctgccaaaattgggtacgttttgttgcagatcacagaccagtctgtccttatccttatctgtgatgtgagaccagggcttatgtattttgttagggaaaatggtcttgtccttactgtgttaaccttcatttggtacatatgccatagatcaaatagtggattccaaattgtaaagtatgttaatttgttcttctttcattaaacatttgagtttcatgtactctctaggggcctgggatagatcagtgaataaaatacaaacatctctgtccttgtggagcttacagtctagtagggggcaacagtcagacagacataataaacaaatgaactgtgtacgatgttagaaggtgtcaagtgctatggaaaaaaatagagcaggacctatatggggagttgagagtgccctgtgggcgggccgataacactattaaatagggtggtcagggtaaggaagcctccttgggaaggaa

SEQ ID NO: 77067 - DNA, 1073 bp, Homo sapiens
gttgtacacactctttacctggaaagtcacggtgagagaaaacaaaataatcctaagtaaaaaggaatggaaaaaagacagtaaatctcctctatctccattctatctaatcagttctgtttcgtttttttccatttcaccataaaatattttacagagtaaaccatatggaatataaatgtaaaatgtctcattttgtattctgtcattctacctgttaacagcagaagttataataatgtaaaaaacgtttaatggagcgttagcatcctcaaagaatttcagccataccccctcactgagcactccacaaatcccttgacagtaggcaggatatttatgattatcttcatattataggtggggagactctcaccaaggtagtgacatgcctacagttgcacaatagtgtgtggcacattacaagtagcaagtggcatagctgcaactagaatttacatcttctaactttaagattcattctaattaactgtgctgcaaataaattttacacataagaccagagatgaagcctttagacccccaaattttcatcttctgagtttcattttgttgtttccttacaattctttttttctttttctttcttttttttttgagacggtgtctcactctgtcgcccaggctggagtgcaacggcacgatcttggctcactgcaatctctgcttcccgggttcaagcgattctcctgtctcagcttcctgatagctggggttacgggtgcacatcaccacgcccagctaacttttgtatttttagtagagacagggtttcgccatgttggccaggctggtctcgaacacctaacctcaagtgatctacccaccttggcctcccaaagtgctgggattacagacatgagccaccgcgcctagcctgtttccttaaaattcttaccagacaacagtaacatatctgtaatagtataaaatcgtatctttaatcctattttgctcatcttccctaaaacacaaatagattaaaacacacgtttctgtctgcaattgccaactgactaaatatttgggcaggttttgacattatggtaagt

SEQ ID NO: 77068 - DNA, 2806 bp, Homo sapiens
gcttgccggatttgaaagctttccaaaaaggaattgatttttttttaattgtcacctatagtttttctaattatctaaatattttatttgtatctacctccctgctatctactttggcagtagagtgaggtgttaaagaaaaaattattcctgtcacttgtgaaacatgataagacagacttccttcaagggggccatggtaataagcatagggatgactgcaatggggtcttccagtgggggagagagggtgggctgcagtctgactccaataaggacagatgaggatttacagccaaggaacagggtgggagtgagtagatagaaaaatactaagaggaaacatcaggggtaagggggatgcttgccttcagcattcttgttgaaggtaggccagggtgataagataccaggggtagtcatgtaggggattttctctaatctgacttagcaggattattgctcaaactggattctgcaagaatggagaaggaggcgcaacgtcaggactttatcagaaaggactccaagaggagcctgactcaagtttggtcaaaggagagagtctttgtcaggttcagaatgacctcattaacatgaactctttaagcccctgttctcagactttgtccatggaccacctgcatcagaggtacttttagtacagtggttcataccttgcttacacacaggaaagcttaaaaaaatagtgccagtgttagagaccttctgtagacccattgagtatctcaaggcgaggcctccctgccatggcatggtgttatttaaaagcaccccagatgcttctcatgtaaggccccatttcagaaccactgctgcttgttaaaaatgaagattctagtttgttccacccaccctactgagtcttggtggatgaggccctagaatatgcattgaaaagaaaaccttaggctggatatggtaatcctgacattttgggatgtaatcgtaacattttgggaggctgaagctggaggatcacttgaggtcaggagtttgagaccagtctgggtgacatagtgtgagcctctgtctctacaaaaaattctaaaaattagccaagtgtggtggtacacgtctgtaatcctagctacttgggaggccaaggcggaggattgcacaaacccagctatgatcacaccactgcattccagcttggatgagagagggaaaccctatctctagaaaataaaaaagaggattgtctttttgacaatcctctttttttccttttaacttttttacctcagtaccaaagcagctctactgattgatggtaattgaaaaaggaaaagaaactggaagtcaagatacaaatgagggagatgtttggcttgtaagacaggcatttgctggcagagctaagttgccatttttggttgtttctggaactctaaatgcctgggatgctgacactcccttctgaacagctgatgattctggctgattgaatcagtggcataggtggagaagttagaaaccagttaggtgcagcaggaaaacagaactaagcattcagagatctgtggtcatggttcctaaggctagttggaattaattatttttgttttactttttttggggggggctgcttgtatttttataacctattaatcctcaaattacttagtacataacctacaaatggccttgcccactataaagttgttaaaatgtttagtattaaccgttttgtaaaactctgattgtcttattgtattgccttctacctctaaaactgttaacttaaatccaagccaagcctttaccagagattacctttatttgctagctgtcttcatctgtgggtagatacattactacagtgtttacgttccttatctctttgtctcagagtagcctgtgatatgttccagccccaacagaggacagtagaatggtccattaagactttctgaggccaaggtgggcggatcactcgagatcaagagttggagaccagcctggccaacatagtagtgaaaccgtgtctctactaaaaatacaaaaattagccgggtgtggtggtgcacgcctgtagtcccagctactcaggcggctgaggcaggaaaatcactggaacccgggaggtggaggttgcagtgagctgagatcgtgccactgcactccagctcaggcaacagagtgagacttggtctcaaaaacaaacaaacaaaagactttctgtcctgcctgtgggttggcacccgttaaaactcagttccttgatttttcacaggcacttggcctcttttctgccttttgtggagggccctctgtttctggctgtgcattagcaaccattcttttaaacttctgattatattgaatcagcaactttaagcttgcccctgctgcttgtcatacatcctgtggcagtcctcaggaaatcctagtttttggcattgaaatgaattaaaggattaagccacaagagggtgggggtgataaactgtgcttttaagaggaatttactgtgcagtacttggtgttagcaaaagcagttctagttcttacagggagataggaaaccaaggggctgctttagaacagcatccctaggatatgaagacgcagatctgtctgctttgatgttctttagcttgacagtggccccggctgagcactttgatatttgtcgccagtctagcaaaataggggttgtgtcttggagatggtaaacctagttcccgttgctttgcttcagtgttagaaaattactgaactcttgcttcctggaagtcccttataaatctcccttttacaagactgttctctggggcac

SEQ ID NO: 77069 - DNA, 1078 bp, Homo sapiens
ctagaatgctgttgtttggaaaaaaaaaaaaaaatacttgtttccgccgggtgcgatggctcacacctgtaatcccagcactttgggaggccgaggcaggcggatcacctgaggtcgggaattcaagaccagtctgaccaacatggagaaaccctgtctctaataaaaatatgaaaattagctgggtgtggtggcgcatgcctgtaatcccagcactttgggaggccaaggcaggcggatcacctgaggtcgggaattcaagactagcctgaccaacatggagaagccctgtctctaataaaaatacgaaaattagctgggcgtggtggcgcatgcctgtaatctcagctacttgggaggctgaggcaggagaattgcttgaacacaggaggttgcggtgagctgagatcgcgccattacactccaacctgggcaacaagagcgaaactccatctccaaaaaaaaaaagtgttttaccatttgttaaacacttatcaagcaacaagcaactactctctacatagtggtagatatgctgtgtgggagatgcagagttgaacaataggtgatctttgcctttgaaaaaacagtccagtggtaggggtaagattcccgggaagaactagtctcagaggcacagataaattcttcctttgttcagcttgtcttttctcaatttcctcctccattctcttctacaacctcctccttcactcactcccactcccctaaaaccttaaacttccttaaaccagctaagtttttgaagcaaactcatattttagatttcttatataataactttctatataaatgaaatttttctgtggatactgtcactctagtaaattatcagcaatcaaagcagcttcttgattattttttaaagcagcttcttgattattgagcacaaaaggccttttaaccaatggcttaagccttctgaaatcagcaagcaatatgaccaccttacaggtggagaaatttgagctcatgtatggaacaagttttctcaatatcttgtctccaactagaatgtagcttttctaactccatctgcttctacttctgaggttgc

SEQ ID NO: 77070 - DNA, 1035 bp, Homo sapiens
tgtggtgttagtggaaactgtgtgtgaatctgagagacagacatatatacacacatatatatacatacagctagcatttctctaggtacttcacataggcacacttaccttactgattcagcacacaggtttaggtgactaagaaatggctaagagctatcaaagttaacattggataatttatttgccctgttccagaacatggatctgtgtgacacattacccccagataaatgacttatctgtactaaatgatgaaatctgggctgtgctagtagtgagaaaatgaaacatggtaattatatataggctttggatcagcacaagttttctagtttttgcctctagccacccccaaagcttagtgatgtgacacaacagccatctgattatgctcacagatgccacaggtcaagaattcggtcagggcacagcagggatgacttgtctttgctctgttgtctggggctggcctggaagactcaagtgtctggaaagactgagatggttggtggttgggatcatctggaagcttttccactcacatgtcacctgggctggagtgacttggagccaggctcagctgaggctgttgaccagagcaccttcatgcatgtatcttttcaatgtggcttaggctcctcatgacatcgtgactgtgtacccagaaaggatgcttcagagagcaagcattccaaagaacctggcggaaaccccatgaccttttctgacctgttgttaacaagcaggtcactaaggccatcccggattgaaggggtggggaactagattccacctccccagtggaggcatgtcaaagaatttgtggctggtttttttttttttgagatgcagtctcaaggagaagtaccatgcttttttaaacaaccagatcttgggagaactcagagcgagaactcactcattacccaaggatggcagcaagccattcacgaggatcctccccatgatccacacacctcccaccaggccctacctccgtcattggggatcacattccatcctgagatggac

SEQ ID NO: 77071 - DNA, 1075 bp, Homo sapiens
gcgattctcctgcctcagcctcccaagtagctgggattataggtgcccgcctccacgcacagctgatttttgtatttttagtagagatggggtttcaccatgttggtcaggccagtcttgaactcctgacctcagtagatccacccaccttggcctcccaaactgctgggattacaggcatgagccaccatgcacggccatatttctaactttaaatgatacattctccaaatttagaggggttgttttaaaactagtttttctcttatgttgttccatgtttaaaaaacaaaaccaaacctaagaactttgccatgtttctgacccagttgttgccagcggtatgcttcgaccatgttggttgaccttgtatctcagattagtgtccctattccagtgccattgaagtgaggagtcctctagaacttagaaggaaaggactgacattgccggtgaatgcaagaattgtctctacttatctgcctctgtgaactccccaggagctgatagactacctgcgaacacattctcatagtgcagtgtatgccacgtcattgtcacctcctgtagtggagcagatcatcacctccatgaagtgcatcatggggcaggatggcaccagccttggtaagtctttcttttcttgaaacattgcataagtccacctagcagccaaacgtgctgtttttcttgagcttttttcctaaaataaatagtcaggtttactaataggcagagctggctggtgtgtggtttccatggacacttttttagtgtgtttgatacatatgccatgagaacgaccctggctcactttctatggaattttcttgtttatagatgggaggctttactcttactatcctacataccctcttaactcagaggtaatataccttcgaggtttttcttgaattacataattttatgtgaaggtataattcactgttagtgatgtttcattaacagcatagttaagagctgctgttttcataaattagtattcctgatttaatgcctttttaaagagtttctactttcatatacggtagataataaatgacatcctgaatca

SEQ ID NO: 77072 - DNA, 1123 bp, Homo sapiens
actcagccgggcagggtggcttattcctgtaaccccagaactgtgggaggccaaggcgggtgtatcacttgaggccaggagttcgagactagcctgggaaacatgaggaaaccctatctctactaaaaatacaaacattatctgggcgtggtggtggcgggcacctctagtcccagctacttgggaggctgaggcacaagaatcgcttgaacccaggagtcagggattgtagtaagccgagattatgccactgcacttcagcctggacaatggagcaaaactctgtcccaagaaaaaaaaaagaagcagtaaactcaataataatgaagtgccaaactcccaattttgatttaaaaagtctcagtgtatatgtgtatatatatattttttcatgttttgccagcatggagggatctattgttcgtcttcctgaagtgattgccctcaagaagaaatacaaggcatacttgtatctggatgaggctcacagcattggcgccctgggccccacaggccggggtgtggtggagtactttggcctggatcccgaggatgtggatgttatgatgggaacgttcacaaagagttttggtgcttctggaggatatattggaggcaagaaggtaaacgagccatgagaatgagcgattagagataaagtcactggcaattagatttggtacctcaggcctagcagatggggccctgaactgggatgtccgcaaatttgcctctggtttaggctcataataccagtgagtgactctaatgtctcctcactgaactaaaggctggttctgttcattgtttgttgttttcttatttgagcttctttctaagctacatgctgatctgagatatagaataccctcttgtgtgaaagaacacacagtggtgctccctgcccgccccagccttctgttgggtttgcattgtgctcacagtttcaaaaacagtggggttgtcatgggagcccatgggaatagcaggtcaccttgcccttggacacaaatatatcatgagtgaacatggagacaggaagcaaaaaagttgtgccagctgtggggtactacaaagcattgtatttttcaatttttaaactatgaagttgccttttctgggt

SEQ ID NO: 77073 - DNA, 1050 bp, Homo sapiens
ctgtgaagtttttttacgccttgcgtttgtttttttaggaggagtatgtgtctgtgatggtttattcacactctctcgctctgtcttttttacgcatttatttccgaatgactcactgggattagagatacagtttgattctgtatttttcgataaacacacagaagctaacttaatggcagggtatttaacatgagacactggtcattttataaggaagctaatgaactgagttagccaccaccgtcctttagtcaagtttcgatggttttgaacatttgttacattttggatttcaattcaaggtggcaataattcacctattttgccctgcttttttctgcccaactctaattatgtcctttgctatctgaggcatggtttctgaatgagaaatatatctctgcatttccggaataaagttaggaaagaggaagatgcggtataactgttcttttttgtgctctgtagatatgcaaagcctagagaagctattgaaagatgccattgtttatggtcagcctcggacacgaaggccctggaagaaaattctcatccttgtggaaggaatatataggtaatcctgctttattattcttacctttgtgacttggccccatgaagtcatagaattttttaactgaagggaacattagtctatccccctctggaaactaaggagacagtgtttataagtcgctaaaatacctggaaacagagtcagcattagaacagaagtctttttgtctagttcttcgttattctttccataatactacatggtcaccaaatcccctttctatttgagtcttttatttttctagtttgtagagggaacctatatgtaggggcaagaattggaatatatattttaatatgtcaaaacaaattacacaccatttaattttaataaatattttattttaggctgagtgcagtggctcacgcctgtaatcccaacactttgggaggcaaaagtgggaggtcgctcgaggccaggaatttgagaccagcttgggcaacatagtgagaccctgtctctgtaaaaaa

SEQ ID NO: 77074 - DNA, 1038 bp, Homo sapiens
atgttttcttctgggagttttgcgatatattttttatttaaatttatgtggaatttgggggcataacattggagagattgaatttttttttctaagtagataatatggttaagcattctgctataggtatttcttttttttgaaacagtcttgctctgtcacccaggctggagggcagtggcgtgatcttggctcactgcaacctccgtctcctgggtttaagcgattctcatgtctcagcctcccaagtagctggaattacaggtgcccaccaccacaaccggctaattttttttgtatttttagtagagacagggttttgccatgttggtcagtctggtctcgaactcctgaccttaagcgattcacccgcctcggtctcccaaagtgctaagattacaggcgtgagccaccacacctggctgatgcttcttttatctaaaattttgaccagtattatttttctcctccttctatatataaacagagaaaactaaaataattcctgtgtttttacttgtcttcagctgatcgccatacattgctctctgcctaagaactggaggctttgcaggacttggggaggccaaggagggcagatcacctgaggtcaggagttcaagaccagcctggccaaaatggtgaaaccccacctctactaaaaatacaaaaattagctggatgtggtggcatgcacctgtaatcccagctactcaggaggctgaggctggagaatcacttgaatccaggaggcggaggtttcagtgagcagagatcacgccactgcactcctgccttggcgacagagcaagactctgtctcaaaaaaaaaaaaacaaaaaaactggaggctttgagtcaggacgtaatttacttctgtagggaacatctcctgaatcttgattaggtcgtatgcagatttttttcttagaaattactgaatgtgtaagcacagtcacaaccttagactatcttatttgtgtttgtgttctgtgtttttattaccttatctctttttctgtcaaaattgttttctgca

SEQ ID NO: 77075 - DNA, 2615 bp, Homo sapiens
agactgagggatgactgtgtgtctttgtatcttctctcttctttttattctcgtgggagcatgctatatactttctgcacccttttcatctaattggatattatgaggctatttttgacagagaaaaacctttttctgagttgagatctgacaggttgaagggccccctgagagatggaagagtaagaactgcagtgaaaaaaaaaaccaaaccgagatcttcaaccttttcttagttgccttagcagaaactgatgtttgtgtgttaaagcaaagcttgtttggggatttttaagacaaaactgaagcctacagtccatgctatgtggggaaaaagttaataagtaggatcttccctggactctggatatgagtagtagtgagagaatgcaccatttccacagacatgaccccatcagctgccatttcccacagataaacagaacatgatactaaaactacatggaattctctcacgtaaagaaaccaaaacgttttagagacggatgtgtcatgttttagatacaaataaagacctgttgccatatatctgagtatttacatcagtcatgggactgaagatattaaattaaaaggctagaattttgcatctacttttaaggtgtctttacaaaaaacaaatgatcgtgtacacctttttcctcttcttaaaattgatcactgtgctgttgtgcacaatttccttaataagatacagctattagtgtttgtggcattttgtgatttgtgtaactaaccctttcccctccagcttcttacctttctgttcctgtgatgttgcagggttgcctgattctgagtgatgaactgaatcatgcatcactggttctgggagccagactgtcaggagcaaccattagaatcttcaaacacaacagtgagtttgctgaagaattcactgctggccttggttttgctattctttcgatccatggtgggagttaacattagttatattagcacttgaaagtataaatgaagacaaagtagcaacatttaaaatgttcttccggtccagtcttttaaaattagaggttgatggaagcctcttgtacaaatataatactatccttttatttgaccatgaagttttccatcccatttccttgtttacagatccgttactcaaatacatttactcgatgactatagtgtatcttgccataagactaacagtatttaagtgaataaatcaagatctctgactggttaacgaagagacttaatagataagccagtccttacaatatagtggacaggtgctgaagtacagctatgaatagatgctgtgggagcacagaggagggtggccctgagccagacctttcctccctcagtggaaatatctttgtgtattattaaaatgattatttagaataaaaatgcgtaactttcatagttaaaacacacacataggcagaaaaggtgaccaaactgtatgttaatagcatcttttcccaaaatgtgtacaggcacagacaaaagtttggaagaatgtataccaaaatgttaggtgtgtacccgtggatggaaggatcatagatgataacatcatttttgtttttgtttttgtttttgtcttgtctaaaatgttttacagtgagaaatgagatcttattaaatatcactatgtaacctgttattttcttttttttttttttgaggctagagtctcgctctgtcacccaggctggagtgcagtggctcaatcttggctcactgcaacctctgcctcccgagttcaagcgattctcctgcctcagcctcccgagtagctgggattacaggagcgcgccaccacacctgactaatttttagtatttttagtagggacggagtttcactgtgttggccagactggtcttgaactcccgacttcagttgatcctcccgccttggcctcccaaagtgctgggattacaggtgtgagccatcatgcctggcctctttttacaatacacggtgattgttgtttgtcattacatgtaactctatctcattcttaaataccagtgtggcagttagtgcctgggtgtgccctcatttaattgccccctcaattggacatcggggctgtttctaaatttttctactgggaacagcactacagttacagttttgtaccatcatctggttagtgccttaggataaatttctagcagtctcagaatgcatggttaaaagagtatacatttttaatacttttccaaattgcctctaagcattatatgaactttttttttttcacttttattttaggttcaggggtacatgtacaggtttgttatataggtaaattgcatgtctcgggggtttgtgtacagattatttcgccacccaggtaatcagcatagtacctgataggtaggtagtttttcgaaccttaccctcctcaacctcccctgcctcactctcaagtagaccccagtgtctgttgttcccttagtcgtgtctgtatgtactcagtgtttagctcccacttacaagtgagaatatgtggtatttggttttctgttcctgtattagtttgcttagggtaatggcttctagctgcatccatgttgctgcaaaggacatgatctcattctttctta

SEQ ID NO: 77076 - DNA, 1006 bp, Homo sapiens
attatatatataatatatatatccccaagtgggtagtgtgtgtgagagggcacaatctgtatgtaaatgtaaattatatttcagcagattggtactctcatcctgaaaggccccttgaggttatttattctcatgtttaacatgacacttaggaatggtatattgaaaacgtggtggattaactcaagcaggagaattgagtttttgttttttggttgtttatatggtcacacttagctgtgtgactgtgagcatgtcaaataatctttctgatcctccaagtttcttttgtaaaatgaggtggttgagctagattaactctaaagtcctttttagttatgcagtgtatgggtctgtaaggtacagatgggacaaatagaaaacaaacagcaagataggagatttaaacccacctgtgttgataaacattaaatataaatggtttgtacattccaatgagaagacaaagattgtcggataaaattaagtaggtttcctaatgtaaaatagcaacctattttaaatatgaagacacagaggttaaaaggaaaaggatagaaaaaaaatacagcatgcaaataataatcagaagaaatgtgaagtgcctgtattaatataaacaaagatttcagagcaagaaatatttctggtgataaagaacattgtgtaatgattaaggaattaattcatcaagaggttataattttaaatgtgtaggtgcttatcccatttatgcctaatgttccattattggaacgctaagcatgtgggagttatttatatcctactgctcaaggtcatcgccagggtctgattttgcaattcaaaaaattgtaacctctggcataaatgggttattaacagagcgtcaaagtacgtgaagcagaaattgatgaaactaaaagaagtagacaaatagaaaattgtaattagagacattaacccctctctcttttttttttttttttttgagacagagtctcgctctcttgcccaggctggagtg

SEQ ID NO: 77077 - DNA, 1071 bp, Homo sapiens
gctaagggctggctgggcatctctgtttctctttctctctgtctccccctctccttacgtctttctctcctccttccatagtctcttatccctcagttcccatccccccgcccatgttctgtttttgcaacaggccagttagattgttttacatagcagctgacttcaaaagtgtaaaagcagattttgctaggcctcctaaggcctagacctggaactagtatgcacaaacaggaatgggagaaatttttcgcagccccctttggggaaattccactgcaggtgctgaatcagattttattcaactattgtgttctttatgagcacatattactcttcacaatattatgaagaatattactcttcataatattgactccttcatagatcttagtctgaaaaggacacaacacatatactatgatttcttttaataaagtgatgagtaattcttaaattcaggattttgtgatactgactttattaacttcttcacacaggaaacctggacaagcatgaagaactagaggagcttgtagcaaggttcttaggagtagaagctgctatggcgtatggcatgggatttgcaacgaattcaatgaacattcctgctcttgttggcaaagtaagatactctgtcatttatgaaaactccctcatgtatatcttcttttgttttgaaaagcagtcagagtgagctaaaagctgttataaactttaggctaaacatagtttagccaaagatatttctaccacaaattgtttttcttttttttttttttttttgagatggagtcttgttctttcgcccaggctggagtgcagtggcaccatctcagctcactgcagcctctgtctcttggattcaagcgattctcctgcctcagcctcccaagtagctgggactacagctgtgtgccaccacgcctggctaattttttgtatttttagcagaggcggggtttcaccatgttggccagcctgggcaacatagtgaggcctcgtctcaatttgattttattttttaaattaaaaacaatttgtggccaggcgcagtggctcacacctgta

SEQ ID NO: 77078 - DNA, 1070 bp, Homo sapiens
aaggctgaaagaggtaaggaagctgcagaagaaaagcttaagcctagcagaagttcattcatgaagcttaaggaaagaagccatccccacaacataaaagtgcaaggtgaagcagtgaatgctgataacttcagcaagttatccagaagatctagctaaaataattgatgaaggtggctacaataaatcacagattttcaatgtagatgaaacagctttaaattgaaagaagacaccatctaaaactttcacagctagagacaagtcaatgcctggtttcaaagcttcaaaagacaggttgaccctacttttaggtgctaattttaagttgaaaccaatgaatgacctcattttaatttgattacctctggaaagttccagtttccaaagaaggtcacattcttctgggaatgaggacgtcaaaatatcttttttggtgggacacaatggaacccgtagcatcatccttctgtatattttccattttcattaattgtgttcagaattacagatgtccactaattaataaaaaattgagcttttagcttttatttcttggttatccagttgttttgtgatgattttcaagaggaagatgggagtagaacatttttatttccccctgcctttaaaacagagtttctaactggcactccagaaatgacaagccttgtgatctaatcctgtggttaaaggagcattgtgcagtggcgacatatagtaaggatacattatgcctttatggcatttgatattttataaagtgctcggctggatgcggtggctcacgcctgtaatcccaacactttgggaggccaaggtgggtggatctcttgaggtcaggagtttgagaccagcctggccagcatggtgaaacctgtctctactaaaaatacaaaatagtcaggcgtggtggtccgcacctgtaatcccggctacttgggaggctgaagcaggagaattgcttgaacccaggaggtggaggttgcagtgagctgagattgcgccactgcactccagcctgggcgacagtgcgagactctctctctcaaaaaaagaaaaaaagctca

SEQ ID NO: 77079 - DNA, 2152 bp, Homo sapiens
agagacagggtttcactgtgttagtcaggatggtctcaatctcctgaccttgtgatccacccaccgcggcctcccaaagtgctgggattacaggcgtgagccaccgtgcccggcctacagcttgccttcttagcttggtcaaatatcagtgacaccccttctcatgtgtatattcacagcaagtttattatttgtagtgactacattgtattttacagtatacatgtgccatggtgtgacatgttgggctgtgttaataatctcaaaatctcagggaattaaaacagtaacagtttatccttatcgatacttcatgttcatcctaggttggtggggcccttgaaccattttgtccttagttaggggcccaggctgcctcagcttccattgtatgaaatgtcactggtctctgtatctgaagaacagatgtggcaaattgtgcagtggctctcaaaggatcctcatgtgtatatattctcatgtgcgggagttactgagtatgtatatcttttaatggataagtactgccaaactgccctccaaaaaacaaacctgatattcttatgtacagtgtcctgtaagataaggtgattgtcctggccaacactggatatcattagttttaaaatctttatcactattaataaatgaaaattgattattttaacttctatttccataattggtagtgtgtttgagatttttttaatatagactttgttctctctgcttccttttgtgtcaccagttcatttaatattacatgtaagtacttttttgctcatgagtttcattgttttatgctattgatgcacaggtatacagggaatataataaagggtgttataaacatgggttcctacaactatcttggatttgcacggaatactggatcatgtcaagaagcagccgccaaagtccttgaggagtatggagctggagtgtgcagtactcggcaggaaattggtaagtgaaagctgtatttggccagctgctgtttttgacattgttttagtcaggggcaaataatagtaatattgacctagagtattaaatatctacactttgtcatgtcatttagataaggtgaagaatgctttgtttttctgaagtgtgatggatgatttcaatgctttcaacacattttgagatgtgtttatctttcccaatgtgttatacatatagaatgtccctcgaaaaatcctgccagtgtttgtttcatttataactttaatgttgatttcattggcttttgcaaatgttagtggttaagagtgccacttattaggatgttgggcatatgagagttaatctgctttcatactggtacatgggggctaataataattcctgccttatagagctcttttaagaattacgtaagctaatccatgtagagtacttggaacatagtagacaataaatataaactctttttattattgttttaagtttgtaaaatataaaagagtaataactttatataaagagattcaatttattttaattcagcggaagatttcagattgttccaatttgattcagagaactgacaaccctggaagttatgaaaactttccaaatacttattactgtaagcacagtagattaaaagaacagttcattgttagttatttctcagggttctagggattggcaagcacagttgggtgcttcttacccaaggttcctctcacggttgcactcagtggtggctgtatggctggagacatgaagccttcttcattcgcatgtttcacctaggctgcggtggctggagctctgtgtggcctctccatgtttctagcttgggtttcttcataccatggtggtcttggagagttgttcatcatgcatggctgcaggcctctagagcaagcatgcaaagatacctgactgaagccaggcacggaggctcatgcctataatcccagcactttgtgaggccaagataggaagatcagctgaggccaggagttcgagaccagtctgagcaacatggtgagacctgttctctaaaaaaataaagataaagtagccgaacgtggtggcgcatgcttgtgatcctagccattcaggaggctgaggccagagcatccctcgagccaaggagtttgaggctgcagtgagctatgatcgtgctactgcaccc

SEQ ID NO: 77080 - DNA, 1028 bp, Homo sapiens
tgttgagacagagtctcgctatgttgcccaggcttgtcccgaactcctgagctcaagcagtcctcctgcattggctttctaaagtcctgggattacagacgtgagccaccaagcctgtcctgatttagcagttaattaaatataagtggcctctcattctcaggtgctcttacagtatgaaaatggaagttgtaaagtttgtttttaaagtaactcagtggaatgatagacagtggagacttggaagggtgagggagtgagggtggatgatgagaaattacttaatgggtaccatgtgtgttatttgaatgactgataccgtaaaatccctgacttgtccattacacaatcttgcacgtaatgaaattgcccttataccccataaatttacataaataaaagatcatgtcatctgttaaaaaattttttaataaagtaactcagttaaatttatggtatgtcaccatttcttggcaggactttgtgtcattgtatcaagattttgaaaacttttatacaaggaatctgtacatgaggataagagacaactggaatcggccaatctgtagtgtgcctggagccagggtggacatcatggagagacagtctcatgattataactggtccttcaagtgagtcttggttgggaaattatttgacaacaattacaaaagggtttcttcatttgagaaaatatgttattataaattgagtattctctcaaaataggagtagcagctgaggatacaatatgattggtttccttacatattcttcattgttgagctttttaagatatatctttctattacatttgatactgtgttggattatagttcagaagaaaatttggcttatttattttttgagatggagtttcgctctgtcacccaggctggagtgcagtggcgtgatctcagctcactgcaacctccgcctcccaggttcaagcaattctcatgcctcagcctcccgagtagctgggactacaggcatgcaccgccacacccagctaatttttgtatttg

SEQ ID NO: 77081 - DNA, 1106 bp, Homo sapiens
cagttatgaccgatggtagctgaagttttatttaaatattcaaactaaaaactctttatctgcagggacctctcctagtgtagatgcatagtcgaaacttgataattgacgtgtattgctggtggtgagggaagtgctgattgtggtgcagacagcacattcctggatgaggggatagtataggcaaaggcatgaagaatgtttgggagaatctggaatgtagacagaagagaaattgtgttttgaaaatcaaagtaagaagtttggtaggcaatgaggagtattgtttttgtttttgtttttaaatagagacagcgtctcgccatgttgcccaggctggtctcaaactcctgtgctcaagcgatcctcctgccttggcctcccaaagtgttgggattataggagtgagccaccatgaccccaagggcagtttttgatcaggggatttttcatacagcttgtgcagctggtgctcaaagtgtgatgaatgaatgaaaccaacaagatgtatctgaattactttgtgagtacattatctttggaacttgtttcatgtttacagaaagtaaattggtggtttaagtgttgggagctgcctgtgtatcctttgtgtgaaagaattagaacacacagattttattcttaagtagtttctaattttgttgaggaaacaaacatttgaaagttatgggcctttgcaaaaccattatacaagtaaataatacttagattatatgaagatatagaacaaaaaaagtatctgagtagcatagggttaatcaggaaacaattcttggaggaagtaatacaaggaaatgggaggctgaggagagcatttgcctctgcagtttatggagaggattttattaaattattcaaattcatttcaatagaatattcccagtagataacattagcatttaaaacagccaacttctgccattttcttacaaaaattcagcttttagagggaaaggaaaagtcattcctttcctgtgatagatcatgtttgttttctaatgttggattagagatggggaaagagggaggcaaattaagtgttaaactggaaggaggtgagggaaagtggttgcttgggatcataa

SEQ ID NO: 77082 - DNA, 1237 bp, Homo sapiens
aagtgctgggattataggcgtgagccaccgtgcctggcctaaaattcttttttttttttttcttgtttccagtgaggttggaacttagaaaattcctttttttttttgacacggagtcttgctctgtcacccaggcaggagtgcagtggcgtgatcttggcttactgcagcctccacttcccagattcaagcaactctcctccctcagcctcccaagtagctgggattagaggtgtgcaccaccaatcctggctaatatttgcatttttagtagagacaggtttcaccatgttgaccaggctggtcttgaactcctgacctcaagtgatctgcccgcctcagcctcccaaagtgctgggattacaggtgtgagccagtgcgcccggcggaacttagaaaattcttaaggtataattcagcaaatctctaaggacctagattttaggtaggaatgtttttcttgccatgatggaaataaacatttttaacctctcttttagatccatcatgttacacaaaatggaggactatataaaagaccgtttaatgaagcttttgaagaaacaccaatgctggttgctgtgctcacgtatgtggggtatggcgtactcaccctctttggatatcttcgagatttcttgaggtattggagaattgaaaagtgtcaccatgcaacagaaagagaagaacaaaaggtaactgttagagagtttttgattctgtaaatagaagccttttatggaaatcttagtatttttgcacaaaagctttttctcagaaatttgggtacacattaaaattaaactattccagatgcagttaaatgaaaacattctacaaagaaagctgaaaaataacaaggttaaagatatcaaagcattcatcatgggtttaatcaagaagaacctaaggaggtgggcggcactatccctgttttatggattagaaatcaaaaagtcacaagttaaacaacgtttcccaagatgccaggtgtcagagctgctgtgtggacagaggactgtgaagtgaaaaagccttgctctttctgttcataccagcatgctgaatcccaggttgtgtttaccattttctgaaaaggttgtattctttggaattaataatgtgttttctcatagatacattatacatagttgggtgattcacacatcagctcctctccccagacaaacaagctgtaatacagaatgtggccaaccgattctatttacggtaaaca

SEQ ID NO: 77083 - DNA, 1072 bp, Homo sapiens
cagaaaaattcatgtcagttactaacaatttttccccttgttttgggtttcactttctttttacttttatataatgctgggccacactttttttttttttttctgtatcacctaggctgtagggaagtggcatgatcatggctcactgccatctcgaccttctgggctcaggtgatcctcccacctatctcctgaggacctgggactacaggcatgtgccaccatgtccagctagtgtttttgttttttgtttttgtagaggcaagattttgccatgtgcccaggctggtctcaaactcctgggctcaagttatctgcccaccttggcctcccaaagtgctaggattacaggcatgcgccactgcacccagcctggaccacacttatataaacatcttagttttttgcatgatttacttgtgttatcactaccaacaaaggttaatttgaactacgtgtttctgcaggggcctactgctgataattatttggaatactatggctgggtggctttaagaatgtgtggtagtaaaacatttacaaatattttacattctaataaagctgaatttacttttgaacttttgatctcttcatctgtaggccaatatagtacttttttgggacaggctttctctttgttgatttatattttttgctttttttattagaacaaaagaaattatgctagcattttagaatctatttaagaaaatcaaataatgataaaaatcagtgttaggtggtgttcttatgcagtccttcttgctccccttcttttactgttcatctgaagggcatataatttataagttatttctattgaaaacaagtagccctgcttatctcttagtgttagatttgactgttgcttacaaaattctttttttttttttttttgagatggggtttcgctcttatttcccaggctggagtgcaatggcttgatctcggctccccacaacttccatctccaaggttcaagcaattctcctgcctcagcctcctgaatagctgagattataggcatgcgccaccacacccacctagttttgtatttttagtagagatg

SEQ ID NO: 77084 - DNA, 1322 bp, Homo sapiens
ctctatagcaaaagaaaaccctggattatatgttgccttctgtctcttaagtttcaggaaaattttttaaaaataattaaaataaaacagtttttattgcactgtaaactgactcagaagaaatgatcctgaataaaggtttcaagaatcccatgaaaggacagggagtaactatgttataatccaataacagtgaagtaattattaggaaacagaagcacacatttctgatatgaatacaaaatcacaaaagcataatttccttaagcaaataagcacattccagctgcatgctacagcaggataacagaacctgcccagctggtgaatggtttggaactttatttttaaaaacttaatgtctaatgtgaaccacccattattcttcagcaatcaaagaactgttatcatgctttgtccattaaacgaaccctattcattttcaagtgctatgtttctgttgctccttaaaatcagttctgctgaaactgtccttgcaattttactgaaatgtactggcctctccctactgcatatcacacatactagagagaacagtttggagctttacacaaatcacataggctatactgtgctctgaatgtgtatgtccagaagtgtctccttttttcagcagggaaattctgaaaagtagaagtccatagtttttcgtgtaggcagcataaattccttagtttttgtcagtaagtatctcatgtggaatggaatgaaaaatgtttccaaaactagctgtgaaacacatttatattttgacattaccattttgctattgaaaacccccaaaaggagatcttcaagcatatatggagtggaacatttccatttcagttcagtggcatcctgtacacactgggcactgatgtctgcccaggagttatcacactggccacccaagcctccgctgtaacacttttccatctctagataagcatcacggtgtaagagatgcaagagcctgaagactggagtacaagtgcagctctgccacaaattctgcatcttcatctgagttctcctccactgctgacacgttctgagcctgtaataccattccctccactctgcccccaccacgtgctccagtctggttttgtggtgcacaccactggagaggcaatccggtttgtgtcaacttcccttctctgggaatactccctgatatgcagggatgcgcccctggtggtcacgtgtatgctttgttgtgactatatttcctggaccataactgattgatgcagcacagacacctctgccgaaagaaatccaacaaccctcttttatggggatttaaaatgtcaatg

SEQ ID NO: 77085 - DNA, 2985 bp, Homo sapiens
aaaaaggaagtcaagagaaaggtgttcacacttcagcgttgctttgtgttcaaatgcttctttcaatccctatgagttatgttcagatttagtaggaaatcaaggacctttctcccataatctctaacaatttagcatttatagaatgatatttcttcagagcttgccaactaataaggtgaagaaatatcaaggtactaacatgacattttaaaatctgtatgaataacatttggttgacttttggggacatgttttgtaaaagtttcactcaaggcacattggtggcatttggaagaacggtctgttggaatgctgtgagggctgcagtatcccttctagaaaactacttctcaccagtatttttaatacagacttcagatctggagctttctacactctcagatggaggaatattgtctgtgaatatttttctttcttatacaaaagagagatcttggtaactacatgagagcaatacaatatcttaacattttttaaaagttgttttcatttttaattaaagcgatgtgcttgtgctccaacctctacctatctttcccctctttctgggggggaaatgttgccaactgtgccatcaaaaatacgcatacagctgtgtgtcatgcttttactaaaatatgaatttagagtataacattgttgagatgtaaattcttttcctcacatctcccaccatgtcttttaatgaacaggagagaagtcagaaacgtctaggatcactttacactctcaagagtatgtttctgtgcttgaagagatgaatgaatgtgtatagtaaaagaacaactcttggatttgggtttagaatttgatgagctagatgctgtgttaaggagttatgaaacaatcacacattgctgtttagtgatgacagtagacacacagttttcacaatagtaacagttgaacaatagagcagtaatttttcctctctgctattcagatgagtgggaggagcacaaacctttatttgaggtaaggtgtggcaatttgcccgagggaaacttttacattagcattggaaagaacctttgggagtttatttaattcagtcctttatctctttgtaggagtttattaaaatcagtcttgatagaaaattctgtactgtttttaaagatctccaggggatttgcagcaagtttttctctatagcaaattggattattattccatgatcttaattaccaaatttcttcctgtggatttaacatttgatgaaataaatgccatgttttggttgcacctgaaatatagtagtttgtttgtgtgtttgtttttaaaacttcacgttaacagctctttttaaaagagcttccatttctttatagaagttttgagatttaggttttccttttactttcctgagttagttaataagtgtgaaagaaaaaaagttatctacctttgagacagttttgaccctaacttttttccctttgggtgtagttttaatgagatattagaaggatgagagctctctggcttacagaataaaaaattctatctcaaggaattggggcaaaagttgtgttcttatgttaaataataagcaaagtagaaagaacaaagtgttagtcttgcttcttaggaggaggcaaataaataactaataaagctggtttactaaatagctactagcttttgtttccactgagggagaaacagtaactgggggtttatatgtgatagttaaggaaaaggagacgatagttatgaggctagaacagtagaaatagttagaatagtcatatatctatttagatttagcagatcctgataagatacctcagatacctgaaggcttttcagaaataatgtaatttacaacttggaggacaagattttcatttcagttttcactctaaggggaagcatatcttgattcttacatagctgcatctgaagaattccagagttatttgagatactcaggaattttctttaacaggaattcttgggaaatgtgtaagcagctatgttcttaagatagtattttagaactaggatgttcagaaaagtcagacttgcccactttttagggtttgcccatgtgccatagaaatttgcaccgctttgagcaagacagttaattggttgatttaattagattcagtttttggaagaaagaagcagtgtttattggtagaataggcaattcagagggatgggtagaggcactgtttgcattctgagtgggtgtgccatacttgattaaataaatggtttgtggactcaaagtcagttcccttctgggtagtttctgagaagcttctgtaatataattcacaatttgtgaccgataaaaaagtaagtcctttgctcttgacccatttactgttagaaaatttatcttaagtttgtctttaagactactttttattgcaaagcttgaggcagctattcttccttttttaaaaaaataatttttacttctcattatagaaataatacatgtttaatgtgggatcataaaacattgagataatctctgcgttaggtttttttttttttgagacggagtctcactctgtcgcccaggctggagtgcagtggcgccatctcagttcactgcagcctccacctcccgggttcaagcgattctccagcctcagcctcctgagtagctgggattacaggcatgcgccaccacgcctggctgatttttgcatttgtagtagagacaaggtttcacagtgttggccaggctggtctcgaactcctgacctcaggtgatccacctgcctccgcctcccaaagtgctgggattacaggcgtgagccaccacgcctagccggaggtttgttttttaatgtggtctattgtaaatccatctgctactttccgttaatttcttttctttctttttttttttttttttggcgagatagggtctcgctccagcctggcctgcagtagcacagtcatagcttactgcggcctcaacttctcgggctcaag

SEQ ID NO: 77086 - DNA, 1056 bp, Homo sapiens
cgcctcctcctcggtctggaccattaaacaggcaagccctaccccggacctggatgcggcctccaatcaggtgccaggccctggagtccctctagagaagccccctctccaccggcgaggcgctttgctctcgtccgtgattggccaggcagcagcatggggtccgcctccttctcttccagattggtcagcggtcctcaggaccacatccctctcggcaggtccccgccgctttttcccttcgctgcgtggccttggccgagaccggtcctctgcggagagggccccgccctctgtgaaggcccgcccgggaattggcggcggcgctgcagccatttccggtttcggggaggtgggtggggtgcggagcgggacttggagcagccgccgccgctgccaccgcctacagagcctgccttgcgcctggtgctgccaggaagatgcggccggagcccggaggctgctgctgccgccgcacggtgcgggcgaatggctgcgtggcgaacggggaagtacggaacgggtacgtgaggagcagcgctgcagccgcagccgcagccgccgccggccaggtacgaggggcccgcgcggcggggccggggtggcggtgtggactggcggaggggcggccgggcggggcgaggtctccgggccatccgctgggcaatccgcggggcgggcgccgttcgcaggtgtgggcggcagtgtccggccgctggcccgacctccacgagcctggaggctcaaggacggctcgggggctccccacctctccgcgcctggaggtcttactcccggagctctgggttctgctcagagctccgggtacttttctctgccccattctgccagaagtgtgtgctgtccccaggggaagcgatgaggggcccttcggactccagtgggagccgcccaagggctccggagggtcccttctcaaacccctgaggttattgcttccttttaaagtcctgcagtcgtccaaagaaaaccacccatggggtccttaagaagcaaagaaaattaggcggtggtgtcagatggaaacacacccag

SEQ ID NO: 77087 - DNA, 1055 bp, Homo sapiens
ggatattttggttagtaaaaacaagttgcaaaataataaatacagtgtaaaaacatgtaaaactattatatatgtatatatatatatatataaactaatatgtaaaaactaaacaagtctttctttttttttgagatggagtttcacgcatatcacccaggttggagtgcaatggcgcagtctcggctcactgcaacctctgtctcccaggttcaagcgattctcctgcctcagcctcccaagtagctgggattacaggcgccggccaccatacccagctaatttttgtatttttagtagagacagagtttcaccatgttggccagattggtctccatctcctgacctcaagtgatccacctgcttcggcctcccaaagtgctgggattacgggcgtgagccaccgtgcctggcctaaacaagtcttatctatatatgcacatatgtttgtaaatgcatggggggaaaggatatgtccaaggataagggtggggaggagagagattagaagattgtagaaggtactttctactatgtgatttttggccttagattttttaaaaattttttaaaatttacatttatttatttatttatttatttatgagacagggtctcactcttttgcacaggctggaatgcagtggtatgatctcggctcactgcaacctctgcctcctgggttcaactgattctcttgcctcagcctcctgagtagctgggattacaggcacacaccaccatgcccaactaatttttgtgtttttagtagagacggggtttcacttcatcgcccaggctggtctcgaactcctgggctcaagcgatcctcctgtctcagcttcccaaagtgctatgattaaaagcatgagccaccatgcccagcctggtgtttatttttttataagaattattcacatgttacttatatattttatttatttatttatttatttatttatttatttatttatgaaggagttttgctcttgtcgcccgggctgcagtgcaacggcgcgatctccactcactgcactctccgcctcctggtttca

SEQ ID NO: 77088 - DNA, 1483 bp, Homo sapiens
gaggtcaggagtttgagaccagcctggccaacatggtaaaaccccatctctactaaaaatacaaaaattagccaggcatggtggcaggcgcctgcaatcccagttactcaggaggctggcgcaatagaatcgcttgaacctgggaggcagaggttgcagtgaactgagatcgtgccattgcactccagcctgggtgacaacagcaagacttcatctcaaaaaaaaaaaaatacataatatttagctgggcgtggtggcgggcgcctgtagtccctgctacttgggaggctgaggcaggggaatcatttgaacctgagaggcggaggttgcagtgagccaagtcgtgccattgcattccagcctgggcaacaagagcaaaactccgtctcaaaaaaaaaaaaaaaacaaaaagtaaagtcacagacgttaggccctgagaaattggttttctaataatctgttagtagggatgtaaattgctatagcccctaaggcacaatttggcatcatgtaatgtgtgactttttatcctactttgaccagggtagtcctggatctccttttccaccgagaagtggtctttcattcaatgataatttatgtggtcatcctaataatgttttcaaatgtataccctttgtcccagtaaatttcacttctaggaattgagtctgtggaaagtaatcagagctgtgcagaaagatttttgtgtgagaatattcatagtagagaaaatatgaaatatactcaaaatccagcaacagggagttaaattcatgtacttttcagcacgtgactactgagcactgttctttggctgcacaagtactttcctttgtggagcttgtatactggatatgccataaccctatgtagcctttaaaggccatgttttacaagaatagttagagataaggggaaatgtttatactatatttaggtgagaaatccaattatgaaactgtccatagtaacctaattttgtatagaatgttgacatttttattttatgtttttttgttcagacctctcagagatgaaatgtttacatatttttttaaactggaatgatgtgaataccaaaacatgaatgatggtggaattacagttgatacttatttgtgcttttctgtatttctgatttttaatttttttttctctttctgcgcacccccctctccccctgccccatctactgggcaccagagttatttgatttttttgtttgttttgtttttttgagacagggtctggctctgttgcccaggctggagtgcagtggtgcaatcatagctcactgcagcctcaatctcctgggctcaaacaaccttcccacctcagcctcccaagtacctgggactacaggcaccaccatgcctggctaacttttctaatatttttgtaatgacaggatttcaccatgtttcccaggctggtcttgaactcctgagctcaagtgatccacctgcctgagcctcccaaa

SEQ ID NO: 77089 - DNA, 2143 bp, Homo sapiens
ggcccccacggccatgtttatgcacagtggtgacatcatgataatgtcgggtttcagccgcctcttgaaccacgcagtccctcgtgtccttccaaatccagaaggggaaggcctgcctcactgcctagaggcacctctccctgctgtcctcccgagagattcaatggtagagccttgttctatggaggactggcaggtgtgtgccagctacttgaagaccgctcgtgttaacatgactgtccgacaggtcctggccacagaccagaatttccctctagaacccatcgaggatgaaaaaagagacatcagtacagaaggtttctgccatctggatgaccagaatagcgaagtaaaacgggccaggataaaccctgacagctgagacttggagatcccatcctttttactcaggcacctgcttaccgtaaatgatcatgttattgtgtattgccgtggacttcagcacccagacaagccaaaaacagagacagggaagaactcattgttgatcacactgttgccttggaacccacgcagaagtaaactcagccactttgctcagagaagtgtttgacatggtctgttcctagttacatgttggctgtaatgtatgttgagaagtcagtccaaggaggtatgttcttccacaacagccttctcagcctctgctatttcctttgaggaaggtagaagtgagtttccatgtttgcagagtatttaaatacctcagattttattaatgagaaatacagtacccctccctccactccatctggtaatttatggtaaaattgtggttctgtgaaccagctattagtctcatcttcttaactccctcaggcatcatcaaattctttgatcttctcttccacctctctggctctcatggaagaatcctttacacatgaaaacaatggaactggaaaatcttgtcttttagaaaagaaattaatcacaactatctctcttgcctaaaagataaatataggtaaacccaaggaaaggggaatttagtttctctacatgtcatttcggtctccaaactccctgttggctttttaatgcaattttaattgttggaataaaaaagtcccaagggtgttttgttactgttttctccatgaataaactcacttgattttaaattaaagatctatatctgtctttggggtttagtctatctgggattaaggtttttttttctgtttttctttgctgtattgttcatgctattgaagccctctagctgtttctgccctacaccattctgctgtgccctaagtattctttgtggctgtctcacagaagagagaacatttcttaatattccagtcactgctgttattgtctgagggtaggcagcttggaaaaatgtaggcaacaccaagttttaatctttatacccccaacaatttgactgactatatcatggtccaggttactttacatttctctggacctcggtttcctcatcataaaatgaagatactgtagactaccatcttcctaaagggatattggtatttgaaagagaattaagtgctcctttctacaaacatgatgtgccaaaattgttttattataagggctctttgaaacatcctaacttccttgtgtggaggactggctggaagcccatttggtacctactgtttgcaatgcatgttattaagtttacatgtctcctctgtcctgctctgccccttttttaaattactggcattgaatattgagttcatatggtaatagcagggtttttaaatgaataaaaattatggatttatctcttatgtgtaagctaggttctttgttttttgttttttgttttttttgagtcagagtttcacacttgttgcccaggctggagtgcaatggcacaagctcagctcactgcaacctccacctcccgggttcaagcgattctcctgcctcagcctcctgagtagctggcattacaggcatgcgccaccatgcctggctaattttgtatttttagtagagatggggtttctccatgttggtcaggctggtcttgaactcctgatctcaggtgatcggcccgccttggcctcccaaagtgctgggattacaggcatgagccactgcacccagcttaggtcctaaaattaatacataggaaatc

SEQ ID NO: 77090 - DNA, 1746 bp, Homo sapiens
taaaggcctatcttggccatgctataaatgagagttagttccgatgttttgagcatgtcatcccatcagattgaccagtcaaattgccactaagccatgttgcaagctgagaggtccaaaaccaaactggctatagtatttgagttgcctttttataaattaactttttagtttaggatagttttagatttgcagaaaagttgagaagatagtacagagagagctcgtgctctccccctattattaacattttaccttagtatggtacctttgtctcaaatagttaaccaatagtaatacattactgtaatagcatttgtacttcatttagatttccttagtttttaactaatatctttgttcttatatctaattttctaatatccaggatcttatccaggatactacattatatttagtccttgtgtttccttgggcacctgttggcaatgacggttttgagttgcatttttaccctaatagaactgtctcatttacagatagagtatactaactagagggtggtggagtaattgcttcatgtatagactcaatgcagtatatagcacagtgcctgttatataacaggtacttgggtttttgaatgattcattattagatcattagataccccaagaatggatggatagaccgggcacagtggctcatgtctgtaatcacaacgctttgggagactgaggcaggaggatcatttgagaccagtctaggcaacatagtgagaccccatctctgccaaaaaaaaaaaaaattagccaggcatggtggcacgcacctgtggtcctacctacttgggagactaaggtaggaggatcactgagcccaggaggtctaggctacagtgagccatgatcacaccactggactttagcctgggcaacagattgaggccctgtctttaaaaaaaaaaaaaaagaaaagaaaagaatggatagataatgctgtgttaatatgttaatatgactttgtaagtaagattattttaaagtggtaattaatcttatagtttcctgtattcctgagatcattgtttatttttcttattctctctacatttaccaaagaaatactcagcagatcattacacacctttcccttctgacctgggtttcctctcagagcaagtagccgctgcctgtggatttgaggatttccgagctgaagcagggatcctgaattactaccgcctggactccacactgggaatccacgtagacagatctgagctagatcactccaaacccttgctgtcattcaggtgagttagttccagggatttgggattactttttatcatttaattcttttttctaagacattttactctaaaataaatacaggtatttaactttaaaaaagtggttggactctataatcttccacttctgggaattttaataaattatagttagtatctctgtttaagacacatggagcctaccttttattttatttttattttttattattgtttttttttgaaacagagtctcgctctgtcacccaggctggaatacagtggcttgatctcagctcacttcaacctccgcctcccagtttcaagtgattctcctgccttagcctcctgagtagctggaactacaggtgcacaccgccacacccagctaattttttttttttttagtagagatggggtttcatcgtgttgcccaggctggtcatgaactcctgagctcaggcaatccgcccacttcggcctcccgaagt

SEQ ID NO: 77091 - DNA, 1124 bp, Homo sapiens
cagactcaggtgatcctcacacctcagcctcacagtaactagttactttctaaaagctccacagtttcagccaacccaacttagatacattaactgctccaaatgatgacagatttgttttaaaaatatttgtgatataattctgactttcagcaatacagactcagtaggaaactagatattttttgaggggaaatgccatgtgattttctttggattagacagcctgagtttgaatccttcctccggtaatgatagtgcctacctcataaggcagttgtgaaaattaagtgatcagtgcctgtaaagtgatctcaatggtgtctggctattctaagcagttaaatgcattatcacaataaatgttagcttttttttttttttttttttttggtgataatatttttactgttgatattgttattccccaagacctcaaagttaacctcattgactaagaaaaatagggagtaaaaatgaccaaaaactgaatgagtagtcagagaaaagtgaaagagaactttaaaagaaaaagtagtgagtaatgcagagacagtttggacagggttgaaagcccaaaagggtgattatttcattatagcagaggctatctacagctagaatgacagccttgactgtttgattatctgagggactaaagcttaaaatgatagaggaaaacttaaagttctttaatcacactttgagttttgagaaattgaataggaactcttctaatttacagttcagtaaaaggagaaaaaatgaaaaacagaaaagttccaactgaagagaccaggccattcatcaagagtcttccttacacctgaagttaaaggtcgcttctggccaaagtaaatacttgctgtccagacctatgactgctgcttcagctagaatatattcagacgctagtagagatatgagacaaaagtagattttctgatcagatttgaggttaatttagcaaagaaagaagtgagagcagaggagcatcaagacaaaagaagagtctgtcaggtacatatagcccaaatagccctcagattcatccatataggaacctgtaagtgaaagtcttaatcataactgcagccatgtcactcatgcagaaagatgttata

SEQ ID NO: 77092 - DNA, 1875 bp, Homo sapiens
agcattaccacctgagcttcgccccctgtcagatcagcagcagcattagattctcataggagcgcgaaccctgttgtgaactgtacatgcaagggatctaggttgcgcactccttattgagaatctaatgcctgttcatctgagatggaacagttttcatccccaaaccaccccccatccccactccatccatggacaaattctcttccatgaaactggtccccagtgccaaaaaggttgggaaccactaatgtagagcactagttctggagtcagactgactgtgttcagatcccagctccaccacttaatagctgtgtaaccttgagcaagttccttcacctttctgtgtctcataacagttctttccttattgaatagtatgaggattaaacaagataatacgtgagaagtcctttaaagtgcctgttaaaaccattttaccaactttgtgtcccgtttggtgttacgtggccttaattttgtagttttcagaaactgtcatgccgattctaacagagtaaagagaagattttcttaaggggaaaggaaaagtaaaattcagtggttttttttaaaccttggtctataggttatggtatcaacaggagcagtgaggaaaatcctgtccatgagcttttagtagtgtcttcttcgcaactgagagcaggggaaaggaagatcgtggttaagtaaaattagtccaagagaacctactgctattaaaccagcctgtgttttcaagtaattttttttccttctgatatatgactctgcagaaatcccagctgtcttttaagatagctcagatgaatctctgtaataaatcatcctgtaaacaatggtgagataccttttttttggtctaataaattagcagaaataaaaaatttgatggtcgtaccttatgttgtcaagggttggaagaaattgatatgctcaagacattgtactggcagcactgaaaatcgattaaggccaagttttcattgtatcactatgtgatacgtgcttcagtttcctcatgtaagaaatgaaggtattggactggataagccattcaaggtaattgaatcatgggcagtcagggtcatgtggacagtacctggcagctctcccaactttgccagagtctctcagaacaggagagagtctgttgagttcaaaacagttcccctggagattttgattaggtatcataacatcctctgacattgagaaccactgaagtaaaggacctctaagatccttttggttttaattttctagaattctatagtcagggaagaaaaaactttaaataggaaatgaagaagaaatacttgaacttaagcaaaaacaaaaattatttaaaaaaaaatacttgaacttaaggactgttcaaaaaattagagtacctcaattctgttcttttttttccaaagtgaatggcgtagctagagattgttgtaaaagtgtacaagagttatgtgcaggccgggcacggtggctcatgcctgtaatcccagcactttgggaggccgagttggacagatcatctgaggtcaggagttcgagaccagcctgaccaacatggtgaaaccccgtctctactaaaaatacaaaattagccgggcatggtggcgcatgcctataatcccagctactcaggaggcagaggccggagaatcacttgaacccgggaggcggaggttgcggtgagccgagatcacgccattgcactccagcctgggcaacaagagtgaaactccgtctcaaaaaaaaaaaagagttatgtgtaaacatcttcattgtgacattgtttgtaacagaaaaaaaaaatgcaaaacagcctaagagttcatcaacaggcgaccaggtaaatctaacgtgaca

SEQ ID NO: 77093 - DNA, 1501 bp, Homo sapiens
ttagctaaaattcattataagatttcgtgtaatcatgcctgtaataaatgaaatagggaggtaaagaagtctcggatgactctaagtgtcaagacctgataaaaattagaggtgtacttttaccacttccaattctaaagtttgctttgggataacagttgttgtggaatatttatttctcttgagaatacccagaaagccagacacatttgcataggggtagatgtctaatgttcatcaaaacctacctgttcattaacttgaagcatgaccaaaaaaatatggggagtaaataacaaaatagtgagtataaagatgtcaaaattatttgaataactgatggagaatttccccctcttctttttttcccacccatcttttgtatagggtttatttttatcccaaaccccttcctcccaggttaccagtggcactgggtgaaacagtgccttaagttatattcccagaaacctaatgtatgtaacctggacaaacacatgtctaaagaagagacccaagatctgtgggaacagagcaaagagttcctgaggtaagtcttgtcaatcagaatgaagtgttaatactcagctcagatcatcacaggtctttgaaggaactgttctataacaatgcagtaaaagtgactggctgggtttttttttcccttcattgtttccaagcaaaaacagcacaattgtattctttccccaggaacatttggacagatgctttgacagttatagtaaattgagatccattttaaagacttgcttatcatagcttagataattgagttcatcctcattaatcatcacatgatccatttccattagcttcagccatttttttctacttaaagtgagttcctttgaaggcttttggtatcctaggaaaggtaacatcgaaagctctttgcttctaccctcctagatggattcagtggtactagccgttttatgataggtcagttgttcctgatgagaataactaatattttcaccttcatgcttcaacattcattcattcattccacaaatacttaatgagggtcagtagtgtgtcaggcatgatgctaggcgttggacacagaaagataaaggcaccctccctgcactcagtagtgcatagtctctggcaagaatgcattacctatgagaataattactgtagagctcagaaagtgttatgatgcggtttagaaaaatactgtgggagcatagaggaggaaataattattccaggcagggtagaagtgtgaacgaagaaaaaatgattttttgtttgtttgttttttgttttttgagacagagtctcactctgtcacccaggctggagtgcagtggcgcgatctcagctcactgcaacctctgcctcctggattaaaacgattctcctgcctcagtctcctgagtagctgggattacaggcatccaccaccacgccccaccaatttttgtatttttagtagagatggggtttcgccatgttggccaggctggtc

SEQ ID NO: 77094 - DNA, 1440 bp, Homo sapiens
agtaaatagctttgtgactcaagatatttcagtacaccaagcacctttcatgattcagccccataagaagttggaaaggtatgatgtcataggaaaaagtagttttgaaagccaaaattagcctgcttaagttttcttattaccattttgccttaattttgggtgactctactgttactatatagatgagaaactgaggctctaagacattaaatgactcatctaaaatgcccagatcaagtaagcagtacagctaagattaaccccagagttaatactccttgctttggccaggcacagtggcatatacctctaatcccattgctttgggaggccaacacaggaggatcacttgagttcaggagcttgaggctgcagtgaactatgatcatgcctctgcactcgcctgagcaatagagcaaggttctgtatcttaaacaagaatcctagctttgcctcatacaagaaatgtgtttggaggtttgaggttcccggggttgacctgcaaaatagatttagtcctttaacttctgtttccttcctgccaggtgatcaaatctcagctaaatgtgtcttctgtcagtgagcagaatgcatatagagcaggtcttcagcccgtcagcaagtggcaagcctatggactcaaaggctatcctggtgagtgtaactgacctcagagaaggcaatatcactcaatcatttatgtcttcatgtcttcaaagaaggtactgtgtgtgagcaagtaaatagacaaaggatacacataataaacagataaatgtttcatttccaaacccattctagactgtaccttgtctaagacgtccgttttgaaaggatagaacaggagtcagcagtgcctgcaaatgtggctgaaagtggcatgaccattgaaaaaataaggacattgcctctgggctccctgccacaactctgaacatctgatttggcagaagtgctgtgaagaataatttatcattatcattgtaataaatgtcataatagttatgaataattcataattgtccctctagtcacattctcaaatggcataacaacttaaaacttgttgctatcaaggctgaacatatttaataaagaattacaattaatgacatcaaaagtcctcgccaggcgtggtggctcatgcctgtaatcccagaactttgagatgccaaggtgggtggatcacctgaggtcaggaggtcaagacgagcctggccaacatggtgaaatcccgtctctactaaaaatacaaaaattagctgggcatggtggtgcgtgcctgtaatcccagctacttgggaggctgagacaggagaatcgcttgaacccaggaggtggaggtttcagtgagccaagatcgcgccattgcactccagcctaggcaataagggggaaactctgtctcaaaaaaaaaaaaaaaaaaaaagctggacg

SEQ ID NO: 77095 - DNA, 1242 bp, Homo sapiens
caaaactgtagtccaatttatattttctttctttacaatccactttaacgttgaggatatgcagtcccttaatttgctcttggtgttgtccacagatgtctagatgaggcattctttccaagcttcctaacagctctgataaaattgggatgctacagtattaagtgttaatgattgcatacttgagctcagcttttcagcaccttcatttgttagggaaaaaaagtggtcttagagttgtcaaaatacagaaagtccacaccccaataataatatactttttctctccagagcgcttcagactctcattcagctccttttacctacattttaccataatatgtacatgctttttagaatgtcagccatcagggaatgagccattatgtgtctagtacaggacctaaaacagtactaagtacagtatgtgttgagtacatgaaagcttgggtgtttagttcctcagctcaaagcagattaaagtagtaattaagagaagttactattacaagccagctgatgagactggtggggaaagtggtggttaacagtctggcaagggaggaaagagaaaaccttttataaaagctcagtggtgtcgttcagtttagcatatgatagaataggtccactaacatcacctctgagagtgtgttgaattatagtgcagtattaagtatggcctattaaagaaatcatgacaaaatgcttaaaagtgttttaccagtgcctaggtacctggaaaactcagctgatagtactgtcagagggtttcatatagcccttttattatagagactggttatacatcagcaaacttttggtattttgtccaggaatctccacacttggagaagttgataagataaaagatcattctctttcaaagagaatgtttcatatatatatatatgtgtgtgtgtatatatgtgtgtgtatatataatatatatacttttttttactgagacagcgtctcactgtgtcacccaggctgaagtgcagtggcgtgatcttggctcactgcaacctccatctcctaggttcaaatgattcttctgcttcagcctcccaagtagctgggactacaggcacgcgccaccatgcctggctaatttttgtatttttagtagagacggggtttcgccatgttggccagtctggacccaaactcctgacctcaggtgatctacctgccttggcttcccaaagtgttggaattacaggtgtgagccaccgctcg

SEQ ID NO: 77096 - DNA, 1051 bp, Homo sapiens
tggtataaaacatatgtttaacattattttgttctccagtatcatattctgtgagaccttgatcttgccagttggtttgacttaaccattagagcccttcaaaatttagtctctgtggattgttggaaggattagtggacttttacttattcatttagccaatattgaggccctgctgtttattggtcactgtaaacatagtggtttatatgctgagggagcttacaattagtggtggggatgaagagacttagaacaaatataggcaattgttgaaccagtgaggttttggtgaactaggagaactaaatagatattataaaaagtaaatcagtgaagtacaagcactgtagttcagaagagaaacagatcgtgtagtttttagtctttaagattatatactctaaatctttgaagtctcacagggctggtacattgtcttgtactgtgataggagcccaataaagtaatactcagtggatgtacttggtttgggtcttgaaggatagttatagtgttacaagttagccagggggagataggattaccaacatatggaggggagagaacaacatatgcaaagagggtaacccgcaggacagataaagataattcaattagttgtactagagagtaactaggggctagcagtgggaaataaggcaggaagggtaggtgagggcaactcaacacattttactaaattgtgaaagaccagtaagttgggattttatttggaaatcttcagtataccgggaaacacactggattgtaatttgtctttttcttcattgtgatctgctcacagggatcatagtccacatagcacagtaactggtatgaaaacactcgatatttgctgaggatggagactgcagccaactcaacaacttctctgtccatctcaccaccaagtctggtacattatggctttatagtcagtaccatagctgcttcctaaatcttaagcctttaaggaaatgcaaagtagttcctgtccacaagaaatctggtgaccctgtctttctacagtctaagatagagaatccaa

SEQ ID NO: 77097 - DNA, 1054 bp, Homo sapiens
gatttagccttgggtaatcaggaagggtgtaaagcaaggttactgacacttataaatgtctgtgatccgatttttggctgggcatggtggcttatgcctgtaatttcactactttgggaggcccagatgggaagattgcttgagcccaggagtttgagaccggcctgggtaagatgggaagaccccatctctgcaaaaaatataaaaaatgaggcagacatggtggtatgtacctgtgatcccagctactgaagaggctgaggtgggaggattgcttgaacccaggaagttgaggctgcagtgagttgcgttcataccactgcaccccagcctgggtgacagagcaagaccctgcctaaaaataaaataaaattaaattaaaaagtccgatttttggcagatgaaaaagttggtagtttgatttggaactcatggaaactttctgaagttcatgattaatcttttcctatattttgaatttttaggacaaggagactggctttcacagaggtttgggttgggttcagttttcttcagaagaaggacttcggaatgcactacaacaggaaaatcatattatagatggagtaaaggtaaatttatttctatgccagatacatacatgatatacatgtaggtactatttaattatgtatcaattaaatagatcataaatgtggaatgatggggacttggagagatttgtaactgaagctgccttaatgcttgttaagaatggtggggtggaggctgggcacggtggctcacgcctgtaatcccagcactttgggaggccgaggcgggcggatcacaaggtcaggagatcgagaccatcctggctaacacggtgaaaccccgtctctactaaaaatacaaaaaattagcctggcaaggtggcgggcgcctgtagtcccagctactcgggaggctgaggcaggagaatggcgtgaaccccagggggtggagcctgcagtgagccgagattgcgccactgcactccagcctgggcgatagcgagactccatctcaaacaaacaaacaaacaaaacaacaa

SEQ ID NO: 77098 - DNA, 1040 bp, Homo sapiens
ggcgatcacctgaggtcaggggttcaggaccagcctggccaacatggtgaaactctgtctctactaaaaatacaaaaattagctgggtgtggtggcacatgcctgtaatcccagctacctgggaggcggaggcaggaggatcactggaactgggaggcggtggctgcagtgagccaagatcacaccactgcactccagcctgggtgacagagtgagactctgtctgaaaaaaaaaaaaaaaagaatccaaagttgttatgaagttcatgtgctaccagttttttaatgaagactttttaatttgcagttcagattgttgaaaatgtgagctgtacattagcaagggtttactgtaaacatgttatgattcagcttttgataaacaatgtttacacttttatttaatgtcatccatttttccacagggtatggacagtggatttgcaggtggagaagatgaaatttataatgtttatgatcaagcctggagaggtggtaaagatatggcccagagtatttataggcccagtaaaaatctggacaaggacatgtatggtgatgacctagaagccagaataaagaccaacaggtgccaagccatacaactcaatttcagtgtttacactggtgaaagcaaagtagttcatagttttttctccttttccttagatttgttcccgacaaggagttttctggttcagaccgtagacagagaggccgagaaggaccagtgcagtttgaggaagatccttttggtttggacaagtttttggaagaagccaaacagcatggtggctctaaaagaccctcagatagcagccgccccaaggaacacgagcatgaaggcaagaagaggaggaaggaataggcacaggtctctccaaagtgaatgaactcttacccataaccctaatgatgcaagtcatatgggggaacactttgtaaatggtcaggataaaaaccaaatctgggtgccagatcccagcactactttttattactggagaaatgggggggatagaaaattctactttgaatta

SEQ ID NO: 77099 - DNA, 1011 bp, Homo sapiens
gtacagaaatacagttagaaagagtaagttctaatgttcctagtacagtggggtgaatagttagtgataatttattgtatattgcaaaatagctagaagagaagaatagttaatgataatttattgtatattgcaaaatagctagaagatttagaatgttcccaacacaaacaaatgtttgaggtgatggatatcctaattaccctgatttgattattacacattttgttcatgtatcaaatatatataccccataaatatgtataatgattatatatcaaaaataaattttaaaagcaattaacattgataaatttgctttatcacatatttgcccatctttctgtccatctgtctgtccgatttactgcattgcatttcaaagtaagttgaagacagcaatacattttacccttaaatattttagccgcatgcttgattctagaattcacattcaaaaattaaactaatatcatttattagacttaaattaattgcaagtaaggtttaaaaggctgagtgtgactacaaagaagtttggaattttctaaggttaaaaaatattctcttgttcagaatattggctgggtgcggcagatcacttgaggtcaggagtttgagactagcttggtgaaactccatctctactaaaaataaaaaattagcccggcatggtggtgcacacctgtaatcccagctacttgggaggctgaggcaggagaatcgcttgaacccgggaggcagaggttgcggtgagctgagatcgcgccactgcattccagcctgggcagcaagagcgaaactccgtctcaaaacaaacaaaatactaatggggctgagtgcagtggctcacacctgtgactccagcactttgggaggcctaggtgggaagatcactagagcctggagtttgagaccagcctcgacaacataagtgggaccccatctttacaaaaaatttaaaaattagccaggcatggtggcacacatctgtggtcccaggtactcggg

SEQ ID NO: 77100 - DNA, 1033 bp, Homo sapiens
ctgggttcaagcgattctcttgtctcagcctcctgagtagctgggtttacaggcgtgtaccacaatgcccagctaagtttttgtatttttagtagagacagggtttcaccatgttagccaggatggtctcgatctcctgacgtcaggcgatctgcccaccttggcctcccaaagtgctgggattacaggcatgagccactgcacccgacctaaagctgctttttaaagtggaaaaaagtatattactctgcaaaatgacaataatgttgtggaggtggggtgagtaacagtttcaaagttggccatgttttattcattgtcaaagtggagtggtaaatgtatatcattatacagtctctgtttttgtctatgtttgaaacttttatgcaagaaaaaggaggagagacttgatatgatgactaaaagggaggaaactatatcactctctggttgtgtttttatacttcaggattaataagaaaattccccggggaccaccttctcctcctgcgcctgtcatgcattctcctagccgaaaggtattctttgctgtagtccaaaatatttttttctactcatggttattaattttatagataacctccctatgcctatacaggtgcatgtcaccacactgacttgtagtttctttttttatttttcaagatgaagtttcaagaatgcttatgagaatgtatataacatgttagctgtaagttttgttattagtaatgcaaaccctacttttaatggaatggacagggtctgctgtttcagtttaaggatgttataggaagtgaatatatgggttcattaggtccctggtaatttgactttttaagatatgttttgttaatcaaaagaacaatttttcatccaaaagaagtcacatcggccgggcgtggtggctcacgcctgtaatcccagcactttgggaggccgaggcgggcagatcacctgaagtcgggagttcaagaccggcctgaccaacatggagaaaccccgtctttactttaaaaaaaattagctgggc

SEQ ID NO: 77101 - DNA, 1057 bp, Homo sapiens
tccatcctcctcaggtcccaaagtgctgggattataggcgtgagccactgtgcccagcctatgctattttctttttttttttttttttttgagatggagtctcactctgtcacccaggctggaatgcagtggcacaatcttggctcactgcaacctctgcctcctgggttcaagcgattctcctgcctcaacctcctgagtagctgggattacaggcttgcaccaccatgctcagctaatttttgtatttttagtagagacagggtttcaccacgttggccaaggctggtctcaaactcctgacctcagatgatctgcccacctcggcctcccaatgtgctgggattacaggcatgagccacccggcctggccctatgctattttcaaattatattttttgtttttagaaattaacagttacttgtggtatatgacctaaatcacaattattatttatagttttccatttataagtaatagatatctttataatacttctaaattttgaggcgttttacttgactaaatctgcatagagaattgaatcacatacagatattgaggaaaaattcagagctggtagggctgctgtcattattcttttctctgttttataacctatgattaatcaaaaactgctaaccgtaagttgcctgctgggattattatgagtgttttttcctcagatgcaggcatactaaataggtactattttctagactgcttatctgtgaaactgaacacggcaccttccatgttggaaaacatatgaggatgggttatttgcaaactaataccactcaagtttatattttgactgtaactcataatttatgttcttttatccctcttgctgtctgctttgtctaaatattttgttaattttctgttaatactttgcgaaaggaattgaaaatgtagtctagcttaagattgtaatagaaggaaaatacctactgaaagcttgaactaattacacctttagtttttatctgctttcttcagatacacaccatctcagcaaggagtggcattcaactctggagctaaacagag

SEQ ID NO: 77102 - DNA, 1036 bp, Homo sapiens
ggagggaggctgaggcaggagaatggttttaacccgggaggcggaggttgctatgagctgagatcacgccattgcactccagcttgggcaacaagagcaagacttcgtctcaaaaaaaaaaaaatggggggttttataattaattactatggaggaatcttgctcttcagatgtccttcactcagccttgtgagatactagaatcttattgatgctcatttgaagggttattaactttggaatgcccaaataaggagcagcaaatgactcttgtatgctaaattagtattgacactttatgttgaacatacatgactaccagggagccatttacttagaatcctttccttataaccgttgctatggagaagtgataaactcctcatgattaactcttcatagaattggtatttttttcttgtgttgttatataattttcagcttagggttgtataggtttttccatgctgagaggaaataagacttttgaggtcagatagtagctgtatgatcttaatgtactgaacctcactcttttcagtagagtgagctttatggtcccttccaaaatcaacactcttagagtatggtgacactaataactcacatatcagtagtacgtgttttgtgctaaatcatcttaggctttcttacctgatccctcttctcactcctgagaaaaacaagctggagattttagtgtatagccatgagatagttttttctgggaaatcagtagcttatagaaagttctgtacggcctaaaatataaacttatttatttattcattcatccatccattctttaaaatagagataggtcttgccatgttgccctggctggtctcgaattcctgggctcaagctatcctccaaccttggccttccaaaatgctgtgattacaggcgtgagtcactgttcatggcctataaacacctttagcatgtaacagaatatctctaaaattcatttatttattcatttgtacaaaaaatattgatcaaatatctccagtcattattataaagcacagga

SEQ ID NO: 77103 - DNA, 1366 bp, Homo sapiens
ctctgattatgaatgtcagtgtgatagaaattctggttatgtgctctcaagatgtatatttccctcagaagatgtatcattttctttttgcttattatctatcactgctttgtggtcactagagaactgtaccatttgtctattcctatatcaaactattaaatatttacaagaaaactaatattttataaattcaggaattacggaaaataatgggaaagtaaaagataagagagatgaaagtggttttcatatttgggctcctcctcctcctcctcccctccgataataccacataaccctgaagagacaactttccttcagggaaaactccagtagcacttcctttgctgatttctttctcttcacctgttttcttacctttaatttgagaatgttaatatatatctgatatatagattaaatatatttttgcgggtataagacaaaatttggttgatttgaaggcaatgagggagaaggaaccatctggaatagctctttctatctctagcttgttgccaaataacaagcttccggtcgggcgcagtggctcacacctgtaatcccagcactttgggaggccaaggcgggcagatcacctgaggccaggagttcgagaccagcctgaccaacatggagcaaccctgtctctactaaaaatacaaaattagccaggtgtggtggcgcatgcctgtaatcccagctactccggaggctgaggcgggagaattgcttgaacctgggaggcagaggttgtggtgagccaagatcgcaccattgcactccagcctgggcaacaacagcaaaactccatctcaaaaaaaataaaaaataaaaataaaaagaacaagcttccttggcagcacctattctaattactcaggatcctttacattaattaattaatttttattttttttatttttgggatggaatctcgctccgtttcccaggctggagtgcagtggtgcgatcttggctcactgcagccttcgcctcctgggttcaagcgattctcctgcctcagcctcccaagtagccaggattacaggcacgtgccaccacatccagctaattttttgtatttttagtacagacagggtttcaccatgtttgctaggctggtcttgaactcctgacttcaggtgatccacctgcctcggcctcctaaagtgctgggattacaggtgtgagccaccgcgcctgccccacactctttattagagtttataagaggaacacccaactagatcatatcttgtcctatgtattccaaaaaacccacatgtaggtctttttgttgcttttttgtcagctttcctctggtccttatgaatgctggtgtgtgaaggccagtcatatt

SEQ ID NO: 77104 - DNA, 1057 bp, Homo sapiens
tgtgtacacagaagaaaatctgtctttggcaacagggaagataggggtgcaaggtatacagacataaaacaattacagaacacaaaatgtgcatttgtgtaatactaaccttagtgcaaaaagaattgaatggaataagttatgtgggctggagagttttctccccaccctcgtttctaaaatttttttgcttttttttttaactttattttttgagatgcggtctcgctgtgttggccaggttggtcttgaattcttggcctcaagcagtcctcctgtctcggcctccgaaagtgctaggattacaggcatgagccaccatgcccggcatctgaaatttttttaaaaaaaaactagaaatagggtgttactgcgttggccagagtggtctccaactcttggcctccatcaatcttctcacctaggcctcccaaagtgctgggattgcaggcatgagctaccatgcccagccaagagtttgtttagtaaatgttacaggcagcaaacatttgagtgctccccaggtgtgagacactgtgtcatagactagtaaagttatgaggggagactttgtggaaaaggtggaatttgaaatggacacacaggaaaaatttctagagatgtcatgggtattttttatttattttattttttgatatagggtctcactcttgcccaggctggagtgcagtggcccaatcacagcccactgcagcctcaacctcccaaggctcaggtgatcctcctgcctcagcgccctagagtagctgggactctagacgcttgccatgatgcccagttaatttttgttttttttagtagagatggggttttgccatgttgcccagcctggtcttgaactgggcttaactgatctgatctacccatctcagcctcccacagtgctggcattactggcgtgagccaccacatcatctggcctgtcatgggtattgcgtgcttaaaattgcagtggcagaatgcgatctttaaatggccagtcttgaggactccagagctttccatacctaccatctggtgttcctcagtattcttt

SEQ ID NO: 77105 - DNA, 1138 bp, Homo sapiens
gctgttgaccaccctgggtgcctcagcccttgactccatgttggaggacgtggtattggagttaggagttctctgatgctccgcagtctctgatggccagtgattctgtgcttcagcaccttttccttcattccttctctctcctgctggtctacgcggttggcatttagtgaaaaaggacagtgccggacatttgggtgtagccagggatgggtacgacctcattccagtcctcacagtccagggtcatgggaggttcactcatcatggtaatacatggccacatagtgcccaacgagcttgcagaggagagagaggttgccttgggcagatggaggctttctgaagcaggtggcctctgacccagccccttagagatggatggaattggaggaggtggatgttggaggaagtgattactgattaataagctgggttcagcagaggtgcagggacaggaaagcataaagcatggaggtgaacagtgaggtcttgttgattacaatgtggcgttcagccggtgaatagtggagcagaggttgtaggattggggctgaggtcacattatgaagggcctagaatgttcttttcagaatgtgagtctgagggagaggaggacttggggagggacctgatcaaaagaaggacgaagagactgagatatacggagtggggtggggcatgtggtcgggtggttgaaggaatttgcctaataggctgaatatttagtaatgtgggagatgaggtcatctttgaaaagtggaggaagatatagatggggaggtttgaagtgggtgggaagcttggggatagagttatcgtggaaattaagggatgatctttgaattgtcagccacactatgctgttatctttggtcatgcacacacatacacacacgcacacacacacacacacatctatacctgcccccatgacatacagacaagtcagatcttgttacagcctatttcaagaaatggtccaagccgtgcgtggtggctcatgcctgtaatcccagcactttgggaggctgaggtgggtggatcacttgaggtcaagagttcgagaccagcctggccaacatggggaaaccctgtctctactaaaaatagaaaaattagctgggtgtggtggtgg

SEQ ID NO: 77106 - DNA, 1073 bp, Homo sapiens
aaaattaggctttgagggtgatagtgggtatgtattttttctaagttaaaaatgataggccaggcgcggtggctcacgcctgtaatcccagcactttgggaggccgaggagggcagatcaagaggtcagggagatcgagaccatcctggctaacacggtgaaaccctgtctctactaaaaatacaaaaaattagccaggcgtggtggcaggcacctgtagtcccagctactcgggaggctgaggcaggagaatggcatgaacctgggaggcggagcttgcagtgagccgagatcgggccactgcattccagcctgggcgacagagtgagactctgtctcaaaaaaaaaaaaaaaaaaaaaagaaaaaaaagttaagctactgcatgaaaaacaaactgtggtgtgcgtcttatagtgtgtaaagtgctttctcatatgtgatcctattttgacattgaatctcaaggttgctctgtgagcaagtagagcaggtggggttagtcccacgtagccgctaagggaacttggacccagactgagaagagaggtgccttatccccagatctcccatgcccagagtgacagaaccatgccattggcagggactccccctcctgtctctgtctatgctggtgaaatctggttaaaacaaacattaggaacagtcccaaatggaaagatagagttggaggcaggtggattgggggtgttgagatggagcgggccactctggtggctcttctcatgtggatatgagcagcaattggcagcccccacccttcccaaccccaccagcagcagctcactcctcagaggcaagggctcccaatcctgagcccccagacccttaggggccatctttcaatgtagtaatagggggcccagagcgattagcaatatttcagaaagcttaagggagatcatacatctccccatgacaggcctgcccagactaaatgaaatgtcatttctctcattttttggctggaattctgtcagctcagtctggctgcactgcttatcttgggctgatcaggagccctgattggaccttatatgtgtccttgacaaat

SEQ ID NO: 77107 - DNA, 1120 bp, Homo sapiens
ctttttccaggcacaagaagaagaatacctgttcattcttcagaaggacccagatctctttcagcgaggccttcaacttatggcagatcaacctccatgagctcatcctgcgtgtgaaggggttgaagctggctgaccgggtcttggccctaatatgctggctgttccctgctccactctgagtggaattgctctccctgccccattctggtgtctttccactcctcagcccctcatcttgcctccacccagctgctccatttttgccacatcgtggcccgcagccccagagtcactgtccatgtcaccatccttctcctcctttggaatcctctccgcacactgtggcccttgtctcagggcccacaagctgaactgtggcatagctctctcttcttctccaagaagactcagcagcctacattcccattcctggtatgtgccattgggttggatgtccccactacttccgttaacccttcccattgtcaagatgtgccacgggtgccactgggggcacactgaacttgtagggagtgtgattttgttggaggtgcacatggtctctgaatttgacagagaacaccttccctttccttgccatgtcaccctccagaggaagtcacacctcagcgaggtggtttggcatctggggccaactccattacagctatgagctcactgctgtcagtgacgtttggtgttttctgtactgtgtttcaataaaaactccttcaaggttgcaggatttgtccatcataactcactggcctcccacctgaccccaggcacgtgcccttccagaatgtgctcatggtcctcgccaagggcttatggttcctcttggttgctgcttcctcagggtttcccagggagatctagggaacagaaggccaggggctgtttggtgggattttccttataggttgggagttcacctacaatgcccattaggtcagagtggacctgaatcgagtattggtgtgatcttctgcttggcttcttgctcctgtaatccttccaacctgtggggccacttccactatggggccacttcctgcttcttgggggtttctcttaccttccaagactcagactctggttggaggagttaagaagc

SEQ ID NO: 77108 - DNA, 1062 bp, Homo sapiens
gaaatgatgccacaaatggaaaattccacacctagcctcatgtaataggttgcagtcaaaacacaggggcacagcaagcacgcagcgtatttaacattcgtaagggttaaaaagaccctcccagtttccttcagctgcgctatatcttttctgcgcatgcccagattccccaggcaagcatgcctacaaagggtaaaaaaatggcacttgtgcaggctgaatcgccaatcaacagcaggttttccacgacatcctatatgcattactcactgtggtttttttttgtttgtttgttttttgtttttgcttattctctgctctgtaatataaagatgttgttgaaaatgcaaatacttgaaaatcagaaaaattccgaaatccgaaacacttctggtcccaggcattttggataagggatactcaaccggtacttatatttccagttccagcaggatctgccccggagtagatgttcagtgcatgttttagaggagagataaaagacagataagtgtgtggctatatggctctggagacatttttaggctcagaaacggaaaagcagtttttgatatcctacttagcatagccagttttaaaagaaaactcaaatcacaacttttgctaaacatttttgtaagacatgcagcagtttatctcatttttcagaaagatgatggcatgaaacattgcagagagaacagggcttgttttgtgtgattggaagctgcattttctgaattagtattatagtcagtcgatgagatggcaccaactgttaaatggttgttaaagtagaaaagaggtataaagactatgctgtcagcctgttttctcatatgctatggagtaggcactgtggtgctttctggcaatggcaaccaatgtccttatcaggcaatgaggtgaggagggagagatctctgttggagggacagcttcatacataattaggggcaattattaatgagactttaaattccaggacttatttgaacccattagaatttcaaaagcaccaatttagcatatctcacaattttacatgttcattttggtagg

SEQ ID NO: 77109 - DNA, 1058 bp, Homo sapiens
gtttgtgcaagtctacagctgaaggcctgagtgtgtgttggccgtcatatttgtggattgtatctgtcatcatcacatgcttccccaggactatccactggatggttaatgtggaacaaaatccttgagattgtaatgttgctcccttaaattctaagttggctttgcaatgtgggtttttagggaaggtggagagactcataatgataaataacatcagttgttccctgattgttgacttttcaatgtcatcctcagtaagttgtgcttcaccccctataggatatggcaggtcagtctttgctgagctttctcgacctgccaatatttggctaatgtacaagccgattgtggtttggttgcctattcatcccaccagtgatcctttattttaagatatttggcttgagaaacttgcttagctcacaggccaatttcttgtcatttagcgatttattttcttacttgggctaagcgtctgctataaaaatcacttagaattgtgtacttctgtccctctttgtttctttacctttactatttcctctctctccacattgcctttgcaattcacaaccctttctactaaagtgatgtttggcacattttgaagtttaggtcataaagtttgagcttcccaaggttcggctttttcagctgatatgtctggtgatgcagtgttgctgaagcagtggataatgtgcttttcatgtgtcttgtcgctcatattaacaaagcttcctaggccctatgctatagttagatggtgccagttttttagtatagataccataatgcaacttgatgcttgtcagcctgataagagtgctattgattctaagcttctggtgcatgcacaatgaaagaaactgtatgcctttggacttcatgttactgatgacattataactaagaaagtgcatactacactgcatggttctggacaacacaagcattggaatagtcaagaaccgtatgcttctttgtctctatagcagtacatcagtagtagctgatataacatcagtgacttttgttttgaagttatccaacgtact

SEQ ID NO: 77110 - DNA, 1035 bp, Homo sapiens
gtgcaagtgtgtgtgcgtgtgcacgtgcacaccggtgtggtttatatcattgtatcctgacgaagcacacattttttactctcaggtattcttcaaataaaataaaaagtttaattctcgtgttttttttaaatgtcataaattgagtgtatttattcttagcttggaggtctgttagtccatgtgaagtttaattatagaaaactcgatcaaataccatgatacattaactaccttctgcaaaattaattttttaggccagttttatattcacctaggtttatttttctttttcttcttaccttgccagcatttaccaaaagaactgttgctccagattcagcttcaaacaaggaagatgccacaatgaatggaacaagttcacaacccaaaaaagaggaatatgggagctaaaaaagcaaatgtaatttgttattttacatgagtatgttacaaataataacatctctattcttacagcaatttggcccagattatctaacagacatacctgcagctttggctctttggtattgccaaacattgacaaaagtgacaatactgttggtccttgtgaatggtaaaccaatccaaataatatcagatcatgaatgatgtgcagctaatttatttgcaacttatactagcacagaaagaatgatattttttcactttgtattttcctttttcaagtgtggtcagtcacattttcccaaccaaaatttggatttctaattgaggccttttaaaaattactggctaaaaagaaggaaaatgagtttcccttgaggcaaaagttgccagcactttagattcagggagcatttatatacaactgattttttgaaaaattttctccctaataaattatcatgtgttataacatgtggagatgtgcatatataacattagacagtccactttataaatgctcaggacttttatatctatcatcttaacagtccacaactgcataccgtagctgaaaattatttccaatcatccatttttaatagcaataaagaattcataaat

SEQ ID NO: 77111 - DNA, 1185 bp, Homo sapiens
cacaggtgggtgtaacagtgatcagctaattaaagactgtgtaataagttattgacttatgatcaacaggaccttgtgtccctgaagcaaatgtttaatttcagatatttctcccaaatcttgagaaccactcctctttcccttttaactgaaataattgctgagaactcttttcttctttataatggcaacatttaagaatctctaatatactccatagataagtaactgcagattcatctgtttctcagtattacctcatagtctatttctgatgttcactgaagcaggtttgtaaattaatattaatatgaaatagtctatagaaagtttcatagcatatcagttgaaagcaattatccaggaagaatttttgtatctgagtcagtcttgcaaatgcatctcatatactttttaaaaggaaataattcttctattttcaaaagatacatttatcttgaaaatactattatatatgttcttatttgactgtctaaatctacagtttgaactgcttcttacagtggtgcatctgatttttagtatgtggattctgagagtattaatcaattttttataatgtttggtttccttatgttttctatttcagagtacccaagtggccttggaccatctggagtctgtgcctgagaaactgagcctactagaagatttcaaagacttcagagtgagaaagagttggcttgtctctttcagtattttatctgagtgagaacacttgacatcttcctgatgtgcaaagaaaagtatagaaaaggaagaaggaccaaaaaacattgggaacttttaacataccaccttatcagggtttattgacatttgtgaagttagaattgaaaacaatgcaacttatgtattagcacaagataggaagatatagactttcactgtactactagaagctcagttgggcccctaaaactttaatgataatttagaaaagcctaagaattaaagggagttacacattacactgacaatagataacttttttggttagcaattttaatttgtgaattatttgggtactgtttgttttagagatatggtagttcccaagttatctttacactatgacatatgaactcaaatccacgtaaatttcacatttcatatttcatggccatttattgatagacctctaaccacaaagcatttcattat

SEQ ID NO: 77112 - DNA, 1071 bp, Homo sapiens
ttacctgtcaccatagcaaaaattgctaaacacagtatcttctaggaaaccttggcttatactgtttgttcatattttaacatgcaatcacttaaaaagaattgtttttttgcaaacgctctgaaatttctttcccttgtgagtacattttatgttcagttttaagaaatgaagtgattacaattaagtagattgtagatctcaagaccctccttcttgtaaaacagttgtaagtgcctagtttattgttcagcacacagagaacattaaactagtcctcatttgtctttgtgtgttattttttctttatatcagggagtggcaagaatgatatgaaagaagacaatttcaagaatcctctgggaaagagatgattcttttatttcctctgtcttcccttctccatcaaatcattcttggtgttttcgtattgaaaggaaaaaaagaaaacccaaatcactcatttggagaaaatactacatctttttaagctaatagtaagataatgggttgactgtaacataattcacttacatgtagaaataagaaagcagtaatttgaaatggcagattctgtatttcatatagttcctctcttaaaaaaaaatactgtgaataggagttggaaaatacctagaaagccttctgtatctcagttttcagtgaagatatgttacctgttctcaaattttatcattgctttttaaaggagatctaccacttttgactacaatagtgttatatgaagacaaatagaatttgttgttgacaaaaactcttttagatgttagcccaaatgtagacactgatgtcatagtgccatgttaacttaacaagcatttttacttaacaagccttatgtaccctcttaccccaatacacatgtaaacacttctaagtgggcatctgattttttagaccgctcataaaatacagtctagaaatagaggactcctctgatatcccaagaaatacacacaactttgaacactggggctcataaagaatgtgcatcaacaccgtgacttcggtggcctattctctgctactgtttggtgtggttccagtgag

SEQ ID NO: 77113 - DNA, 1013 bp, Homo sapiens
agctggatttttgaaggttttaagatatacctgatagtctctgcttccgtctgctttggcagcagtcgtcagggaaacactttgctacaagagccagaagagtgtttctaagtgttcaaaaaaggattaattatgaaagtaaactttaaaaatataggcatagttgatctcacttatttttgaaataaatctcaatgccacaatggtaaaaataaaataccttgccggatttctgtttagatctgatctgcctgtcacaagaaattcatccatataggaggattagctgttcacatggtctttcaacatccaagtgctgtgtgtggagtaatggaaaatgattaatttattttgtcattctctttgagaacacaggacatctctaaaaaagaaaatagccctttattttgaggacagagaagattaattatgtttacctcaccaaggcgcttttaaataaatcaacctagaccctaccttagccagaacaatgatcattcctaatcagagctctctatcaggaccctctgctccaggttaaatatggaagagacaaatgtgattacctacttgagggtgtcttgaggacttggggccagggctttgcaggattcagggaaatgattagcatttctcagtatctgccctgtgttgggtgtccccatcattgtccagcagggccaagctcctatagactcatccataggaaacatgttgctcttcagagcactcactcctatgccatgtcattaggtccacagaagacttggttctcatcttcctctctttaactcggtctatactgtctatctgaactttaccatcccctcattcttctttcagttctgttttttgtttttattatttctttaattttgagtctgttgagaaatattctctgtccctcaaagatagtcgatttttaaattctgcatttaaaatataatcttgcagtatttttcttgccacaatatttctaagttctaaatgtatctttatgtatgtttatgata

SEQ ID NO: 77114 - DNA, 1691 bp, Homo sapiens
aacatcaaacagtaaaaggccaaactgtcaaaatagcctgtccattgttattctctttaggctcacttcttaattattttgctagctggtcttccataaatgattttctggagcttttgtgatgtttttctctcctagcatctcactgctacctatgctttctatcacagcagaggccttgacatggttggttgattgctatcaggcattaactatatagtggctttagaaagccactgaaacatagatagactcgctgacttaaagtatgtggattctatgaagtactccctttacatcttcttttccaagaacttctgattttcattttatccctttcatttctaactcaaacctcatttttctgtgaaatacttcaaagctcctacttctacattagtttttgcttgaagaagagtacgtttgttccagaagtgtaggaattaagtgacagggtaaggtaaaagcctgatactctccaactctgttggatgggagttagaagacctgattgtgaattctggctttttcacatgggcgactcacttaacctctccaagcctgtttcctatcatctaggaaatgggactaattcttatcctgcatgtgtcacagttttgctcagaaggtcaaatgagacaatggatgggaaagtccttttctaaattttaaaaataatcatccccgatgtatgcattacctttaccagccacaacagcagtgtgtggactggaaaggtttggcccattaatcaggacatttgcattctgtcctagtattgccactctggttatgtgccttagcactctgtgttatgttaattttacctccaaaattcagctcagttattttacatgtaggctctaagaaatttagatttagagttcttatttaataaccccagtaattttagttcaacacaccctcacccccagattcagttgacccggggtaggacccagtattttttaaagcttgccagatgattgtaatgtacaactatggttgagaatcactgatttatgccatcttcaacatgtccttcaagaattgcctttagtgtgtcccctaaaacctggtgttactctgctttcctggattttgtcctactcattaacacagacttaatttcatgtcttttctgctgatagcatcatgtcttctctccccagtattttttctttttaatctattgaaacaacagttgtaagattctttctcacacattattttccataactgtccaaggatcaagggagcttcattttagccttttgttaacattaaaatttgtcagatctaacttcaaggaccagtttgctcagtcatgaactcgccaaatgaccaattctcttattttaacaaattacaacaaattgactgatttacaaaaccattatctttggaaactatataaacagttaaaaacaaattagtggttattgtttatttttatggtaaatcagtgtaattgctggtatattgattaagattatgtaaactggctctctcatcttccttttctaatttttcctcttactactcttgtgttaatcctttgttgcatcacactcattgcctttcattcatttctccattcagcatgtgataaccaactactccatgcaatggattcagtaggaagcatggttccttcttataggcactgcactggagggtggcatgggaca

SEQ ID NO: 77115 - DNA, 1033 bp, Homo sapiens
tcatactgcctttctaacttccttggttgataatgtgttttataggcctgttctaaacaatattaagaacagcacattctctgggtaaaagctcttgctttatattgtgaagataatatgaatgtatattgtaaagcacaatggcagtatctttctgtaaaatacaacacatgtaagaaatgctttctgctctctttaagagagcctatctgggtgaaagctcagagtaatgatagtatatttgatatctttttaagatcctaacttaaccataaaataagatattcgtattacactcacaatatatagtggggggaatagtatattttatacacattttaaagtctttaatgaaaaactaatatggagaattttcattttgtgcatctagttttaacaaattaccttcaatctttagctgaaaattattatatgaatagttttaaatgatggaaagtgatatgagaaaaaatagtatctgattaatagtcagaaaatctagattctggtcatgtctccaccatagccaggcacatgaccctggccaaattatttaacctctctgaatttcaattattattatttttttttcatgattgggctggactagatcatctttaaaagttcctctcccagctgggcgcagtggctcacacctgtaatcccagcactttgggaggccgaggagggtggatcacctgaggtcaggagttcgagactagcctggctaacatggtgaaaccccgtttctactaaaaatacaaaaaattagctgggcgtggtggcgcttgcctgtaattccagctacttgggaggctgaggcaggagaattgcttgaacccgagaggcggaggttgcagtgagctgagatcgtgccattgcactccagcttgggcaaaaagagcgaagctccgtctcaaaaaaaaaaaaaaaaaattcctctcccttgtaggcttttgtctaatataggaggaattaaaaatctggggtgttcacaaaatttctatgttgccagtagttactatcaaacaac

SEQ ID NO: 77116 - DNA, 1087 bp, Homo sapiens
tgatttcatatgacattttaagggacagattttaatgaacttggtagactcttcaactgataaagtactttatagttcataaaatcaaatatgctgaaagctatctcaagatcatttattattctctcccaagtcagtgcttaaaacttagaaaaatgttgttggtccatatttggttgagttgttattaacagtacagaaggtgttgcatgtagagcatatatcatggtgctatcaatatgcaaatgtttgaaatttcaccattccattaggagtatttacagtagattgattttagcagtgcagtagttataatacctgaaaagaagatcaccttttcatcataataagaaacttggtttagcttgccaccaattatctatctgcttaggtcacagtcacatgcccatttttccccgtcttcctcaacttttccctctctttctttaatagcaggtaagctccttggattagaaactgcattttatttgcaaatgcgttgccagggtctgtcagaaatgtttgatatatagtagacaatcaataaacatttgtagaatgaaagaatgactgttaaactgcatgtatctcaacctcacataagactgtgctcaggaataaatagcattagtccagtagttgtgagaaattccccagaagcacggcaatgtattctttatttcctagaattcctggtcagtgctatatgctatttggtgtttcacagaagctctaaccatcttcactaaatgttaatgtaaattttcctgggatggaaccaccttcagccaaaatagaatgggttgattccctaaataaagctaagtgattacatgggaaaaaactttgattgagagcccctgctcatgggccaaggatgggactcagcagtggaaatttattgggctcaatatgaggcattgtgttgacaccaaggaagaaaaaaggaaagtaaattgtgatcaatgccttcaaggaatttgtactctatttgagtaaagaagacacattcatttaaatgaattaaatgatgaaagataaaaaccaaaaaaatacagtccatgaatgaaaaagataatgcattttc

SEQ ID NO: 77117 - DNA, 1041 bp, Homo sapiens
ggaaaataaggaaaagaaagctcatagctttgcttcgtgatttgaaatttaaagggtagtctcagaatttttggtgtcagtttcatatagctacctagaagtatgtatagggattttaaataaaaccctaccttgccgctcaggctgcattttccagtctgaaatctgtcccaacaaaccaatagacccccatttctgtatctttctcttcatcttctttgttttccccacttgtattcttcaccccacaaacccgtacacataccccacttcaatataaatacaaccgcagcctttcctgaacaatgtcaaaactgaagtataatggtcaataatctcctcataataaaaccacaaactaaaacacccaccagagaacacagcagaagaaagctacagaagaacaactggctgccctcaggtctctgtcaaggcaatagtagtaaatgacagaacatattggaaatgtggatcaaccaccttgagtctgtttttaaatcctgtgattgtttctgcttctggttctatcagagatttgccacacccaggttgaaaatcaggcaacaaggaccattattgggcttccctgtaggctagaacatgacatatcactttaaattggcttttcttcctaagtcaaaatgttggtttttttttttttccttgacaacttttcagacaaaatctttaagcctcgctgttttttttttcttcaatatgtgtgttgtgttattttagacgctgaagtaggttgtttgaaaaggcacataagcagccagtgaaatgaatgaacagaaattgactacaggtatctaatgatggttacagtgaacacaggatgattgggaaaccagtgcaagctgctccaatgccacccatcctggagtatttgatgtatagacaaacttctttcactgacttttaatagatagcatacaattttatatataaatcacagatgcatttggtatattcaaagccaacttatgctacattttaaagctttttttgatgttgctacactgagatagtgatttttgt

SEQ ID NO: 77118 - DNA, 1037 bp, Homo sapiens
ctctcaatacccagtagatggctaatcctcctggtaaggaaaccgtgtgagaaactgggctattgatcgaccaggtggataatttctgtggttttgctgtcagtcttttctgccgaactgtagcatgcccataaccagtacttttagagattgcaggtagaaatgcagggtggggcagccacgagtccattttagagttccctcggaattgctttagaaggatgagggtgacagggaatgctctgctctctcactggatctcagaaagaactgaagcaattcatttccccagaaattcccattttcttgggagatactaaagtacatttttagaaatctcaatttgaataaattgataaattaggattaactgtttaaggtttcattaaactagaaagtaatacagtccctactcatccctaagatgactcgtgagagttataacagaatttttattattctggaaaccaaaatgtaatgcatacccacgtattcttctcaaggtgcattcctcaaagcttaggcaaataactgcgtatctctatgtcttcttctgaaatgtgatttaaaaataattgttctaagcaatggcataaacaaaacaaaatacagtgttgtggggatggaaggttgggcgaccctttgccactttcaggcagaggtaacttaacagctcattaaaatctctattttctcgaaaggtgaacaggcttaccaaccttaaatttggtacaaagttacaccagaaagaacgcattagcagtctgccttggggtcaaacaggttctcagccaattaggtttacacccttcaatttactacatcaagagacctcatgagagcagggacccactctcagtaaaaaggattccactgaaattgtagtgctcattaaaccttgtcactctgttttacctgaaatttgcaacttaatattaatcccaaatttatgacagtataaaacttgaaaatagaataccctacgaaagaagtattcttgtgtctgaatatatcgaagttgattgactaggtcattt

SEQ ID NO: 77119 - DNA, 1046 bp, Homo sapiens
ataataagatcatagcacagggtggtatagctgcaggcagaaaatatgttttcttaatagcaagttcataaattaatgtagggcactgagacaccatggctgtatacatgcattaagacagagctctcttcagttgacgaccttcccttccaaccactaatttctctgggatggtgccaaactcttagtcaaatgtagcttcaatgcatcccaccctctcagtgtgaaatgataattaataagactttatggatgaggtggtgttccacttccagttaataacacctattattccagggtgttttaatttggttataaaaattgactgtaggggtggaacttggcttgggagcttgttttaagggcaaatggtttgtttttaatttttctttcaaaagaaaaaggcttttctttttttctaaaggaaattttgtgttgcattgagttatataagcatgagaccaaattcttaaaatattggtatgattacagatttttaattgatttgatgtcatcctttggtatgtcaggtaaagctgagagatgtcccagggcttcttggctagcttagagttggcaggctcccgcgctctgccatgtcctcagttgggatcagagcgtgtttcttttacatggcttctcacacttaaacattaaattctcttctcaggcaacagtttatacaagctactggctgaattgcatttgatgataagaggcaactcgtttttacattgtattttgatgggtattttactttcttattacagatctactggaagagacccaaagaaaagatgaagaaatgggatctctgcaggtaaattcttaaatagggcaagcatgcttggtatgaaaacatttgttttttactcttttatcctttattattgtcacattcacactggtatagcaaatagggtgacaaggacaatgtcagaactataaagttggaatttgcttcctttagaagtctctgagagcactgatctaaagcaggaagccaaatcagcctctatgctacttttgataggaaattttattcc

SEQ ID NO: 77120 - DNA, 1057 bp, Homo sapiens
tttttttttgagacggagtctcgctctgtcgcccaggccggactgtggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccctgtctcactcttaataaggacaattgtgattacatttagggatctcctgaataacccatgctaattttttcatctcaagatccttaaaatctgcaaagtctcttttgccttgtaaagttatgtattcacatattccaggaattagaacctgactatctttggggctgattattcaatataccagtgttaccatttagtattttatgactttttaaagagtaatacaggctcacttgatattggcatgaatgagagaactaatctgatatggtaaaaatttcttctgtacaagagtaacaaaaagaaagaagaaagagagaaagaaaggaaagaaagagaaaaaagaaagaagggagaaaaaagaaataaggaagaaaaaagaaaaagaggaaagaaggaaaagagaggaaggagagggaaagaaagagaaatgaaggaaggaaggaaggaaaaggggaaggggaaggagaggacggaagaaagaaagattataggaataaatttaaccaaggagatgaaagatctcgataacaaaactacaaaacactgacgaaagaaattgaagaggacacaaaaaatggaatgacatcccaagctcatggattgcaagaattgatatttttaaatgaccttaccacccaaagcaatctacagatgcagtgcaacacctattaaaatactaatgatattcttcataaaaatagaaaaaaaatcctgaaattcatatagaggcatgaacaacccaaaaacctcaaatag

SEQ ID NO: 77121 - DNA, 1030 bp, Homo sapiens
gacatgccagtcaagctaataaaatgtacagtagtgttttaaaaagtgaggaaactgataaacagatggctatatgggatgtttctaagaataggaaaggaaagactttttgtcacatttcactatttaggataacagatgcattagtctgtgtttctaaataaaacttcaagcacatgtctgaaatcatctacttactattcaaatagaaatttccctttggaggttagtttgatctgtcaaaccaccatatgggtctgtaatagtataaagttctctgaattttctgttcttgcaatttaagctttttcactagtacgcttactcccgaagctagactgccttcaagagagctgtgctgaggatatttcaaactgttttatacacacacacacagcctgagtgagatgaatgggttaggtcacttgaaaaacttttaagggaattagaatacaatctctggtatgggactttcattttatagcccaatgaggttattgctctagctctattacatctaacaccaaaaacctcagtgagcagacatggtttttacttcattaagtaggctttttaaaaatggactttctaccttctgagccaaaaaaaaaaaaaaaagaaaataataattaattaaaaataaaaatggactttctaaattgcttttctgagtattttaatatctcattttattcttccaaacctgcctgtgaataatttctaaatatttctcttatgtacaatctaaataaacatataacttgctgaccttattagcagtatatctacaacaaatgatattcatttaatgtattattcattcatgaaattagccaccaaatgttaattgaacatctacaatgggccttacaatgtcctgccaacagcattagtaatgaggtactgtacataggtggacacttcatgtgatgcgttcttacatctttgagcatgaatatttattttaatcacgtctaagagtctttcaacaaggttcttacatttctttattttcacttacattcttaag

SEQ ID NO: 77122 - DNA, 1052 bp, Homo sapiens
atggcaatgtaatttttatatcatgtttatattgtgcctatgtgtgtggataggcataggtggatatttctgggctaaagactctacttagtgttcatcagattctcaatggagatggtggctaatttgttgatgagctttaaattcttttaaaaatcatgttattatgaataacaatagaatgacagtctttgcatatatatgattttatacatttctgattacattcctccaagtggaattattgactcgaaaaagcatgagtattttttagtttcttaatacaaagataaaaattaccctttgagaaagtaggcactgcatgttttcttttacagttgcccatgggtaaaaaacagaagcccaaataaaacatgttatggacaattattttgacagcgtttgtaagtttaccttctgttcatattacataaagtaacatattacaatgcgtgctgatggtgacttttgtgattctgtattacaacagagatatggctttgtctttttgcatctagattggataactaattttcgttatattggtcagtccttacactataaaaacttgcagaggttctgccctgaaaacaaatcatatgaacttaacagaaatatttggttgttggcttagggagctggagtttttttgcctatacaattcagaaggaataatgtatattactgtatcaagtgaatttttattgtaacttgtggttttttccatatgacttaatttcttgccaaggcagactttggggtatttttttagagcttctttttctgctaaagaatctttcataatgtaaaccgttacactgactacccataaatactattttaatgaatttacctcacatctaagtgtaaactctaatgcctataaaattttaaatatgaaatattatgccacatcatcatactacttaatcttggtaacaagtattcaattcaatttacttacagaattttatgatttcttaaaaatagtgggttaatttacaatgaattgctttgagtttatagactgtaattttcattcattacttttc

SEQ ID NO: 77123 - DNA, 1050 bp, Homo sapiens
ggctcaacctttaggaggaaactaacaagtcaccagaattaagttcctttgttcgctgataaatctgctttacataagacaatacctgacacataatgtatactccttattaactggatggattgattaatttattgaaaacctactaatgtcagtcattgttattgtgtggcgctgtatcctctacacaagaagaaactcttcttgcagcgtaaattttagcctcaaggactatataacaagttaacaaatgcaataacagggtcatgtttcagttctgggatgacactagaaggacctagttttttgtttatttgggggtttttttgttctttttttacccccagtggagttggcatttggatgcattgggactgcgtgatagtgatgatgtcaattcatcttataatgtactgtgcattgaattctgtgtgtggggtctattctcattcaaaatcaaagagaaattcacttagcaagtgtctcatctataattgagtatggactccaaggagaacattgcaatgaattttcacggacagattgcggaagtgatcagaggtgtatgagataaagccagaaacatttctataaggctcttgagaagcaggcattataggtagctagaacgagcaggccaaataaagggattgatcagagagaactggcttctacgaaaagaggagatattttagaagacactgtactaagttataaatttggaggcctggtcgtctgggagcaaggtcatatattagtggcctaccacaaacattatggtgaacgcacactgataaaccaggcagtgggaagcaactggtggttcttatctgaaagagaaaatgtgatgaaaattatataagggaagttatcctgacatctgtgttgggaatataccagagaggagagaaaatgtagagaaggaaactgttggaaggcttttgttacaattcaggcatcgggaggtaagctgaagtggtacctgtggaaatggaaaaaaagacatgtgagtgacaattgtaggagaatagggaaaagtgggggcaaaac

SEQ ID NO: 77124 - DNA, 1051 bp, Homo sapiens
tctggtacggctattttaattacttataatagagttttctttcactgttgggataattagtcttgagtaaggagaaaaaaatccttttttgaccttttaatattacgttcacattaggtctcagaaagcactctttcagcagccataaatactttaaaaatcagtattaagccgtagaaacttttaattcaacaagcatttgttctgtgcatactttctaccaggcactgtatccgattctaggaaaaaggcgcaaagacaggttctgcacctttgatagggcacaggccatacaacatcagtagttggtgactgtagcatatggtaccagggaaactggtacttgataaaacttgaaaaggcaggtggaggccaagtggaaagggcacgctggccctatgttaagaacataaaacattagcccttgaacatcaagaagtcacagtattttttatttcagaggagtggtttaaagattcagttagaagcagggatatacatgggcagttgcattagagaatgaggaggcatccacctaaaatgagagcagtagttatacagaaggggtaaatgctggagatatgaagatggttaatggtttagattgtgttactattggttatggatgcagagagaagtagaaatttctggaatgactgtaaggtcctcggagagggtctacaaaaaagagaaaactaaactcgggaacatgtttgtgaagggccattatataatcaaatttaattctcataataatggcccttcaaagtagctaggaagcaattctcaaggaatgtaaatgcattaattaaagctgtgtaactaggtggtgacagagctggatatttatctggcttcaaaactcatgctcttcaatctctgggaaaatagaagacaataacaagtttagatttagatgctgtttttgaagtacccttaagatatgtgggccaagttttctaataaactattggaattttgatcgtaaaatcagcaaaagggtggtttcttttgggagggccaatttgggagttctttttatatgggtact

SEQ ID NO: 77125 - DNA, 1205 bp, Homo sapiens
ctgaagctcctggctttaaccaaaggtcctgtgtccctttctctactggaatgagcattttgggtctccatatcttgtgggagctgaaagccctgtccactgcgtcagaatctggaaccaagcaggtcctgccatgctcatctttggaggtctgtgagggtttgtgttcatgcagatgtttgctttgtttggggtcctggaagtggctttctggcttcttgtttttatatagtacttattcttggtgtgtttttgaaacaaagacggacagtcaaagcctgaacttactatgccattctgattggaagtttattagtgcttacttttttctattttatttctcctcttccgtcttttgtgaagttaattttgttcttcgtcatttgttactttctatccctcttaccctgctttagttttctccttggactcatggtttattgtttttatgcgtttggtctttttttttttttttgtctctctcttttcctacttgaatatatgctttgtgaggacagtactttgttcattgcaatatccctaacatcttacaaagaaagtttccattatttatgcagtaggctctcaacagacatctgtagaatcaatgaatgagtgatggtgtttttgtcccaagttgactcatcatttttggatttctgtttgatgtgtatttcagaatatgatgtgataattcttcaagaaatactggttctgactggggaaggggcccatgaccagaggcctgtgagtgttgttgatttcctgggaatcaagtcctttcctacttcttaaagggcagacattaggaaggcctgccttattttgtttcatagaaagtgtgtttctctggtgttagaactccaattcgcacaaggcagcttcaggctttgtcctggcccataggctagagtcaggcacttccctatctttgtttcttcttccagtgtcagcagaatttggatatctaatctatgcttgtccttctttattcttttcatactattgttttatttaaaaggattccttagaggtttatcctggggccacataacatccctctgcagctcattttaactaaacttgattgaaccagcttaatagagttgtaaaattaactaccctggtggttgtcctctcctgatttttaaataactctttgactttgcaattggaaaagccctggaattactcatacctcaaag

SEQ ID NO: 77126 - DNA, 1027 bp, Homo sapiens
gatattgcaagaaaaataggcctagaaacctgtaatttataattggcaggccccagtcttcaaggtcagaatttatatgtgtcatctctttggtgtaaatctctgtttttgcttttaccgaattggaattgtgaaaggtgcttttaaacttcagaggcctgtcagttttgatatgtgaggataattttgaagacataaaattctaccccacctgtcccctctacgttccccactaccccccacccccccatacacaaaaaacccaagaaggagaaaacagtttactatatatagacaatacaataaggagatcagtgaattgtgaacagtaaaccataaagcaacatcctctgtaatcaatcagtctttctccatggctcattaaaggaaagcatccaatttacccagcttgcaaaaagagtggtgaatttcagtttgaattgtacacatatctacattttttgtgtctgttattagtagattgcctgtttatttctgttcattccccatggcttgtccttgacagagaaaagagattttaacttttaattgtttataaagaatagaagagtctatgagtttatgttatgtgatggtttgatatgagacaaggtttgagaatgactgaattgatcttagcctgatactcttccctagatgtctgtcttgtgatatttttattaatgatgacacatgtataactgatgaggaagtctgtcagagaacataaattgtctgacaccactagtatcttacctacaatccaaggccttttaactataaagaggtaacctgtcagccttattccctgtatttatttcaaaaagacttaatcaatttaataggctgcctttaataaatctatttgcttttatttatttagtggaaatgtttagctttctagcttttaatgtgttatgtctgataacttaccatctgacaaaatgctgaaggtccttatctatagcatgtccctgcattctttctggatctctgtttgatctacttatctacaacatcctagaga

SEQ ID NO: 77127 - DNA, 1200 bp, Homo sapiens
acttttcagatagttctaataaatttactaatgttctctgatttatttattcaaatgcgctatgaggcaagcaaagattcctctcacttatttttctgtaaatagagacagaatggtaacattgttattatttctaaattaactttgacccatgttttgaaacagctggcatcaactcacagcaaagtgaatgtgggtttccaggagatttttaggtgatgccttaatctgttaaaacaattggggaaaattatgcaacaaacatgaaaatttgttttagtataacattagttatctaggtttgggaactattgcaatgagcttcttgctaaacttgatgctatttaataagtcagaataaagaatgttcatttcatgtatttttgtttgttacatggacacggaataggctagtgaataactgaatttatacattctttatacttgttggcaaggctgtttccaaaatgaagacaatgcagcagggagcagagcgttaaggttggtatggattctggaccagactacaaaaaccagtcagcataattgttggaagaaatttttgagacctgactaaggagttactatcatctgggaacattttttgttgctattttaaataaaattaataaaatatttaatttttttctatcctacatagagtttagagactcaggcagtttggtagaggatagatattgcataatgatattaaattgggaccatagcaaggatgtatcttctaaaagagctaagggagatttagacttagataatcagatggaaacttgttctgttaaaagtcaagccagattaacatgaagcaactatcagaataaaggagaagaagtaaataaatgacttaatgcttttaatggagggataaaaattgttattaattcccagactatatattttatttttggcacctggaaaaaatctaatacgtttttatgtttttaaagagtaagatgttttatcaggtaagattaggcattcagtagtcagttgtttattttcgtgcatgagtgcgatctcattttgagggagagttcagtattaccttttcgacttctgactggttattttttcttttaaattttattttagattcagggttacatatgcccttttattgcatggctatattgcatgatgctgacgtttgggatatgatagatcttgtaaccaaagtagtga

SEQ ID NO: 77128 - DNA, 1026 bp, Homo sapiens
attgccattctaactgatgtgaaatggtatctcactgtggttttgatttgcatttctctaatggccagtgttgatgagctttttttcatatgtttgttggccacataaatgtcttgttttgagaagtgtctgttcatatccttcacccattttttgatgggtttgtttttttcttgtaaatttggatgaagttttaaactgatgtcatgtatcaggaagaacctaaaacacttttgacggaaaacatggaactttcttctctatccccactcatcctcattgtaaacatcctttttgaaggattaacatccaagataaattgaaaatggtttcttattcaattgcagtatttttcttttaaattactggtgagtttttcagatgtgtatctgttttgacaaggcaaacctaagtttcaaccaaattataagtttgattattcatggtgatctagctaagagacaacgtcattattaactgggaaattgtattctgaatttcaaacaactgacttatagatacacttaaacacatccatatatagggaactgcctctttatgatacttttttatttttagataacttagtattggaaacttctttgttctcttttttaaaataaagaagtatggcctctaattcttgcttcacaaaatatctttaagatatttgatgacttattttttcaagcaaatagttatggcagtttatttttaattttcaaattaagtttaatataggaaaaattagattttgattgagatttgaaagatcactctatgtctcattaaagaataaagtcaattttttgtgaatcccaaatacaatacaatcacttctgaaatagaacatacctgtttacaacctttgttctctcagaactactgcacaaataacatgtagatgtcgttttctttccaggagatacatgaaattatggccataaattgaaatactagcagtagaaaggaaatcatacctttttacaggggacttgaaaacaggttgaaactgataaatatcct

SEQ ID NO: 77129 - DNA, 1010 bp, Homo sapiens
gcttaaaatatttccataaaattatttcaaaaaaaatttttttgaagcataagaggtaatgttatatatacctttaagtcttttatggaccattgaaagtctattaatactgctactttcctaggcactttgaccaccagcaataccaaactacttgatattacctgaacacaccctgcaatttctttttttttttttttgagatggagtctcttgttgcccaggctggagtgcaatggtgtgatcttggctcaatgtgacctctgcctcccgggttcaagcgattctcctgcctcagcctcccgagtagctgggattacaggtgtgcaccaccacgcccggctaattttttatatctttagtagagatggggtttcaccatgttggccaggctagggtcaaactcctgacctcaagtgatccgcctgccttggcctcccaaagtgctgggattacaggcatgagccaccatgcctggccacaccctgcaagttcatatcttggctctttggaagtgcttttcctctgcttcacatttcatcttcaactgatggtaaactaattatttctcaaaactcaatgtatacctactttctgaaacattgcttggtttccaaccactctctctagacaaatggagaaatttctgagcagatgtttcccaaaacatatcttctcctttatggaacaaagttttttttttttcttttcttttctatttctttcgttccacattttcccatgatgggcaacttctttttcataggcacaaatgcaatccctgcaaaaaatttattttttcttttctattccaggtttttcccttggaaacatctccactgtagtttcttttctttccttctcattcataagctattactaataagatcaccttaataatttaagcaacaaactattcttatttatggttaatgtgcagaaatcatggaacctaaatctcttgttttaaggaaaacaagttttttttttttttttaattttactttgag

SEQ ID NO: 77130 - DNA, 1063 bp, Homo sapiens
ggttgataatattacctggtaagtggttgtatcaaatgaactgatatatgtaaagtgattgaatagtatctaggaagtattcagtaaatgttaattgctatttttatgcaaatgtcttcattttggttttactctcattagacatcactcagtccagggcctgaactgggaaactgggaagggtgacaataagaatatggtgaggaatgcacacacaaggaacaataaatcctctttgagcagctataatgtcaagggcaaatggatgtatagggaaaatgtaatttctttaatttggtctataacaaatctgattttcctcctaaaccttgaacctttgattaatctttccttcaagaaatatttgtttagtgcctactacaatgtcaggctctattttcgaaactagaaatatgaccgtgaataaaatacacaaaaatccctgtagctgtgtttcttacattctattggcaggagacagacaacaaacaaaaacaaatacataaattatagagtatgttagaaggtaataattgccatgttgagaaaacagggaaggagcttttgggggctgagctgccagtgaaagcaaagtgtaattttaaataagatcagagtgggttccattcaggaagtgccaggggagccaagaatgaaagaatgtgagcaccagaatgtattcatgtgcacatcttggagaagagcatcccatccagagagaagcacccatgcaaaggcatcgtggctgcaatgtatccggcctgtttgctgaaccacaaggaagccagtgtggctggaacagggtgagccaagaggagtgtagttttggggtttgagagaaagaaaagggtcaaagatgatggcaaagcttctgcctgaacaattgaaacatagaagtcccatgtttaagatgggaagactgatagagtaggaaagaaaattagtaggaaaaagtgaactaaacgttggaattagtttaaaatttcaagcggtcccttttagtctgtcttgggccaagaaagcttagtttcttaaataacctccttgatgcccaggaagagga

SEQ ID NO: 77131 - DNA, 1011 bp, Homo sapiens
cgggaagcagagtttgcagtggctgaggtcatgccattgcacgtcagcctggatgacaagagcgaaactccgtctcaaaaaaaaaacaaaaaccctaaaaataatagtaataatataaaacttagagttttattttattattttatttatttatatttttatttttttattacaggcgtgagctaccacacccagcctaaaacttacaattttaaaaaaattgactagaaggactactagaacagaatagaaaatctccccaaataggcccaaatactgaaggaaatttagtttacaatgaagctagaatttgaaatcagtggagatggatataccttttaataaatgtgctgtaacaactggatatttatatggaaaaatataaaaattagatctattctgacaccattcatcagtataattttaaatgggccagaagtttaatgtaaaaactttaattattcaaatactataggaagcaaatgcttttataatgtggctacagattaaatttacatgactactagctaaaattcagaggcaatcagggagtaaagattgactaatttgattgcatagcagttttttaaaatggcaaaacattttcaccataagcaaaataaaaaacaaataatgggtgcagcacaccagcatggcacatggatacatatgtaactaacctgcacattgtgcacatgtaccctaaaacttaaagtataataataataaaataaaaaatggaaaataatcgaaaaaaaatggaaacagtatttgcaagtcttatcacagacaagaggtgatattcccatatccctaatatataaacaacttattaaaaaatccaaatgcatgacaatgtctgtgaggctggggactgtgaggaaatagaccctttcaaacattgcttgtaggaatgcaaaaatggtacaatcctctgaaagtgactcagaatctagttaattttcataagcattttttgactcttcaattccccttttaggaatgtatatc

SEQ ID NO: 77132 - DNA, 1678 bp, Homo sapiens
gggaagtggtatggtcacagctcactgcagccttgacctgacaggctcaggtgatcctcccatctcagccttccgagtagcttggaccatgggtgcacaccaccactcccagctaatttttgtattttttgcagatgtggagtttcaccatgttgcccaggctggtcccagactgctgggctcaagtgatccgcccaccacggcctcccaaagtgctgggattacagacatgcctggcctataattacttttataaaaataaaataattccatgtgattgatgtctttctaagtgttgtggtgcctttcagttggtttagggtggaaattgcttttttgataagatgatatttgagtgattggacaatactgttattcttaaattttttcttttttttttaagtcttgatctgctgcttttaggatgtggttttattattgtcgggtatgggatgtgggcagagagtatgatggatggggagagtagttcttggttgttggtttcatgggggctttgaaatgatatagctgccgttagtgtggagacaatgtgggaagtttgaggtttgcctgttagagagctcgggtaattttctagatccgttcttgtctgatattaggtgatttttggttggcagtgagaaattttgcagtgtcagtcatgccttcttttcattagttggacaaacacatacatgcactcatgtgtatattcacatatacacaaaaacacacctttctgctctatgtacataatggccttttagccacagcctcccttctgttacttttcttctgcctttcccagctcagaatggtggtgtttataccctaaatgagaaaagtagccttaagtgtgtgtgtatgtgtgtgtgtgtatgtgtgtgtgttttgccttgaatgggtgatgcaacctatatggactcatgaggaaattttaaaattccaagtgtatgcacaactggaattttaatccaagctttaatgaaaacatggccttgtttagtgagtggaatatcatacaattagatgtctgaaatttacattttgataactgctcacttctgctatagtggaaaagaatacaatattcagtatattcttccaagtagatttatcttctccaaatattaaaattggatcccctgtgcatcaataatatttaaagaattggattatcctaacttttcactactcagcagagtgagagagagaaacactagatactgaaaaataaaataggaaactgcagcattggatggctaggctccagttgcttttacatagtttctaataaccaagatttttcatgctgctgactcttgattctttgtgcaaataggctagttgcagaatgataaatacaatttatataaaattaaaaacaaaatcactatctttgtttccaaccttctcttttactcagtacacgtaagtaatgctgaatggaagttattctattttttaaaaagttatgctttaagtggatacacaacaatcaatctactatgtgcaaaacaggggagattaaagaacaataagaccttgtccctctcttagaatatgctacagtccactagtgtagatacttactttaatacagctttgtatgtgttgctgtatatattaatgaattgctatatatacagataatggaggcaccatctctgcttggatg

SEQ ID NO: 77133 - DNA, 1018 bp, Homo sapiens
ggttataaaacttttctgtcagaaaccatatttcatgtgaagaagagaaaactgtcagtgatagcagagaactaagccaacactcagaaaaaaacaaagacgtgaagcaaatgagaggttcgctggtgttaagcccatgtacctatttagcctgctttatgccagtgcccttcttgatcagatacagcttttcatgccctcttgttttggtttaaactgttggactttgctgtctctcctcacagagtcctgacagattaatgttctcacagaagagactgtcagaatccttttgttttcctgtgataaattaaaaaatactcagtatcactacaagatcacgtgaaactaagtttgtgtagtttggaaatggtggctccactcctgcagctactgtgtattctgtgttccaaattctcactgtcctttcggtttctgaaaacctagagaggtaaaatatctatatgtgatatgtgtataatacaaaatggttgtaaacttgtagactgtatgatttaattactaaaactgttgtctttttatgccatatatatttgaggtctgtcattaaaactagttgtttaaatttttctctgagtcaccactttgaaagtagtatttagaagcaaatgttatgcaactttacttttgctgaaaagatgaaatgtgatgtatatacctataatgtgaaatcatctctatattagagttaatgaattgacattgataatttatacagactttcattactactgaatcgtgtaagacttgttggtgatattattcacacctcatgtcattcacaccttcaactacatgaaaaagtaagtctcaccattttgtctttgttgagttatatgaaaatgaggatcaccagccttggcaacatggaaaaacttcatctcttcaaaaaaccgaaaacaaacaaacaaaacatatatacacacacatacacatacacatacacatacacacacacaagttagctgagtgtgatggtgcatgcctatagtcagag

SEQ ID NO: 77134 - DNA, 1051 bp, Homo sapiens
cagagatatcatatcatgaactttatccacttattcacgaattcacctgtttatttatttatatcctgacttgttcgataacagatttatgcagagttgatttaatttaaaatgtacatcattatggagctgtgctgtataaaagaaacataacaagacaaacatgagctacatgtatagttttaaattttctgataataaaatattaaaaaggtaaaaagaaagtgaaattaattttaaacatgtatttatgtaacccattatatcctaaatatgatcacttcaacatataatcaataagaaaaattattgacatattttacattttgtttttcaactgagatgccaaaatccggcatgtattttacccttagagcacacctgaattccaaccagccacatttcaaatgtttaatagtcatatgtggctcatggctaacatattgaacagaatagccctagaggatcatttatactggccattttttggtcttattctttttataagagaatcatctgtagtatgattgccagggttgtcgagttctctttgggaagtccaagatgatgaatgtaacctgaagctcatattctctaatattaatcctatttatgaaaaaatcttttatatgtaaaaattatttaagggatcttacaatatagacaatttatagccataataccaatatgtaagaagggaaattaaagatgtatagaaattattttcatagattctttgaattcttaaattttctacgtaactttttaaaaaggtagggaataacacgattatgcacctgggtaacagataaagataacgagcaaatcagaaagatgaacaactcaaggatatttatttaccttcatacttaggttttctctgtgttgtatagattgtggtagagaatttggatggttgttgaatttagagtttattcttaaattcgtagttcagatttttggtttagaatatagaggctagtaaatattctgatcaagtcaaggttattttccattcagactagtttgtctgcattgcttagatacttcg

SEQ ID NO: 77135 - DNA, 1050 bp, Homo sapiens
gaatttaaaatgttaattcagataaaagacaatttacacaaaaatttacatataaagctatgaaaaggagtgtatatatgtgggtgcatgtttttcaaaagggaggggttgttgatggagtagctctagttggttctacagttcttttcttatgtaggtttggtgctttcaaagaagcaaccacttaagggatcttgccttctgtctttcatgactatgaaatcctataaatactctgagggaatataaattacaggttacgggatcagtcatcaagaaaagattttctttgtgctttttgttgttaggaattttccctattaatacaaggttataagctcctgaagccttggctaaatcagacacatcatggctgtcatggtcatcagacataggagatgtctgttggtttctaaaccacaagagaaggtaacaagtacctctgttttgggggatttgggtattgggaaggaaagggtgagacatattctggttgcctacaaaaaggatcttatagaagttacttatttgtttttatagatagtaccttatactacttgttccttattcaaggtaaaggaatgtaattgaatggttagagcatttactggggaagttgtggttttgggaaacaaaagcattttcagatcacatttgttcaatttgtgatttctgaaagatctaccaatatagctgaaaaataccaaagcctgattattccatataaattaattaattagagttaatgttatttaagagtttgagatcttttctactgcatacttcttccggagggagatttttctttcaggattttaactttgtgaattacaatcttctctaattagcatgaacttcctcttgtaccagaattctagcatattataattcttggagtcagaaaacttttcctgcttggatattaaattttcatcagttatgggtcattcttgttggggataatgtgaaatagagggaacttgtgttctggaatagttaatagaggtaaaggtggagtaaattatctgcaggaaaaagcactgggggctg

SEQ ID NO: 77136 - DNA, 1053 bp, Homo sapiens
atactgtgaactcgggtgattagggaaaatttccttgaaaaggcagggaggatatgagaattgggtgagatttagatagaaaggtggatgagagaaaattggatataagaatacaatattcacatatgtgatatgtggtgggcactcattatgctttcagcatttgtctaaatgagttaactaatgatattcctgacaaagaagcaatgtgcacacagctcaggaggtatggaggtatttgagaataggaatagacttctccttgtagagagagaggatatttttaaacaggcaaatttgagaaagaggtcttcaaaaatattatttgtagcacagagttcaacaaaagtacaaattgagaaaaaacttttgtatttacaattataaagtcattgccaactttgaatacagttttactttagtaatatgacaaaaccagatgcaagggattttataaatgagttggcgtgaaggaagtcaaagcagctagcgcagatgaactattgaaatacaaggcaatgtttgcgtgaagtcatgtcgatgagtttgtgtctattgacaatcattgataagacaaaatggcccttttactattaaattaaagaaggataaatgagagagaattgtttccatgtaatcacatataaccctctttgaagtacattatgtagaacacgactgaggagaggaaacaaacagaaatgaaataaactgactttaattgaagctgtttgccatatggaactccacagaatcagcctccatatatcctagcaatgatagcacttgatagttgatttttccatcaaaatatttattgccaatacataaataaatgaatacatacataaaaaggcatataaatgaatgctagtttggaactggttgagtatttggggcaacaatttttctttttaaatccttaaattggggaactaaacttttggatactgtggtgaagaatttcatttatatatgtttatgtcagagaaaaatgtatttctaatcgactgttttctcttttgtaggttttttcatctggtcctgatatac

SEQ ID NO: 77137 - DNA, 1017 bp, Homo sapiens
gaaatcagaaaaatagaagcaaatgagctgttgacttctagcatttactttaatgtttacactttagaccatttttaggcagcttgtggtcttttttttggtgctacagatattttaagttgtgtgagtagaataaagttgtagtcaccacacattaatttagaagcaaatttaaaccagatactctaagtaaacactaactaggatgttatgagtaatttcctgtaagattcccatcttcttaataaaaacaataataaaaataataaaatggttgaaggcaaatgatacatttttaggagttttcatttaaagtatgtttaattgaatcacatgtaaccattaagcccagagtactccttgacttttacagagaataggctgaaataacagagtgcttcccatttatgaaatgtaatgtcagatgttaagaaaacagtatagaatgcaaaaatgaagtgaatatacaatgggaagggagaggatgcatttatatgtgcagctgtggcaaagagaagggaaaaaaataaaggtgcatagaagtacttctggtttctactttctgaattagaacacagctatgatgaagccgttttgaaattactcaattggcaatgactttcctaccaactatttacaatcaaagaggttgattttaagtgaattacaggagtaaagtcaaagtttaccagttgtacccactcctgacttggacttgattgagaggcctgctattaaatccttaactcactgagggattgataactacaagggtctagaggagaaggcaaacatgttctgcactttccattaaaatcctttactattagcttgatttcatttacttccacagttgtgagtgatccctgtagtgtgggtatcaggctaaataatggtgtataccattggttgaggtgaaaaaagccgatggaataggcaacatgaaagttctgtatcatatctgtttcagttaagcaatcttagctggctttggttgaccctaaaaggaaacataaa

SEQ ID NO: 77138 - DNA, 1066 bp, Homo sapiens
atggacaaagaggtatgtgtgtatacacacacacacacatacacacacacgcacacacacacacacatatgtatatatgtaaagaaatatggatacacatacacacatgtataaggtggccagtctggggcagataaaagcaagaaaacgaaataaaaatatgttttcaatgaaggaaaacccagtgattagtagcctgaagattaccatgtaagcaatgcaatgaatttgataaatgaggccttatgggttgaagggacagctctgctacaatcaaaaggggtggacgctttctaatttgcttaacaaggtggtatttttgcatgcccatcctcaacatcaatgtgtgatgttactgaggctaccaatacacacagccttttttttaaagccttgcttttattttgactgtgtggttttagattgtgtttcttgtcatgttattattacctggtaagctaagaaatattaaaactgcatcaaaattcatataaaccattagcatcagtggtagcattaatcagtgggagaacactgcccttgctaaatatccacagaataactgactttagcatattttcctcatgtattcagtggtgatatatggtattaaaatgcattttttctaacatctgattttgctttatcaaatgttatttttcagttttacatgacaaagagaacgagtgttatgcaacccacagatttttacatattcatttggtacttttattactagcttctaaccagggcaaaaaagctaccctgaaatattatagaaagaattttctcccatccctagtatcattaaaatttattgttccttttgcttacattttatggtgaaatatttgattcttcttttgtttcagaagaatcttactgatattaatcttttgatttttgtgacatttacctgtttactctatcagaaatatatttttattagtttcactggaatctgtgaatcaacaagtgttagtgcataattgaatcatttttgttcagccagtcagcattaaagtttacgtaatgaaggttttaaatgcctgatctatatggatct

SEQ ID NO: 77139 - DNA, 1072 bp, Homo sapiens
tatcaccatgcagggcaatcattttataacatgattgtcaggagtgtgataaatctgttcctcttcctgtcttttttttttttttcataacacgtgtcatatgatatagattccatattatttattttttaatatccccttattgaaatgaagactctctgaggatagggattttagtctgttttgcttctagctatatccccagtgcctacaacagttttttggaacattgtaaatatctattgaataggtgaatgaatgaatggataaatctttgaaggttaattattataatgtttttcaaaagcctttgaaatgcaactactactttcaaaatgcttatgatttaagatgaaatgatattgaaatagttgacatctgtaaaatgatgtagctattctatgagtccttccccagtcctagatagccttctggcattagtggatttggggtcttcagttgggattggcaggtcagaatggaggctaaaataggtaaaagacccttactatatttcattaaacctaagacaccttataagatgcatcattgctgttattactagatgcatatgctcctaagaaataaaaatgctgcctcctgcctatgaaaccatcataatgctatcaagtgtaagaactcccaggtcagagatggtcaaatgtggaagatacacattttaatgttgatgaactatggaatagtaatcttttagagttgatgaatatagaaagtagagtttgggatatggagaagagctgatcttatagaaaataaaatatatattacatgttgattgattggctgtgacaataacaatactaccagcaatcagtttttcaacattttgtgccggtcactgctctaagaactttacaagtgttaatcatttaatacccacctcaccttgcagattgtgtggtattattttctccctgatgaagcaattgggacacagaaggttaagtaatttgcccacggtcttacagcaggagagtggtagggaaaggatttgaactcaggtaattaactgtgttcttaactgctttgctagtctggaaaaaagtttaga

SEQ ID NO: 77140 - DNA, 1148 bp, Homo sapiens
aagtatttgttgaaaagaaaaatcagttccatttctcttttgatcaggaatcacttgattgctgcttgttaatcaagttgatttctagcatattggtaaaacttttagaataagagcaaaaggtaaaccacaattacaagggttttctcatcttattttagaattttctacacacacaagtacacagttctcaatttaccatttgggtggatgagacatcttccaggctgcattgaatttagcaaactggacaaatgcaaacctgtcgcccagaaaatgaagtttgtttttgaggcatttaaaaaaatgtttgccataatgtcaaaccatgattttaatcatgagggaaattatatttaaccttatttgagccatagatcatagaatctggacctggaacctctgctgttggggccaaaggagcttggtaaatgtttctagtttcatttgtccggaccttagtacagtggagatgttatttattgtttatccaactcacagcctcattccaacccctggaacccattcttattcggacacatgacctttttatgttacttttgttgccactaagtatttggaaactaaggctcaggagggtcagcttatgtgactcattgtaagtgctttatttctgaatttatcactttcttacaaagctttacaaaagtggcttaatgttaatgattctttaatggcttaatgttaatgattattttatttgtataaacttgcataaaacaatatcttctcatgtttaaacttaaaatagatatttacttattcttaaaatatgtattaatcatgatgatttagtgtaatttccaaatatataatcaccatcctggcttcagggaagctagactgaaggtttttttcttgattagagaaatattcaaaataaagttaaattaagtgtatttataaatctgtactatagtgattcatatcagcttgagataagtgcttcaatgtataatattatgttggtttatctggaaataatgtataaacactttattgggaacctaatatgttatctatgctgatgtttctgtcactctattgttacttatttttattttttattataattctgttttgctgccagaaggcaaaatgttatatatgattgctactaatagttc

SEQ ID NO: 77141 - DNA, 1123 bp, Homo sapiens
tcaacgtcagggaatccctcctcctgggagccaagaggaagtctctcaaaaccagaagggaaaggtgttttccccacatcagtccagctttggagacattctgttagtgacgtatgccccttcccccaaaaacaacaatgaagtgttctgtgtgctaacaacatagcttaaaaaaaagtaaaattatgcagttttataaaacttgataaaaaatagtatttcaaactgtgcagtcaacagaagtttacacagttatcaaaaatgcacacacttcacttggcgtctccagcaccttcagttttatgtgcctggtctgttttggcatctccattttctacagggctattcccctccttgccagcatcagcttttccctttttccctttgggtactttctctcccttctttgcaggggcctttttacgcttgggttctggctttggaggagcaggtttagctgacaacctcatggatcttctgtgtgattcgtccttcaccttggctttatctcctttagcatccccttcagcctttctcttgggcatggtggcggcaggatgtaggtggtggacgcgggatgcagtggtgcacgggctttggttggttaggggttcgttctcgcctcttcttcacactgctcccattttgaagtgttaagatttgacttccctgttggattttggacttgcatggggccagtagcccctttgttttggccaatttctttcatttggaatggctgtatttactcaatgcctgtacccccattgtatctaggaagtaactaacttgcttttgcttttacgggcttatgggcggaagagacttgccttgtctcagatgaaactttggagtatggacttttgagtggactgttgggaaggcatgattggttttgaaatgtgaggacatgagatttggaggggccaggggcggaatgatatggtttggctctgtccccacccagatctcatcttggatccccatgtgttgtgggagggacctggtggaaggtatttgaatcacgggggcaggtctttcctgtgcttgtctcatgatcatgaataagtctcatgagatctgatggttttgtaaagcagagtttccctgcacaagctccttt

SEQ ID NO: 77142 - DNA, 1065 bp, Homo sapiens
aaagcacctaattttatataacccaaaggaaatatttaatgttactcatctgtgtttctctttcatcttgtcagcacatcaatagaaaatgtcttttaaatttggttcaagatttggattgtaaagataatgaaatattgacatactctttacaaagccctctacatgtttaataaagacttacttgaaattgtctcagagcaatggtaattatacaacttttaaagtttgcttcatgggtattattttagcccttgatcctgctgatgaaaatgctaaaatatgattattttgctgaagtcacgtatttaaaaagaaagtatgttggatagatctaaaaggtagaaaaatccctttgctctatgttcataaccacacattggtcctccctcccttctttccttccttcacattgtttcttttcacttgccatcatggtatacattggaaaaaaatctcaaatatgtgagcactaaaaaaattatttgtaatagcctaataatgctcttattcaagattcctggctttccccttgtcctaacttagtagttattttacaatttcttatgggttaggggaagaatttgagtcctcttgggttagtttggtttggttgtatagagtttgggtgtgaaaaacaattggaggaaaggtttttacaacacagcaaatattattgactgcctgttacatgccagacactgttctaagtgctggcaacatagcaaagaacacaaatgcagccgattccttgtttctcacagtggatctaaaattgatgcaggctgggagcagtggcttgtgcctgtagtctcggctactcaagaggatgaggtgaaaggattgcttgagccaggagttcaaggctgcagcgagctgtgattgtgccactgcactccagcctaggcaacatagtaagactctgtctctaaaaaataagtaaataaaaataaagttgatgcagaaagttctttgagtttgtcttgcttctaagaataaatttctttttgagaatgaaatttttttttccagttgccattgcaaaggacatcacaaagacaatgt

SEQ ID NO: 77143 - DNA, 1349 bp, Homo sapiens
gatatattaatttcaggtaataatctccagatgagtaaggattagtaaattggttggtcatacacaatcagagatttaatagcatcatttgttgtttatgttgcaaaaaaaatattttgtagatgaagtagcttagttgaaaactctttttgtattttttttttttttttactgtttggagatagtgtagagatgtgaggaaaatttaaaaatgtgtgtgattttcttgaaataaattgcagtagaaatcaggtaacattttaagttttagtatcaaactggaataatatttgatgatatagcaatgtatatgtttttgaaagctataaaacttgaaacaacaggctggcaaagtctgttgagtaactgtcaataaatggattatgatagctagaatattgaaacatcagggctcagtactatttgaaagtacattcttctgtgaataaagaacaacccttgagccttacattttatcttttaaggggttgagcgggaaaaacaggacctggagaagcaaatgtcagatttgagagtgcagctgaacttcagcgcaatggcatctgagttagaggaagtgaaacggtgcatggagagaaaagacaaggagaaagcacatttggcatcacaagtagaggtgactttgctctttttaagtcatattcgaaatattttaattttatctcatggaattgcttaatgaaattttaatataaagatgtgttattttatgaactccagtgtgagcattgataatataaagttatattaatgactgatttacttatatgtagaaattcctatgggttcatttctctttcattcaggaccccaaagccaggaacctggatgattttcctttattattttacagagaaatcctttactatttttaaatttgaaaatatttttgttctaatagcaattgaaccctttctacagacagaagggaccttttttgtttgagagaacagtgaattattatttattttgcgggtgaaactggcagaatgcatagtgaaaaggtgttaccaataattcttctttggaaccataaaggttttcagacctctagttgttctgcatgaggtggaattgcaatgcctccattaatttagagttgtgtagcaatcatggatgatatggtaaccgtgaatggagtataactaggcagctaccatttcctgcttttatctagcatagatgaggtaattatcagtatatattaaaaatcaaaggaaaagacctcataaaaggaaatggtttaattgaaattacaattatgcaaattagattaaacatggatgacacatttggaaatagatatgtatcaatcctccctgtatctg

SEQ ID NO: 77144 - DNA, 1104 bp, Homo sapiens
catttacaaatagataaatatgtacattttcaggttggttacctatcagaagtagggaaagtagggctcatgggccaaatccagactgccacctgtttttgtaaatagactttattggaacacagctactcccattcatttatgcaatgtctaggctacttttgcaatacagtggttgaattgagtagttatgacagaaatcatatagctaagatatttattatctgatcctttatagaaaatgtttgctgatgcttggtttgtaggataaattcttctaagtttcctagcaacacataaactctgttgacactccctcctcccacccttgtaacatatgagatgtattagctacttgaaacttctgtgtgtgcaattacctgaatgttaaattcagttttgtacctgtatgctttatggtatgtgctttccctaaaaacaccccaactccttctcctttgcttggtgaaattttgtattcattctttaagtctgacttagttctcagttcttcctactttagttcctcactgagacagagctaatcccttttactgtttgtactgtttctgtataatccacatgtatgtatcagcgctcttatcatcctattgaaatgcccatatgtcttccattctaatatgtacaattttgaacactaatattctgaagtgggaatgtattttatgaatgatgtataaatttaatttgttagtgttttcttctttcattgcctccttttttttttctggaaaggaaaccactagaaagacagtagttttaaaatgacagacagtatatgttccagttgttgacattttagactccatagagtactttatattttgtctctattcttgggatgtgtattattctgttctcacactgctaataaagacatacttgagactgggtaatttataaaggaaagaggtttaatggactcacagttccacgtggctggagaggcctcacaatcatgatggaaggcaaaggaaaagcaaaggcatgtcttacgtggtggcagggaatagagcttgtgtaggggaactctcctttataaaaccatcagatctcatgggacttattcactatcatgagaac

SEQ ID NO: 77145 - DNA, 1017 bp, Homo sapiens
acactaaaattgttaaaaatattttttaaacaaatggaatgcatttcagatattatgaaagacagttccaagtataattttcccctttaagtttaattttgttctaacatagaaacaaaccaaagcaaacacttttatagttaacttttgaaatgtgtattttcttaactttctttttcctcattttattaaagaggggaatctgtagaaaagaatatttgtttccaagaaaactgttagctatctaggccctctaaataatgtagtaaaattcccaaagatggggaaaaaaaggaaacaaagtgaatattaattagggtgatcaggaattgtttatattttatccccactgaagtgttcttatgagcagactgtaatttatagattttgtgtaactcatatccatgtcttcttcagccctaatacataataaattctagtagtgactttcagttttgtacatattttgggataatttttttccacctctttcattccaggcactaaagaaacaagaagctaaagcagatgagcatgagggggcaataaaaaataagctaagacaaactgaaactgagaagaatcaagtaagattttaaaagttatctttcaaagaataaagtggtttggggccaatggtatttgttgagtgccttgaaaagtgtccccaggatcctttagaacattgtgagttctttatctttctatgtggagtcaattggttcaacggctcttctacttgctaggacttgctcttgaaaacagataagcaagttgtttgctaccttgtcatctatgaccattctcctttctgagaggtgaattaaactttactttttcttgttggaaacatttaaagaacttgactttgttgcagggttagaaaagacctgtcatttggagactgaatattttggttatattcattttcattatagtggacagatatagtaagcagccagttctgaaaacattctctatttatattaaatatcaatgatctttgacatatgttca

SEQ ID NO: 77146 - DNA, 1069 bp, Homo sapiens
aaactgctcttaggagacaaacaagctttaaaggacaaaataacataattattgaaattcattggcatgtgatttttttttcttcttttataactgcttttactgggtccgttttaatataagtctaagttgcttgatttaagtcaaatggaaaagaaatccagtgcaggcttacacccttaaaaaaaggtagtaaattagttcacgtttattattaaggtttaaagaaatggcttgtgattttgatttggttgatttaaaaatatctctctttgagtattatctgtgttttcagtgtttacaggtgcatcattgatatatttaatgggtcttaagtgtcagattttccttctttgtctttcattttaaactaggtaatgtagaaaaactggttcaatattctaggctagaatattgcatttgtgtttacttgttgactgactcatggtatatagaaagcagagctagtgttcaaactcaatggcatttctagatgatatagtggaaatgtagtaatttgctttggattgttccttagtatctcactattgcttcttattgaaaacaatagaatttaagttatcattgacaaaaatttcttaagacttacatatacttacagtaaaaggagaaattgaaaaaaggagacttaaataaagttttaggcagcaagtagagctataatagaaaagtacattattttggaaaatcaatattataaacaacttatcagatgttctaaggggaaagtaaggaagaaaggagtagcacaatattattttagcaaatttctaagtatccaagagaattagagtttcttttattcaaccaacttaaacatagaaatttggatttttttaatttaatttttttgagggtctcactctgttacccaggctattattaccaataataatagttgcattttattgcacatttgctaggagccagacattgctttatgtgctctacagatatcaaaccatttagttttcaccactaccctataagtttggtattattatttcaatatgaagaagcagtgccctcagttgttaagaggcaggca

SEQ ID NO: 77147 - DNA, 2379 bp, Homo sapiens
atcctactaaccgtgagctagtgcccatatgacttttgttcttcttttatctcttctttccccactggtaactattgagattatattcactttctaggttcttgaagagtcattacttattcttttagggactctgacttctctctttattctacttaatccttcagcatatgtgtaagcgtcttgtaaagcatctgtaatgctattggggaatagtagaagtttatatgttaaataaatactctgattgctactgtgagttgtgtttaagcctgacacatattttatgttcatgccaaatattactagatctcaaattatgtttaatcacttttactttgctatgtgtacttatatgttcttgccaatattgtcattgtaaattataacaaataaggctagcgtgaatctgtgtgagtcactttgtgcagcaccatatgcaaatagacatttaatgccgttaatgctatgacgatgatgaaaaatgtctgctgcccctgttgactgaacagctgcctgacaatagactgagattttctgtgtgcaggatttgttcaatttctatgttacgcttttcttgaagagtggaatgtttctatctatgttttcagtgaatttatgctaggccatctgtttataaagcccatttccatcattatcaattaatatttattgggcaactactgagtgcatagtaatattgtacaaacaaaaaccgttttgctacagatagacttattcattggcttagtactgttttatttttattagaaaatagtgaaaaacaaaaaaaacccttctaaacccaaaggcataaaataacatcctttaactctggacactggaagatgttgtatatttacagagctttctgttcaaagatatacaacttgagaaattctaaattaaatttccataattatctatgatcttctatttgtcaacaatcctaactcagtggccctgcatttagaaagtcaaatgaagtattatattactctggatttctaataaaactatgcatctctttttgagaggaaactactcggataaaaacagaccttctactaggagcatttgttttttgattttgaaggaaatcctggaaagtgcacttgttgggctcacatttaactttacttgcaagattttattaagtaaaagattgcataaaaatataatctgttccagtaaaagcaatggcatgttagggaataatactcattaccattgttgcttttgaattaaagaagttaaaagacttgtatgtctttttagcatactggctttttcatgaagtaattaaggttttgttttgcagattggcaaatttataacatttgaagaatgaaatcctgacacttgtcaacaggggtttacctttgagttatttttgtagtcatggtattgaatttttgctgattcattcatagtctctggtctagttagccttctgtgaggcccttggctaggtttagggtaaagattgtgtccacgaaacagagcaaagggaattggtgattaaactcatgaccttgtttgggttcattggcactggatgccctaaacagtggtggattccgtaggtatgggcatagtggaaccaagaagtttgttcattggagaaaataggtcagaaaaagcatccatctcttccaccaagataattcctataagagcccttgtggattcttgggattcttgaaataataaacatcttataagaagagaaaaatgaaaaaaacaaaaaacacatctaggccattcttaaaataaaaccttgagctttatgtttaaataccatagatatctttaaggaatgttattaaggattactgttactattagaaatagtatttaacatatgatcaatcctacttaactacgtgatattggatattaccttttgaaaaagaggaattgttgtattttgtgacttgacttatgtgcttaccatttccatcgggaaaatacacacatttcaattcataccaagttttttgaatttctcccttactttgatatccctcaagtatgtatggtatcataatagtatcaatattgaattccttttggacttttatcaagcatttctacttttcacctaccaaagtgtgtggtgtgtgcggtttgttttattttttattttttaagttgtagttgttggtatagaatttcctttccttggtcatggctgaaaaataaatttctttgaacaatttaagtaatacccacctagctatttttaaattagatattggttcagggatttagaatgtgaatgcgttgttttgtttttttttgccttgaaaagaaacttaatttttttttgttttggtttttgttggcacagataatcctcaactggatgaacttaaa

SEQ ID NO: 77148 - DNA, 1016 bp, Homo sapiens
atatttgtgtttatgattgagattagttttccttgcactgacgtttttggttttagaagcatggttacattagtgtcataaaatgaattagatggattccttcttttcctatttcgtggtttagttttgtgtaagagagggattatctatttcttgaatgtctgttgaaacttacccataaaacaatttgtgtctaatatctttttggtgctgcagattactaattttttttaatgtttattgggttgtatagcctgtttattaagtcaatttggtaattcatgtttaaagtcttgctagaaatagtattattttattagttttctttttgactggctttgtttattgcttcattaacttctgctcttaactctgttactctctctttctcttcatttaaaggattattctgttttattttttaggcttgaaaattgaatgcttgattgatttttctgcttttttaaaatgaataatgaaaatttaaccaaattaccatatgctttgttatacttttatggtaattttttttcaaaatcttttataatttgttacaattttctctataactcaaaacttatttaggaatgtcttttggtattttcagagatatatgtgtgcttatttttaaactctttttattgtttttaatttaactcctttgaaagttgttgaaacttccattttgacctaattctatgaccaattttttgtaagtactccagagtaagaaacaaatatttttctgtgttttggatgcagaattttatgtgcttgtgcatgtcatacatgcatacatacacacacacatatataaatttaataggtcatttgtgaattttgttgttctgttcttctgttttcttagtacatatatctaaagcttctcattattatagagattatcagtttctccgtgtgatttgtgtcagttttcttttatctgttttgtgcatgtggtatcttatgtataattaaattacttcttggtcaattatttaaaaaatattacctag

SEQ ID NO: 77149 - DNA, 1106 bp, Homo sapiens
aaactgcacgttgttctgccagcaatggttgagtgtagctctttcccccacattcttaccagaagtagtggttataattctttaagtttttgccatctgatcagtataaagtgttaactcatttttatgtttattcacttttctctaatagtgaatttgagcatctattcacacacctcttggcagtttgcatttgtgcttacatacagtgcctatgtatgacttttgctcatttaaaaatattggattatttgggatttctctctttccccccggggattttttttttaataggagagaggaaaggatctaatttgctttttatatgactcatcagttgcttcagcatcatttttgaataaaaattggttctttccactctaatttaaatgccacatctgttgtatatctagtttcctacaatatctatctgacctctatatgctttgccattgatttgcttgtctagccctatactaatataattctttcttaattattataggttttattatcttttggtaaatgataatgaaaatctcttgtcctattccatgaaaaatcatgctggcatttttattgcgattgtattaagtacagactaatttaaagagaaggtcttttctaatgttttccaataatgttttataattgtctgtataaatgtcttagacctcttttgttagacttatttttaggtaccttatggtttttctttctatctggaatgggatttttttttaaaattgcatctctaattggttatttttagtatacaggggtacaactggcttcatatatggttcttatatccaacaattttgctcaatgcccttattagtccttataatttcttaatagctttactgacatactatcttagtgtatagataatcatatcatttgaaattaaaggcaatttagtctctttataattcttttcttttttttttatcttattgcactggttagaacctgaagtctaatattaaatggaagcaaagatagcaagaattcttgtgttacttctatatttgtatgattcttaagtgttaaatgttgtatggtgtttgcccctactttttagtgctaacctttgtcgcatt

SEQ ID NO: 77150 - DNA, 1595 bp, Homo sapiens
ttgaaattccctttaagtgtttctttggtctatacataaaatataaaaagtagaaacaacaagaaacacaaaagattcaaaacaaatgggaattcttttcatttatgaaatgatttttctaagagttctaaaaatacacttatgtgtgcttgtagatcgttaatctttattaatcgacagattttttaaagtttttttcactgttaattgaaaattaggaacaaaaattgcaacactgaaatttaatgtaagctgatagaaaaatctgcttttgttttctgaaattccatttccttccatttcacaaaagaagacatacccttgtaagttggtaattactttgaagaggatatgttgttgaataattagatacagcatgtgggtaagctttttttttttaaccttgatttttatacatttgttctcaaagcaaattatatctggtgagcataagaatagtactaaagagacaattgttcttttctgcaagagaaaattagagaaattttctgtacttattttcttctctctttgcagaatgcacaaaattacaaagaaagagggagaaaaagattgcttcccaccacttttcttaagataccagagcctgggtatttccattgaaattgtcaatttgactaaaagcttcagctgtgatttggaattccatctctgacaatacaataggagatcactattgataagaactatttaatttcatattttgttactttaatataagcagtgacctatacgtttttaaaaagtggttttagattataaacagagtagtggaagctaggaaagattaagctgatgtattttcctgctcccatgttaaatggcttaaactgttccggaaaggtcatgtttaaggagaggaaacactttcccttctttttattaaaaatacttatggaaattcctataccatatgataatagtaattgatgcatttttttcctgtttatggtgaaaaattaaatccataattgagcaggtgggcctgaacttctagccactgtgctcttttgccttcttaaaatgtatctttcaatgttaatgaaaaatatgacatttaaaacttaagacattaagagtttttatttgaaattataggatgcagagatttgaaggtataatatattacagggaggcattctgtggttttggctaaaatctgctgctgttatctcacgggtccttaggtcctcagagctttacctattcccatttaatgcaaaagcacagtgttaatcattggaaattggtcaagggaaagccattttccttttctgtaggggttttaaagaattgttcactcatttctgtttcttgtcctgatttgaacaaaagggccatgcacgcccaggaatccacttccttttttgagcctcagctactcatgtgctattgaagtcacatgaatgccagattttctttcttttttttaaaaattaattaatttattattattatactttaagttttagggtacatgtgcacaatgtgcaggttagttacatatgtatacatgtgccatgctgctgcgctgcacccactaactcgtcatctagcattaggtatatctccca

SEQ ID NO: 77151 - DNA, 1030 bp, Homo sapiens
atagaaaaggactaattaggtcgaacaatttatcattaattggctaacaaatgcaatttttagcaaaattggtattttcattctaactcaccagagggcactcttttctagtgtattacttttaactctgatctactgaattattatatcatacctcaaaaaatttgaggcatttattgggatccaggtgtcgattatttggagatcagtgatgactttcttttgtaactttcagtaagctttttggccagctatttcatgttagcgtcattagaaggggctttgcaaacaaaacaatcttaaatgctttaagcagtagtgtatctgctataaaactatcttctcaatttagtctgttttgcttgctagctctataatgctgctgtttctctgaattcttattaaggtttcagatcgggtggagcggcggcttcaggaactggagagagagatgcgcacagaaagggagctggtggaaagacgccaggatcaactgggactcatgtccctgcagctacaggaggtttgtgaaaaacactttcatggaatgtaaatcttgaatttggatgtttatttagccatgttaaaatggttattgcatgtgacagtataattcaacccatctgagaagtattaatatcacatattggttatagttcagtgtatagaatcagacctccctggtttcatacttgctgtccatgtgacattagttgggcaagtttcttaacttctctaggcgctagttttgtctgtggaaaatggaaataataatagtattgacctaattagattagtgcaaggataaatgaattaatgccaatacagctcttaacatactgtttgtcatatgctcggaaaatgttaactgaaagtataattattctgattaatttttctgggcatagactagaccaggggtcatcaaactgtggctcacaggtcaaagctggcccattgtctatttttgtaagtagttttattggagcacaaccactcctattcattgatagattgtctgtgggtgctt

SEQ ID NO: 77152 - DNA, 1237 bp, Homo sapiens
taagtaagtaagtaaagtaagtaaaatgtaagtaagtaaagtaagataacaatggaattttgtagtatgaattcttgtgctttcccaacaatgagacacattaataagtatatatttttgaaagaaataccttgattaatctcccaggtgaaatctagaatatttagataagaaccatttcttttgtgattaaaattaaatttgttgtttttcttctcctcaagttctgaggtaaaagaatagtcaaaatcacattgatcttaatgattttcttctcttgtacacagtctactagatttgctctttcagaattccttttctataaagagggtgtgaattggttgaggggcacaaattgaaaattatgattctgagaatttatggttttgttgctgacttactagggaatcttgaatacggatttacattatgtgcttcagattttacacaagtaaattgcagttggatttgagtttctctcagtggtgttaagatttacttaatatgtgtgaagtacattgatattcaactcagccatgataaaagttgtacattttacaaactgttgacttagttgattgacatactactaagattgattaggaaaaaaaagtatttggaataattaattcagtccattttctttctcaaggataccagtcggaacctgcgacaagtggaccagatgcttggacgataccgagaatacagtaatggacaggcgggtgcgatagaacatgtgagaaactacatttgtttgcattttctcctacccacctttttgggaatgaagtgttttggggaatggggctgtgagctaaaggaaaaaaccattgtgaagtgctttagattttaaactgatttattattttatagtttaagtttaggttagcttgtcagatggattgctaactagcttatataaattagattctattgaatttgaaggctttacatcagagagagtagaattcaagacatgaatttaatggagacttggtaaacttgggccatggagagacccctcatgtagagttaagaattttaaggatggtttattttaaagtaatatgtgtttattgttaaaacaaaaaatgaaaaaatcctctctcaaagcccctttttaattttttaaaatttctattgctgtagtggaacaagtggttttttggtttcatggatgaattgtatagtgatgaagtctgggattttagtgcacctgtcatccaaatagtgt

SEQ ID NO: 77153 - DNA, 1819 bp, Homo sapiens
tttttatcaacaatgtaaataatctaacttttattttttattataatgagatttaaaaattttacttagtttaacatttatgaaacttaggtaattaaagtccttagatagttgctgaatgtttcatatgcttaaaaaaagccatgcaaatttctcagatatatctcaccttaaatcttgatgtctctgaaggagttccatcagatgcaggagtttgaacatcttttattgctcacagtaacttaactttatagctgaagtctttgtgtgtgtgtactagtgaaactcatgccggaacttgtgattctgtcttagtaaaagtatgtaatcctagtggtggtgagagatcattcttttttcttgtattgtatgacgattagagataatttagtttatgttgttcttaattttttttaataccagtaagattttctgctttagagttaaattcagatgcccccgtatctttacttattaatatttatcaattcagtgcagtgtgttttataaaaaaagactttgaggtacccatgcctatgggaacagtataaaaacatagcctggagagttatacatgaaatcatgctagtgattatccctgggaaaatggggcaggagtagtactgggtgaaggaggggtggttggaaggtactaagactttatttacagtgttctaaatattttactaaaaactctcaaaggtacatatgtcagaatgataatgtttattagttcttggtgatagatacatgcatgtttattagtctgtactattttgtatcttaaatatcatccccaaatttcagttataattatttttagtcatgttgaaactcaaattgtctacgtattagaagtgtctgacatgccatttatatctggtgaagttgtcttcagataactgattattattaaaattttgatactcttagaaatatcaagttatctcaaagacagttattttgttccttgttctcattaacaactattatagtaagcacattgtctttttcaatattaactttttattctgcctgatttcttaacttcagtgatttcttaacttcaatcaagtttccagaattatgacttgttaaaatgaaaattattatgctttaagctatagaattttgatatgaaagagacagatgccaggcataattattattttctcttatataagagataaaaggaataaggaaacaaaaaccccttaatctgggaccagtggattgatttgtttcagggctttttattaaatgcattagtatagatatgtcacttagtttttttcctggtgcctagttaagattttatattattatttgatatttcccttttttcttgatatttttatgctgacatgaaatgagagggagttgagaagattatacacacatgtaggctctggcctgcacctgctctctttagcactttttgttaattgttaagattgttaattctcaggataatcggacagcagaacacagtgggaagaacatagtgttgaggacagagaaagccagctgaatcttgggtttgcattctacttataattactgtatggagttggatattatttaatatcttttagcagtagcatcctctatgaattaggggttaatagtgttcactttaataagttgttatgagaattaaattgggttgtcttatgtaagcatctgcatagtacttggcagaatagcagagtcttagaaaatgttgatttttcctgctttcactaatggaaaatgcttgatgggaagtactgtaacttagagtaaaagatgttatgttatgtggcatagatttatgaga

SEQ ID NO: 77154 - DNA, 1096 bp, Homo sapiens
agctgcagaagagtgttcactgctttttctccaattgaaagaaatacctttctcagctttaaccagaatttagatatttctgtttctttaaattgttattcaagagtttggtcattcttcaaatttagcagttcttccttttctttcagcaatgtgtcatgctgaaatttcttatgataatgagggtaaatttcttatctaattgaacttttttcttttaaatctttaaagacaataatgaagattttccttgagcatacataaatgtttttcttcttctactcttaataattcgtctttgcgcttcaaattataatagtgattaaacataacttgtgaaccatttttaattcgttctccaaagtagattttgatgcataagtgatgttggtacacattaatatatttttatatcctccaatttttatgttcattctagtagtttagaatgtttctttaagtgagtcatctttgaatctagtaactgcacttcagtaaaactacacagcgaaaataatatacaattaaaataaattttctttcagttcataaggcatgataagtgtttcctttggtcagtgaatgctcttcagtatgaaatagtaaagattggcactgtgatcccgtttcttcagctcatcagttggtgagaactagtggcatggccctacctaggtagatgccaggggactaggaaataaggtcaggaagttgccatggaggaaaaggacacagttaccaagaaaatggaagttctgaatatagagcttttatttaatcaaattttccaggtcgacagcttgttaatctgctgtcagcctgttaaccggctatctctgaagaggtctttaaatttgtttttgtttcttttaagtacacattatagttttctttctgattatactccatttgcattaatgtatattaatgcaaatcattgtagaaaattcatgaaatgtaggaattttttttttttttgggatggagtctcggttgtcgccccagctggagtgcagtggcgtgatcttggctcactgcagcctccgcctcccgggttcaagtgattgtcctgtctcagcctcctgagtggctggga

SEQ ID NO: 77155 - DNA, 2000 bp, Homo sapiens
ttgcagcattgatttgagtattatgtaaagtatctagcacagtgcctggcaccctgcaagtgctcagcatttgttgtttattttttattaattatgcagattagtgttgtctaatacaaatacagtgtgagccactcaggtgaatttaaattttgtagtacccacattaaaaaagtaaaaagaaactggtgaaattaaataatagtttatttagcgcaatatagaaaaatgttttcaatggagtaaatataaaacttattgagatttttacttttttttttttgaggagtctggctctgtcgcccaggctggactgcagtggcgcggtctgggctcactgcaacctccacctcttgggttcaagcgattctcctgtctcagcctccggagtagctgggattacaggcactcgccaccatgcctggctgtacattaaaaaaaaaaatattttaagtcatcaaaatctcttgtgtattttacatgtatagcacatgtcagtttgacctggcaagagctagagctcagtagccatgtgtctagtgactgctgtactggacagcactagagataaggttaaaactttggcagtttcacattggcacacataaatttggttgtgcctatgactcatttcatgggtgatggtggctgttttgttagaagagtgaagtgtgcactgtgcctatgttctctcagcgtatcttgtctgccattgcataacctgggtctctttgaactgtttcttgacagtttattttgattaactttttcagaataccttttttttttcttgaaatggtttatagatgtattcccagatctaccttttatgtagacaactcccagttctctggatcacttcctgtggattcttacagattgctttgaaagcagtcacaattaattgaaaatatttctgtccacagctcttttctacaaccaaaggcattttattcttatttatttaattgtagcactgagtatgggaagaactgggcatcttataaaatatttcctttaggagtgttagactggcttggaagtataattgggtcaccacattcagcagtaacatgttaactgtattacctgacttagttaccaacttttagacatgctcatacatagtactttttggctagacttgggctgcggttcacactggagcatgaactctctggcaagccccagggatgcccaggcatggatggaagtcaccagtgacaatatgtgggctgggcacttggatgtgaagaattgtagtgaggtctcttgggcttttgaatcattctaggagcattttctctattctgtgttatgccatagtctgtacatagggacttaattttcatatttcattatttaaaaatgtttaaagttgtaggtatgtcttacccccttgttttgtttatttgtaggtggtttggggaaagtgtaggggcaaccaaagatcatcggcttgactaggccctttgccctgaacctcatgaagaaatgataggaggcagacatatgtgcctaaaaagagcgttgagctcagagaagagcaactcggagttttgggggtgtgctttgtaagtatgctttctccctgagtttctgagataacacattttttgcatatttatggtagaaaagactatgccaagaaatagagttttgggagcaagaagccccttctaatatatggtttaaaaataaaatatcgaatgattgtgtatgcagtgttgcaaaaattcagatgaacaaagtagataagttgagatatcctttataaccttaacaaaagcaacagtgatgtacctgtttctattaagcaaggaattgagaacctgctttgtctcaggcattctgtcagacaccttttacaggcattatataattcctttaccatgcttatcttttacaaaggagacagttgagtctcaggttatttaatttgcttgggattctggagccaaaagagtgatcattgttcccaggtcttctgactccaaatt

SEQ ID NO: 77156 - DNA, 1023 bp, Homo sapiens
ttttctacttccccatcttaccgtagtcctgggggactccttttgtcccccaaggagtaaaattacagtcaaggccaaggaagcatttttattcactttctaactggagtttgcctcctacaaaggaggctggtcctttaacaaaaaaaaaaaatagagcagggcaagagggcgcggccaagggatcaggcttttatccgggaaagttacccgaaggccagctatatggcatcctgggatttgcagttccttttcgggactctctcccttggtaattccttgatcatgaggccgagatggactacaactcccagacggccaagcggcggcagcggggtcctgtactcttgctgtggctgggcggctagttcaagttgccatagctgcgagtctggggagagcacagtcggttgagtcgctgcgtttggtcagttgcaccttctgggtcactggtagccgcgggagccgggtggggcctaggcgatgatccggcattaaggagctgggatcatcctccgtctcaggtacctgcccccacctcccccttgccctttttcgaccacttccccgtcttactgtagacgttttagtcccacttcccctcgtcccaggggtggggacctcagagcggcgcgggatctggggtggggccgtggatgggtggagtgtgtgcagaggtgaggggagacggcgcgcctgtcatcccgaggcctccctccctcggcaggggtgtccgcggtcaggtcctggccaggttacccagcgaatctggactacattgtccttcctttgggagcagcttgctctaccgctagcatctgtgaagctttaagggacaggagattggactcattcggtaggtcctccagaggaccgtctgacatttgcttgcctgtcctgcaagcaaatttgattttttttttaatacctgttttgtagtcacagaaagcgtgctactctcgggaacgctttattagtgacctctctttcccgtgccatcataggatttgctccagccttagc

SEQ ID NO: 77157 - DNA, 3531 bp, Homo sapiens
cttgttttctctgttttctgattgtatctctcaatttttaaaatgttgtttttgtttagatacacagaagtaaaaacaaatggaaatttcatctcaaggatggcattatgaatcttaatggaagagattatatattttccaaagccattggagatgcagaatggtgaagagttgctttttttcttttataaataaaagaaacttaaaaaaaatgtaaagcggacagtttgaaacttggggcatatgccaaccaaaacttcgtttctgcatgtcagaaaagtgcagtagaagcaaagctactggaacaaagatagaccttgacaacatagacactacttactggcaagccatggaactgtagcacctagggtttttgggtgggagggttggggttttgtgtaggaaaaccataattgttgattttaaatacaggtacctgccaccggtaattagcatgtaaagctttgtctatattccttcctccaacttgggttcaatcagaagatacttgttggaatgaactgaagaaacttcccttttgatagattgaactgaaactgcttattgtatgtggttatatttggtaaaagttgcgtgtgagctttttacaaaagggtaagaattgtgttgaattttaattcacttgtataagaaaacaatttaaaactctcataataggtcttaaatatttttacttgctattctccctcagtgatatatacctcttcctttccagctttatgaaacatctatttaagatttaaagttatcagtgatcatagtttggagataaaatttgacccaggaatgaatatttattttaattaggttttcatacttattaaatgtaattaaagacttgggtcttgtctgagttcagtggaattgaaaccacaactttaatttccttacagaaaaacttaatttgtttcttttagtgccacaccttaaaaagaaaccccaaactagctcctcaggaatatagttttattttgcaagcataccatctagctgaaattgtatacacatgaatatatgtagacttttcctgttgggctgaagtgtgtgcttataaatgtgtttagtttttaagctaaacattcagttaacagtctgtgcattgattagcatagggcaggtggtgaggacctggatttttattaaacagtttagtaattataaaagtttcttgtgtttactagtaaagaattttaaaaatctattctaattcaacaagtttttaaaatcaactttgtaatttgaggggaaaatttggggggaagaggtgggtgggccactaagttacctctctttcatttggtggcccttccaggccattgaaaataaagacgttggctccagtttgcacattgggaagaaagcatagaaatttgacttgtatattaaaaataatagaaatgtaatatgtatattaagaatgcataggtctgtattctgtaaggggctctgaagaacaatatggcactgctgtgttcagtgtgaattcactgcctgggagaactgcaggaatgcttgtcttcaccattgtgttcttacaacgaattcaactttccatggtttatcttgacaaaatttacatgtgtttaggttacttgtatattgatatatttttttaatcttcagtttttgtcttccttttgcctttgtgttttcagaagtaacacatgaacactttttaaagtacattacagagaagaaaactgtgagctattatatagtgtttcttttttaacacaaatcttttaactttaaaaaaaggcaaaaattttttttttctacttcccacccagcttaccaccttgatctctttaacttatgttctaaactttggtgttaatggtggtgtctagcatgctagtagttagattttatttagatgccataactggtaatacagcttttattttgactatattaatttagttttttgaggggaagtttgtttattctgtgactctcaaagcacacagaggttttaaaatatatattattaagactgagagaagaggaaatgggagggagtaacatcacagaagtgctgttgttcaactgttcttcaatatagttgctagtaggtttgtatttactcagtaaggaagtcagtgacctgaactacctataaaaattcagcagtgctgcagtgttgcttaagtgaaaccctttggctatctagtagtttttatgctactgaaacttggattactgtatgatattcagcttgtcttgggccctctatgtagacaaacattcatattcatagtagtgttgtatactggcctgtttttataactttatttttcaaatattaacaaccactgctttcagagtggttattttgttatttttgaagcaggaaataaccatttgtatttgcacctgcgtattgcatatgaattatggtatacttggcaaatgcttttcttttacctgtgaaaattctgaaagctggtccaagctacattgcataccaaattgtgctcttatatattatttgcatcgtgtcctttttaatcaaatagcatgttttagttttattatagtagcttttgctgtaagaatgtcacttgcttatcttttattgtacttgaattcttaatcatgcttttaacattgtatttaacaaatcatttcgtattaggttccattaaaatgtcattcctttgaaaaggcaagggatttccactttcagaatttgaaaatgaaagtagcatgtttatctaaaggcagaaaatagttcggacttggtattatgaaaataagtaatggtttctggagaggatttgtttagatttgcacagatggcgatggcaccttttacttaaattaacattaatcaacagtgctaaggaaaatttacacaaaattacaagataaaacatggaaatgtgtgcctttcagtatacaaactcttgcttggtggccatttgggtaatcagaccatttgaatgcctgagagcatgtttaatttctgtggagtgccacatatggctaaaacaactctttaatgtgcaattaatttctagagtaaaatgtctgttatgtgagggggatctttatgttgggcttttctattttttaaatgttcacatttctttctgttaattaaaatgccatcataatgtcacatttacactgttgcctcttttaaaagcaaagccactttcttgttctaagattacatcaagacttgagcagtgtgtagtaattaaaatgtgtgcttaatgagcataatagattctggttttaggaaataacatatagcttttatatgaatattttcttttgctataatgaaagtcacagattttttttttcctggcttttatggaggaatgaaaagagttgtctccctctaagagtatactatttttgattctcatagcaataatgtcaccattcttatcagagggtaaataccccttgtataggaaaacagacataatttcctcttgggagttctctttatgacttagcattttcttctacttgagaaaattcctgtttttccga

SEQ ID NO: 77158 - DNA, 1025 bp, Homo sapiens
atgactcggcctatggtgatggtattaaagttggtgagaagtagttggattttggatttgttttgaaggaagaatgttaacagcatttcctgactctgagatttgtggtagaaaagaaaaaggaatcaagaatgactcttgagattttttgatgaggattctgaaagaaggatggtgataccatcagttcagatgaggaaaagctgcatgtggagctggttggacatgccaagtctggtatgtccgttagacattcaagtcatcaatcttaagatgctacatttagcatttatgtagtgtatttagaccagagatataattagttcttaatccaacagtctttaccctacctgctgttttacctttattgtgctttgttttgctttaataagtaagcaaagtttgaatccagaagaagaacatgagagtagtttccaaataagatgaaggttgtttgattgagtgattttttttttttaagtctcaaaaagcagagctaggatcaataaatggaagttggagaagcagatttccgtaagggtaaactctgaaagattttacaagagagctgttccaaaaaggaataacttaatttgaaattctttgctcactgtttctaatcgtatttaagcagacactgcacaaccatttgccaggaatatgtcatgaagaatgtttgcactgggaggttaggccatggaattttaggaatgagatctcagaaaatatctgtacctggccgggtgcagtggctcacgcctgtaatcccagcactttgggaggccgaggtgggggatcacctgaggtcaagagttcaagaccagcctggccagcctggtgaaacccatctctacaaaaatacaaaaattagctgggcgtgatggtgagtgcctgtaatcccagctactcaggaggctgaggcaggagaatcacttgaacctgggagggggaggttgcagtgagccaagatcgtgccattgcactccagcctggataacagagtgagactctgtctcaaagaaaaa

SEQ ID NO: 77159 - DNA, 1049 bp, Homo sapiens
ctcactgcagcctcagcatcttgacctcccgggctggagtgatctttctgcctcagcctcctgagtagctgggagaaaatatttgcaaatcatgtatttgataaggatctactatccagaatatataaagaactcttaaacagcgtaacaacaaaaagataatgcaatttaaaaactggcaaagaacttgaatagacatttctccaaagaagatacacaaatagctaacaagcatatgaaaagatgctcagcatcattagtcattagagaaatgcaaatgaaaaccacactgagataaccactttacaccttctagaatagctatactcaaaaaagaaagagaaaataaatgctggtgaggatttggagaaattggagcccttgtgcattgttggtggaaatgtaaaatggtacagctgctgtgggaaacagtttgatagtcctcaaaaattcagtatagaattatccatatgacccagcagttccactcttaaatatatacacaagagaactgaaaacatgtttttcaacaaaaacttgtatgtgactgttcatagcagccctatttatgatatccaagtggtataaacccaaatgttcatcagctgataacagtggaatattatttagccataagaagaatgaagtattcgtatatgctacaacatggatgaaccttgaaaacatgctatgtgaaagacatcagccacacaacgccacatattatatgattccatttatatgaaatatccagaataggcaaatccatacagacagcagattatagattgccaggggacagggagaatggggagtgacagcttaataggtaagagtgatgaaatgttctggaactaggtagtggtgagtgttatatacactgtaaatgttcattgcacctgaattgtacatgtacaaatgctaaaatagtgaatgttgttaacttgaattttacctcagagatttttttttttttttttgagacggagtttcactctgctgcccaggctggagtgcagtggtgcaatcttggcttactgcaggctccg

SEQ ID NO: 77160 - DNA, 1426 bp, Homo sapiens
tgctcaataaatgaagcagttatctttagaaaatccttattttctagaaatttgataaaatagaaatttaatgggtcactacactagttaaactaattgcttttgtactttggtagtttttaactgtgtatgaaatatggccattctggtgaatcttaagcatttgtttctatttctgtgtaccatacttgatcctcttaactagttactgttatgtggttttcttttgctttaggtgctggctcctcttcctggagggatttcaccacagacaggtgtcatcatccagcctcagcaaatcttatttacaggaaataagactcaagttatacctacgacagtggcagcacctacaccagcccaagcacagataactgcaactggccagcagcaaccgcaggcccagcctgctcaaacacaagctccattggtcttacaagttgatggaactggggatacatcatctgaagaagatgaagatgaagaagaagactatgatgatgatgaggaggaagacaaagagaaagatggagctgaagatgggcaggtggaagaagtaagtttctagtaacatacttaaaataatctacttgattatttccttttttagttggtacaacactgataaattatatcctgtttttttcagagactgttaggtgctgtacaacataagattttaaagataaagttagattgttttaactttagtaaggtttttatattctggctatatttatcttcataaaatataactttcatatagctggtaataaaaaatgtataacaaattaaattgtattaatatgtgtagtaaagagtacaggtaattctaactctggcttacgcatttataatgtggcttaaacataagacattggtagataaatagatgtggttaatcttttgcttcagtaatttaaaaagcgtggcaacatttggggagagagcaaactcaagaaccaaatgtcacaaatttattaaatatttaaaaccttttggtccatgttctataccacttccttaaaaacctatgtacccttaatgtctgtgttcttctagaagcatataaatatgcctttgttttcctcactatttcagcttagttactaggctccaaaaactatttgtcccaccacaattttcactgttaattgccttcgttagcctaaaatgcagtctttttgtttcttagtacaaagttcttctaaattatctaagtaattttttttctgaagaaaacatagtttattattgaatattgaatagacacaaatgaatagaaatgtttcaagataaaaatcatcctggtgcccaccatctagttaaaataaaattccattatttaaagtgccttagatgcctctccctaatcccatcattcctaggccatcaaagtacctttgctcatacatttgtgttgatt

SEQ ID NO: 77161 - DNA, 2540 bp, Homo sapiens
tttgttttgaaaaggctatatagtgatggatttcctaagttaaatctaaaaggtttatttactaagggatttattattttatatggtacaatagttatttgctttctctataaaacatgttctttcaaagacatgtttcagattagtttttaaaatatatcttacattctggagttttttgtatactttggcaatctgaaaattcagctccataggaatttatgtaagcctaaatggactgaattagatttattttaagttaagagtggatatataacatatcttaatttatattacttggattaaagctaagaaaaagcaaatattcatagactgtgtccatagtgccttgtactctgcaagtcattttatagatactgtttcactggcatcttataagggctttgtaaaatagcccttggctcagttttacagctgaggaaaatctgagcccagaaaaggctaagaaacttgatctgtattttctctcatgacaaacatctattcagttataaaacttcctgagcattctaattcagtgcatctgcttttatgggagaggacactagaagtaaatgaaaagttcattttaatatcatttagttactcatttgcctcatttgacagtatatatatgtgtcttaaaattggtaatgacacacagtagaagagtatttgggttattttactgttgatatctagtggtacttttcatacctaattttaatgtgtactttgtatcaaataattttatccttttattcttttttgatgactgttcttcctgttgccttcagacctggcattaggattttaggtcatcataaattaaaatttgattttcttcactcagagaatattaggataatggagttatctgttctctgaaatttgcggaatcaaacatgtaattccttttacgcttaagtaacattgccattatttctgatttgtattttttccgacttttgccggtttaccactcttcaggcaacctggtggtcccctgctttcaggaggccaccatattgatgccgaacttatttggacacctgatcagcatagcacatacagcccagaactcctgggctcaagtgatcctcccaccttagcctcctgagttgctgggactacaggcatgcatccctgcacccggctgatttgtattttttaaacagctgatgaaagtggcatgagtctgtcagctgtcatatttggaagaaaaggactatgtagatttcaaaaactagtcacaactttttgagcttacttttattggattagtaactcattgtaacagtggtatcattgtatcagtaaaacagttaaccttgagttaagacaaaattatgtttgaaaatgtccagtttacttaagaatgcatagaactatttatgtttagatgttaaggtaactcactacttcatgttcctaaattcccttgcatccttaggaattgccacttaattttttttttttgatatggaaccttgtcacccatgttagagtgcagtggcgtgatctcagcttactgcaacctccagttccggagttcaagtgattctcatgcctcagcctgacacccaactaatttttttgtatttttagtagagatggggtttcaccatattggccagtctggtcttgaactcctgacctcaagtgatccacccgccttggcctcccaaagtgctgtaattacaggtgtgagccaccacgcctgggcttaaatattttttaatgttttctagtatagggtgggtatatcacagctgttatttgccatatacatttataatgtcctgagatgaaatgattgaaagcatttgagtgcagaaaacatgaaaaacatgaaaaaagttttcatcattgtatgtaaagtgttcttgtgattataaaatagcctcatggttccttgtttgcatgttcgcttgtttttttgtagccacagcaccacaagttattgttccagattctaagttgatacagcatatgaatgcatcaaacatggtaagactcagaatgtagcagtttgattggctgtacttaattctaacccacattgtaattatgcctatatatgtcctatattaactacttgaagtttattgaagactcaagcaaaacagctgttttagtttcctgaatattggatctgaagtttagcttggtacctagacattaaggttcataaaattacggaattgtttaagaataccaaaagaatggtgctttgtgagagttattccattccctactatttccgaaaaagttttagggtacctaccaagcttataatgccaagtatggttctgtttcaggagacctagtaattgcaagagggtgggaaggctaagaattgtgaacttttaaaaaatgaagatagactggatagttcagtataactatttttaaaatcaagcatttaaaaatattactctgacttaaccatagtatagtctaataagtcattatagtgtgtaaattaccacagaatacattttaaccagctgagttatattagaatttttatatttctg

SEQ ID NO: 77162 - DNA, 1196 bp, Homo sapiens
gctctagattgaacactaaacctggtagagaggaaatgtgttaggtagaagaatgaaatcgttgcacatgttttcttttcttttctttctttttgtccattatgatttttcccatcatagaacctaaggtgaaatgagaaaatagaaatggctaaacagaaaaggattgtcaattggcgtaatggaagaaggaaggacatttcaagaagtgtggagagttgggataactactaagaccttcgggcgttgccggttctttttctttatgtaggattggacagatggaaagttaggcttttcttctttgggggattgcatctatgtatctcactgttgtaaatgaatttatgttttgtatgttatttaagaatttatgttttatatgttgcagaaaattttgtattttctatttttataaggaaaaagttccatataaaaatagtttagtaatggttttgctattataaaggataatctttgattactaaagaagttgcttgtatgaaactcatcgcttaataataactgctgattaaggaattactatagaaagttcattggaagataaaaaaaagaaacaaaatcttcagtactctgatgtggcaaaaatgaggtttgatactttaaaattttgtttttgttattgtttcacttgggttagaattacagatttgttgtatttctgtgtctgtatcagtttttaaaatggaataactttataaagagattaataaaactgttgtattcatctgtccagagttatttttcacttagaaatctttaatgttctttgccttagttatgggaaaacaaactaatgcagtccagggcagtagatggatttcattcagaagagcagcagcttctactgcaagttcaacagcagcatcaaccccagcagcagcagcatcaccaccatcaccatcatcagcaagctcagcctcagcagacagtacctcagcaagcgcagacccagcaggttcttattcctgcatcacagcaaggtgagactggacttgttttcctacttatgacttggaaattaagtttgtcattatgaaagaagagaaatattctgcattttttggatcttgtcttttaaggggcacatggagaacctaaaaataaacaaaaacccctctgttgatttcgggctttttcccccctttctcttggctgagggatgtgtatgtaaa

SEQ ID NO: 77163 - DNA, 1041 bp, Homo sapiens
ttgggaacctagaagtgtaatatattttatccaggagctagatgttttgtgaaagtaggagaatccttcagaatttctagcccaccatgttgccaggtttagccacctaacctctgggcttgtgatgtgacgggctgcagtgaaggtctctgatgtggcctggagacattttctccatggtcttggggattaacagtaggggagtgataaggggattaacttggggagcagtaggtctcatcacattttataggtgagaaagtagacttggaatgtgctttgacaaggtcgtttagctaataaatggtagagccatgaacctagcccttttgcctctatgtgacatatacagtacttagcagtaagcaggaaggtaacagagttttgactagatcttgggttgttggtgaatggcacctgagatggttttgatggtcggtgacctgctctgatagcagcagtctagtttagagactaggaatttggactagtactgggattaaagggaggcaagtgagggtcctggggtacagaatgcagagacattcactctctagccctgactgggacattgaagtcagaccacctgggttatatccctattctgtctgccattagagtgatcttgaataagctacctaacttctttcttgtcagattctttttctgtaaaagggagataataatgtctatcttataggatttttgtgaaaaaactagtttgtacatgtatttataaagtacacagaatttagtaagttttagttattagtcaacacaatatacaaatgtatacctgaatcattttgggaacagaagatgaattttctccatgtaatttcagatacctggcaaagattagtattcctgattgttttcaatactatgttagtggctgggtgcggtgtcttgggtgcggtgtctcatgcctgtaattccagcactttgggaggccgaggtgggcgaatcacttgggatcaggagtttgagaacagcctggccaacacggtgaaaccccgtatctactaaaaatacaaaaat

SEQ ID NO: 77164 - DNA, 1550 bp, Homo sapiens
ttgtatagaagatgcagcatttttaggtgtagaaaatcagttctaaagatgttaggtaattttctctaggtcaaactagtggtcagtctagattgttatctactctcgcttttcacaatgaaaatctggagaattttccctatcgttaatagtagaatcaagacattctctcgaagagaatgagcatctttgagaccaaatgtttccacctccatttttgttatatatgacttttttagtacatattttataggtaacacactgatttttagtttaatggttagtttttaaatgacaaaaaatgtgacctactcaattttgaatccccagcttctaccacgatgtctgggcatatgtggttggcattcagtaagtatttgattgaagtgtttgataatagatacggcacctgaatctaactgaacaaaatagtgtaatattcttgttgtttttaaatgggccatactcttctatctgggttgtattggagttaaaaataaaacggttagactaaaatgagtttgttattttaattctctgcactgaatttcttcaggatctcattagaatttctagaatatgccctagatttaacagctggacagccagcattgtccaatagaactttctgcagtgatgaaagtgttctgtacctgtgctcttcagtatggtagccactagccacatgtgcttattaagcactcaaaatgtggttggtggaactgaggaactgaatttttattaatctaaacttaaatcactacatatggctagttgctgccatattggactgctcaggtttagacattcttgcttaataaaacgaactttaatttcatattttatggtttagaaagcctgtcattagctctagcccctctccctactttctggggccattttacaaacttatcaaaagcttgtataaggctgtaaaggaggcagtggtgaattagattgagaacaaagatgaatgatgagaatgcatgtaatttgagggttaatgaggtaagcagaaagggagatgataagaatatttcaacccaatctttgaggttatcttttgaaacactgcaggcctactttaatgtgtaaactgtgagaggtagaaaaaacacaataaaatacagccctggttttcagtaaatctatattcgaatgtaaatgtgttttggattggtgagtgtctgtgggtgggaatgacactgtagaaattctcttcaaagtgaatgataaaatcaacctgatttctagattttccaacctacctatgtccaaatgtcaagtactgtgggagatataaaacattttctctctttttaataaaacaaatgagaagagttgcctcaattggaagtatatctgaaattcagtttatctgcctctggttcagatttctcaacactggcattattgacattttgcactggttaattctttgttgcaggggctgtcctattgattgtagaatgttagcagcacaactggcctctgcccactagatgccagtagcactcttcagttgtaaccaaaaatgtctctagacattg

SEQ ID NO: 77165 - DNA, 1032 bp, Homo sapiens
acattgagagctggttttctgtatcttggattcaagtggaaatatttagattttttttattagcagttgtgttttccttgcattgtaatgactcatgaaattgtggaatatttttgccctgttgattagaatagtggttctcaaggtatagttcatggagccctggattctccccaagggttctttcagggggtccacaaggttgactaaatgcttaagtctggaaaatcatagtttgcccgtcattctttcaagtaaaagttgtattctgtgagaaaagtgaccagttaaattcacaattcaagtgcacaggtgcttttccttgagataactgtaaataagcagcagaaatgctttatgtatacttctcatttctgacaaactgaatattaaaaagatgaggactcaatgttgatattaagaaatttgattgtttgatattccgtaatgaagtgtgtttacagttgaaagatccatataattcactgaacttgtattttctgaatatccaatgcataatgttggaaaattcattcaaaatgcaagataaattaatggactttaaaagtatgaaaagttcacagttatatggtttcatattctgcattgtaactaactattaagaaactgtcacttaaaagtaccttttcttttcccaactacttaattgtaggaaggcagattttctttgtacacctccaccaaaacaaagcaaaaacagggtcagatacgagaatctagctattttcctttaagtcatttgtcattctcactcaattttatttactaaaatatggctattttcagaaaaatgttatttatgttaacatataatggatccattatttctaaacaaattagtgaaaattaaaaatttgttataatttctattagtataaatataggtggatgtaattcacatacagaaaagctctttgagggtctcagtaatttttttttttttttgagacggagtttcgctctgtcacccaggctggagtgcagtggtgctatcttggctcactgcaagct

SEQ ID NO: 77166 - DNA, 1473 bp, Homo sapiens
ataggatgtgggggaaaaaataggatgtggattgggctaattgttctatctcccactttgtagtttttaaaaaatattttatactttttgaaagttctttcacatctattctcattttactcattttaccattcaaccttctagaagccagcttctttacttcccgctcctccaagtagtatcaacggtgctaattgtaataataatagtaaacatttagagggttcatgttcattataatgtttcatagcattacctgggcagtagtagaggagaaatcctgggaaggaaatcagtataccttgttccttgggaccttaagacctgccattgtgagtgtatgagtagtttaatggtacagcttgaaagtacagactgggtcacacaacagaagttaggtgatttttaaacctgaatgttcattaggttgcagattattaccaggcagatgactcccggacataagattctccaaagtctaagatacagtggtgaggtagtaagacatacaacagagttcaaaccaagcatggaatagtagaagccagacataagcaacccgtaaagctattattgaacattacattaggtattttgactacaacataggaaattataattggaaattgtatggaccttgtagtcttaggggccttctgtttatgaactgcattaatcttaaaatttttattaaagtgtgcagtcatcaaatccagtttatggcaaatgatggtggtcgtatctttaaagtcatatatagatagttggcaaaatgactattcgttttgaatttgtgaaaacctgttatacattataagctgtgaaaaactgtctttttcaagtcttttatttttcctttaaagcctaaattatacagatctgtgattgaagatgtcattaatgatgtgagagacatctttctggatgatggagtggatgaacaagtactgatggaactaaaaactgtgagtttgtcttttttttaaaatattcctacttttcccccacaaaacattttctttagccggagatgaatctgtaatttttctataggatgaacgtatagttgagtgaagtgtgctggttttaaatcccaactctgccatgcattcttcctctgaccttaggcaagctacatttatatttcagttttcttatacgtaagatggaaattggtagtacttaccttataggtttgttttgaggattaaatggaataaccatataaaatcttagcacaatgcttgatagtagcattagcagttattattggatagttaacattctacattttatggtctaattacttgacatgtctggaagaattttgttgctttcttttttcgttttttatttttgagacagggtcgggctctgtcgcccaggctggagtgcagtggcacaatctggacttactgcaacctctgcctcccagactcaaaccatcctcccacccctgggactacaggcaca

SEQ ID NO: 77167 - DNA, 1159 bp, Homo sapiens
ccaaagggagtaaaagccgatcggggcctacttttaacattccacaattagtaacgtctgattcgtttgtttccacagtgggtacgctgcgaagactaggcttatgttacccagaggttagtcctctactaggccacgtactttaaataatttatcacgctagtggaaatgcggggtggaagaaaaccccaccagcctttggattgtaacagcacagtaactttccctggtttttaaaaatattgccaaaatactgcgactccatgtggccaacgtatagtgactgatcactttgaaatgcatgcccttgacccaccaactcgcatggcctctcgctataagagagcaagccggctgtgttccatgttcaattcaataagtgcaattcaataagcttttgacttgttctgcccaagcaaatcctgcctttatatcgaccttgcaagcagaacagagaatgctgtttggaaggcagaattcatagtacctagttttcttgtccctgggaattttgagggacttgaaatgtcgcgtggatgagtgagggagtttgtcttccagagacaaagcaaaacgaaacgtcaaagttctgtgctggtgaaaccagatttgaagaatatcaaaggcgtcttaccaaagaggaaaaaaaatgcatcttgccaagacttgaagaaagggattagagaaaccagaggccttgaatactcagaaaatgggagattgtgaatgggtgtagaggatatctatgaaccttgacatttcttttcacgccaagtccattcccctgttaacagttgcttcccagtttcctgcacagctgcatggtctgggacacttaaagaaaaaaatcacaggaaatcagtgttcttggtatattatataaagttatgattctatcaacatttgtaattcatttaatattcaggtgacagcccgaaaatttacactaaacaataccattcctgttaagttttactacatattgagaggacttcttgttacctccctattacatactcccaaacgctttgcacatggaatccctcaccttccacctagttttcccccctactattgatattcttgactaaaaggttgagtagtttcgccatcaattaaagttaaaaccactgcagacaggacagggaagaaaagctac

SEQ ID NO: 77168 - DNA, 1036 bp, Homo sapiens
ttctccatggtaaccatgtgcgaccgaaaggccgtgatcaaaaatgcggacatgtcggaggagatgcaacagaactcagtggagtgcgctcctcaggcgctggagaaatacaacatagagaagaacactgcggctcatatcaagaaggaatgtgacaagaagtacaatgccacctggcactgcatcctggggaggaacttcagtagttacgtgacacatgaaaccaaacacttcatctacttctacctgggccaagtggccattcttctgttcaaatctggttaaaagcatggactgtgccacacacccagtggtccatccaaaaacaaggactgcagcctaaattccaaataccagagactgaaattttcaaccttgctaagggaactcctcgatgtttgaacctttgttgtgttttgtacagggcattctctgtactagcttgttgtggttacaaaacaattagcacaatagcctacatctgtatttattttctattccatacttttgccccacgttgttttctctcaaaatccattcctttaaaaaataaatctgttgcagatgtgaaaagaaaaaaaaaaaagtcccacaaaccattcctggcaggcacaccccaaggccaactgagcaaccatgtgtgcatgcccccagccagagtaacaaccctgtgacctaaaccacagtgagccaaaccccaagttggctgacccactgtgtgcatacacacacacacaccaggcctgagaaacagtctgggaagcccaactccagcaaagccacatcattatcacaaattctctcagcctagaccactgagaaacacacaaatgccactagtatggattacagctgaagagactaaatggagagtacactactgtacatacctagaatcaaggtcaatgcaccccactgaactgacacccaaaggtttattggtacaaataagtgtttccctatgaagccttcttcataaaactggaaaacataacttttccaccagatgtgtagaaatcaatgtatgaacacatca

SEQ ID NO: 77169 - DNA, 1004 bp, Homo sapiens
tgatttctacacatctggtggaaaagttatgttttccagttttatgaagaaggcttcatagggaaacacttatttgtaccaataaacctttgggtgtcagttcagtggggtgcattgaccttgattctaggtatgtacagtagtgtactctccatttagtctcttcagctgtaatccatactagtggcatttgtgtgtttctcagtggtctaggctgagagaatttgtgataatgatgtggctttgctggagttgggcttcccagactgtttctcaggcctggtgtgtgtgtgtgtatgcacacagtgggtcagccaacttggggtttggctcactgtggtttaggtcacagggttgttactctggctgggggcatgcacacatggttgctcagttggccttggggtgtgcctgccaggaatggtttgtgggacttttttttttttcttttcacatctgcaacagatttattttttaaaggaatggattttgagagaaaacaacgtggggcaaaagtatggaatagaaaataaatacagatgtaggctattgtgctaattgttttgtaaccacaacaagctagtacagagaatgccctgtacaaaacacaacaaaggttcaaacatcgaggagttcccttagcaaggttgaaaatttcagtctctggtatttggaatttaggctgcagtccttgtttttggatggaccactgggtgtgtggcacagtccatgcttttaaccagatttgaacagaagaatggccacttggcccaggtagaagtagatgaagtgtttggtttcatgtgtcacgtaactactgaagttcctccccaggatgcagtgccaggtggcattgtacttcttgtcacattccttcttgatatgagccgcagtgttcttctctatgttgtatttctccagcgcctgaggagcgcactccactgagttctgttgcatctcctccgacatgtccgcatttttgatcacggcctttcggtcgcaca

SEQ ID NO: 77170 - DNA, 2016 bp, Homo sapiens
tttacataaaattagggcattctcaccaagtttctaaagatgatttctaaacattaccaaggtctaagtgctaattccccacaaaccatttcttatcttgtttaaatgagactggctttagatatcatgactcatatttatgtgtttaaggaattaaacgtgaaggagatgtataaggcaaccacaaatgtagaaaacaaatgtatgtattagtaatattctcccatgtattaactagaacaagaatgtgagatttttacatttcttctagtgtgccttagcaaatctgctggaaagagtctagttgttttgagaattgaaaaaaaaatgtgtctctcaatttgtcaattctaagcctgtaaaggcagaaactatccacagtaatgagtttggtagtgcctggagagaggcaaatgatcattggatgtaacaaaagctacaagagaatagactaaaaaaagaatttcaatatgaaaaagtaaaatctagagagatgacaaatcagcattgggtaccaagcctcaaaatacttgaactagaagccatctcttaaagttaaaagtaagaagctccaggaaaaataaagattgcatagtaaaaagggatagatggcaggattaattcaactcaacaaatatttatcaaatgtctactctggtcaggtgctgtgttagcagccagcttccctaaagggaggaaaggctagacacgaggacattgaggattgtttatttaaagtcactcataggcatgccataatggatttattaaggggaaattggggtttctgtgaatctttacaggacatagccatggagacaatcactatgttaagtaagttgctgttttcccaattgggcttcagtttcctgagacaaaaaagtgaggaagttggattaattgtttcttcaagtcctttccagctctaaagttgtgggttattttacaaaatatccattggtgccacctttcagtgactcttcctatgtttataagaaccaagaaatttaaattttgaagattggaaaaatcacctggtccatctttttccttttcacatctctctcttttttttttttttttttatcatttccccagacaacagaaacagacaaccttccaaatcctctatattgcagttgccttccacacacagatttaaaaagaggatcaaagagggtggtgaagatcaggtggaatgcttctttggaagttccactggcatcatctatcagaacaatggtgtgagcatgaagaggcacagacaggtctccaaaatagatgttaggatttgggtgctacctgacacagaagtaggtctaaccctccaagtactggggatgataggataatcaatgaggtatatatatatttgtcattttgtataaaatattgtgaaaattgaaggaggacactcagtaaacatcctgggactatttgtaagttatggcaaaaccagatgagagaaaagggacagtcccctctgtatcctcgttgtctcttagtaacatcaaattgtagttaaaaaaattttaaactatgtacaagctacaaaatagcatctctttcatggtatgtttgagtgtgtaattttagtttcttttctggttgtatttgtggtagtcagatgtgttggattgattccaactggacagagtaaggaattccagcatcctcttcctgcttgctcgtgttaccccacagatcaaaccctcaattctagttggggatgctgtctagccccacaccatgactgaagccttaagcactgttgcgcctccatgtgctttggatcagcaaccccagtggtattctaccagagcattgtgggaaagcagatgtatagtcaggtcccaacagcaaattgttgggtgtgagagttctaaagtataggggtgagggaagagaaggatatgaactcctctgaccttaagccagcattcatttaacttttatgtctacttaacaagagaacctggagaaaactaccgtattcaagagattaatcaaaatcag

SEQ ID NO: 77171 - DNA, 1085 bp, Homo sapiens
tcaagagctgtgctttcttttgagtctagggcctgctttttgactttacagcaaaaagataagaaatgtactcatgacatgtcagacaagacaatgtgaggcactttgtggggagaccattagatgatcccccttgcctgctcttgcagacatagtactagttattccttatcaaaagtttgcatttcattcatattaaatattatctggacagtttcattttttctatttggctcttcccttactgtgccttcctgcattattggcagggttcataatccttgagaacattgtttgatttaaaatattttttatttgaaatgagactgatttctattcaaatccagtggctgggagtaagagtttatttccctagaaacttatgtttctgataaatgggatccatgaaggcaaggactatatataattttttgtgtttccaacacctagcacaaagcttggaatataatagggttcagccaccttaaatgcttgccaggagggcaaacgtatactcatgaaataaaggaaaatgagtatgtattcaataaatgtttgctgaaagaatactgaccctgagactcgaaggctacttaacccttacttatcatcaaatactcataataaagccagcaagcatgcttttatttcctgaaggacttaaataattttgctttccttttactcctgcctccagagtcaagtaataaaacctgtcagcatttaggcacttaatatgctgctgaatttgaactacaatgtacctcattcacattgaaaaacatttttgtgccccaaagcatagtagcatagatgctgtccatagtcacggtgattgattgctttgttcctgcaagtcaaacagatccatgagcctgagccttgcccatttcaatggtcagtaggaaaagaaagcatttgatagagtgcacaaccagtcttcatgcagtaggtctttgttcttccagcactaaccgctgaccgttactttgcatttattttgtcaccacagtaagatggaggtctgagatagtaaggtcaaaatttgtgagataaagtcatgatttcagaggtgatatatattt

SEQ ID NO: 77172 - DNA, 1933 bp, Homo sapiens
aatcccaaggagtgtggagtgcagtgacaaagccttgcggcaaggaatcctgatcccagagtcatgatagggtgtcttcctgagtcatgatagggtgtcttcctgagtagctgaagttgcagtcaatacctgctgtggccactgcatgttgggaacagtataccagatcttcctgtttgcagttacttgtattttaccaggaaaccctgagaatggtggcttttggagaggctctttgattctggtcatgcctaaagcacgaggttcacctgactgttggagcttactgtataattaagcctccttgtcttgtctctgcttatctcacagcactggtatgtggtttgttgtgactgttacagtcaggaaaagaacctcccacatcagtgttagcacgattgccttctgatgttcatctgtcactcgcataactttctggcaaaggcagtcttgagaagttaattaagaatccatctctttcactctgtctagaaaaggttcagaaaaggtgcaaaacaaatttcctctttgggtcttactagacctttttgaggtgtctccattctttaactgttaagctttcaagacatttccctcctggctctagatcgtttagattggaacactttttccatctctctaaggtttcagtcacaggatttgctatcctgagtcacaatagacaatggaaaaaggcacaataggagactttttaattttgtgaatggacccacattctgcaaaatgggtgttgaggggaaggcaaaattaatcttagttttcttcattttggagaaaagagacattaaatataagatgatgttcagttcaagaggtagattcaatctcagtgaattcccaaattcacactgaaaaatacagtccacttctgattcctgaaacaaatatacataatacctgaggcatttgtaaggggcatttgggagttctttttatacctcatgaccaatagacagttgcatgtccctttaacccaactttataggaaatttaagctgcaaagataatttttaaagctgttttaaaattaagcttgaatgagctttcccccaaaattcagagtttgataatcacagtattggattggattgaaaaggcatctctagggtagagacgtggaaaagccatatttttctaatgttgggaacattatattctgattccaagagtcagaacgctcactccatcttctttttcttcatctgtttctgggacaattaatcttcttttccttcatccgttcctactcacctctgcttcttatttgtatcttagtgttttctcccatgaagaatacaagtcgggggacagaaagcacacttcattggatttgtagatgatgcagaaatgaaaaatatctccagtttttggctgatggattcaagattaatgtattcaatgaacaatcattggagtctaaatgtgtattgacactgggatatagaaatagttacagtattttgaaatatctgaactaagactgaaagtaaaatgatgattgaataggcattaatgagaaaccctatattctgggtttttaaaatgcaaccctctaagtacagagtggagtgtgtgtttgtggatgtgtgtgtttgtgtgtgtttatgtgtgtggtgttgatgggaacggtgttaggaagacctggtttcacggtagtttatagagaaatatttccttacagaaatggaggttcaatgttgaatcagaaatatatcatggctattcacaaagctaatgtagtcagctggtgttaataaaagccttacatgcttttattaaccctccatctagtccatatctaaatggagggttgagttcaattatgggtatcatattttaagagagacattaataagttgattgtgtccatagggaggtgaccagggttgtaaagggtctgatgatgcaagaa

SEQ ID NO: 77173 - DNA, 1056 bp, Homo sapiens
ctgctggtggtagcactgtaacttctaccttatccacggggcccctctgaattgacagaggaagagagaaaaccctgaactctcctttgacacggaagcccttggaaagagacaaccatggaattaccggattttcaagctggaagggaccttgaataacttagtcaagttatttatagatgagaaaattaaggtcgggaaggtgatgtgacgtatctagagagtcatgcagtcacatccagggtccttttcttaatatatcactggtgcctcctggtagatgaagccaaatagacacaaatattgaaataatttccaccagaagaacagatatttgcagtttttccagtatgtacaaacgtatctatttgtttcaaagtgatttctcccaaacatttaaaagtactgcatgaaggtttattattattattattataagcaacaaagacttatcggctaccctaagcaacaaaacaaattattggataggatagctcagagacctgaggaaaagactgatcaagagaagactttagacagacagcactagagtagctctggtcatagagactaatggatgtctcctcagcatgtagccttaggacaaatcatcacagactattttttgtttttgtttttttgtgtttgtttgtttgtttgtttttttgaaatgaagtctcgctgtgttgcccaggctgaagtgcagtggtgcgatcttggctcactgcaacttccacctcctggattcaagcgattctcctgcatcagtcttctgagtagctaaatttttgtatttttagtagagacaggttttcaccatgttggccagactggtctcaaactcctgacctcaggtgatccgcctgcctcgtactcccgaagtgctgggattacaggtctgaggcaccgcacctggccctattttttgtacttttgcaacttggctcaagagactaggggagaggagtgcattttgactgacgtgaccaccaagacaacatgtagcaccggggaagattatttcccaaaaggagagaaagaaaaagactgctacca

SEQ ID NO: 77174 - DNA, 1031 bp, Homo sapiens
tgagctgctttggaatgtactggattccagttaaaattctagtaatccctcattcctatacttcagttttccttacctctagagcccctgaacagtagctcatatgttctccttttccttttagacaattcctcctcgcttcaagaagatgaagaagtagagatggaggccatcagctggcaggccagcagtccagccatgaatgggcaccctgcccctccagtgacctctgctcgttttcccagctgggtcacctttgatgacaatgaagtcagctgccctttaccaccagtcacctctcctctgaagccaaatacaccaccaagtgcatctgtgatcccagatgtaccttataattcaatgggatcatttaagaagagggaccgtcccaagagcactttgatgaacttctccaaagttcagaagctggatatttcctctttaaaccgcacgccttctgtaactgaggcttcaccttggagggcaaccaaccctttcctgaatgagactctgcaggatgtacagccctcccctatcaaccctttcagtgctttctttgaggagcaggagaggcgctcccaaaacagttccatttccagtaccacgggcaaaagccaaagagattccctcattgtcatctaccaggatgccatcagttttgatgattcaagcaaaacccagtcacactctgatgctgttgaaaaactcaaacaactccaaattgatgaccctgatcactttggcagtgcaactctacctgatgatgacccagtagcctggattgaactagatgctcacccgcctggatcagcacggtcccagcctcgtgacgggtggccaatgatgttgaggatccctgagaagaaaaacatcatgtcctccaggcactggggaccgatcttcgtcaaactgacagacactggttacctgcagctgtattatgagcagggcctagaaaaaccattccgtgagttcaagctggagatctgtcatgagatttcagaaccccggcttcaaaactatgatgagaa

SEQ ID NO: 77175 - DNA, 1039 bp, Homo sapiens
gggacctgaggcttacagatcttatataattttcccactgtcccctacagcctgtttgtggcacagcacaagtccgctgtctcttgacatgctgtattccttgtggagacatttgcagtgtcctctctgatgattaaatgatgtaaacaccctctgtatcagtttgtcatgcaatcaactttatatgcaaagctgtgtattagcagaagttgccactatggattctgacaccatggtcattctcttactttaatgagtgtagtttgactagaaatgtcagtatagaaccagtcagccttgcaaacactttctgagttgttgcataaatgctttaacattcagaagcactaacctgctgcaccatccgaagggatactgagcctatttcgttatctatattaaaatcttggatccaagtgagactttccatcactacaggaagagcctgtgtgtattgagaaagttctgccattttgggccttctttattagactgtctctcttagactactttaacacttattgttagcctctgttccagaaatttgtagacagataggggtatctgatgctgattaaagtgagtattgctgtaagctgggcacagaggggcagctgatatggtgcatgcttacaaatgctgttctaaatggttttccacagacaggcacagtccagagtggctactactcccattagtcctgatgtttttgtgtcctcgcctccagccttctaataaaccactctgattgggacagccaactgccctcagtgcacagtgtcatgttatgcattggggcttgagtcatattcaagtgaggagggaggtcaaagctagcaaatcaccatgggcttaagatctaggcttaagctgtttagcctcagaaacttaatattattgtattgagaagcaagcatttctggagattgacaaatctacaataggagatgtatattgggcaatatgactaataacagttatttgttcaaaaactaaaagctactaaaaatggagtttcctctgcatgggctcagttctt

SEQ ID NO: 77176 - DNA, 1001 bp, Homo sapiens
cttagtgccatatattaaaatagagaacatcagccaggcacagtggcatagacctatagtcccagctacttgagaggctgaggcaggaaaatcacttaagcccaggagttccaggctgtagtatgccatgatcacacctgtgaattgccactgcactccatcctggacaacataaactccatctcttaaaaaaaaatagagcatatggcgcctgtagtcccatctgctcagaggctgagacacgagaatcacttgaacccgggaggtgaaggttgcagggagccacaatcacaccaccgcactccagcctgggcgactgagtgaaactccatctcaaaaaaaaaaaaaaaaaaaaaaaaaaagagtatgtatgtgtgtgtatatataaaatagagtgtatatatatatatatatagagagagagagagatttaaaagaatcaataggattctttggttgcaattaaaaaaaattaaaaaggagagtgtattgcaagttgagggtgggggctgctcacagagttgaaggggaagttaaataatcaagcagaaaggccaagctcagaaaaggccagagctagatcagctcttgggtcgctggcaaggagttatagctggtttttgctgagtaccactatcttcatgaatgagcaacaaccattttcagattcattttcattttccaaaagaaccaaataccaggcgaaaagttttgcattgatttgggttagcatgtgactacatcagggtgaggaaccttaactgacaatcccaccagtcaatctctaataaggtaagtcccttaaaaatatatcttaaacgagacttaaaaaggactaaccataaaggaaaaaattgataaattaaaccacatgtaaattaagaatgtctattaagcaaaagccaccattaagaaagttaaaggcaagctgcagcataagaggaggagatatttgcaataaatacataataacaaagaaatcaaatcctgaatatataaaa

SEQ ID NO: 77177 - DNA, 1056 bp, Homo sapiens
ttattagacgccaagagggatacccttgaataaatgccccaccttcagcatgtagaattctggggttaggttttgtctgctcagtgttcttttaaaaataatttctaggctgggcacggtggctcatgcctgtaatcccagcactttgggaagctgaggtgggcagatcacctgaggtcaggagtttaagacaagcctggccaacatggcaaaactccgtctctactaaaaatacaaaaattagccaggcatggtggtgggtgtctgtaatcccagctacttgggaggctgaggcatgagaattgcttgaacccaggagacagaggttgcagtgaactgagatcgcgtctgcactccagcctgggtgacagagcaaaactctgtctcaaaaaaataaataataataatttctgagtctgagctagattgcataaatccagagcaggtaagcgtaatgacagtgtttcaaacatacatttctgtttgggaagtcctttcagaacccatttatattcaatagacaaaagccattttcctttagcttctgtgtcctaataaaagataaagatataacagcttcagatatattatctgattatcaaccatgcccatcagatacagttgacccttgaacaacatgggagttaggaatgccacccccaagcagtagaaaatccacatataacttgactccccaaaaacataactactaaaatagccaactgttgactggaagtcttaccaataacataaaatgattaacacatattttttgtgttatatatacactacagactgcattcctacaataaagtaagctagagaaaagaaaatgttattaagaaaagcataagaaagagaaaatatatttactgttccttaagtgtaagtggattatcatcctcgtctccttcacattgagtaggctgaggaagaggaggggttgtctggggtggcagaggcagaagaaaatttgcatataagcagaccagtgcagttcaaacccctgtggttcaagtgtcaacagtagactattaattctttctcatttacaag

SEQ ID NO: 77178 - DNA, 1405 bp, Homo sapiens
attctgcttgctctcctagaatctggcgtctcttggaatgtagacagaatgggcttgcttgctgtggcccagagaccccatcaccccaggtgacagtgaccttacactggccacgtgagtgaggcaattctagaccagccagctaacctcagacacttgagtgggcctagcagagatcggacaaatccatccagatccatagactcataagcaataataaatgcttattgtttcaagctactgagttttggaatagtttgttatactaacatagccaactgatacgtagttccctggacatggtccccttatggggtctattaatgtcattataaacccttagttcaactcagtagaagagattcagtcactggatggaggggttctattaaatgggggtggtgggtcctcaattcttgtgattgtcagcattactctgagacatttttaacacagatgcctaggccttgtactagagtattcaatcaaatatctgtagatgaaggttcggaacctgtaatttttaaagctctggtaattgaccaggattaaaacccaataattcaatggtcttgtcaatcccttccattactgaaagatgcagtgattccagttcatctatacttaaacaaataacactcaggtggttcagagttcattactgacttgatagacttctagctgcaaaagtaaactttatgatcacctttggccaaaagcaaactaacccagatgctagatgggaaaaatccacagttgcatattgatggctagaatgtatattgtttaccattgtatctgcctggggtttagacatgatgcggactcatgaataaatcctggacactgggaatgtaataggaccttgctttgaggatcttagagtcaattgaaaaaaaaaatcaggtataaattacttataatgtagtaagaaaacaaagcaagcagtattttaaccattaaatttcaggtgaaattttactatggcatatgtaccagttgttgcttacaataatgctgctttacaaacaaccacaaaatctgttttatacaacaatgtgcatttcctaaccactgtgtctgtggtttgaggggggcaattggttgattttaggctggactctagaggcgggtagctttataccatgtctctcatccttcccttggcaccagccgctacctttagcatgttattctcgtggagatggcagagatggggctacaagccacagtgtgcaagctcattttaagcttctgataatgtcactaatctgttagcatcctgttggtcaaggaaagtcacatgaccaagcacagcgccagggcagggaaatgtatttcacttttttatttgttttaattttttattatattttttgagatagagtctcactctgtcatccag

SEQ ID NO: 77179 - DNA, 1088 bp, Homo sapiens
atagggttgttgagaagactgaatgaaaaaaacgtatttaaagctcttagaatagcctccctggctgtctgaggatagaccgccatcatgaatgacatggtaactatctgaactagaaagttcatgaccaaccaacgacttcagaggaaacaaatggtcattgacgtccttcaccccgggaaggcaacagtaccgtacctaagacagaaattcgggaaaaactagcaaaaatgtacaagaccacactggatgtcatctttgtacttggattcagaactcattttggtggtggcaagacaactggctttggcatgatttatgatttcttggattatgcaaagaaatatgaatccaaacatagacttgtaagacatggtctgtatgagaagaaaaagaactcaagaaagcaacaagagggacacaagaacagaatgaggaaagtcagggggactgcaaaggccaaagttggtgtcgctaaaaagaaatgaggtgtctagcagtgagctgtggagattggatcacagctgaaggggtaaaggtgttgcaatgatgttatctgtggccattgtggatttttcacaggaagatcaataaactaaaaactttcatgtgaaaaaaaagctcttaaaataatgactgatataataaatatgcttaatggatagatgtcagctcttccaataatttattattattttattatagttattatgacaatgtcttgaatccataaagagcaaatctaatctttttttcatatgacagcttcttccctgtttgaaaagtgctaaaatcctcagtcccagaaagtctgcttgtcaatttagttctacagaaatggcaaaaagttgtagatgacagtaagttcaaggcactgaggtaggtttagtatactcaagcccatgtggggaacatatggtaagatatttttaatatctgagtaataatgccttcttcccaggaatttctatccccaaaagagaggtttttaaagagtagaagtaaaataaatctaaaaagaaaatggttgggtttctttgccggttcaaaggtaatccttgctttatgatgcatataaaattttgctt

SEQ ID NO: 77180 - DNA, 1064 bp, Homo sapiens
tctgccatacagggtccttctcaggctgtgtttatgttattgctatcaggtggatttaccatacgggtggctaaaatcgtctgcatccctgatgtttgtatcccacttgaacttaagagtccagcattttccaaagtgtgtcccatgcaagaggccaaaaagatccagatgctggggccagtgtattaggtcacgctgtgccccctttgttggagatttataacatgtattcgcttattaaagactttgaaaattcccgaaattatatgtatgtatatgtataatttatattcgtatacatgtatatgtatatgtatacacacacatacatatacaaatgtagcttttcattaatctctactgcctacttggtcagatcgtggtgtacagaaacccaaacatacataaattggcaaagctgacttggaagtacatgccattttagcagtgttttctaacactgctaaagtgttagaaagctagagaaaccagaaagaaatattttgacaaactacctgtattagttaactttataaagttagccttactttgtctcttgctctgctgaacctcttggcctttttaaaaaatataaaattctagattcagcagactcaaaactatattttgccagactttctttgtatttaaaccctcataggctttaaaacaaatttagaccagatgttcttgattcatttgcatttaacggatcacagtggactcctgccagagcagtaggatatccctagagattttgaactcagtttctttttctcagaaacaagtgtttgtattctatttggattttagagtccagcatttcccaaagggtgtctcaaagtgatttcccaaagtgagtagagagttgtagcctggggaacctcaatttttgtgacaacaactttagatgctcagaaaggttctcgtcattatttaataagatcatcgcctgggctgcatgtctctgtacaagatataacatgtttctctgttgcctgttttgctgtaatcctgctgcagctcatagagctccaaaccagagtggagggcccagatttgca

SEQ ID NO: 77181 - DNA, 1064 bp, Homo sapiens
tcagataacaacaagccattttctaaagtggtttctagttactatcctaccagctgtacatgaaagacactgtggctccatttcctcagctgcacttaggattgtcatatttttctatttttgtgatcagggaagtggagaaagaaagggggaagggtaacaggatcttaatatatcatgtgatttaaattgcatttcctagattactaacaaggttgagagcatccttttttggtgccatttggatttttctttcatgaaatccctgttcagctatattcctgttggtgtctctgcctttttcttgctgatttctgggagttcctggtgcattcaatgtgtggcacatattatctcctatcctgtgaatggtcttttcattctccttatgtcttttggcaaaaataagttatttattttaatgatacagtttttttcaatttctcttttattattagtgctttctgtgtcttggtaaagaaaatatttctctactccaaagtcatgaatgcatttggctatattgtcttctaaaatgtttcttatatagccttcacactttgacattcaatctagctagaattgatttttctgtacagtttgaagtacaagtctagtttcactttttcatgtagatatccagtttttctaatacaatgttttattgttgtttattttaacatgaatacttataaatatattactcaaaactcagcttcattcattctaaatagtatgattctgcttgttaatatgggtgaaagccatgctataatttttttttctttccaacatttattttagattcaaggggtacatgtgcaggtttgttacctgagtaaattgcctgtcatgggggtttggtctacagataatttttcacccaggtaatcagcataatacccaataggtagtttttcaatcctcactctcctcccaccctccaccctcaagtgggccccagggtctgttgttttcttctttatttctgtgtgtacttagtgtttagctcccatttacaagtgagaacatgtggtatttggttttctgttcctgggttaatt

SEQ ID NO: 77182 - DNA, 1072 bp, Homo sapiens
ataattttgaaaactgctcaagtatgaataattccatctgttcatatgtgtgaaaatttaactcaaccctgtggagatggagttttctaccttaggagggtcctgtaggatgggttcccagcagacttgatgcccagtctgtaggcaagaagcagaaataaaccatgtggagggccagccccacctcaagaagtgtttctaacctggaaacccaaggagcataggggacggtgcacagcattagagtggtaaagaaaatggttcaattccaaattttctgccaatacccaacttgacccatcaatgaacctaaactgaatcaaaagctgcagagtacattcctattacccaaactaacctctcccacataagctaattccctcttgggtttcctcccatggattgtgtttaacaataaggatagagtaattggcagagctaaggccaattacacaggagagactaggcgttagccccccactcctgcccccacataatggataatgtagacattccccaagttacacagtcattccattcaggaggctgttgtgcagctcagattttaatttgaatccaaaatgtttgaatgcatgtgctgtatattgcaataataccacatatgtaactgcaggcattatgcagaaataacacagatgtttgcagcaagtagagacagtgtgagacttgctgcaatcactgctacctgctctgttcttccagtaatactaagctgagtaatggctcccaaagacattaggttgtcctccctggaacctataaatattatcatatttgggaaaagggtctttgtagatgagagtaaggattttgagatggggagataattctggattatctgtgggccttaactgcaatcacatgcatccttatgaaagtggcagagggcgattttgcttacacagaagagaaggcactgtgaagatgaaacagaaagaaatttgaaaatgctgatcttaaagattttagtgatgaagccacagccaaggaatgccggcagccaccagaagctgcaagatacaagaaacagatgcttccttaaagcctctgc

SEQ ID NO: 77183 - DNA, 1948 bp, Homo sapiens
ctgtctgcgtgagagatcatgaggggctgagccaaggcattggcagtgggattggagagggtaagctccagagctcaaactcgttctgaaacttagagctccttttccaggatgcttgacaccctcttcagatgaacagagtgtaactcactgtgggctagacataccattcctgctcccccttcctgagtgcctgtgcccctcagctcttttgctcagacccctcctttccggcttagggtacagttcaagaccacctatagctcaagctctcagaagtctcttaacactcttacttgctgctgtcctacttttggtgactaaccaccagaataggttagagagcagaggttattgttttaggttgctgtggtatctccctgcagttgacagctgcttgagggcagagatgctgttttgttctcccttgaccctcaggccctagaatgggcagaaacagtacatgttcctgatgactgtgccccccaactttgtgagacacaccggaggtactgatggctgaaaaattccatcaccacgcttctgtccagcactgtctgaggaaggcttatctcccttaagcacacttcttgagtcactctctgcttttaaacctcccacagcttctcatttccccttgaactctccttagcttttatggtcaatcaatcccttcactccatattcccccagtagatacctctgctctcatcagacagaggcttgttcagacagaaacacaccttgttaaggtctgcttctgatttttactgtcacttgcggtgatcccctgtccagaggcttccctcacttgtccctctgttggtccagaatcaaggacatccttcacatctcagaaacccacccagtcccatatggttccaactctcagagatctccctacggctaaactgtggcaattagaggactgtcataagacaaaactacttctatgacccccatcttatcagacaattgcattctcccttctacaaatttttgtataatgctgagaaagaagtagctctctgaaatggcaactccaagacttcaatgaaacttttagcatctgttggtcaatcctcctgctgatactgagtcaccactcatttgtggtgattctaaacctcattttatgattcacattctaaaaatggggtgaggtttttaccaagcaactaattccagtatgaacttaacctcacaattattgggttcttctgtgggtttccagctgcttagcacagcacttttcaaggtctgatttcttatggcttattggtgtggctcttccatggcaaatacctaaaatccattttatggatttatggtatggaatatgatggggggttccatgtgatcaatttgttccaccagtcttcattgggaccactcattgtctgtcaccagcccatgtctggtctgggacaagtgaaggaaggatagataaagttttggggctcttttttcgttcatacgttctgaggaatggtcttggtactttggccagaatgcacctatatctataatgaagaggatttagaatctgccttctgggcactgtagctgagcacatgactctacttagcattttgaacaatgactgaaaccagattctgcaaatgacagaaatgcagtggtttcatgaaatctgcattccagtcccaagacttctacgaacaagttacgcaacgttgggcgagtcatttaacaatagcagcagtgctggcgatggctaacattggtttggaatggagcctggggcacagtaagccctctgtaaggtcacctgctgttttcattgtcatcgttacagagggtttattacatccagtccttagtacttggcgtacattatcttgtttaatcctcggaattatggagtgagttttattattctttctgtacaaggttgaactgaagcttaaagaggttgagttatgagtcc

SEQ ID NO: 77184 - DNA, 1322 bp, Homo sapiens
tctccattgcctttatgacaaaacccagccttcttggcatggcctactgggccctgtctgacctgactcctagctctccagcctcctgtcttacttttctccttctggctcattgcttcgtcaaagtaaatcacctatagttcagaaaacatatctttttattcatcttctggactcagtaggggcataatacatttttaatgcagctgttttgagtggaggccttgaaaaaactattgctcttcacattccaagtcgggtaacaaaaagacatcctcataccgtctcagtgcttcatcccatccctgccccctgacctatttctaacattaatgctgaatctcaggccatccttgaacatgaacctcatttctgagcctctcgtcctcccttcacatcatgccttattcatgtccagatcccaccctgtctgtgacacacactgcaggggttggggtcagtgatgggtgatgttcaggtgtgaggttagggaggggcaggtttgggggtggacgtaggaatcagggaggttgcatacaccctttgatagcaaacaacagttttgcatgttaacgtgagtggttaagcatggctgagtgcaatggtaccctcttattgaccattttgtattgtcatgctttgttcttatagataccatcctgccagcttggaatgtccattttctccaccagtgacccctgcctcacagaactaatttctattcatctttcaaccacttgttaccttccctgttattcttcactgaccccaaattgggctaggtgtcactcctatgcacccatcgcactgctacattctcctcattgccctggtcacaccatactgtgattatttatttgcctgtctctctctccaaggcaggtgctggatcttagtcctctctctgttcttagaatttcacaagaacatccctagcaataggagatgctgaatgcttattgaatgaatgaatgaatgaatgggcgatgttctgtgacagacttctaaaaacctgcagatgctccatgagcataaataacccagagtccaataagacctattagatcatctctttatattctacgcatgtgacattgcataccagcattgattcttatccagattttaactttccgtattggccatctcttaggcacatctcaaaccctcttagccctacctgtctctgggccactggactgaatcattcggccatccgaggctactactgcaggtcctttcactacttcaggacccagatgaagtaccacgttgaagggtgtggaatctggatttctcatctgctgctaaaggatctagca

SEQ ID NO: 77185 - DNA, 1006 bp, Homo sapiens
tcctgcaagctgtggcatttcataacatacctgctctccacatttagaatttactttaaacataggggatgtcagtagtgcatttcatgtatcaaaacctcagactccactctaccaaagcagccaggcctcagtcaacagacatcgactctcgcactgtgccaagcccacccagtgtgtcctggttccttgtggctgtccctggcagttggagacacccacatgccccagccttcagtcagcagacacaaacttgggatgcgtcggtttcttgtttgtgagaggcctggttcacaaggataacatcatgatcagccaggggcccctgtgcagctgccccatgaggccactgcagcagcctgtgttttagcctttggccaggctgttttggttttatgcccatgcgtctgttttgttgggggaagagggaggggaaggattctcagaaaagggaaggacgtatcctccgctttgctgaaaacggaaataaggaattatcagttcagggtcagtagaagccacagtgcctggcttccttctgctgggctcctctggaataattttgttttgttttgaaaggcccgaaagcaacttgagccagataagttgttctagggtgacagtttttaacagggagtccacagatccctaggactttgagaagtgtgtctgtgaagtgccttaaattataattaatgttgcatgtatgtgtatttttccagagatgagagtctctggcttaaattataactcaaagagattcagagagctataattttttgtttaaaggctaagaaccagtttcaaggagaggccttcaagtctgagttgtacatcttggtcttggccctaacttgagaactcttcctggttggtgacttgtgtacgtagtgataacatcaagaaaagtgtgcagcgcaccttaggtatacctatagaaggtcatgttgcaggaagatgaagatagtttcactttttcaagtgctggaaagctggaaatctagaa

SEQ ID NO: 77186 - DNA, 1046 bp, Homo sapiens
agatgacttcttaaagctgtcctttcttgactgccatcggactatttaatctttgcctaaattatcaaaagcactgtttaatctgaatggctgcataacctcctacaaatgaagccattcagtgatttattagtaggtgaataacactggactctgatttggccctcttaacatgttcattgtattaataggaaagcactttggagctaaggatgtcaaacgtctatataaataaaatctaatcctattataaactctgtcaaacttgcaggcagttggtcctactccacttgcagtctaacctggaaaggtcaaatgacttgttgaaagtcatgcagaaatcccctggtgcttctataataactgaccctgcttcccctgacatttggtggtgtctagcttaagtcacttcatatctccgtaaggatggtgacactaagaatgacattaagatgacactagggctcctgtcatttagataggatttctcctactcatattatgccccatgggggctctcagctgtgaccccaaagggtccttgttaattttaagcttggggtgagatcattgtacacttctctttcaggcttctccctggctttcattgaaagaaggtaccattttagtgctgtgtgtccatgcaaacacaccatctgaatgaaagggcattctcaagcatatttcatgccaaatgccgagaagtagagtgggaccatcagtggctttctatctacctgaactttgaagttagacactagaccattgccagcttgatagtccttccattggctgccctttgaagttagctaactggtttaaaaaaaccaaatgggatactttaaatgaaaacagattttatttgtttgccttagaaacggaaaacatttatcttaagtttttttggtttttgtttctgtttttttttgagacagagtatcattgtgtcacccaggctggagtgcagtggcaggatctcagttcactgcagcctctgcctcctgggttcaagcgattctcatgtctctccttccccagtagctggg

SEQ ID NO: 77187 - DNA, 1057 bp, Homo sapiens
catccagagaagatcttaaaagttatacctgggaaagacacaaaaagcttgaccgaggggtaacacttgagctgagtgtagaatgatgagcaagtctcttgtgcaggcaggggtgaggtgggattggaaacaaggtagagcagagaagagaagacattccagactgagagaagtgatcaaaaggactgttacagtcagtttaacggtaaataacaagtaacccccaaatctcagtgatttataacagccaagatttagttccctctcatgctgcatgtccagtgtaagtcaggcatagttctacccctcacttgtcatcattctgggacccactgaggcttaagaaacagcttctctctgggacaatgtggatcttatttatgacaaagggaaaaaggacatgatagaacaaaactgtagcatctaaagtctgctcagaagtagcagccatcacttcagctctcatgctgttggtcaaggtaactcacatggcaaagtctgctgtccgtggtatggggaagtctaaaccagctgcagacagcaaggtatggctgagcaggaggaaaagtgctgaaggaaacaagatcaggaggtggcccagtggcagatgatgaaggaccctgggtcgggtgccaggggattgggactttatccattggcagggagcagccactgaagagttttgagttgggctttgacagggtcagattttcctgctgaacacacatttctagtggccaggtggagagaagattgaaataggtgagctaaaaagcaagaggcgatgagggccagggcaaatacggtggcctgcagtctctctctcaccatctgttacatgacttcaaattccactgctagaaactgatttagttggcgcttgagcagcttgccttcttcacaagttctctcctaaaatgcacgtgctctctcatcttgaagtcgttattttatatcacctgaagcagtggatctcaaactttagtgtgcatccgaatcacttggagggattgagaaaatgcagattgctgggcctggccccctgagttcctgaatc

SEQ ID NO: 77188 - DNA, 1091 bp, Homo sapiens
gctcagaagcattggatcttggataaaaagcctacatgatgcaaactgtggcaactgagatgtcagatctcaagatctcaaattgtacttgtgggagcacagtcagtgaccccagatgaccttgactgacctaaaagttgtgggggaagtcggatgtcagagccttaacaccagcaggtgaccatccaacctggggcaatgcctgcctgttcaccacttagcctctttctggcaagtcattagaatgtcctccatcttcattggctgcaacttgatgagctacagcctctttcctaacttcctttatgatgctagtttaggttggttataccagcttggaagtatgcttagattaagttacagcagatacacaaattagatgcaagtaaaaaaaatcagaatttctgtagtagaaactacgaaaaataaaaaggaaagtttttactttttgggtatttttttacgaataagaaaaagtgagcgttaatcagttcaaaaggaggtactgctgtgtaatgggctttgtacgttccttctcatgtcacttacgtcactacttcgccatcaaattgaacaagcttttaattagatcctgaaaattcactatgctagtagtttattggtagtattatattttgagtagaactctgattttccctagaggccaaattctttttatctgggttaatttcttttaaacataacaatgttaatgctgaattgtatattaaatcccatttctaaaaaccacacaattttttctcatgtaagttgagtggaatgtggttagttaactgaatttggaatgttcatataaataatttgttgctgctcaatccggtttcccactgcctcctctctaccgcccagtataacctcgttaattcacctctcggacttggaaagaatgtctcataagtcttgggagataagagattcaggtatcccaagtaaggattctaacttcgaaaatgaatatgtcattgagttttacacgattcaagattcaaacgtgggcaacagaaatctctgttcttggaaacagatttatttcaggatgtgaaagcccagctgtgggtttcagagtttgc

SEQ ID NO: 77189 - DNA, 3962 bp, Homo sapiens
cacacacacacacacacacacacacacacattgcaaaacgtttttaaaacaaattattttaatttctgtacttacttctggtgatgtaactttcccagttccttgcctgacattttagtgataataatggtttctatattattttcattaagattcgagatatgttcacccaacttgatatggaccagcttttgggacctgagtgggacctttacctcatgaccatcattgcgctgctgttgggaacagtcatagcttacaggcaaaggcagcaccaagacatgcctgcacccaggcctccagggccacggccagctccaccccagcaggaggggccaccagagcagcagccaccacagtaataggcactgggtccagccttgatcagtgacagcgaaggaagttatctgctgggaacacttgcatttgatttaggaccttggatcagtggtcacctcccagaagaggcacggcacaaggaagcattgaattcctaaagctgcttagaatctgatgcctttattttcagggataagtaactcttacctaaactgagctgaatgtttgtttcagtgccatatggaataacaactttcagtggcttttttttttcttttctggaaacatatgtgagacactcagagtaatgtctactgtatccagctatctttcttggatccttttggtcattatttcagtgtgcataagttcttaatgtcaaccatctttaaggtattgtgcatcgacactaaaaactgatcagtgtaaaaaggaaaacccagttgcaagtttaaacgtgttcgaaagtctgaaaatagaacttgccttttaagttaaaaaaaaaaaaagctatcttgaaaatgttttggaactgcgataactgagaaactcttaccagtccacatgcaattagacatattcagcatatttgttattttaaaagggagggttgggaggtttcttattggtgattgtcacacggtataccatactcctctccttcaaagaatgaaaggccttgttaaggagttttttgtgagctttacttctttggaatggaatatacttatgcaaaaccttgtgaactgactccttgcactaacgcgagtttgccccacctactctgtaatttgcttgtttgttttgaatatacagagccttgatccagaagccagaggatggactaagtgggagaaattagaaaacaaaacgaactctggttggggtactacgatcacagacacagacatacttttcctaaagttgaagcatttgttcccaggatttattttactttgcatttctttttgcacaaagaacacatcaccttcctgaattctttaaatatgaaatatcattgccagggtatggcttacagtgactactattataatactaaaactcagagaatcaaagatggattaaactcagtggttgatgaaagccaaaacctgtttgtactgttctatactattcaggtatctttttatttctgatagttttatattataatagaaagccagccactgcttagctatcatagtcaccattttctcactgttaacattaggaaaatcaaggctactatgcttcaggattgtctggttaaatagtatgggaaaaaaactgaagagtttcacataattacacacgtgaaataattaaagcttaaactgaatttgtatttcattttattgtcagatggtggtgttcaccagcctgtatcttgtctgagactgcattcgtatctgagcaggttttctatgcctactgatgtcagtatgtttatactaaccttcatgcttttttcccagaatccctcatctgccagaaaacttgaaaagtttattgcttgtagagttgtactgctttgatttttgaagttggggtagtagttagaactagatttaactagtctataatgaacatgaaggcttttatatatgaagttgtatacctttttgtgtttagagaattatgggaaacctggtaagcaaaactttcctcccagataattgcttccaaattcgaagagttagtcaccaagagagccatatgtatgaaagcgtatctgtgaaaggtaggaaacttaccccccctaagtgtaatgttgctttaggcaactcttgtaaatagtgagacttgtttggtctcttacatgtagagatttgagtgcagttggtacagtactttggtgtctccaccactgtcccttctccccgcttcaaaataagtgtaatccacggtagcagccacacttcctttagaaggaactgttataatttatttaaaagttgaaaaaccacccaagatgactaccaactttcacttttttcttctgccatccaccctcatttttcctttagcaagatttttatatctaactttccttccctccattgagtacgtgctttgagaaaacatttcttaaaacagtgtgtgccacctaaggctggatgggaaagtgcagtcttgttgttcatataaaaacacacttcttattagtttaccacttgcctttttctattgttaatgttctgaatttccttttcttggcttgtttctacttcattttaccctgggtcacttgctgccagcagtttgtgaatggtgtctttcaaataacttagttcttatggcttcacttaaagactgtctcaaaaatactttgctctcttcttcttttttgttcatgggacatggtacctaagcaaataggagttgggtttggtttttctcctaaaataatgctcaatacttacctaatcaaatggcatccatttgaataaaatgacaataactaaagctagttaatgtcagtgacattaaactaactccaggattcaggagttttaatgttagaatttagatttaacagatagagtgtggcttcatttgtccatggtagcccatctctcctaagaccttttctagtctgtcttcctgccttcgaacttgatgacagtaaaaccctgtttagtattctcttgtgcatttggtttgttggttagccgactgtcttgaaactattcattttgcttctagttttattttacagaggtagcattggtgggtttttttttttttttctgtctctgtgtttgaagtttcagtttctgttttctaggtaaggcttatttttgattagcagtcaatggcaaagaaaaagtaaatcaaagatgacttcttttcaaaatgtattgtttagcacttaactcagatgaatttataaattattaatcttgatactaaggatttgttacttttttgcatattaggttaatttttaccttacatgtgagagtcttaccactaagccattctgtctctgtactgttgggaagttttggaaacccctgccagtgatctggtgatgatctgatgatttatttaaagagccgttgatgcctccaggaaacttaagtattttattaatatatatataggaatttttttttattttgctttgtctttctctcccttcttttatcctcatgttcattcttcaaaccagtgttttggaagtatgcatgcaggcctataaatgaaaaacacaattctttatgtgtatagcatgtgtattaatgtctaactacatacgcaaaaacttcctttacagaggttcggactaacatttcacatgcacatttcaaaacaagatgtgtcatgaaaacagcccctttacctgccaagacaagcagggctatatttcagtgacagctgatatttgttttgaaagtgaatctcataatatatatatgtattacacattattatgactagaagtatgtaagaaatgatcagaacaaaagaaaatttctattttcatgcaaatatttttcatcagtcatcactctcaaatataaattaaaatataacactcctgaatgcctgaggcacgatctggattttaaatgtgtggtattcattgaaaagaagctctccacccacttggtatttca

SEQ ID NO: 77190 - DNA, 1046 bp, Homo sapiens
ggagatcgagaccatcctggcgaacacggtgaaaccccgtctctactaaaaatacaaaaaattagccgggcgaggtggcaggcacctgtagtcccagctactcgggaagctgaggcaggagaatggcgtgaaccctggggggcggagcctgcagtgagccgagatcgcgccactgcactccagcctgggtgacagcaagactctgtctcaaaaaaaaaataaaaaagaatgagccaccgtgcctgtcatctgttgtaaaatcttgagtgtttctaccccactttgaagatcactgtccagaactgaaaccagacgttgctaatactgattgaagttttaagtagcaaaaaattagtgtgagtttcagaagtcgcccttggaaatctctaggttaacagtgttaatgcatagatatatggctgtatgcagcatatctacacagcaaattagatgttatgttgggggaaaatgagttttttaattaagtttttcaatattaagcagttagataattaaacgaattttacccaagtaaagcttggcatttttgtttaggtgagggaaactcattttaaaatgaaaacctcaaaggtaaaataaattcgtctaatatgttcactaaatatttttacttattttgacaagaaatgcatttttgtttcttacctgtattataggatattcaccttgcgaaacgtttttatgacatggcagctgaagccagcccagatgcacaagttccagtcttcctagccctctgcaaattgggcgtcgtctatttcttgcagtacatacgggaaacaaacgtaagtggtccgtacctcttttcattaaaatataaatgatggaaggtctgtcctggaggtttgtttttcaaaagttgagaagcacagggaagagtggtcctgcaggtatcgggtgtgttcccttctcctcagctcaggtacccgaggaccttatcaggggagggataaatgcaggcataaagcagctactgcagtttttaggtagcgtttgacacttcctgacgctaaagcatttttcat

SEQ ID NO: 77191 - DNA, 1036 bp, Homo sapiens
aaaaaaaaaaaaatagtgtttgctcatcagtatgttaattcttcattgaaattagctctcactgagctcttactttttgtgtattgtatgcaataatgaggaatgtattcttgatgctgtgcggttttttgctaagactctcacagttgtctgtttccttccatgctgaatagaggcaattagagtttgttgaaatttatctgcagagtttttaattgtcttaaatgtgatagccatgacccacctcttctcattgtagctgtgttctcaatcaagggaacagaacatttaagtctagaaactttataaataaattccatatgtcatggaagaatctcaaaactttttcattattttgaaacatagtataaatcaatgggtattttcacttataactaaatcctaaagtaaggaagtttagatggaatatatcacaaaggtttttacaatagggaaatttcatcatgatttgcctcatgatcatactagtaattggggtgtggtaactacatttaaatattccagctgttccatagcatagaacttggtatttccctctgtttttgttaagcatttaagaacgtttcattcctcctcttttggttcttgctctgaattactgtcattgtctttaaaaactattttttacatttattgtttctttaacatatatgtgaataaagacagtcttgaccattctgtttttctttctcttggccctttatcattctccatacctgatgctctaattgtttagtgtttaaaccctcttcaagtaaaccttttagttacttcgtttcctgaacttaagacccacttgtgatcttatcctggggaaagtagtggtagaggagaaagaagaatgaatgccgcaagcagcttcccctttccttgttgaatcactgatctgatcctaagcaacttactaaccatttgacttccctggaatagagtgagaaaaatgattcatgttgggcttaaagatttcttctgagactaatatatgagctgattttatgtattcatgtttataaat

SEQ ID NO: 77192 - DNA, 1019 bp, Homo sapiens
caggctggagtgcagcagcacaatcacagctcactgcagcctcgacctctccaggctcaggtgatcctcccacctcagcctctcaagtagcagggactacaggcgtatgctaccacgcccggctaatttttctatttttttgtggagacaggattttgcgatgttgcccaagttgttcttcaactcctgggctcaagtgattcacccatgacctcccaaagtgttgaggttacaggcgtgagccaccgcacctggccgcaaatggtactttgcaattacaagtacacgtttttacttttcaaaatttttaggttaattaaagtagaatagcattttcaggagttaagactaaatctttttgttttttgagtcatgaacagaagccattttacgaccaaatcatttcttgttggtctgattttaattgtgtgccagatggtaccacttacttttgccttgtttgtgatcattttcaggttggtcttggacaactgcacctgcacggagggcgtggagtagaacagaatcatcaggtaactaccctgttcctagggctttgcatctcagttttagcaggaaatgatgttcccaatgtatttcttgctaagtcaataccagtatcaaacttctgtcatttaaacacccatcacaaatgagctttcaagatgtaaccaacccctaagaaagctgaagaatacaaatattagtacctactatgtgccattcactgctaggcattcaccatgcaatattggacaaaatagttttggtctttgaccttttggagctttaactttaataggagtattagatattttttaaatgatcacaccaaatataaattgtggttattcttacaaaggagatttaaaagatacaataattggttaatgggtaggaggtaccgcttgccagggaagacttctgtaaagagaagtagaaaacatttaagttgaccctggagataaggtccttccaggccaaaaagaacggtatgtgcataggcccagagacaggaa

SEQ ID NO: 77193 - DNA, 1050 bp, Homo sapiens
tgttttttacttttcatgattggctgtcttcccatttattctggtcatttattgctagtgacactgtgcctgcttccagtagtctcattttccctattttgctaatttgttactttttctttgctaatttggaagattaactcatttttaataaaattatgtctaagattaaaactggttctaagcaaaagcccttataatttttctcttatgagtaaaatgcacacacttcaaaaataaagtttatgacatctattttgattgctctaggaactatattatttatttccttgctcttagctatggccttcttgttgaagttgctgaatccattacctcaaaacctaacacttagcataaataaggtgttagtgtacttggatcaaatgacagcaaaattctgggtatgcttagctttatttgttccacgaagaatgacactgaagtacatgaaactgctgcctcctcacgtgaagttgttttacagggttacagatactgggctggcatcggcgtcctccagagttgtgaatctgccctgactcactatcgtcttgttgccaatcatggtatctatgtttccccttttaccttttaggaaaaaaaaataaatggaattaactttaaacatttctatttttattgttctatttgaagtattataaatggctcttttatgtggactcatctttaaactagttgaggttcagaagtacttttttctttatataattttgctttaggttctatttacgttgtgaaaaaagttcaatttattaatagattactgatttgcgatctatatagactactgtaaaaacagcttcctttaacaatgtgttcgtcaacgtttggcagctggaattgtacttctctctctctggaacaattcttctgattttcctccaccttattgttttatccctctatttcagttgctagtgatatctcgctaacaggaggctcagtagtacagagaatacggctgcctgatgaagtggaaaatccaggaatgaacagtggaatgctagaagaagatttgattcaata

SEQ ID NO: 77194 - DNA, 1010 bp, Homo sapiens
attcatgaaaaaccacccctatgatctagtcgcctctcaccaggccttacaggtgagagagattgtaatcaccagggattacaattcagtgtgagatttggtggggacactgatccaaaccatatcacatataatctgaaattttagttgaattatatttaaaaagttagcattaccaacagaaaagtaccctctaagagtggcttggtattggtatttctataaaaaagtgatttcagtgaattttatatatgtgtgtatatatatatatattttttttaagttttatcttgtgtcatgtaaaggccacacttaagtgtttttagaatcatgtttgggaatagtgaaagatcattcattttgtttgtatgactgcccaaaagaaagaatactaatggttgataattgatagaattaaaatccatttaaatgcatctgacgttttgtttttagctgaagaagaggctgctaagagacggcagatgcaggaagcagaaatgatgtatcaaactggaatgaaaatccttaatggaagcaataagaaaagccaaaaaagagagtaggtagcactgctaagtccacttttcccccatgacaggccattactgagacaaatagcaactacattctttaaaaagtgcactgccagagacgcagaagatttttttaagttccattacaaaaaaatgtaatataacttacgggcattagtagcattgcttttaccacactttagttaaggtaaaattgttatactgattacagtaacaaacaatgagtaaaatggcaatgattgactcaagttgtagtagtttctaagaaccaagcatgcatatactatttagaattcaaaatgacataaaacaaaaagaattgttgtcaagtacgttttttgtttttgctttgtaatttttgactggaatttaggaatttgtgcttggaaaaaacagaacaagtgattatctcgtaacatcttatgtccttttaatttcagctgacatttttatagt

SEQ ID NO: 77195 - DNA, 1020 bp, Homo sapiens
taataattcttagtttccatccttactatagtagtaaacaatacaaatactaatgagcactaaaatgggctactctaactcaagatcctgagcagacaaacagaataggtggaagcccggagtatgaaattagagatttatttttatgaacttagtaactcattctcagaaatagactaaatagacccacaagaattggatggaatgtgaagaaatacctgtttttgttggtggaggctgttggtcttcctacctttgtaacagatggagctaatgtcttttctggagaaagagagaaactaaacccccaacccattttttttttcctttcacttgatcttttctgaacaattgctgaatatagctaactttaaaataattctatgtttatttatccaatgtttgattattatttgctatacttttcacatgttttcttttaataataactaatttcccaacaagaaagattactaaattgtcttaaaatttctttgcagatgaagaaggcagccaggatgaatccttagattccaaggtatgtactaaaatgtgtattggccagtatttgctgcctgatttaaaaggatgaattatgtatcttagaaaggatatgaggtctgcaacttttgagtaacagttgaattaaaaaggacagaaaaagacagatggtattagtattagttctagtttttctggaggaagaaaaaattactgacctacaagagggaatagtaaatatttcatttcaacttgaatgtgctctgtgtgtgtgtgtgtgtgtgtgtgtgtgtgtgtgtaagtttgaagatttaacctgtgtcatttgtttccactttccagttctcaaaaataaatccagtgagctaatgcacttattggttgattgagctctcccttccaagtactaaccaagcccaaccctgcagtcagttatgagctctgatctttagatttgagggaatgtagataaaagcaggaagtagaagtataaggtatgttgggggcatgtggaggaaa

SEQ ID NO: 77196 - DNA, 1074 bp, Homo sapiens
gtgttagttaaattctaacttcaacagtcacccgcacttgtaaatcttgccctacgatggactacgtttcccaagagcaccccccgagttaatcacatgaagcgcattctgggaattgtagtctcggatgagcctctttctcccagtcttggactcacgcgctgattccggttgaacccaggggctaccaattagctggggccatgtccgtgagtcgtggtccaaccgagaaagctggtgtgggagcttcgtacaatgattggccaatgaatgacccccggggcggagcaatgggggtgggcggggagaccatggtgattggaccagaagcccgcgacggcgggcggggattggctgcgcgctgggtcagggaagcctgggaaggggcggaggaaggagactagagcaggaagagcagcggcgaggcggcggtggtggctgagtccgtggtggcagaggcgaaggcgacagctctaggggttggcaccggccccgagaggaggatgcgggtccggatagggctgacgctgctgctgtgtgcggtgctgctgagcttggcctcggcgtcctcgggtcagtatccgccccctcgggctgaaggcccagagcctccgccccccagcctctacagccggcggggccgtggggactccaggctcgggaccccgttctccctgggcacatctcgcactgggctgtcactcgctctttggctttgcttggcctgcgccaaaggggctatttaggaaggtggagtggggtggaaaaagaaggggcggtcaccctgcccacacctctctcccacgtaacaaactttgcgcgactcttctcacgaacgcggaattgactccaaaggaatgaatcctgatacaggagcccgagtggagcttcctcgaccctggggtagaggaagggtctggtctagaactctgggcttgggaattgtaagttaaataattgacaaacctggagctgtcactttggggcagaggaggatccatccagaccaggatgttgacagtagtttgcttaacacctgagatggtccctggtctgtctgtttaaaaacgaaga

SEQ ID NO: 77197 - DNA, 1051 bp, Homo sapiens
taacacatggtgtgaagaaaaaaaggtcaaagtttttcatgaaatctgtgttcacttgggctgctgaggaggggtgctaacattctctactgtctcacctagcagaactttcctcatctttaattttgacccgagtttgtgagaccttttggtttggatttctgtgcagggctgtattcccagagggatcagaccacatcacctcattagtcatatacactgatcttcacagcaaatcgtgtgcccaccaaaagccagtggttaaggaccacttggggcccagagctctgaagggccaggtttatttccacatgctgaattgttccttgacctcaatttttccctctcacagcagggcaccatgtggggaagaatgcagactccggagtcctgccagcaggacgtgtgaggagctgggaaattactctacctctgagctctccacagaactagcacacaagctcttttggaatagctgggtgttcacattaaagagggggttggaggaaggggcaacagtgcttggagaataatacttgttacacagctgtagctgagacccctctgcttatcatgaaagcttcaggcattcactttccctcttcctcgttgtaattgctccgtatctaaggcttcatagacctgcagttcctgtggagagtgggctcatatttgagagccagatcccttgacccaggttgtctgaaagatgcgcttccaaaggttaacatttcattgagtggctgacaaagcctttcaaaggatagctatggtccaattttagggggtgctgtgaagaccctgtctcctggtggggtctttattctggtgtctgagatcacaatagaggctgaagtttgcctgagtgagtccggtgtgggcttctttggaatcttgcatatgaaaaggtattgggtatctcaaaggatgagggtctttcttactgcactcatctaggtgggcagttatttatttggggtacctggctccctctctacctctgtagatataaggtcagcttttggagggcaaggcttgcattatggacatc

SEQ ID NO: 77198 - DNA, 1011 bp, Homo sapiens
catactgatggaacaagccacacttggcctcatctgaaccttgcagatgtatttttcacttaagaaatttctaatgtcaacaagagacccattctcctgaatgacaatgctgagtaggaagtaagcatacacagacttcatcctgtagcatacacagacttcatcttgtaatggaagcctagtgtaatgttctggatcctgttctgtacatgactatggatagtgtgaaccagagcaaattcctgtcttatttctccactgtgccaacttgaagcctctgttttctttccaagtagaccgagttctacattaatatgagtgaagtctctctgcagagttcctctggggcccttcgtaactgtgagtccattcagagtgatattgacattttctggaatgtttaatctgattcctgagaatggtcttcattctcatgtagaagcagcaaagacagaatgtcttaattcttttttgacctctctactgtatttgacactgctgactcgctcttctttgaagacgtgcttgcgtcttttggcttcacaagggttcattctctttctttgtgtccagatgctggaagaagacttttcatgctattcttagagacagggtctcactctgtcacccaggctggagagcagggacgcaatcagaactcactgcagcctccaactcctgggctcaagcaatcctcccacctccacctcctgagtaactggaactacaggtacacactactacatttggttattattattttttctttttttgtagagattgggtcttgctatgtttcctgggctggtcttggacttctggcctcaagtgattctgctgcctcaacctcccaaagtgccgggattataggcatgagccactgtacctggccatgccttgttttttaaggtgctttttctttcctgtttctttgagctccatattcacatacacaactgagttctgcacagtttctcttagaacttgcaaagacattttaaactcagtaat

SEQ ID NO: 77199 - DNA, 1777 bp, Homo sapiens
agtgggctgggtcagaggcaagaagcttccatggctagcttcctaagtattttttttttttttgaccctcaagactgtgatatcgataagattctcttgcctgaatttataatccccaaacctcaatttactctctcctcatgcatccctcaaatggttcccctctgtagtactttcccaatattgcagagcagaggttaaccacccacgagccttcctcacttttagttttacaatgaacagtacggagtttttctgctggcagttatgacttcagaatcagaatcaatcttacatacatttaactctattttacagatgaggaaatagaaatccagagaggctaaatgacttaaccaaggttatacaacagctctgctgggactgagtagagtgagaacccagacatcttgactcctaaaccagtgctcttcccactataccatgatactttcaaaagcaacatgctggaaaagagagagaaggtgcccattttctgtgaataatgttcatcaatctttacattacttgaaaggcagagcaaactgtaagagatactaagtaatggaggctaagggggcactgtagttttaggcaagcaagtcaatttttctttttaaggattctctaaactcgccataatggaaacatgaagcaatagcagccgaagggacagaacacttagaagcacagaaaacatgtctcattcaatctacctttcccaactatgttaggttagccttgggatgttaaacctgccaaattattcccaaggctcagcctaatcaattttgggacattctctcccaaaaggagaaatcacatctctccagtttctcacacaaaaaaagcatttgcagcattgtccaatcctagcctttcctatttctgggccctacctggactacagggagtgtgtggaagtgtcaatctaacgaaagaaataaacttagagccccttttcaacctacattaccttctcagcagcccccagcagaatcacagtcatttttggctagcaagctgagaagatctgactaggtgcccatttcatccctgcctataatatataaaagtccaatggttgaggaaggggaggagagggggtctcaggttaccccgcaagcttgctggtgacgagcgaggactttctctggggcagatcctgtggggtgggatgtgatcaccagtcaccaggttcttgtctggtcctgcacttggcagctgcttattcttcatcttggctttggccatgttgtagtctcctgagtcaaagtacttttgccctttctggagtctcttcatgaggaagtcggagcctccaggcttttgtcctaggcttgggtatttggcctttagctttgcctcttcagctctctcagggagaataccttctttctcctgcgtgtcctgcttctcctcgccggcctcctctgcagggttctcttcttcttgcttctgggacatggcgggaccgggactgtggagtgtaaggggcccgggaaggcaaccggagaagggaagggggagaggaaacggggacaacctgcgctgctgcttcggctcctatcactagggttgctcagttaaaatggcggcctttgcccctgttctggcttttcaacagtataggtttagtaaaataatggcaatgacacaacagcaataacagtccaagagcagttggcatggttggtttaacccctagcggattcagagcatatttttaaatttattaatttggtcaatatagttgctttggaattcatttaatgaa

SEQ ID NO: 77200 - DNA, 1129 bp, Homo sapiens
aaaaaatttttaaatgtctgcatactatcaaaattatgaattctttgagagcaggtatcttgacttattcataattacatctcccagaaaattaaacacaatatcttccatatagctgatgttcaagaaatatgttttgagttgttctcagattctgacattcaattttgattggacaataacatttaatccattagtgtgtgattttacgtgcataaattcagaagaatgcttgacgaagaaaatattttaataaagagtatataatcatgataatctggataaatttaatttgtcaactgttgttaaataattatttataagtagtaattagtaatacaaccaaaatgtaattgaattttttcaacaacatcattaacattaaatcccaaataaatataaaattcatataagtcgtggttagagtaactgttttttattctctatcactttctttcaaagcaattcagtagttaacttgatgagatgtgggagatgctgtgtgggggcatggaaaagtgggacctgctgttctgcttgatttttataacattcatatacctttggaagaagataacctcacatatggcttctttctatgataaatagctgtcacaataatgacagccaatgagccaaaattccagccacagccaaagtctgtgtagatgtgttgctgaaccagtcctccttgggacaagtcactgaatgacttcatagacagggcagtcttactgcagaagtcatttctttacgaaaagctatccattcacagtgggctgaagatgatgactatcaatcacctcagtgagctgctatcacagaggcaaatttctacccaagtaatgacacatatatattcattctcagataaatgtaattgtgattctttgcctagttattatggaggtaaaatcccctggtgatacaaaacacatttaaaaacataaatcttaaaatcaacagcagttccccctaaaacatccctactgtatatttgtacaaccttgaaagacagtgagatgatggtgacttttcttaaaatcaacattttttactgttttcattcctttaatgcacatactcatcatttatttgtatatctggtaaagatatctgcattgaatag

SEQ ID NO: 77201 - DNA, 1236 bp, Homo sapiens
ttgtccttagcttagtgaccacatcatatatagtaacacagagtgtaattgtttgtattccttgcatcatctatcgtgttgtcttgagcatcatatatgctgtctctacaaacatttgtagatggatttactgattggaaaatgcctttatgattgaaaagggttctgtaaatccaaaacgttttatttctctttttcttctttaaagtgttatttatactaattaaaattctattaatcgacacattccatctaacagactggttggtagtttcttttgtttaatcagactaattaaagaggatgaaattaatgttgtctttctattcaatgcagatatctttaccagatatacaaataaatgatgagtatgtgcattaaaggaatgaaaacagtaaaaaatgttgattttaagaaaagtcaccatcatctcactgtctttcaaggttgtacaaatatacagtagggatgttttagggggaactgctgttgattttaagatttatgtttttaaatgtgttttgtatcaccaggggattttacctccataataactaggcaaagaatcacaattacatttatctgagaatgaatatatatgtgtcattacttgggtagaaatttgcctctgtgatagcagctcactgaggtgattgatagtcatcatcttcagcccactgtgaatggatagcttttcgtaaagaaatgacttctgcagtaagactgccctgtctatgaagtcattcagtgacttgtcccaaggaggactggttcagcaacacatctacacagactttggctgtggctggaattttggctcattggctgtcattattgtgacagctatttatcatagaaagaagccatatgtgaggttatcttcttccaaaggtatatgaatgttataaaaatcaagcagaacagcaggtcccacttttccatgcccccacacagcatctcccacatctcatcaagttaactactgaattgctttgaaagaaagtgatagagaataaaaaacagttactctaaccacgacttatatgaattttatatttatttgggatttaatgttaatgatgttgttgaaaaaattcaattacattttggttgtattactaattactacttataaataattatttaacaacagttgacaaattaaatttatccagattatcatgattatatactctttattaaaatattttcttcgtcaagcattcttctgaattt

SEQ ID NO: 77202 - DNA, 1007 bp, Homo sapiens
tgttatcatgccacgcaagatccgtgacaatctagatctcaaaccactcctcagacctcattgttcagcacccatcccctgtaccctcatgccaaacatggtgaggcatggccctcttgatactttgcctttcccatgctgtttaccatttacctagaacattatcgcatactctccatttggcaaactcttcctttaagaggcacgtggatgacactttccctcctggttactcctttctctgggcttctacagagttttgtttgaactttgattggttctctgtttatattgtattataaaatgtgtctgcttacatgtctatctcgctcattagactttaggaactttggcccattcatttcatctctgtggtgctaacagagttgcccagtgtaccgcattctgcaaaaatgtaattgagttagtaaatggaatagcactgaccagacctggaacacaagaagatcttcataatccagtgagaaggactgcttcctcagaagtatttttttattcccatagattgattacccagtggagggggaagtacaaccaccacctttctgccttactctgagcaggtttgtcagacaaatattggctggtaaacccaaccttgatcagcagcaagctttccaaaccacacatgaggcaattcatatgccacactggataggtctgtttaaagaataataatttcgcttgatgatacacctttcttggcactgagtaaaactatcggttacgtagatgttcacacagatgtggttttccacagaatgagaaatttaactcagcattaactttgtgtatctgtcttggcataattaacaagagcaaagcaaaggtcttgtgaaattttgtgcatttgctctcttctttattttttgcttgttattattttgtttatttcatcctaggcccattatttcctgatagaggcctctgaggacccagggctctccagagaagggaaaagaaggctagaaatcacaacgccttaa

SEQ ID NO: 77203 - DNA, 1040 bp, Homo sapiens
cccgtattcatggcaggggttgttattaagcatgtgttggctaactgattataagacagttatgtgcagacagtaggcctcgctattcttttatagctcatttttcctgcatgttgctaggcacagagtaagttttgtgctttagtccctgtaagtatatggtgactggctgacccactgggtccacagaaacacacattcatgcttctcattcaatacatttcgtgtgtgccttgtgccctgcttgtggaagatagttcaaacatgttaattgacttactcttcatagtagccccttgagttagctgctgttatttatattttacagatggctaagggacttagagagtttgagtagcctgtccagatcttatggcctgtggaacctggatttgaacacaagtctgagtaactctctcaagagagagtttttgtcactcactactttccactctactgaattcttactacatacatgccacacttcagttttttagtcattcctatctctgattagtcacagttttgtgtgcatacatttctttgtgagtcatcattttgggcatagaactgggttgaaactcatagtcagcaacccagatttgtctatcatatcctccatcagaggaaagttcctatcaatgtaaatagagggatgggtggcaagttattttaaaaagctgatatatcacagagaaaaaaatcctgctaagagagggagaccctccctctcccaccccttcactcctaccccacacatcacactcacacatcacacatatcacatacatcacactcacacatctctctctctctctctcacatacacacacatctttgggagcaaaaagtaattgagttttatttttaggtcagtgcaattagatttttctttactcgcttttaatattatattagctttctctgataaaatgaagaagcagtttacgcctgttgaggtaatttctgaatcagatgtgggtttctttatgctccaccatgattggccagttgctttgtaatgaaggagtttgcacttc

SEQ ID NO: 77204 - DNA, 1072 bp, Homo sapiens
ctatggagaagattaaagaaagtaatatatgttaagtgcctagcacaatgcctgggaggggtatagcttttaaggagttcagaaaaccttaattccctcttgcctttaaaactccatttgtgagggtatattctagaattagaaagggtacttattgcactaactcgttaagagattgttcatggacttgtttatttatatgctgtgttttctctgattaataacctactttggagctcaccacgaccaagcatgaggtaaaatgatcttcctttactcaaaatgtgtgctatatttgaaattctggctgaccgtggccgcctcaaaaactcatgacctcagttatccgggtttccttcagctctagtgctgttttaattataagtatttacttttttttgtttttctttcgtggcaagagctgtgtatttccattaccatggttatcttctgatgcctcaaagtatttggctgttttcctttatttaggcataaaggcagagacattgtaatttgtccaaaagtatttgctgtctccaaacagtagacagaatggcatacatttatgaagtgctaaaccattaccattgttttgtgtttggtgcttgcaaactgggagctttacatgttattaaaagctttcaacaccttcttctcctcctttgaaaaataatcagcatattgcttgcctccagcattcttttaaggaaagccaaagacagtgtttttcaatttccgaaaatctaattccaaatgcaatggcagtacacactggttggaccttttaggggtaagttaacaagctgtttgtcctatttgttttcaaacccatttcagatttgcagctctccatattaaaactagttgcttgtttggtggtggaaatattctattgcattggagaaaaggtattgtagacacaccttgaaagtattccaaatgtacctgaaagagcattgacattcagccatcagaggggagcagaaattctgctggcagaccccaaatctttgacatgaaattcacaaaatgtgcacacgttttgtatttctatttagaaaaagtggaaagc

SEQ ID NO: 77205 - DNA, 1013 bp, Homo sapiens
gcatgtgtgcagctgcacatctgcgagaatactggtgggttcaggcaacgctggccctaccttagccaagccttctgtgtgggagctatatgaggcttttgtactcttgcttagttttcattgcaaatggggccgtatccaaaaggcatagagtgggggtgggaggtgggtggcagggcggggggaaggtagaaatgatggataaagatgtaagaaggataaggagagaccagatgcagtcgagggcttttgtggcatgaggaaaggatatttaacttggcaccaagaaatggggtggcattctaatgctgctcctgacctcctgtgtgaccttgagctccagtttccctctttgtaaaatggtggccctgatgactacctacaaggttggaggtgggaataagggacctaatgcatgtccagtcatctgtcatcaacactcaataagccttttcctttcgtggccatccatcttcaggtttgacggaagtgaggatctgccctcagggttgaaaggtcaagatggtttgctcaaatattttatttctctcataaatctcttgcaggtttggttcatcccagactattctttttcagggcagtatttatattgtcactgcgttcaggctgccttccccatttgatggggcccagcagtgttcagttatactgataataccaaaattatcttcattttaaaaaatgtaaacctttttatttctgatcattaatgtaaggtaagtatattgttgataatttggaaaatccaaagttaaaggataaaattactactaattgtaatctcagcacacagaaagaatcatgtgtgtgtgtgtattatatgcatgtgcgtgtgtatagagggcattctatttgtattgtatttctttattatttagggttgttgatactgtaaaataaatgattttttttgagaatgaagatgggtgaaccttgtttttctcatatttaactaaatctaaatgacaggatatttggtaaaaggagatata

SEQ ID NO: 77206 - DNA, 1056 bp, Homo sapiens
tgtttttgtgtaattccagaactctgggagttcaaggcaggcggatcacttgaggtcaggaggttgagactagcctggccaacatggtgaaaccccatctttactaaaaatataaaaattagccaggtgtggtggtacatacctgtaatcccagctactccagaggctgaggcaggagaattgcttgaatccaggaggcagaggttgcagtgagccgagatcatgccactgcactgcagtctaggtgacagagcaagactctgtctcaaaaacaaaacaaaacaaaacaaaacatatatatatgtatttaaaattcctagtcatcttatatattgtggatcccatcatatgtctacttatttagaatattcaggtccaattatttgttaataatttgtttttaaattcattaaaataagttttgtttagtaatgttaaacatacactaagcatataatatttaactgttattgcttaaatattaaacactctcagttaagggacaggaggaaaaaattgtgtaggccttgatcagtatggctgggaaggcctggggatttgtgttgtgtgtggaatgtgtgtacacgtctttgagtttggttttgtgtgagtgagtaaaacttcatcaaatagccactcccagagatgtgtgtgtgccgctccctcatacctgtaagtctcaactcacataccctaggtgcggcttagcttgactgtgactatttaaaccttggccctccaccacaaactctaaatctctcttaccccagtaggtgctcaataaacagttgagaactttctccctgagctctgaaagaatgagggtctttggagttgttttaatctcactcatttgcagttgagaaacacatgttttggtacttttgaatctaaacccgtctcctattcaattttcctataatcctcataaaaactaaagtttacttaatggagttgactcttgaaaaatgctggagttaggaacacggaccctctgcacagttgaaaaatctgccgttaccttttgactcccccagaatttaactactaatagcc

SEQ ID NO: 77207 - DNA, 1035 bp, Homo sapiens
tttttgcacatggaggacagcagcaaagagggcaacacaggctgataagaccagagacagcagggagattattttaccatacgccctcaggacgttccctctagctggagttctggacttcaacagaaccccatccagtcattttgattttgctgtttattttttttttctttttctttttcccaccacattgtattttatttccgtacttcagaaatgggcctacagaccacaaagtggcccagccatggggcttttttcctgaagtcttggcttatcatttccctggggctctactcacaggtgtccaaactcctggcctgccctagtgtgtgccgctgcgacaggaactttgtctactgtaatgagcgaagcttgacctcagtgcctcttgggatcccggagggcgtaactgtactctacctccacaacaaccaaattaataatgctggatttcctgcagaactgcacaatgtacagtcggtgcacacggtctacctgtatggcaaccaactggacgaattccccatgaaccttcccaagaatgtcagagttctccatttgcaggaaaacaatattcagaccatttcacgggctgctcttgcccagctcttgaagcttgaagagctgcacctggatgacaactccatatccacagtgggggtggaagacggggccttccgggaggctattagcctcaaattgttgtttttgtctaagaatcacctgagcagtgtgcctgttgggcttcctgtggacttgcaagagctgagagtggatgaaaatcgaattgctgtcatatccgacatggccttccagaatctcacgagcttggagcgtcttattgtggacgggaacctcctgaccaacaagggtatcgccgagggcaccttcagccatctcaccaagctcaaggaattttcaattgtacgtaattcgctgtcccaccctcctcccgatctcccaggtacgcatctgatcaggctctatttgcaggacaaccagataaaccacattcctttgacagccttctca

SEQ ID NO: 77208 - DNA, 1103 bp, Homo sapiens
ctggccaaaataatgaattttttttaaaaagcaatacctggtttccaccttggactgactttgatcctgttccacttttgaaattttatttgttccttttccatcgtggatgttcctctactttggcaattgtggagggctaatcaatcttatgttagcaggacaacccatgaaaaacaagtcagagagtgaaggctttttcccctaatcctggcagagcagggcgtagaaaagagaggatgtccgtgcttaattctagatacttttgagacaacaccttcagaaaacacataatttaatctttgccatccttagatagagaagggctatagatcacatacgttatcaaaaactactcccttggaaaaaatatctttcgaaaatcaaatttaaacatttcactctgtgctgcatatttcttttaccattgaccattattatagggacccatgaagtaaatgtcacaatcatcttactagctctctctctctcagcaaaataaaactgtgatgtgtcttctttgtaaaagtttaggtataaaatgctatgcaactttttctttatagtaagagctttattttctttaataatatagcccaacttatatgttttaatctcccttgtccctcagaataagcagaaaatataactgcagctgtatgtcgtagacacaagaattgaaactgtgcagtcagtagagctgaacttagctatgaattaatttaaattaattctaaagtgactctggtttccattttagtctattagctagagggttttggctgttgctttttttaaagttaggtccacacagtgaagggaaaagagtctgtgaaggtgatcagtgtagcagtaagacatctaaaatcaagacaatgacatgggggctttgtgtacttagctggataattcccttctactgtcctcttccccttggctgtgtagataaaattgtgcattcaaatgatggtactttgacttttgagggtttttatttctgttattcacaaaatactcattctcatttatgtatattgtatgtttaacccccagtgggatttctggctgctgaaaccactttgggccaggaagaacaaggatga

SEQ ID NO: 77209 - DNA, 1062 bp, Homo sapiens
gaatgaacaggaacatttactgagaaaaacgtgggcacatcataaacctgcacatccctttaccctattccctgggaaggagggatgaaatcttgaagtgtctgccaatatggcatttttcctctcacagggtaaaagcacaggtacgcctgagaggtgtaggaagcatcgtggctttcatatggaggtaaaagttacaggactggtcttccatgagcgtgtgagtatgtgtatttatgggcaaatgtggggtgagaggagagtgggcagaggcgagagagaatggcctggccaaggaaagatcaaagcagaagacggtggtgatggaggcagcaggctttttttgcgcatcaccttgagtgtttttaacccagaattggccccatgtttaagattatggatccaggaaatccatccccttcttcctctcttctctttttgccacagcaaagatgacatttagctctttgggcttgcatctgctgatgactttgttctattttttcctgccctattcgatttgggtgttggtgtgagacatgaaagtttgaaagtgacactccagctgttccctccatgccacttctgctgaattatcttgaaatccccaccatttggcttggctttctccagttcccgccaaggacagttttcggcaggcccctgttttgacgtgtacttatgctcttggcacctcctgtcaatggtcttcttggattattgaacatctatctgtgctctaggcttcaaatcttgtggttggtggatgatcggctgtccctgagtacaactgagagccacagaattgatggggcctctagatggtttgggttccaagccagagaatatacaggtatgccctgtgtgtgttcaacacagctcagaccaggaaagtatttagattagggagatgctcataaagatggattgtttttaaaattatttaatgatcatttttgttactgggctttatcaaaacagagtacagtatttgtttattgtcctagctactagacatccagtcgcaaaaaaagtaggtagggaagaaagagttttgtaggt

SEQ ID NO: 77210 - DNA, 1005 bp, Homo sapiens
aggccactgctcaggaatatgtggggagaagtatgtattctctctgacaggggattttaggggctcttaggtaatagtggtgtaaaaataaatcagacatctccatttatagtcttgtttgaagaactaatgtagtctctcctcacccctcccccaacattgtccttttgatctaatttgtcttcaaaagtcagaacaaatgtcatgcctctgtgtttccagttctctgaagagagctgcttgctctgttgctgctcattccccctgaggtgtgaggatttgttcccagatccatctccttccttaaaccaacagtcactcaaggcaggatgggtacagcatccacctctgattctccggtgcctggcctgctctgggatgtcaaatgtatggtgctgctggtacaatgggcagggaggcaaggccctcatatctggcacatctgccagtgcagcccaagatgtcattcatttcctgatctgctagtgtcttagtccgtttgggctgctataacaaaatgccatacacaaggtggcttaaacaagagacgtttatttcttacagcactggagaccgggaagtcctctatggaggcactggcagctcctgtgtctggcgtgggctctcttgctggcttgttggcaactgccttctcactgcatcttcacaagctgaacagagagcaagctctctggtgcctcttcttataagggcactaatcccaccatgaggtcctacccacatggcctcagctagtcctaattgcctctcaaaggccctgcttccaaataccaccacactggggcattagggtttcagtataagaattgggggagggggccaggtgcggtggctcacgcctgtaatcccagccctttgggagtccgaggtgggtggatcatgaggtcaagagatcgagaccatcctggccaatatggtgaaaccccgtttctactaaaaatacaaaaattagccaggcatggtggtgggtgccaccaagtattt

SEQ ID NO: 77211 - DNA, 2271 bp, Homo sapiens
gacttcagaggaccattttcatatggtttcaaggaatgtgtttctttctactctagggtcatttcacctctggcatgctgaatgacaagtctctgtggacagacatccctgtgaattttccaaagaatggctgggctgcaattggaactcactcctttgaatttgcacagtttgacaactttcttgtggaagccacacgctaatacttaacagggcatcatagaatactctggattttcttcccttctttttggttttggttcagagccaattcttgtttcattggaacagtatatgaggcttttgagactaaaaataatgaagagtaaaaggggagagaaatttatttttaatttaccctgtggaagattttattagaattaattccaaggggaaaactggtgaatctttaacattacctggtgtgttccctaacattcaaactgtgcattggccatacccttaggagtggtttgagtagtacagacctcgaagccttgctgctaacactgaggtagctctcttcatcttatttgcaagcggtcctgtagatggcagtaacttgatcatcactgagatgtatttatgcatgctgaccgtgtgtccaagtgagccagtgtcttcatcacaagatgatgctgccataatagaaagctgaagaacactagaagtagctttttgaaaaccacttcaacctgttatgctttatgctctaaaaagtatttttttattttcctttttaagatgatacttttgaaatgcaggatatgatgagtgggatgattttaaaaatgcctctttaataaactacctctaacactatttctgcagtaatagatattagcagattaattgggttatttgcattatttaatttttttgattccaagttttggtcttgtaaccactataactctctgtgaacgtttttccaggtggctggaagaaggaagaaaacctgatatagccaatgctgttgtagtcgtttcctcagcctcatctcactgtgctgtggtctgtcctcacatgtgcactggtaacagactcacacagctgatgaatgcttttctctccttatgtgtggaaggaggggagcacttagacatttgctaactcccagaattggatcatctcctaagatgtacttactttttaaagtccaaatatgtttatatttaaatatacgtgagcgtgttcatcatgttgtatgatttatactaagcattaatgtggctctatgtagcaaatcagttattcatgtaggtaaagtaaatctagaattatttataagaattactcattgaactaattctactatttaggaatttgtaagagtctaacataggcttagctacagtgaagttttgcattgcttttgaagacaagaagataagtgctagaataaataagattacagagaaaattttttgttaaaaccaagtgatttccagctgatgtatctaatattttttaaaacgaacattatagaggtgtaatttatttacaataaaatgttcctactttaaatatacaattcagtgagttttgataaattgatatacccatgtaaccaacactccagtcaagcttcagaatatttccatcaccccagaaggttctcttgtatacctgctcagtcagttcctttcactcccaattgttggcagccattgataggaattctatcactataggttagttttctttgttccagaacatcatgaaagcggcgtcatgtactgtgtattcttatgaatggtttctttccatcagcataatgatttgagatttgtccatgttgtgtgattcagtggtttgttccttcttatttctgaagagttttccattgtatgaatataccacaatttgtttcctccccaccagtttctgatactacaattaaaactgtctacatttacaatctttgtgtcaaatatatttttatttcttctggatgaatactgaggagtgaaattcctgggtcttatgttaattgtatgtttaactttataagaaactaccaaactgttttccaaaatgattgtatggttttacacttctatcaacaatgtttaaaagttccagttactctgcattcttgtcagtgcttcatgttgtcattctttttaattttaacccttaattgtgggtgtatagtatgtacatttctctgatgactaaagctattgagcagatgtcatggacttaatggacatttatgtactttgttttatgtaatatctattcaaatattttgctcatctaaaaaat

SEQ ID NO: 77212 - DNA, 1061 bp, Homo sapiens
atgtaaaagttggccccggaatagcttgtgttctctcaaaggctcctagcattgccttcattgcctctctttgttgatggaagtttgaataaacattttccctcagaattgtgtggaactttttactttttaatgtgttcatagacaatagtagcattttaaaatattgtattcttaagatgagaagttgttttattgtagaaaaaaaattttctcaggaaacttaaaaatcataactattattgtccagtaatcatttaaagaggcaatgaaatgacttaagtcatgtaacatttaaaactgttgtcaataaagattcttgaagcccatctctgctacaggcttagacttagcaaatcacattctcacctcaattagaagtttggaagcatgtgctgtgaaatgacatatctgtactatgttacaaagggcatattttaaagagtactaatcaaccgttttattttgcaggaccaatctgactataaagtgtgatgtatacatagagacccctgacacaggaggtgtgttcattgcaggaagagtaaataaaggtggtattttgattagaagtgccagaggaattttcttctggatttttgcaaatggatcttacagggttacaggtgatttaggtaactgactttttttttttttaatagcatatgacttatgggctatgttactttgagcacctacttgttatttgtgggagtgataaaaagaattcaacccaaggtgtttggacatctaattgggaagggatgtaagcaaataccaaatagtttacaattatagaaagttatttaattcctagagatgggggcagctctgtggaagggaaaataattgtacaaagcttttaagggtattgtagagttgaactgggctgtgaggataggatttgcatagatagtatcaaaaccatctgaggtagtggtggtagggagagaatgctcaggaggcaccataaataaaagcaagagtatacgactgttgctgctgtacctatagaaatataaggaggggaattgatcggcttaaaatggaaaaatctcatt

SEQ ID NO: 77213 - DNA, 1044 bp, Homo sapiens
atgaattactcagccatgcttttttgtcttttctttacagagtgaaataccagagctacaggtatggtataccaaacttggaaaaacatccgaaagatttctttttaagcagctggattctctatgggtaattttaaagtaaattcttatattttgggtattccaacagtaaaacagtaaaagggcacagaaatgtcattaattaagaatttttatttttataagtttgtgtgtttatagatgtgtttagctcttagacatttagtttgtcttggtggatggtgacgccatcacctggcttcccaggttggaaatttaagtcccatttgagactctctgtctttcccactcaccctctgtatcccgccagtggtcaagtatagacagttgtatccacacatttctcttactcactccttattctccattaccaccgttacttcttgtttcagttcttcattatcgctctcctggatttcagaaactgcctcttgtttttccagtctgactttccaggtcacccatcacactgctacagagtgaaatgtcaaaaatgcagatctgatttttgtgaccactgtgctcagaggacctcagtgattattttcttagaagttaacattccttagtgtagcacatggccctcattatcctcccagaaggtagaagactggtcttcttcctagagatgtgtcctactaaactggcctctcttcacatactaaacttacatttttcaaagcatagcatgcctgtttatttacctctgtgactttgcacatactgtgttcttcacctagaatggcctctcctcaactttgtcatcttttgagactcaattcaagtgtcttttcctctgacgcttcctcaccagtcttagctcatattcacctagggccatgtgcttacctagttaaatgcttttcctgcaccactggacaccttgaagactgagccttgccttatttagctttatatcccaggtgcttcccacagtgcctcatccatggtgctttctggggaaaggtttcaaagaacgaattg

SEQ ID NO: 77214 - DNA, 1031 bp, Homo sapiens
cagtctgactccaataattctcaattgtaaaactttggaacagttcagagtcaagttcataaaaattatgtcataaaactggggcattaagaaggctgactgttgaaaggaaagtaggtatgcacaaagcctttatttgtatttgactcaaatttgtgatgtgttgggtattggtaaggcatgattcgtcttctggctataccacagttcagtaaaaatttgcacataatacatttgtattttttatcatgtgattcaccattaaaaatattacaatgtaccccacactggatttttcaaaatgtgaataaatttagacaacttatattttcttattttgggtgatccttttattgtcatttatgtagatgtgtattactatgataaagtctttttactccaggtttttagacatttacatttttatcacaagttgtcttggtgtttcttttttatcaaatcttttagcacaatcgcatggaatttagtggctagttactatgaacagttgccttatgggagatgcgggttgatgacggcccaggagccatggagtgggcactacgtggtagaatctcctgtctgggtatcaggtatggttcagttccatctctcactccctaaattcttctctaagagacaaagcagaaaaaaacttagagaagattatataaactgtgtgtctatgcgtgttttaagtatagatttaagttttaagcaagatttgccagtgttttataagaatattttgggtaactagactactctctgattattctaagaccaggcttttagaaaagtgtaggagaggagggggagagagaggaaaaggaggagctgtgtagtgatagagacacaaataaataatcatctaaggatataattacaaatgatgataattgctaataagattatgtatttataaacagagtagaagtcttaagattagctttgaagacattttgttctcttatattaatagagtttcaattacaatcgtatgctagcaaaatcaaagggagatgattaaa

SEQ ID NO: 77215 - DNA, 1052 bp, Homo sapiens
tctaaggacaggagtagtggggagagtactactttatataaaggtttcactagtcttatttttggcctcctcctcactcgtttactattgccccaagctccttagcttcccctgggaagtctgaatcttatctttacttcattctcctcttggagtgttctaggctgtggccctctctgctacctccatccttcaacatgcttccatccatcttgtgagctccagaaatagattgaaatttcttatctattgatgattttccttcctatcctgtatgctgttgtaggtttatccccttttgttttctttgctgtcattttaatggcatgctgagacaaaagggcataaagcagatgcttagattcattatctacctggaagctacccaactgttttaaaatagaaaaccttggagaagactcgtatttttatatactcaacaaatctatacgtatataagtgccacgtcgtgaccttttttcattgacttccaccctttttttttctagggctcattatcctggaacccattcagcaaaagatgcaaagttgactgggaagaagctttggtcttctgaagactttagcactttaaatagtgacatgggtgcaggctgctggggtcgcattttaaatcagaattatatcaatggctatatgacttcgtaagttattaaaaaccttttagagttcttatcaaaaaaaatttaaaaacataagagttagaaaaaaatggaattccttattcttccagcctagattcaatgattgtaaacattttgccttgttagcgtcatctatttgtatacctatacctaatctatatctaattttctatatttgaatatagtctatattaaataaagtcaggtttattgaggtataatttatatgtagcaaaatacatgcagctctctgatttttgacaagctacttgtatttttaataattataaagtaaatagtatatgtaaggacactttatctctaaatattttagcatgtgtctccaaaacataaggatattcttttacatgatcacagtatcatgtt

SEQ ID NO: 77216 - DNA, 1015 bp, Homo sapiens
ggttcatgccattctcctgcctcagcctcccaagtagctgggactacaggcacacacctccacgcctggctaatttttttttttttttgtatttttagtagagacagggtttcaccatgttagccaggatggtctcaatctcctgacctcgtgatccgcccgccttggcctcccaataaaaatttatattcttaaagagcctttacattttgttgcactagtaataaatctatacattaagaaagacccagattttagtattagttctgcctttctttgctcatatcatgtaataaatcatttgggttttgaatgtggtaacagtttcatcattttctgaatgaaggatatatcacctattcctataacttcaataaagttactttttcattttataaatataatatgctcattatagaaaatttggaaaatgtagaaaagtataaaaatagaatttcctcataatcctaacatctactgattattggtaacatgctagcatattactttacagtgttttctttaatatagaaatatattttaaccaaatacaccaaacatgcatttggcaactagacaactggatgacaactagatgagtattaaaaattaacatttggctgaggtaccaaagctgaatttcatggaaatagaatggagttgtgggatagaagaataaatctaaagtgtaattttttgaatttatattatttaaaagactagtagccagatttttcaggttgggcgttatagttccagaacaatgattgcttaaccctgttagatgctagatttctgttggtatctttgtagtgtagatttgcaatattgaatagatgcctgctttcacctgagtttagtgactcagtaaaatcttagtggaacctcatttttctctaatacttctttttatgttctccagtatatattgtatattattttcttactcatgaaatcctgggatgccaaattgatattgtgccctaattcatcttcactaggtataaagaattac

SEQ ID NO: 77217 - DNA, 1050 bp, Homo sapiens
gtaatgcttttattttccataggagggatgtttctattgagaaaatatagtattgaaattatcatccatgaggtcaggagttcaagaccagcctggccaatatggcgaaaccctgtctctgctaaaaaatacaaaaattagccaggcgtggtggcgcgtgcctgtaatcccagctacttgggaggctgaggcaggagaatcatttgagccctggaggcagaggttgcagtgagctgagatcctgccactgcactccagcctgggcgacgagagaagcctctgtctgagaaaaacaaacaaacaaacaaacaaaagaagctattatccagaacgctgatttgtaaagataactttatctatcttggtcataaattcaacagctaaaaattcatttgtatcctttcatatgttctgtttcttactccaaaagatattaagaaaaatgctgaattatcaaggtctccagcgagtgaaaatcatagcaagtgataatctctgggagtccatctctgcatccatgctccttgatgccgaactcttcaaggtggttgatgttatagggtaaggcatgttttacttggaaaactagcagtttctgattgcttgctctgtgtattgactatctttttcttgccttctccccatttgattacattctcagaaggtagctctcctgtattcacttacctgaagcatgcatggctcatagttcattattttctcttttaaatatattttaggatctttctatgacaaacaagtattgatagcttttaaaaagcatgttgatgtttggaataataaaacagggctttgttttagattaaggggcagagtaatacctgtatttaattttagaaattataaaggcaaagttgtgaaattagtttcaaactctcagatattctgtggttggaagttcttgcatgaacacttttgtaaatggttcattgtgatcactgacaataacttttgtcatgcctccttagtagtatagttttgatgcctactctttattccatttctgccttttagcactctgggccctga

SEQ ID NO: 77218 - DNA, 1032 bp, Homo sapiens
tttacatattgtctgtggcagcttttacactaaaaagcagagttgaccagttgtaacagactgtatcaccctgcaaatcctgaagcatttgctacctggccctttgtagaaaaaatttgccaacccttgatatagaaaaagtccattacctcaaagagttccccctagtcctttgccgtcagtcccctcctgacaaatccctggcaaccactgatctgctctttcgcctatagttttaccttttctataagttcatagaaatggaatcatgtatcgttttgggtctggcttttttcagttatcttaatgatcttgagactaattcacactgttctgtgtaccaccatttattcttttgtattgttaaggagtatttcatttaatgaatagaccacaatttgtttatgattcaccagttgttaaacatttggattgttttgactcacttttggccattaggaataaagctgctataaacattcacatataattttggcgcatgtgtttacgtttcactcgggtaaatttatgtgtcaggagtagaactgtgaggtaatatattaagtataagtttaattttataagaaactacagttttccagagtgaatataccatttacatttccattacttctgcacccttaccaacccttggcgttgacagtccttttttaaccattctagtgaatatgaaatagtatcacttcatagttttagtttgcatttccctgatttctagtgatgttgccttattacttcccatctgtatatcttctttggtgaaatgactgttcaaatcttttacccattattaaaaatgggttgtttgtctctttagtattaagttgtgagtttctttatatacagattctatatcagatatatgttttgcagatatttttttcccaatctgtagctggtgttttcattttcttgttaaaattcgtattctggagaaatttttagacttacataaacatttaaaaattgtatagggagttaccatataccctgtactctgctcttccacta

SEQ ID NO: 77219 - DNA, 1134 bp, Homo sapiens
cttagtttaaatacttgactagaacttcagataaaatattaacatcttcaggaacatatcagttaattttgtaaacccttgaggctatcatttttttaatgtataatctcaaaatccccaattacatgaattcgtaatgcagttgatgactgtcatatcgaatgttcttagccctcaggcgaaccgcaaattgaggatgacatgttaaaagaagaaatgaatggattttcatcctttgcaaggtcactagtaccctcttcagagagactacacctaagtctacataaatccagtaaagtcatcacaaatggtcctgagaagaactccagttcctccccgtccagtgtggattatgcagcctccgggccccggaaactgagctctggagccctgtatggcagaaggcccagaagcacattcccaaattcccaccggtttcagttagtcatttcgaaagcacccagtggggatcttttggataaacattctgaactcttttctaacaaacaattgccattcactcctcgcactttaaaaacagaagcaaaatctttcctgtcacagtatcgctattatacacctgccaaaagaaaaaaggattttacagatcaacggatagaagctgaaacccagactgaattaaggtatgacacatcagcaaccaacagtaaatccttcaggaaattaaatgaaaattaatgaattaatattccttgttttctgctgccagccttaagatctgatagtgcccttttgattggaatgagatgaatgtgacttttccttttccatgtatcactagaactatcagagtaattgctgaaaaatagctattaaactggtcaagcaccttatgcgtatgaattacatattttattatttcaagcgtggttcaagaattgtgtatgtttttaaatattatactttcagagaattcttaaaataggtcatcagacagcatttgtggaaatatgcatattgattcatgttaaaagtggcgaaacaatgggctatagaggggaagaaactaaccctttatccatctaaccctctgctccatttcctgcagatattccggccagtcttcatagcaacaactgccaagaataattttaaattgggataatttctaga

SEQ ID NO: 77220 - DNA, 1023 bp, Homo sapiens
tatctggcagtaggttttagttgttttagaaagtaaaaacaatttaagattagtatttttttctttgaatatagataagtacagtgatatcagatgagtctgcagatatttaatcaaataaaatcaaataattcaaaattatgtattttataagaatagatgggtctcattctttttgagtttattttttctagccagtaaaccttgttaccacagtgcttatattttgaaggattaacaattatttattttaaattattacagctttaaatctgagttggggacagctgagactaaaaacatgacagattcagaaatgaacataaagcaggtaataagtatgaaatcttttggtattgctacatttgaattacagatgtttttcagtaaatagaatatgtacagctatttagactgtgaagaataatctgttggtggcacttatcatacatgatatagccagtatacagaaggtctgcctatttacaaatggttatagctctctctgaatggccaggtggatcctgccaaatctgggaagtcatttgttactaacatctttcctagatgattggttggctggctggacaaatggaaggatcagtaaaataccttaagtattgttttcaaagatgcagacctggattactagaggagccagcagagtagtgcagaagttgagtttttataccttttttttttttgtaaagaattgccacatattatataattggaaattatacattttataagaataagtagctgttattctcttatgtttgcctctgctttttctagaccatgaagctgtttattacagggtttatattttgaattcttagcatcatttcttttaaaatattgcaactttgagtctgattttgagataaattgttttatttttggagtttcagtcttgcacttgtgtcctgacttaaatttgttgcttataaaaatggtttgtctattaaaatgtcaaacacagatccagagatagaagaataaaatataatcatactcaac

SEQ ID NO: 77221 - DNA, 1056 bp, Homo sapiens
tctctattttactgaagctatgctgggcaattctggcaatcattaaagtgcatagatttctatcttaaactaatttttgataatggagtttttattttatgacaaatatttagggatttttctagtgagaaacaactttgtgtaaggatgatccacagatatgagttgctcctatataactttgtatttaaaaatcatgttattatcttttgttattttttaaaaaccttgggtacttaataatggtttagttgccaaactgaaaactatactgagaatctgtgttattttgaaacatcaaaaggatttttctatccagaacattttttatcctaaaaattctatatagttgtaccttctgtttttcaaatgagagctcaattcatttagatactgaaatgagtcagttaatgtaaagttgaggatgaaggcacattatttaaaatgtaagagaataagcattattttttcagtattattcatagatctaaatgaatttgattttattggttgaaaatgaagtgaaaaacaattgcctagggtggttttaagcacttttttgttaaaaacaaatctgagttttaatatatgtgttgctttgtagatgacacaataacaatgggcgctgagaagcgttttgggagagattaaggactaagagtatgtaagatgactaggacaagagtaggtggagtgtgatggtaaatgcaggatgccttcgtctttacaaaaatgcagtattatctatactcagactgaggtgctgggatggcgagcaggggaccccacagcactgtccccagggaattcaagtcctgtgaccgccagtgacttactccgtttccttggggcttttcccacctcaacctgtattgtttctttttcataaataaattcagcattatagtatcattaaaagaagccttaaagaggcgtatttttccttttggttgaaggaagggaatagttaataatagttttcacctcttctcccaaaaagtacagtccaaatttgtgcacagagattgctgtggtattcaagaggtacttgcattt

SEQ ID NO: 77222 - DNA, 1070 bp, Homo sapiens
gccctgagtgagagtgcgtgtggcacaaggcttggcactgggttttacgtttagtgagtgtttggagacagttattgtcgtcactcaatattggtgaagccaagatttaacccaggtctcttaaccacaaatctagtaattactgttgtattagactgctctcaaggaagttaaatctgaagtggaaacttaatattattgtggagagtgaccttgactcagaagttcagaggtgagactatcttaagtaggaaggttttttttaaagaagaggcaccatgtctgcaataacagctacttattgagttatgtgccaggtaccatagatactgactcagtcctcacaatgaccctatgacggtaggcagtatctttattgtataaatgagaactgacattcagcaaggttaaacaggttgcatagatattatgtatattcacagtacctaagtttataaaaatgtcagtaatgcaaattgtattcacaagggaaaagatgaaaagtctttccttattctgctgaataatccagtttactacttttttactttttacttttttaaaaaaacttttttagtactaccatgaatgcatgcatacatacctatgtatattatacccacacatcaatttttttaaccttttctaatcccaggtctctgtcagtggaatcgaatgggattatattgccacacagggaccattacagaatacctgtcaagatttttggcagatggtatgggaacagggaattgcaattatagcaatggtgacagcagaagaggtaggtacttatttctcttaagtgattttctcagcctctgaagaacagttaatgttaatcatctggaatcctgacctgtggagaaaaaggcagggtagggttgtggttctgtttcagatgtgccgtctatgtgagaaaggcatccattgccggatctcgagtcatttaaccatgctcatctttaacaggagggtggaagggagaagagctttaggtactggccacgacttggttccaggcacaacactgtcacctatggaaggtttaagatcacgacccggttccg

SEQ ID NO: 77223 - DNA, 1050 bp, Homo sapiens
gtgtgtgtggatacagcttacatatcttggccgtgattctccagagtgattctggagttgggaaggtggcactttgttaaggcaaatcctgagacgtccaggtttcttaaatttaaaagaaagatgaattcagctgagaatctaaggaaagtccccggtagaagatgcagttctttaatattcagcctaataaataaatatgaattaagcactttttacctactttgaagcaaaatataaaaaagcatagtagcatcatctctagctaccatccttggagcatttgccatgggccaagcatttcctctacttttgtggcctatttacagtaagcctattgttatgcctgttttacagatgaagaaacagacttagatattaactaacttttccaaggtcacatgactagtgagtgactgaactggaattttaaacccatacttagaagcccattctgttatcatctacactgtagatgtatgttctgcattgaagtatactgtatatgttctattaagtcataattgcttgttgaagccttgctagtctttcactgaaacttttaaactcagtccttaacctgggactaagcatctgcggccttgtcatgaagtgtgtccaccgaagtgattttgttgcagtgctcaggcttccagctcttcctggcccacatctccactcctcatgccctgcacttgagccaggctaacttgattagggcctccatcctttctcctgttggcttccagtgtcctggcaactagggttctcctccccccatcgctgctaaactgcaaactccgacaggacggctcatctcaagtgtggttctggcctagtgtatgacatcctttaagatgctgcaaacatcttgctaaacaggaaaaaacgcacactattatagtacttatgaaagagattaatgtacatagacaaaaactacttaacaaaaaaagtaccacagatttaaatttgcttttttttttttttttttttttttagaacagtcttgccctgttgcccaggctggagtgcagtggtgtgatctca

SEQ ID NO: 77224 - DNA, 1013 bp, Homo sapiens
tcccagctactcaggaggctgaggtgggaggatcacctaagcttaggaaggttgacgctacagtgagcagtaatcatgccactgcactcgagcctgggcaacaaagggagaccctatctaaaaaaaaaaaaaaaaacacacacaaccatgtgggattaaggttttatttcactggtttatgcttctctaccaaattatggttaaatgcattgtatctcaatgagataatattgacattgaccttatacaactgacattttttataggtatcagtattatctgcaactgaagaaagatatcttggaaggaagtattccttgtaccttagaacaagcaattcagctagcaggcttagctgttcaaggtaaataagatcaattcataatgaaatggttctatcagattaaaatgtgttacaacaaaatagcaagggatttttaagttatctatctatatacatctttagtagtgtttatatattagtgaaatattctgttatctaaggggcttccttttgggaaaaaatgaacttggaatacctcaatgaaatatgagacttctggaagttaatcatgttataggtcaacagagcaaacagtacaataaatagaagtatgtatatatgtgtgtatacacacacatatgtacaatcatatgccgaatgacattttgttcaacaaaagacctcatataggacagtggtcccataaaattataacactatttttagcgtaccttttctgtgtttagatacacaaataccattgtgttacagttgcctacagtattcagtacagtaacatgctgtataggcttctatgagcaataggttatacaatatagcctaggtgtgtagtaggctatacaatatagcctaggtgtggagtaggctgcaccacctaggtttgtgtaagtatactctgatgtttgcacagtgacaaaatctgatgatgcctttctcaacacattcccatccttgacacatgactatatacatatacatttattaatac

SEQ ID NO: 77225 - DNA, 1919 bp, Homo sapiens
tgaatatgagtagctagttacagataggtcttacctcctttttttccttcagtttttgctgttgttcttctctgagaagaaaggcaataagagactgctgtcatttggtcacaggtcagggattagtgcgactgaagtcattgaaatccttttgtatgttattgcctccttcaatgaccttctgtctttccaggtcacttacttcagcctctggtactacaacaagcaaaatcagcgccggtgggtagatttggaaaaacctttgaagaagcagctggataaatatgcattggaacctaccgtctattttggagtggtgttttatgtgccttcagtttctcagctgcagcaggagattaccaggtgagaaattacatgccgtttgtttttaggaaatagtctagtgagatgtaaaaagtgaaactaaggttgaagtcagaagataagtttgaaactttgccctctcgccccacatttttagccacggtgttacaaagagattctcatatgtggcatgtcagagtgttttactgcatgttgggtaacttatgggttcactaggcacaaaggaataattaaagggaaaaatgatggatttaccctctctgtgaactcttcttgtagtgatgttacctttaatgtttttgttgttttgtttctgatcttttgtaacaaggaaaggagagaagagattttagaaaattagttacaaaatctgtcttcattcctcaaggaaatgtgctgaaaggctcctagaattctctgcctctagctatattctgtagaccggttggggagggagtacagaggagagggagggaagtgtttaagatcaggaaattttggccaataagtgcacttaatagggacaaaagcagaaagggaagatgatattaaggagcagaatagaggaactaagtgttcttattctttttccccctgaagacaatgaaaaaaggaataaaatttgagttcttgagcctgcctttcaaagttctgtgaatcccatcactacctgacctttttaaccctatttaatgttacttttgaacgttaaatatgttcaaaaatgaagtagctgtgctacttcaagggcccgaaacatgctgcacgccctttcatctttgtgtcctagatctttctctcacatgtatttactggaatcctgtttgcctcctgagttgtggttcagaaggtacctcctccatgaagcatctatgaccccaggatagaatgagttttggcttaccacctagaatttgattctacttgtgttaagatggtaattgtcataccctgttattaggattgtccgtgtatctttttcctaggttttagcccatgttttctttagctttacttaatgatatcttacacagtgccttgcagatagtaagaacctggtactgtcccatgtttgtggagtgctgtttgagtctgccagttaatgattaggagagaatggaaagtcaaagcagtaggatccagtggtaggataaacacaaactgactgtaaaagtctgagatagaaatattgaagagaaaagtggaagccagaaggaaaaagcctgaactgatcactttaactcatttaaacatttactgaagatatgctctaagaattgtgttgaatagagtgggaggtgaatatgctttaatcccaccctggaggagctgctcacagtctggtggaattggcagttcatataaatagttacagtatcctatgataataaatgctttaattaaagctgtggattcctaggggtggggcaaggggaacttgaacaggaaaggtagagagactgacttttaaattgactttagaaatgttctagagggaatagtttttgcaaagcagggggaataatcaaaatgattacatgtcttcaggaagtttcaggtattacctaaggagg

SEQ ID NO: 77226 - DNA, 1003 bp, Homo sapiens
cctgaggatggggcaagggagtcctatcaagggctggaggagttccaacaaagagaactgcacaggaccaaagacgcagaggaagctggtctgcctgaagcctgaagtgcgtggaggaaaggccgactgtaagggccacacaatgaggattttttgttaaaggatttagatttatcctgagggtagtggggaagttaatgaagggtgtaaacaggtgtggtacgattgtttctgtgaagagtgagccctttggagaatgatttgaggggagtggttcaggtacagatggtagccacctggagttggatagggttggagagaggtggttggaatctggatcaggacctaccgagtaatagagaagggttagcatgggtcctggttgatattcaggttttcagtagatggtggggctataacagagaggaaatgtgaaaggaagtgcagatctattaggggcaaggaggagcgtgtggtgagttcagttttagaaatactgagtttgaggtgccagttggaggttttgaatagacagatggatctgctgatctggagttcaggcatgagatccaggttagagggaagatattgggaagtatcagcctaagtgagttcattaaagccagaagatggtatgaggctctccaggggagaaaaagaggacatcgcagacccctcatggtagattagaggaggggaaagtgttggaaggaaactgagatgaaactgccgaagaagaagaaagaaaaccagaacagcaggcctcagtaaccagtccctgcttacttgcatttattcttttttagggatgaggtctcactccatcacccaggctggagtacagtggcaccgtcatagctcaatgcatcctcaaacacctaggctcaagtgatccttttgccttagcctgccaagagctgggactacaggtacactccaccacacccagctaattttttttttaacttgtgtttttgagatggagtcttgctatgtcgcccag

SEQ ID NO: 77227 - DNA, 1089 bp, Homo sapiens
tgatgtggagcttttgggtctatttgtttattcgatgttgctacaagtttgttactgtgagtaattgaaacctgcctttagcaagggtaaagatgttcacttgagaaatgagtgttattttgaaactttgcaaattaaaactaaacaaaactcaattctttttcttggggaatgttcaaatatttcccataagcttctttgaaattaataagcattattaaaaagattcaaggaagtgaatgcatgctcaagtttgaccctataattcagaatgtttagttttgtaagtatcaattattcttaatttccattcttctagtatttgaaatacctgtggaatgaagagaaaaaaattaaagctaagccatcttgtccaatgtaattccagtagagctctgcgactctaaagcttagagctacatctatattttcaagcacatcaactttaagaagaaagttttgaggaaacaaagttttgatctacctttccttttaaatagatgaagaacttcctgattacattatggtgatggtggccaacaagaaaagtcaggaccaaatgacagaggatctgtccctgtttctagggaacaacacaattcgattcaccgtatggtatgtttctgaatttttgtgcctcagaccaaagtttggcacaagcctgagttgatattctgtccaaagagaggttcttgacacttgagttaggtttactttggagaggcagtttgtgagtgatgagagcacagcctctgtattagtccattttcacagtgctatgaagaaatacccgagactgggtaatttctaaaagaaagaggtttaattgactcagagttccacatggctggggaggccccaggaaggggaagcaagcaccttcttcacaagtcgacaggaaagagaagagtgaaggaggaacttccagagacttatataaaatcatcagatcttgtgagaactcactgtctcttgagaactcgggaactcactgtctcttgagaactcactatcatgagaacatcatgggggaaaccacccccatgacccagtcacctccctcccttgacaggtggggattacaattca

SEQ ID NO: 77228 - DNA, 1060 bp, Homo sapiens
tggctccctcaaaggtttcactgttgacattagtcgggttgcagctccatcatcgtaagtctgtctatttaaaagaacaacaaaatgtattacagccaaattagggcaattatcaccaaatctttaaagaatgtttacttgaaaaatttcaatgaaaaaactgaggatactccctttacatattccattcaaaactgctttgaaattgcactttctttcaactttgatttactaaatttgtgataaaagataatcatacttagatcttatccattattttattcaaaaaactactcacgatcacttcattgtttctaaaaattgctgagaacagcaaactgaaagatataaaaactaatataaatgtcacatacacagagccatctgcccccagcaggtctacaccagactcttacctgacatttgtggtttttgactcctgcgaacttgtagaaactctggaatctcttttttcaggtctcgcgctaggaatggcaagtggtggcactgcagcttcatgcctcctctcatctccccgactgaaattgctcttgtttgaaggcacgttactatcaaagatgttggtatcagaagacttcagactagagggttctgaaaagaaaaatacagtccttttaatctatttttatttcttatttttatttatttatttatttttgagatggagtctcgctctgtcgccaggctggagggcagtggcgcgttctcggctccctgcaacctccaaatccctggttcaagcgattctcctgccccggcctcccaagtagctgggattacaggcatgtgccacgatgcctggctaatttttgtatttttagtagagacggagattcaccatgttggttggccaagatggtctccatctcctgagcccatgatccgcccaccttggcctcccaaaatgctgggattacaggcgtgagccaccgtgcccggccatctatttttattactttaagtcgtttccttcctcatcaccaattcaaaagcagtatgtttattgtagaaaattttaaaaatataataaaaatcacca

SEQ ID NO: 77229 - DNA, 2148 bp, Homo sapiens
tatttatttatttattttgatacggtgtctcactctgtcgcccaggctggagtgcagtggcatgatcttggctccctacatcctccacctcccgggttcaagtgagtcttctgcctcagcctcccgagtagctcggactacaggcacatgccgccacgctcagctaatttttgtatttttatagagacagggtttcaccatattggccaggctggtctcgaaatcctgaccttgtgatccgcccacttcggccttccaaagtgctaggattacagatgtgagccaccacacccagcctcatatttatatttttacataaaaccaagaaatactctgtgaatttctcatattactgtgtactgtttttttcttaaaatggaaacattttgtggtagaactcttgttattttctgagattaggtaagcataaattttatctgattgcaggatgaaaactttcggaagagaaagttgcctgtggtaagttcagttgttaaagtaaaaaaattcaatcatgatggagaagaggaggaagaagatgatgattacgggtctcgaacaggaagcatctccagcagtgtgtctgtgcctgcaaagcctgaaaggaggtaccttgaacatggctgtaaattaatctttaactgccttggtggagtcttcctgatttattgaagagaataatcacgaaaataatttttgtttgttttttgagacggagtctcgctctgtcaaccaggctggagtgcagtgccacgatctcggctcactgcaacctctgcctcccaggttcaagtgattctcctgattgagcctcctgaatagctgggattataggtgtgcactaccatgaccagctaatttttgtatttttagtagagatggtgtttcaccatgttggaccaggctggtctcgaactcctgacctcaggtgatctgccctcctcagcttcccaaagtgttgggattacaggcatgagccaccgcacctgacataaatatttaatgtaataccgtgtaagacttttccattgggttttgagaaacacgttaatgagagaaattgcttaacattggagaggattgcagagaatattgactaatatggtggggtgaggaggaacaacatcaattaagattcagatttattatttaaaaaaactaaaaggggcctaggcatggtggctcatgcctgtacctagcactttgggaggctgaggcaggaggattgcttgagaccaggagttcgagaccagcctgggcgatgtaatgagtctttgtctcttaaaaaaaattaaaataaattagttggtcattgtggcaggcacctgtagtcctggactggagaggtggatgtggaagcattgcttgagcctagaagtttaaggctgcagtgacatcacactccatcctgggtgagagagtaagagtctgtctaaaaaaaaaaataaggttccagtgtagttggcattttctaaaaactgcagctagtctgtttaaaacctagagaaggttgtggtaaaggcataatagatggctggcctgtgaggaactgaaatttaaagtttaataaaaatacctttcttaactcttttagaccttctcttccaccttctaaacaagctaacaagaatctgattttgaaggctatatctgaagctcaagaatccgtaacaaaaacaactaactactctacaggtaatttaaatgtattatgtttacacttggtaagacatttctgtaattcttgagtaaggtgaaaatgattgctccttaaattgtaaaataaaggtgcctgtcagatgtcaagaccaagatgaggttcccatatagaaaaatggctttaaaaggaaattgacaagtttgagaaacttcgccaactgttattggactgtagtttttcaagcaccatataatgccttttatatctttccaatgtgtgtaaaatatatagtacgtaaatattttgaagagaattttgatgaagtaggactttcatattagtagcattagattcaacattagatatgaatttacgatgtgtaaaggggagtacaattggacaatgataggtatctgaagttatagaaatttgttaaacagtagtatataaacaaggttggtttcttcccttttggcggaactcattag

SEQ ID NO: 77230 - DNA, 1034 bp, Homo sapiens
tctcagtaacgtaagaaaaaatgaatggtatctatggattgaactcctcatatatatgttcttttcttttctttttcttttttttttggagacagagtctcactctgttgcccaggctggagtgcacagtggtgcaatctcggctcactgcaacctccgccttccgggtttaagcaattctcctgcctcagcctcctgagtagttgggattacaggtgtgtgccactatgcccggctagtgtttgtatttttagtagaaacgaggttttaccatgttggccaggctggtctcaaactcctgacctcaagtgatccacccaccttgcctcccaaagtgctgagattacaggcatgagccactgcgcccagcctgaactcatatgtcctaaaccaaaggaggcatttatatttaatatgacatagtcactgtggagttttgacgtattactgcatttgtatttctatcttttttgcttttatgtgaaagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaaggtaataacttaaatgatgtttcactctttactacagttttttcatgaggcattgaatattttccaatggatttttatgaaatattacactatgaaaaaagtgatgattaagcccagaaatagaatgagaagaataccatgaggaaggttcataccaacacttcagaaaaaaattttttttttaaagaggtagggtcttgctgtgttgcccaggcagtcctcaaactcctgggctcaagcagtcctcctgcctcagcatccttagtagctggaggtgtgtacaagtgtgtgccactgcacccagccctttctagaaatttttgaaagtctttttattgtggaaatttttaatattctcaaaaatggaaaggctagtacagtgaactctcatg

SEQ ID NO: 77231 - DNA, 3963 bp, Homo sapiens
catcaatttttggcagcggtgttaagacagtttattggcaaaagaataggtttttccacaggtgatgctgggacaactgaatatccacatgaaaagaatgaagttggaaccttatcttatgtcataaacaaaaataactcaaaatggatcaaaaacctaaacttcaaaactcttagggaaaaaaatagatatgtcttggattccagaatgatttcttaaatatgacaccaaaagcacaagcaaccaaaggaaaaaagataactcggacttcatcaaaatttagtatttttgtgtttcaaaagatactatcaaaaaaaaaaaagacaacaaaatgggagagaatatttaagaaacacctgtctaataatggtctagtattaagccaaggctgagttcttatttccccatccttaagtttacacgatactatattagtgaagttgaattctgtcattaccacatgtatcttgaaagaagtttgtgtggatcacgggtccagttactttctccgccctttccctccagaggatttgtcactctcaataatgttatatactaatttcaaggggaaatacaactcaaaacaaatcagaaatctgaagcttaaaaatgttatggtttagatgatgaaaagggaaaagtacatttaattcatatcatatttagatgtaaagcacttaatgttatattgcttaacctataaagtagcgcttcagtgctctcatcatatgaagtaaataatagaaaattctttgtgtgacacatgtctgttttcagccaatcagaaaccaggattattttgtatgtaataatagggtttactggaagaggagctatacagatggtacttagaggatgtagggccctacgtattagggcttcttagttgtagcgaagagcaattggtctggtacgtttagctttttcacatttagttttgaattctgactctagaaatgtacaaccccatcttttgaattacaggttttaagatgttatttgctcttaatacgtcttaaggtaacagccttgatcactgcttttactttcgatgaaataacttaatgagctgtgaagaaaaaattatcagattttaagggagagaattttatgaaaatgtctttgaggttcctgtcacctttatgagaatgtcttcaaagtttccatcaccacctctaccaatttttcttccaccggagccagtggacttaggttccataacaagctcctcttgttcactgaatgagctagacaatatttcccaccttttaaggaaaatatcagctgatatcaatgaaattaaaggaatgaaagcagctattttgacagtggaagcaaatctttttgatctaaatgttagagtgtccaagaatgaagcaaaaatttcatctttggaggttaaaatgaatgaatattcaacaacatatgaatgcaacagacagtttgaagatcaagaagaagatactgaatcacagtcaagaactactgatgtaaaaataatcggcttccttagaaacgttgagaaaggtaaactcttaatatatgatatgttctaggtacccatcctttgatctgtatctttccacgtatgttgactgtagctctgatgtggagggagcaagttacagagaacttgaatttttcatggacctttaatgacaaatttggattctgcttgatttagcttagcaatctagaattgatcagaattccatcctctttaatggagctctctaaaacgatgttttgaaaagacagatgaacctagagcaatgaagcaaaacttgaaatgtggaagtgtggtctttcatgtgtcttgtgaaattattttaaaatgtctcattctttcatcatgtactgttgatgtgaaggagacctgttgcagtatttggatggaaagagcattcttcctgtaacttttcacctcagttttccaagcttcccacaggaatgcaacttgacctaagtgtcatcttcgttacagttcctcagaatgtgtgtttttttatggtaataattctggaaggaattgacttttttgggacgcaccagtaaaatttcatataacttatgttttaaaggaaactaactgatacaatttcaaatcgagtataggttttaaaatttaaaaacaccttttaatgaaatgtggtgcttggtgggagatggcccacttaacatctttgcactgagtaagcaaagcctgtccttgtgaagccacctgtaatggatatacccaaaatcagcatgtgggcatcttagtaagatttcagtatttgcaaccctatcagttacatccctttgtacactgtagtgcagtaccttataatgagcaagtgagtgcctgatgtctgctaagcgctgtgggggctacagaaaagtgtgacattctcccatcctcaaggagcttaacatcaaatcgaggatggaaaaaaatcagttctttgtccctattttgtgcagtcagactgctgggcatattattgttaggaatagtgaacctaataggaattaatgttaggagcctattttagaagaaataagtagttgaacatcttttcttgtggaagaggcaaagaattattatcatgctttgctaacatagggtgtggattgtagagctgagtgtcttattgttttctttgcatgcatcgaagcccagagtttgtcttttaggaactcttgtttagatgatgagagtgttttgttttgctatttcgattatcttcaaaggtcatgagttagtcgtgatggtaagagctcaggtgatggagggaggtgcttgccatgcttattgtgcagttggctgttatgcgagctgctgggccacaaggtgccttttcctggattttccacccgtttgccacctttactttccccgcagaattcaaattcaggaaaactgatgtcctcatagagggagaaccaggagtgttttaaattggcatttgtggtttaaccctgagtacagccttttttgtcttacaggatatgtctttggtctataaatactattaaattgaattgttgaagctttaagttacttttaagacttcaagttaagaacccagaaggattgatttttgggaaccacatgctggtattgtctgtgttgtaagcttagtgaagttttaaaatttatattctaggaactcaacagaggcaattattatcccgactgcaaatcgacccagtaatggcagaaactctgcagatgagtcaaggttggtaatgtttcaagttgtactgtaatccagccatttcagttgccatttccatttcttacaccccatttaacgtatctcggatctcttagatcctgccctaagatgttatatttagatctgtgaaaatattttagggccaggagataagatctgcatttctttcatgttatatagtgttataattttttgcctcattggaaaactttgttcctttcacaccattccaagtgtgtccctagcactgtcggctgtcactctcctgctgtcaggagtgacctgcgtttctgatttaccctcccactctacccagcttttgtcattgccatgagtggcttttgtatcctgtttttcacctggttagccttatcctcttgtacttcattttggagtcttatcaccagggccacacctggaacttgttgttctagtgttctagagccactctagtttgcctgtctcctttcctctccccacagacacacatgccaggggctactccaggactggagctgacgccttcatttttattatctctgtcctcagtgcccagcccctgccagatgcatgttcaatgtcttaaaaatgactgcaggataaacacaggcaaccatgagagacccggaatcatctcagtccttctgtttcccctaagtctgtcttttgtgggaagctctggtccctagacccctctcagtcaggactccacagtcagtcactctgttccccgaccctcccc

SEQ ID NO: 77232 - DNA, 1063 bp, Homo sapiens
tcaattccttccagaattattaccataaaaaaacacacattctgaggaactgtaacgaagatgacacttaggtcaagttgcattcctgtgggaagcttggaaaactgaggtgaaaagttacaggaagaatgctctttccatccaaatactgcaacaggtctccttcacatcaacagtacatgatgaaagaatgagacattttaaaataatttcacaagacacatgaaagaccacacttccacatttcaagttttgcttcattgctctaggttcatctgtcttttcaaaacatcgttttagagagctccattaaagaggatggaattctgatcaattctagattgctaagctaaatcaagcagaatccaaatttgtcattaaaggtccatgaaaaattcaagttctctgtaacttgctccctccacatcagagctacagtcaacatacgtggaaagatacagatcaaaggatgggtacctagaacatatcatatattaagagtttacctttctcaacgtttctaaggaagccgattatttttacatcagtagttcttgactgtgattcagtatcttcttcttgatcttcaaactgtctgttgcattcatatgttgttgaatattcattcattttaacctccaaagatgaaatttttgcttcattcttggacactctaacatttagatcaaaaagatttgcttccactgtcaaaatagctgctttcattcctttaatttcattgatatcagctgatattttccttaaaaggtgggaaatattgtctagctcattcagtgaacaagaggagcttgttatggaacctaagtccactggctccggtggaagaaaaattggtagaggtggtgatggaaactttgaagacattctcataaaggtgacaggaacctcaaagacattttcataaaattctctcccttaaaatctgataattttttcttcacagctcattaagttatttcatcgaaagtaaaagcagtgatcaaggctgttaccttaagacgtattaagagcaaataacatcttaaaacctgtaattcaaaag

SEQ ID NO: 77233 - DNA, 1040 bp, Homo sapiens
agcagtccgtcctgcttcctccacaggagtatttgaaaaggttgacagccgagatctgtgtgtgggatccacttcatcagctcttgtgcatgttttctcttctgcctccttcagcttttcattgtacccatggtgcacgcagtttgaaatagcaagtagttctgtgaggcttatgaatgactgcagtccttagctcctatcacattttttattctaagatccctttgtttctgcatattctattaattttctaaaaacatactgattttgtgtacacaatactctttgttatttctctgtggtctgaaaggtggttttgacatttttcccctccctgcttcgtcttgttttctctaagtggtctgttttggctgtcttttatgctggaggttcccctctgatgtctggggatcctaggtggtcttacatttaagagtggagcactcagaaggtcactggtattctgggttcatgagttggggcatggggcactttgactttctgtttgaaactagaccctgtggtggaaagtgatttgtcctgcctgtctggtttgtgggcaccctgatgtcactgccttcaagactttcctctcaggctggtcagcttctccaaaacaaagtttttcaagtaatagcctggtagtcagagttctgcgagcttaagtggggaaagaaggctgggggaggcacctcaccattaattattatgtaatgtttatttaaccctcccccaaccattgtcagtccagtacttctttcatcatggctggtgtctcttggtccagggactctgttcttatcctctgaagagtctaaagctccactttctccaagggagaatgcatgcagtgggtaaagatttatcaggaaatctaattgcctttaaaaatttttaacagtgtaccttcaggtgattttgtcgtagcatctttctggcagagaccctaatgcttcatccataggcctctccgaagattatctacaggaaagcacatcaccagtcatcccaggtgtcttcagtgtagaggtcgggattgg

SEQ ID NO: 77234 - DNA, 1437 bp, Homo sapiens
acctttattatatgtgtcagccttccttggtatgtactgctgagcccaccacacacacccttccagccattccacattctaacctttctcagatgccttcggccttgtgaaagcccctttccttctacgtgcgttttcctctgcctgaagtgctgtgttcgtttctccgagtctctctccttgtttattcctgcttgttcctttactgctgacttcagatgttcctccttgctaagcttttcgttggttcttggctggagtgggctgttctgtattctcagcaccttgttcacatcccttttgggtcatgctattctgaaattgtatatgtgtctgtttttctttttttctttgtgtatctagctcagttctcttagttgttcagtaaatactcagtgaatgaacataaatgaataccctgtaaattttggtctctaagctttaaaagaagtgtattaacttcagtccgttgatggcgtattgataggtcagccattctgggttgtaggtcttggcatattttataaaatagtagatgatgtgagcttatggttatttgcattaaaggccagtgtttttcttgatacatatgtttaagtgtccattcacctttcagttaccttttaaagtagtcctcggtttataaccaactggaaattataccacttgaattctttttatcaggacatgattctaagtggtactgtgcgaagtgaacaaaccagattttggaaaagtggttcagcagtctgtgtattctaattatagggagcattaggactcaaattctccaggtttttagaaaagatttttgtactttaagggtatattgttaatatctgttgagatgcctcacctgagaacctttctctgctgtggttagggagtgttaatcagaatcacttgtgccgtgccctacgcgagaaggactccttgagttctttgaaaacatgtttggaatagaattatagccctgttttcctgagtggaaccagttgtgattttcctttgaaataatttgaatatataaaagattgacattcttctcacatatataatgttgggaatgtaaggtatattcaaaagtaaacatttgtggccaatttttttggctcagattactatgacatggaatccatggtccatgcagacacaagatcatttattctgaagaagccaaagctgtctgaggaagtagtagtggcaccaaaccaagagtcggggatgaagactgcagattcccttcgggtactttcaggacaccttatgcagacacggtagatggtttctttttcttgtgtagttaatttgtgtgattagatagtaaaggttaaccattcgtttgcagcttccctcctccccgccctaaccgctagcgtagagtgctttcattgattcagtagctagcccatgaatagttagccaaattcagttttc

SEQ ID NO: 77235 - DNA, 1008 bp, Homo sapiens
cagcaccctgaaaatctgagctctcaacacaccgttagaaaagctaccatttgggtcctcaagctgcctgctcagcaagtgcaactgctgtgggtggaggagacctctgagtcccttgtttgaggctgcagtttggtttacgggtttcattccttcaaagcacatgtcctcctcttgatctgacatgtatcctggggggctggggacaccatccagcgtcactataaacttgggacttgcaggtttatctggttgtacaagatctctgccagacagataaaaaataccatagaattagggaaacaaacacaaaacgctgagccccctaaagtgctcttcagcagaactatcactcccttggctttgcgtttggttcaataaaaaaagactaggtagggctaccaggtgcagcactggtgggttctctgctaacacacgatggccatgaacagtcacagtggcatcaccagtgaccctccagcctgtacttactaaggacaatctcccctcaagcctgaccccatcacccattcgatcttcatagggtcaacatggaaacaaaccaaaaaattagcatcaatgctcagaacacaagggccagcagcatttatgctaattatctgtatgtttcttcttttatagaaacagtcaattttctaagggaaaaatcacccaaacctgatctgccaactctctttagagctgacctgattatggtcagctggcttttaaacttgcatttcctgaatttgcataaagaaaagaatctttaatagagttaaatcatacactgagttgtaatttgtaggttaatggatttctgaacaagaaagatgaactggaattcttgaaaactgaatttggctaactattcatgggctagctactgaatcaatgaaagcactctacgctagcggttagggcggggaggagggaagctgcaaacgaatggttaacctttactatctaatcacacaaattaactacacaagaaaaagaaaccatcta

SEQ ID NO: 77236 - DNA, 1623 bp, Homo sapiens
agcctcaaacaagggactcagaggtctcctccacccacagcagttgcacttgctgagcaggcagcttgaggacccaaatggtagcttttctaacggtgtgttgagagctcagattttcagggtgctgtcattgtgaagggaatctttgacttgtttctctaccttgaatgaatattggttaaaggccttgcttttatttatattcagtaatggccttttttcttctttcagacaaacccaccaagtacatttcagactctttttcctgtgtctttttcataggtgggctgttactccagtttgaaaacggagttcagccatggaacctgagagacctcttccgcttatgctggctaaaggatgaaccaccattcttgttgccttctttacctttgtattttcttcagaaactgtactgccactttgcccttttatcagcaatagtctcttgcaattaacttgagagaaaaatttagatttgatgctatttctacctcagtgaaatttctttgaaaggagtttctcacctaatctatcaagatcttggaactgtttaaattaatgttgaagagtaatatttagcagaactcagatgaactcatttcagatagcaccatagtttttggcaggtgacagtttcttatcaccgtttctttcactgggtatcagtggtagctgcaacgccactgatcatttccattcatgatagagaatggtaattatgttccttatatcttctaaaatatttagaagcacctcttcattggcaggagggataattactcaatcttaaaagcgtacagattcaaaggaaaaacagtaatggattttgaaacatttccttgagtaatcctcttcttggaagagatatgaaaatgtattgaatacctttctcgatcattaaaaatagaatagacttcagagggaaatcatatgttagtggagcaataacacttagctttattttaattggttgcgtttcctactgtgaatcaatgacgtagtgtcgtggttttgattagtggagggagttgaaaatctgaccctatcaacaggaagaaaaacttaaaaaatagtaaaagctgcagtaggcagtcccgatttattgactctgtatgttttgtctaaagagaagactccagtgttttcactactcttgattttcaatttggtaccttaattttttggtctattaggatctggtttcatttaaatgtaggtgtccatatgaggctttatggggtatacatgtagcagcagtgacaccataaataatatgttagtaaaaattcttgccagtgctgtggccattgtgctgacagccatgatgagtggtgagcctcctttcccattgctttgactggggactcagtgtttccctgctgctcaaggatgaagctttgtaagattagcataggggtgtggctggagagactcctgcagaacagttctcaggagtctctagtctctgcaccacttcccctgtgagcagggagtttgaaactgcaattgcttctggttggttttatgttgggttgtttcaaggatgctaccaacaacaacatctgttttaacctgctgtcttttcactcactgtcatatggcagcacagattttatagct

SEQ ID NO: 77237 - DNA, 1004 bp, Homo sapiens
gcattgagaagattgaatatgaaatatgctttttttttgttttgtagagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccaggtgagtgagtgactgtgctactacatttgggtaaaaaatataaaatggcattttgtgactgtaaatggaattgaacaaacaaaagatggtttcagaaataattttggcaggatcagttaatccaaccagtctttaaagagcaagtgtgcctatctgtagtattccgaagtattttgactagtgaatatataaaccttaccattctaatttaaaaatggttttcactttcaaaaaaaacatcagtagactgcattaaaaatgggttttccaaacagattggagatcagtcctggtttttattttgttagcagttgcaccaccagcaccaccttccagtagtcagctctgccgttacttccctgcttgtaagaagatggaatgtcccttctatcatccaaaagtaagaacttctattttctcaaatcaatttagtgacaacatctcaatttcctcatttaacttcttttttgtcagagttactacattggtgcaaaagtaattgcgatttttgccagtaaaactattaagttgttcctcgtcactgaacctccatctggccccttaggccaagtggtctgaaactgttcaatgttagtatcccaagcactcagtggggggaagcatatctttgctagtcacattttccattattccctgcatttaagtatatggatgggttttagcgggggctggggggcagtttgaacctaatgtcagaactgagatgaagaaatccagtaggtactgcttaaaaccatccaaacttgtactgatgatggttgatgaatctccagatgtttagttggtcaaaatgaattat

SEQ ID NO: 77238 - DNA, 1936 bp, Homo sapiens
ctgaagcgatatccttccaccgtggccttccaaagtaccaggattacaggcatgagccaccacacccagccagattttaacttctcattatatactacgcaaacatatactaaggccagcaggagtatatatatgtgtactgtacttgaatttcacatccattttcttcgacattagcaactgggagatactgaaaggaagtttcaaaatattttagtgtggccagaaaatttaattacatatggtattatcttttatctacctgacataattgaattatttttaaaaatctgccatttatattgtaatcttatgaccaaatatttattgcttaaaactagtcaactttttaaactgagatatatggtatatatggatacaaagcagataattaaaacaatttttggttctgttcattcagcgaatagcacccagtcctgcctggcagaagatcatgcagtttggaagttttcatgtactgatgaaagatactctacagaacttgtcaaatctttgaaacttggaatatattgctttcataatatgaagttttattgcctatctatctgaagtgtctaatttttcaagtttgtaagtttattatgtggttttaacattgggtgtttttgttttgtttttactatgaaaagacagcttaaggaagagctaaattctgttaaaatatttggggcatgtttgtgcactgctgttgtgaggatcagcatatgaaattgacatcatggttagtcatggtactgcagcttagggggctacacggttgctgtgtgagtggagagatgcagtgaggcagttgtcattattctaaaaattgtactactttcacttttcccaaagattatataatgttcataatccaccatgaaaacagcattggccaaaggtactgaggctgcttaaaatattcaattctgctttttaatttttaagtgaatttagtttgaaaagcatgattatacaggcctctcaggctgagtgctactttggtaaagttcccagttttcctgccttctgtgacaggatgaatgaggtgggtatggacagtggaggcagctggaatggcaagtgcagaaaataggaacagttctatacagtgctctcatttactaataacataatgccttctaaataatttttttgggaaactacattatcacaaaattatacaaatttttttacaagtatttacatactgtatctgaaaacagactttaaagtcacaagattataaatgtacatatatattctcacattctgaaaaataacattctcagaatccacagaaaatatacttagttactactgaagataatttttgaaatgtaaaaattagatttaaatagtatattttaaatgacagaactataattacagagatcagatcagataggtaaactgcaagatagataggatgaaacttttggcctactgtattacttacagagtttttttgtgtgtggtttttaaaactgttaaggcaagaagtgtcaaatgctttagagttaaataacagatcactgatttcaaagacttggtgtatagtgttaaaaattaaagcttaaaaggtggttagaaaagtggattaatgcaaaaggggtaataaagactgcaacattctcaggaccaaattaaactgctaaaaaaaaaaaaaaagttcattgacttgcttagtcgtatactcaaatgatgataaacctacatgtgcaaaggctcacgtttaagattgtcaagccagcagtctactgttgtgttgccattgcttttccattgggagaagaaagaattaaccagtcattaaaccatttggtaagttgcactttgctgtgctgatcccacaggaaaggcttgaaacacgagaagcagcaaagacagagcacacaagtgcataaggctgttgtcttcggcttgggtgaaatga

SEQ ID NO: 77239 - DNA, 1025 bp, Homo sapiens
ccagcttttggctacagagaaattatatttccattacagtgcaggtagaaactctgtaaccttaagcatgtaaactacatagaataaaactgtttccactgcatttctgtccttcaaagtggccaacctgattaagtcagccttaatcactgctgctgtcagtttcacgactaaaggtcatattgactaagtagtcatcagctgaccacctcgctgtatcagccagcaacgaggggaaggtgaagaaacatgataggccatatagaatctgccctatgtttacttttttaacccagataattatttttgtgtgcagtatctaagctcctgattgtgtaacctgggacttctggcaccttttgttccattcattttatgtataaaatgcatgccaaagcacactgtgccctctggtacccttgcttccaatcgccaaccatgctcatttccttcctttttttgtggtccctttttgtggtgatcattttaaaccacgtcatccaacaaatgttttatggtcaaccttagcttgttcataagccatagcaactgaaagattaaactcttaaatatgtgtctgggcagtggctattaaatagcaaaaaacaatcagattttagtattttattatttccttgtaaaatggctgaactaaattaaacccttgtttcccatttgttctataatttatagtgaaactgagaacaaaactatctttataaatgatagctaaaagtatttccagatatttaaacaatttaaaataaatttcttctgcagagatgcaaagcatctcaacactggaatgaacaaatgccttaaattcaatggagtaaacctttagaatgaagaggaactgtcatttcacccaagccgaagacaacagccttatgcacttgtgtgctctgtctttgctgcttctcgtgtttcaagcctttcctgtgggatcagcacagcaaagtgcaacttaccaaatggtttaatgactggttaattctttcttctcccaatggaaaagcaatggc

SEQ ID NO: 77240 - DNA, 1463 bp, Homo sapiens
aataatgaaattctgtcattcttggtggcaacatggatgagactggaggacatgatgtgaagtgaaataagccaggcacagaaagataaatacatgttctcactcctgtgcagaaactaaaaaagttgatcccacagaggtggagagtagaatagtggttactggaggcggacaagggggagggggagggggatagggaaggactggttaaaggatacaagtttacacagccagataggaatagtatgttttagtattctgtagtactgtaggatgactatagttaagaatcacgtatttatgtattttcaggtatttacaagagaggattttgaaagtttccatcacaaagaaatgataaatgtctgaggtgatggttatgcgtattaccctatgccctatagatatgtataattatgtgtcaatttcaaaataaaaattcaaaactacaactcctatgaaaatttttgagcgtgtttgtacttattaagtgtatttataaatcatacggatattatcttcagcctgcatattaaattgtagttaagcttttactttttaactaaaaaataaattctattattttttcctatatcccactgcactgaccccagtttggaaatcctaagattatcaaataaaaactttgattattgaagaatccaggtgtactgccacagaaaagttctattctgtagcatggactctaatatgtaatctagcccattgtgcttacagatagatgtgtgcctgtagtcatagaaaaatttgcatgagctaatgactgccttgctactagattagctcaaagcaaaaagttctctgaaagcaggtcaatagggtcatttttatattatgaagaagaaaagcagctgttgtattacattcactgtattggtcctgcttgtgtttcagggcaagatccttgttgggacaaggaatgctgaaataatcgaagttggagagaaaaatgcagcttgtaatattttagttaacggtcatgtggatgggccaatctggggactagcaacacatccttccagggattttttcctttctgctgcagaagatgggacagtgagactttgggatattgctgataaagtaagtacagataatttttttaaaagaggttacaacttctaaaaagaaaagttggaagttctaaattgctagtacttaaagaactgccagaattctgttgagcattttgaggggaaactggtataatttagaagtacttcacttaatgtttcctatgactctttttttttttttttttaaatgcagaagatgttaaacaaagtgaatttgggacatgctgctcgtactgtgtgttacagccctgaaggggacatggtggctattggaatgaaaaatggagaatttatcattttactagtgagttctctaaaaatatggggaaagaagagagacaggagatgtgcaatccatgatatcag

SEQ ID NO: 77241 - DNA, 2049 bp, Homo sapiens
acatttgattccttggactactgttatactcaaaagccttccttaatcttctaattgtcaccctaaatatcctaaaatttctgtcttcctagtagttcttcatagtcctaaaaatttgtcagagagaaaggtaaatcaagaaacatgattttcaaatgatttaaggtggtactagggtttaggatttcctttgctttttatcatttaacacactgcttatcatacagctggaagtgctctgggccagtgtctctacttcgagggaagaaggaggtagtgagacagaaggaaatagcacaattcctggccctgacagaagggtgttcaggagacctgctctcctctcactttattccatctcatctggacctgtggcttccaatccacatctctttcctttaatatcctgcattggctaggctgtataaatcctttggtgcatcgaaaaactaagtgcattttttgtttttgtgattatgcaatacttataggaaaagttataattttagaatatttaagtacacttacatttttgagaaaaagactattgaaatgtttgtgccatgtcaaatttcagttgaacattttgggtattcttaatataagaccaggccaggcaccgtggctcaggccgggcacagtggctcacacctataatcccagcacttagggaggccaaggcgggaagatcacctgaagtcaggagttcaagaccagcctggctaacaaggtgaaactctgtctctactaaaaatacaaaaattagccgggcgtggtggctggcgcttgtaatcccagctacttgggaggctgagacaggagaatcacttgaacctgggaagcagaggttgtggtgagctgagatcgcaccattgcactccagcctgggcaacaaagagcgaaactccgtctcaaaaaaataaaaaataaaccctagaattatagtatgttagaattggaagggaagaattgtctaaggttattctagctaataagcaacagacttggaaaggaaaaggtcctgacaaagctaagcctcccgttcaggtttcctgactcgtgaattcagtgctgctgccactacacgatgcatgctctttgtatcaagggtgagacagcattacacatacatagaaaattatctatttaaactctatttgaacttttgatgagtttgtctccccctcccccactccttttcagaataacttgacgtttacaggtaccatcagtggtgatgtctgtgtgtggaaagatcacatattgtgtagaatcgtggcgagagctcacaacgggcctgtgtttgccatgtacaccaccctgcgagatggacttatcgtgactgggggaaaggaaaggccgtgagtcctctttcttttcacagaatatttatgcatttgtgacctacctgaggtttgcagttaattattctagttgtttctaggctacacagagtgtcctctccgaccttcctcctcatatgcttctcctttattaccttttatgtgccttctatttgattctcatttctggtcttaattcacttccaatttttttcatgttggggtgatactttttctgaggtgtggataggtagttgtcctacaagttgagttacttttcttaatgtctgtatgcctgtgtatgatttgctgagtaggaggcccatgggggaatctggagccagggttgtattttgactgcctgctctctttttgttcagaatggattctaaggagtagaatgcacattgttgctttagaaaaggatgagggaactagagagaactgccttgtttccttttgcttgaggcaaatttaaactgttttatacaagacctcaaaatttgagaagaggtctcttctgagtgattttcaaatctcccaacagtaaccagatacttatgatttgatttgtcaccaacatagtcatatgcatgttgaaacatgacatgtaggccaggcacagtggctcacacctgtaatcttatcactttgggaggctgaggcaggtggatcgcttgagcccaggagttcaagaccagcctgg

SEQ ID NO: 77242 - DNA, 1042 bp, Homo sapiens
atggttgaaaatttcttttgagatctattcaggtggtttcctatctactgcctttgtctatttgtgtctgcttttcacttctctttcagataacatcagtactgaatgtatacttggtgtttaatatttattgtttaatatttgtatagttctccatataattgtataaagattaaaagtatacataaaacatgcatttgttttgaattgtttaaagttgagattgcctgatttgcttgtctaaatgctgtttttccaaaagtgcaatttggaatatggcctgaagaagtgttctatatattttccttttctttcctccccacccccaaaactccttttcctttcttaaatttagccttagttttgagctgttctttgttaagtacagtttttgtttggtacacatttgtccatgtttcacagatgaatatgcataagctttagaaacagaaatatttataacaggtagattacaactttttgatactatctttatttagctacagctccttctattcacatctgggatgcaatgaacaagcagactttatctatcctaagatgctaccattcaaagggagtatgttcagtcagcttcagtgctactggcaaactattgctgtctgtgggactagacccagaacatactattaccatttggagatggcaggaaggtaggattcttttgtgtgtttgatttttaaaaaaacaagaatacaaaggtagtaggaattctgtatttaatatttgtcttaaagttggtggttgaaacaatcattcagtggaggcctatgcaatatactgtacacagtggtactgtaggtatatttcactttaaaagcccagtggaactgtaacctcacaaaacagataaattaatgaaaccattattagcattataaatgattcactgctattttcttccagcaagaaactatgtatttattattaatgatttgattggttttggagattcttatgaaaattatgtatatttctaatgataatggcagatcagcaggataatattacctaccacact

SEQ ID NO: 77243 - DNA, 1481 bp, Homo sapiens
tggagacagctagcatattctccctgagtcttatctagttcttatcttttatttgtttctttgtttgtgacagagtctcgttctgttgcccaggctgtagtgcagtggcacaatctcggctcactgcagcccccacctcccgggttcacgccattctcctgtctcagcctcctgagtagctgggactacaggtgcacgccaccatgcctggctaatttttgtatttttagtagagacggggtttcaccatgttggccaggatggtcttgatctcttgaccttgttatctgcccgccttggcttcccaaagtgctgggattacaggcatgagccaccgtgcccagccttttgcttctcttttaaaaggtctcctttggcaccctccaactacattccatggaacaaggtgtacatgagagcaaggggattgctttccatgggggagcctacttctccactggaccatgttttgggtatatgaaatcccagaattctctaccagatggtcctgaacctactaatggccctgcatgagccttttctctgcgtctgtcctcccagtgacagactgtacaaccaatgtgtatactcttgaggggtggccaagctgttctttgtgtaggggtggatggagttctaatgcagtagctaggataaccacatgtcttaagaaatttgagctgccatgacagataccacagagtttgtagcttaaacaacagaaatgttatttttcacagctctggaggttggaagtccaaaatcagggtgccagcatggtcaagttgtggtgagggccttctctgtatttgcagatggctgtcttctcattatatcctcacatggtgaaaaaagattatctttctcctgtctcttataagaacactaatctcattgtgagggctccatcctcataaccttcacacctcctaataccatcacactggtgattagggtttcagtatatgaattttgggggaagacagacatccagttcatagcaccacacatgagcttccatggttctttgtggtgtgggatggaagagaatgagacaggttgtctcatgctgcccaaactctaaggagttctaaattggtatctgccttccagatcattataggagtgtactcatcaaggtaagaggctagaatatattttatttgataagttttatcttgatggatagctttaaaatatttaggccgatgacattcaagctttcatttgtacttctgtcccagaccctgttaatattcagagacaaacctagtctctccagaccaaacactcccagtctttcacccaggcttcaggtggcaaagttccaagccctctcaccatttggttgttaatagagcatattcataactaaaaatgatatttcctatgtggtctgctcagcagagttaagtactttattctgtttttcctcatgttccaggtcaaggcactatggtcctatgttatcaatatgtttt

SEQ ID NO: 77244 - DNA, 1052 bp, Homo sapiens
gccttaatttcattgtttacccaaaagtcattcaggagcaagttatttaatttttacgtaattgtgtggttttgggagctcttcttggtattgatttctattttgcactgtgggtagagagtatggcagagatgatttcaattttcttgaatttattgagacttgctttatggctgaacatgtggtcaatcttagagtatgtttcatgtgcagatgagaagaatgtatattctatggttgatgggcagagtgttctttctgttatgtccaattggtcaagtattgaattcaagtccagaatttctttgttagttttctaccttgatgatctaacactatcagtgggttgttgaagtgccccacttgtttgatttttgttttgctttttggggggcctagtagtattcatggtttctctatcctctggatccaacctactgctctgaactcattttccacctcttcattttacttccacaagtctatcttttttcccttctgcatggactactgtcatagccttacaaggtctcttcactgttactactaccagatgaatcacattatacttatttgatcaaaaaacttcaattcctgctgggcacggtggctcatgcccgtaatcccagcattttgggaggctaagatgggcggatcacttgaggccaggagtttgagaccagcctggccaacacagcaaaaccccgtatctactaaaaatacaaaaaatatatagctgggcatgatggcacacacctgtaatcccagctacttgggaggctgaggcatgagaattgcttgaaccagggaagtggaggttgcaatgagccaggattacaccattgcactccaccctgggcaacagagtgagactgtctcaaaaaaacaaaaacagattgcagttcttcctccactgacataagaacaaatataaaatgtgactcaatatggcccaaattattaaatggaaaattactactggtttctgtgtgactctggcaaatccttttctttgagaaaccaaaacagaaggatcgtgggctgacactcaa

SEQ ID NO: 77245 - DNA, 1063 bp, Homo sapiens
tttgtcattagttttcatgaaaatcagtgtatttgagtactgttttttgtttgacttaattcttatgtaagtctgagttttggatggatattctctgtttctcttaattttttaaattagtcttccttttacttttctgtgaataataccctaattgaactgtatctcagaggagtcctaaacctaagtatgtgtgaatgatcttttgcttatagaagcacagacaccttggcagtatctaaaatttagtggcttaaatttgtaaattaaagagtaagtacttataccaaataggaattttgaccctgtgcgatatattcactgtacagggttcatgaagcctgtttctccttctgtctctgcttccagccaaagtaaccttacgtaataattgaggaagaaggaaggctctttaggcatttcataatcccggtagcagtagcgaacaaccaaactctgctaaatcaaacgtaaacaaggcgtaaagctgtgcgatggtgattgctgtcgttccctccccaacctagtcctacaaagtcaatgaaatgtacattttcagttgcagaattatctgccagaactttagcatgaattgtcagagacagtatacttagtttttatccaccgatgatgaatgtactgtttgagttcttcgaagtatgtgacttggacataatttatcctgactcttgtatgtaggtcagatactttgattaacaatgaacataaaattttcttcttttggacacaaaaaatacagtccctctatgtccatgggggatagattccccctggggatgccaaaatccacaggtgctcaagtgccttatataaaatggcatagtaatttgcatataacctatgcacattctcctgcatactttaaaccatctgtagattacttatgatacctaatacagtgtaaatgctgtatacatatttgttatacaatattgtgttttaaatgttattttttattgtttttttccccaatattttctatctggaattggttgaattcttggatatgtaaggccaactgtacctcagtgtttacatgtga

SEQ ID NO: 77246 - DNA, 1102 bp, Homo sapiens
attcagttttatttttacttgtgggcatccaaaaaagtatatgaagaaggtttgaaaacattgtttatatattcttgaaaaggatgtttactttttatgacaccagtcatgcttatatattttacatgctgcctcatattgcgtatcaacatcccattcatttcttattggatgtttaagatatagcacatttacttttattgatgtttaacttgacaaccattttgaaaatgcaagtatattttatgcctttaattttatgagacttgttcataaatgttggagtcttttatatgggaaggttaatttgtattatttcctgatttaggtgttacaaattgaatattaacttaaaatttggaaagggattggtgcatgattgatttaaattcaatgttccggttattcagtatttgaataatggttgagataaaaataataaactaaattgcattttttaaaaaaattaaaggttctagagaagagcttctacatttaagtaattcaaaatgtgaactcaatatacctgttgggacacggcacattataaatagatcctgaacagagaagaggggctagatttgagatttgacagctactgtgtaggtaaagttgatacatttttagtaaatagtgagaataagggaagagaaagagttggaagcaataataatagttatttccttttatagtgtgttgtatggtttacagtgctttgtgactataaaatgtcttccttgagtaaccatctgatggcaatgccattaaccagtactagggacttcagcaagtagagaaggtgaagggcatggagaaacagataaatacaaatttgaactcggatgtgatttatgttgctaacagtgtggaacgttcatagaaatattacgaaaattcactttcaagaaggatgtattcaatacctgccatgtgaagatactctgttagatactttagaacagtaatccaggctttgttgttaatgtacctatcaagaaatatttgagtatgttaaattaacattttcacatttgtttataaacaatctactcttgtgctgttatttacattatgacacgtacaccaaagaaattaaaagtaa

SEQ ID NO: 77247 - DNA, 1044 bp, Homo sapiens
gccacaggcctggctaattgttgtgttttttatagagatggggtctcacagtgttgcccaggctggtctcaaactcccaggctcaagcaatcctcttgctttggcctctcaaagtgctaggattacaggtgtgagccactgtgcccagccttatgccttttctttattcttttttctttcttttttttcttttttttgagatggagtcgtgctctgtcgcccaggctgcagtgcagtggcgcatgcagtcttggctcactgcaacctccgtttcctgggttcaagcagttctcctgcctcagcctcctgagtagatgggattacaggtgcgtgccaccatgcctggctaatgttttttgtatttttagtagagacgggatttcaccatgttggccaggctggtctcgaactcctgacctcgtgatcctcctgccttgggctcccaaagtgctgggattataaactaaaaacaacaggcctttaatattatgcaatatagctgtctgcattaaacttgttaaaatattttattacaggaggtatttcactagtgttttcaattcaaatttatgttgtaatctttttccctctttatctgctgctgaaaagaggttccaggtaatcctctctttgctgtgtttacaaagcctaactttgtatttttgtcatcttccatatttagcattaatgggatactgttacttagtgttctttacctctcttcacagttttgcacatttttttcctttggaattggtatcactgaaatgaataacatcttaattattggacttactctgtataagtaactgctttactaaaacttatccattcaacttgtataattttataagttgtataattttattttcagcaatgatataccttatataaatgatatttataaaaattaaaatatgcttaaatgatctttataaaaattaaaatgtggttaattgttatataggattatatagataaaaattacctgtttattgtttgggttacatttaaagctgtcagacagtaacatagaataatatt

SEQ ID NO: 77248 - DNA, 1052 bp, Homo sapiens
aaatgcttctgatgacaataaccattctatttggttgatactttcgtggatgtttttcctaagtgataattttacctttttcttttttaataaatgtttttgtttttatttttttgttttgttttgttcttttgagacagagtcttgctgtgtcgcccaggctggagtgcagtggcacgattttggctcactacaacctccaactcctgggttcaaatgattctcctgcctcagcctcctgagtaactgggattacaggcaggcaccaccacgcccagttattttttgttatttttagtagagacggggtttcaccatgttggctaggctggtctcgaactcctgacctcaagtgattcacccacctcagcctcccgaagtgctgggattacaggcatgagccaccttgcccagccaataaatgtttttataacaaatattatgtatttaaagtagttaatttttgtcaaatttccagtatttgtgaataaaaatatttaaatcaatgtttaaaccaatgtgacataagttagacatttttgtatttccttaaaattctgttgacatgttgcctttcttctgtttgctaaaatgctgtattctattcatcatcaatttttatatgttttcctacttttttcccccttgctccttttgaaggcagggagtagtaaggtaagtgttttataaaagaaaatattttattcaaaaatttaccctttattttattctttatggtattttaaggtattttttccctataaaacatttaactacatttgtcaacaaagcattataaaatgaagtaggacaaattctataaaagagttgcatttttagatagcatatatggttgttattataagggtcttcattatgataaattgttttacatatgactgtacaaactactacaatgcaaatgaatagttttggttttctttaagtttcagaggctcgtaaaaacaaacctaaccacacatatatttaagtgaaagactattcaattttaaacctgttaacatgatttaatgcatgtttaatccattcat

SEQ ID NO: 77249 - DNA, 1538 bp, Homo sapiens
aacacagcctccataatttgaccacacagaggtaacacctcttctaatatttggggtatatcctaagatgtatgtagctaatatttttttaagaaaagtatggtcatattgaacttattttttaacctgctattattacttagtaatactttgaaaacatcattacatataattaaatattcttctacatcgttttttctggttgtatattacttcataatttgcttataacaacttaatttatttcatattgttgaacatctttgtatccaatttataagatcataattgatctcagttattgcttaaagaattactcgtatatttttattgtaggctatgacagtgatgttacaagggagaatgaaatcagttacaccatcagagccttatcaacaaatattcgcccaatgttaggaatcaagcctcatttacaacaaaaagaaccctcaattgatgaaaggtaataatttagtttagtattagatgaagaaaaagatattgtcattaaaaatggaatttattatttaagtggcttttttacacaaactaagtaacagtgatattcttgctatagacaattcacagcacctcttagaaagtatgtctgtctttaaataccttttggtatcagcctgggtgatgtagtgagaccttgtctctatggaaatataaaaataatccaggtttagtggtgtgtgtttgtagccccagctacttcaaaggctgaggcaggagcattgcttgagcccaggaagttgagattgcagtgagttatgattggtgccactgcactcctacctgagtgtcagaatgaggccctgtctcaaaaaaaaatacccacaaaaacaaaaccctattgatggtaacactatgtgttaacactattggtttagggatttatacatgtttataaggttgatatgattcatcttatttgctaacttttataaatgtgtgtgatgaggttggaggagataataaaaattgaatccaataccgagtactttttaagaagtatgtgagcagtattgtgattcaattttgaaaaggcctgcctatccatgtgcctttctttaagcatagtcagtcctcatttcaaaaattttctaaaaaggcaggttgtctttaatgggaattattggtcttagtctagaatcagcaaataaaaaagtaaggacatatgcaaggccattttatgaggagagatcacttttttttaattatactttaagttctgggatacatgtgcagaacgtgcaggtttgttacataggtatacatgtgccatggtggtttgctgcatccatcagcccatcatctacattaggtatttcttctaatgctatccctcccctagctccccactccctgacaggccccagtgtgtgatattcccctccctgtgtccatatgttctcattgttcaactcccacttatgagtgagaacatgtggtgtttggttttctgttcctgtgttagtttgctgagaatgatggtttccagcttcatccatgtccctgcaaaggacatgaac

SEQ ID NO: 77250 - DNA, 1481 bp, Homo sapiens
agggagttttgttaaatacaaagtatcaaaactacatcatacatagcttttgacatttgcttcccactgaactaatttgttacactaaaaaattattttgttaagtataatatacttgaaaaatgttatcatttgttatttaacacatctgttttattataatttatgaaacagctaagatttctccataaagaaaaggaaaattaactctagttgcagagtgtaaaaaagtatttccaaagatagaaaatgtcaagcaaatatgtttctattataggttctgggaaatatcttgctgtagcatcccatgacagctttatagatatatacaatgtaatgagtagtaaacgagtaggaatatgcaaaggagctaccagttacataacccatattgattgggatattagaggtaagactttaaataacttaatacttgataaaagtttcatttgatttagtatagctatattagagaaacggaaaagtgattcaacagatgagttaaaaagaattgggaaaaacaaccattattctcaaaattattttttactattttacatctgaagatgaatactatagagttgagacttttctttttcctttttcttttctttttttttttttttgagacaggtctcactctgtcacccaggctggaatgctgtggtacaatcacagttcactacaaccttaacctcctgggcttaagtcatcctcccaactcagcctcctgagtgctgggactacaggcatgcaccaccatgcctggctaatttttaaatgttttgtacagacaggttctcactatattgcccaggctggtcccgaactcctggactcaagcagtcctcccaccttggcatcccaaagtgctgtgattataggcatgagccactgcacccaacctacacttttcaatacttcacctaatatcgttcaaataatagtacagtaagtgattagttgtttaatttgtaaagtgatttaaatattgtgcaaaaaaattgttgtgaagatgtcttgatctttgtcatataaatttgacataaatagaatatagaaatgttggccaggtatggtggctcatgcctgtaatctcagtactttgggaggccaaggctggaggactgcttgagcccaggagtttgagaccagcctgggcaacacagtgagaccccattcctaaaaaaaaaaaatgaaatacatttttaaaaagaaatgttaatgaagattttaaagtcatttttctcattgtttgatatgaaatatatcttcaaaaagagtcataatcatataacataaagaacttaatgagtatgtttgtattttagcagaatgcatggcatatgactgagtttaatatgtttgataaatgttaagtattttaaatcctctctttttaaggatgttattgtttcatgtattcaactatattgtattcaactatataaattgagcatcataaagtttttctaaatata

SEQ ID NO: 77251 - DNA, 1614 bp, Homo sapiens
agaaaagtcaaatagttaatatacacaaataaagatatacatataacaaacattatatgcagctcctgaaaaggattcatatattaaattgtctccttcatgtcttcacttgaacttctcataggcatctttaacttaatttgtacagaactaagcactggtggttcctcctctagtttatcccatctcagtaaatggcatcaccactcaagcaaaaccatgcccttgacgcctttcaccccacatccagttggtcaaagttctgccagctctatctttgaaatatatccaaatccttcctcttatcacctccactgctgccacccagctccaggtcatcatcatctcttgactctcaaatctgagaaatcacatcttagatttcttcatttccaatgtatgcttgataattaaatgactacttgttctcaacttatgctataacttttcattctgtatataccctgtcctttcctcatcagatttcatacaagataccaaaatccttagggcttttgaatatgtttgctgcaacccttgctgttagggtaagcccttttttgtgtttatcaatgcagcactaacccttatttttacgaatgttaacatcattaatgacattaatgaacgatattaatttatcattaataataaaaatatcatttcatatatggttctgaaacgtatatatacagatgtatcttcctacctttaataatggcctattagatttttaaaaatattttagtttcataggccaggtgctgtggctcatgcctgtaatcccagcactttgagagtctgaggcaggtggttcacctgaggtcaggagttcaggaccagcctgaccaacatggtgaaaccccatctctactaaaaatacaaaagtagccaggcctggtggcacatgcctgtaatcccagctacttgggagcctgaggcaggagaatcacttgaacccaggaggcggaggttgcagtgagctgagatcatgccattgcactccaccctgggcaacaagagagaaattccatctcaaaaaaaattacttttataaagatgacttatttcttaaatttctgtttttttggaaagaagctacaaaggtaaaacctactctgcaaaacttccacatatatcattggctttttatgttaattaaaatctctcattctttttcatcaacttaatttcttttaaggtaaatatccatacttgcttttgttgtattcagaagtgagtttcattcctgcttagaattccataccattgacttctatagaaaacttaatctgtatctcgactcctttttaatattgatttgaagccataataaagaggcaacctttttagcaaatattttttttttttttgaggcaaggtctcactctgtaacccaggctggagtgcagtggtgcaatcatagctcactgcaccctcaacctcctgggctcaaacagtcctcccgcctcagcttcctaagtaaatgggactacaggtgtgtgccaccatgcctgtctatttatttacttacttacctgtcttcccttccctcttctctcttccccctcgccccttctcctttgccccttgccccttcccctactctgccta

SEQ ID NO: 77252 - DNA, 1040 bp, Homo sapiens
gccatatcattaggacatggtcatattttagttggcacaaagaatggtgaaatactagaagtggataaaagtggcccaataacacttctggttcaggtaattttaaatgctaatttgtttttttttctttacatacaattgattatttcaatatataagagccaaaagttgacagtgatgaaaaataatgttaaattagggaaatatttgttaatgtatacagaaaaaaaatttaatgtatacagaaaaaaattttaacgtatacagaaaaaattaatgtatacagaaaaaatttgtttttttctgttaatgtatacagaaaaaattttaatttggttataatgaaatgattgggtgtcagtaaatatacatattcttctatggaataattgccaatattttgagtaatttcttatcagaaaataaaggacccatgaaaagaaaaaccagctgtaattaatttaacccagtctgtttttaattttatttatataaggtatatttgttgagcctaaggcaattatttttctctgaaactcttcattaggccattcttaagtttctaagaaaaaataaaaatgtatgctaaaatttcattactgaaaattaaatatcagtgaaaagatgtaaataataaaacaggccgggcgcggtggctcacgcctgtaatcccagcactttgggaggccgaggcgggcggatcacgaggtcaggagatcgagaccatcccggctaaaacggtgaaaccccgtctctactaagaatacaaaaaattagccgggcgtagtggcgggcgcctgtagtcccagctacttgggaggctgaggcaggagaatggcgtgaacccgggaggcggagcttgcagtgagccgagtttttaacttccattatttttgatgctgttataaatacaactgttttcttaattttgattgcatattgttcatttctagtgtatcaaaatgcagtagattttgtacattaaccctataacctgtaaacttgccgtcctcatttattagttctgatagttttataat

SEQ ID NO: 77253 - DNA, 1153 bp, Homo sapiens
aacatgaaaaatgagattgcttaaaaattcacaaatatttatatgtaaaggaatgcatgagaataatcagtatcacattcacaatactaaagcgtgaagaagggagatgaggttggcatgacatttcagttactttgggatctttttgtaggtcagcggatatataggcattcattgtattggggtttttaaatgcctttttgtattcttaaatatgtcataataaaaactttaaaaaacatcatcaaaagtgctaagggctgattaaaacagacttagtccaggtctttgtttatctaaaaagttatggtctaaatgcagttatgcaaggtgttacccacatcactgattgagacacctgtagttttcaattctccttactgttgcatgccttactattcaaacaacaacaacaacagtagaaaagaaactttgcttctttataattgagtacattttgaaagtggtactttcataatattttttgtgaactagggggaggattgattggaagaaaaggctacataggcacactggggaaaaatgacacaatgatgtgtgcagtgtatggatggactgaagagatggctttttctggaacatccacaggagatgtgtgtatctggagagacatctttcttgtaaaaacagtgaaagcgcatgatgggccagtgttcagtatgcatgcattggaaaaagtaagtaacctaaagagattttaaattaaacaaaatttgtcctggagtgtagagcattttaagaagtaaaggaacactgcctttctacttgcctggactatccagcagtagtctgtgggctagggtcatcttgacctttctttgtttctcttttcaaactcccgaacacagaatgaaataggtctgcagtgttttgttttgagatagtgtctcactctgtcacccaagctggagcgcagtggtgtggtcatagctcactgcagcctccagctcctgggctcaagaaatcctcctgcctcagcctcttgagtagctgtgactacaggcaagtgccacccacacccatctaatttttaaaaatttttttggtagagattatgttgcccagggtagtctccaactcctgggcttaagctattctcccacctcagccgtcaaagtattgtgttacaggc

SEQ ID NO: 77254 - DNA, 2106 bp, Homo sapiens
aaagtagtcatattagtggcagcatgttgttgtaacttacgtgtttttcatttgattaacttttcataattactcaaagttcttatattacagtaaatttcttatgatgaatttaattaaatattttcttcatccctttgttagttttccctttccttctattttttaaatctcttttttccatttttcttatctccctcctcccatcccaacctgatggatagataagggaaaaggagatcaggtgcgatgagagcagatacatttagaggatttgagaaacttttattctccctcccttataaattctggttctttttataggtgtatgcatgcctaacatttaacattattttatcaaattttaaatataggatgtgggtttagaatatatactgaatgttttctctcttctgaatgttaatagtcagtttatctctctcattaattttccacagcggatgggaaacgtttggcatcagttggcatagatgatagccatactgttgtgctctgggactggaagaaaggagagaaactttcaatagcaaggtaggaaaaaaacttgatatcacatttgcaaaatactagaattactttggacttaaaaaaatttttaattaaaagaattttgaaatcaagcaaatatgtaactttttattgcttccatgtttattaccattgaataaataatataatcatagtaaatgatttcagaatttctttgtagatttatcccttgtgaacccacttttaaatataactataatatggcattggatataactatctaaaatctccacgtacagttagaatgtgttctactgtatgataggctattatatagctgttggagaccatgttcaaatgcttatattatatattaaagtgaaaaaagatatatatgcatatatgtcacaaagaagttataggtttttattttcttatatttttcttcattttctaagttttctacagtgagcatgtattttttatagtaatattaacaatgctttaaaggaggaactagtcaacagtgtcagagattttaacctgctatttattaaagcgatgttaaagcactttaaatatatagataaatgctttttatggagcatatagataatgctcaaattaacaatagtttaagaggaattttgtagttggaaaggctatcttaagctataacaaagtattgttttaaaattgactttaacccattcatgccacaaatagcattccctatggcacagtactatagtaggtattatagatgctgtccaaaaggagttcagttttgaccatttctgtctcttgagattctcttgagcagagttaccatattaaaatgatgacaaaagaacaaatacacagcccaaacctgagagataagtgggagtaaaatattcgtaaatagagtaatcaagatagggtatggattaggcaagagattaatacaggaatgatgaatcttcagagctaaaacatttcgatgtttatttcagaggaagtaaagataagatttttgttgtaaagatgaacccctatgtgcctgataaactaattacagctggaattaaacacatgaaattttggcgtaaagcaggtaagaaagtgcttcttttttactccatagaattttaagaaattattgcttttgaaagtaatttagctaagtgcagtgtgtaccctagactgcatcctggaatagagcaggaacactaggagaaaaactgatgaaatctgaatgaagtcttgagttcatttaataataatgtatcaaatatgttggtttcttagtttcaacaaatggtctatggtaatataagatgtcaacattggctgggcacagtgactcatgcctataatcccagcactttgggaggccaaggtgggaggatcacttgagcctaggtgttcaagagcagcctgggcagcatagtgagaccctgtctctacaaaaaaaaaaaaaaaattagctgggcatggtggtgtgtacctgtggtcccagcttcttgggacgataaggtggaaggatcacttgagcccaggaggttaaggctgcagtgagctgtgatctcccactgcactgcagcctgggcaaca

SEQ ID NO: 77255 - DNA, 1123 bp, Homo sapiens
gctatttcacatcttttacttagttccttcgtcttggaaaactcttcccctccacttctattcaaccttccaactttatctaatttctgctccttttaagacttaggctaagcctatctgagaactctcccaacctctcccttctccccttcatccctgagtgagatgccctaagtgtactttaatagtactcaatattatactaaatactgtctatacctcatggaatgtgatattgaaatccaagcctttccacttattcgctactggcaaattacctaacctctctttaccttcgtttcttcatcctttaaaataaggatgttatctgttcccatctcgtagagttgttgtgattggtacatgagtcaatgttcgtaaggtgcttagaacagtttctggcacataaattacttctcagtgagtgttagtcatcatcataatttccaggtgagatgtccagtagacaattgaaaatgtaagtcttggattcagaggaaaagtaactgctcgagagaaggacttgggaggtatttattgatttaaccactgaaactatagaagtgagatacctcagggcaaaaatgaagaatgagaagactggagaattaaagaccaccttgggagaggtttgtatttaagtaacaggtgaggaaattgagaaggaaactcagtagtaggagtcaaggaagctgggcgccgtggctcatgcctgtaatcctagcactttcgaaaactgaggcggcagatcacttgagcccaggagttcaagaccagcctggacacgtagtgaaaccccatctttacaaaaaatacaaaaattagccgggcatggtggtgcatgcctgtagtcccagctacttgggaagttgagacaaggaggatcacttgagcctgggaggcggaggtcgcagtgagccaacatcatgccatttcacttcagcagggcaacaggagtgaaaccttgtctcaaaaaaaaaaaaaaaaaaggaaactggagaaccagaagagagtagtacagtaaaatcatcaaaagcatcaaattctgtagaagtttttatataaaaagaaaacttaaaagttactggtactactgtgtacccacaaaaaatgttaaaaattt

SEQ ID NO: 77256 - DNA, 1926 bp, Homo sapiens
ctagtggtgacttacaacattatgtggcacataataagcactatgtaagtgtttattaaataaaaaataaatttgtcttatgaaagtttcatatgtatggaaatgggcctctttaaacaattaagtaaaatgtaagagataatcatctcccctcaatatgtctaatttggaatgatattgtgacttcttcttgcatgagcatttttgcctaaatattttaatttcaccaaaatacgggttctggattctcttagaacatctggcaatacgggtctcacatttcagcttggcagaaacagattttccaatctgactcttttctaccattcacccagcattcgttttcttacctgactgataatacttatcaagaatttgaaaaaggatttaattagtacaagtattttttctctagtgttaaaatggcagtagtttctatgcagttgtattttatgaattgggtttctttgaagtgcaaaccaaggttgctataaatagacttatattgaccattttaagatttgactactttgtcttggatgaggataatattttaaaattgtagtttaaacttatttttggaatatacgttgtattctcatggtccaacaatgtgtataaaagggtacagtttgaaaatctttctcccacctctgccctcccagccatcatttcccctctctgcagatagttactgttacttagtttcagaaatacttatacaacaaatacaaatatacttttctataccttttacttataaaaagcaattgtttttgttttatagtatacaattttaatattatacttatgtaaatggtagtatactatacatactattttctaccttgtttttttcactcagtattatagcttagatttagctatttgcagtccgagcagttcataaaagtttattggatctgagatggtggtatttttttaattgttcaggctgggcatggtggcttacacctgtaatcccagcactttgggaggccaaggtgggtagagctccggagtttgagaccagcctgggcaacatggcaaaaccccatctctatgaaaaatacaaaaattagccaggcatggtggcgcacagcagtagtcccagctacttggagggctgaggtgggaggatcgtttgagcctaggtggtcaaaattgcagggaactgcagtcacaccactgcacttcagcctgagtgacagagcgagaccccatctcttgaaaaaaaattgtttagtatcctgtaaaactggaaattgaatgattcacccaaagggtacctacttctcccctgtatattctgtattgatcagataaaaggccaaaattaattatatatgatttgttttctatattagttacagaggttatgactgtcgaagtaatctgttttatactcaaattggtgaaattgtgtaccatgtggcagcagtgggtgtcatttataatcgacagcaaaacacacagcgtttttatctgggtcatgatgatgatattctctgcctaactattcatcctttgaaagactacgtggcaacaggccaggtaggtttgaaagactgacaataagccagataagctacacctttgtttgagtttaaataaattaatcacatatctcttttatgttctaggatatgaagagtaaagaattctttagaatgagttttattttcagattataaataaaatttaccccaaacttttttcctacagttttagagtttttattattttaattcatattattttaatttaaatttggaactcatagctctggcttgttttatttctgtcatgatattaattttttaaattagtaaaattagagaaaacataaagactagaaatctggtgtctttaggttgagttacctaaaacaaatgtaaattatttaacaaatgtcctgtgacaaac

SEQ ID NO: 77257 - DNA, 1861 bp, Homo sapiens
tcctgaaagaaaactgaaagatgctgttcacatagcaccccaaggtgagtagtatgcattagctaaacagtttccctgtcaaataattcttcagtaacccccaaataacaattttatattaaagtataatctggcctcataagttaacagtgtagtttgttattagtagaaatttcaagttaaaatattagttctatatgtttaaagttagatgtcacagagtgtgaaatacaaagtaattttgattgcgttttaatctatcaaataatgagtgaagaaacagttatattaatagcaaaacaaacatttaatatatcctctgagagatgggtatctagattttgtaaatgcttttattgacaaaaattatctaatgtcaattcatctgttgcatatagtatttttagctatttttcatgttaattataggttatattcacttatatttgcacagacatttaaatttgatgtagcggtcattggggagccagtgaagggatttaaaggagctattgagtttgcagtgagtggagaggaagataatctgtagtacagtttactgacatctgtgtcacttgaataggtaatttcatttgattgttttatggcttgtctccatgtcaactgacatagctcttaatcattaatttttcagtgctgttttgaaaatgaatcttctttaaacaagtaacatttcatttttaaaaattacagaaagtctggctgactctcatagtgatgaatcagattcagatctgtctgatgttccagaactggattctgaaattgaacaagagacacagctcacctaccgtcgacaggtaattttccatatcacatggtttttctctaaaaagtctaatttcttctttatcttgctccccgttagtcatctgttgttatcttttgtggctttaatttctcaagcaatgtatgactatattagttttcccactgtcagtgttagagtacacttgtgtaaaattttttttatattaaatgcttggtatattaagtatgcttgccttctatttgcctataggattttgtcatagtatactcacatttattcctttaacaatattcttttatgaagtataaaaatttcctggaacactatgtatctatttgtcagtgtgatatgtagaaaatgtgaatttgtttgttctttccgagggagtaaatttcatgaattaacttttcatttaagactactattaaagctgttgttttcagacaatgtctgaaagttatattgggagtatacgaacacctttattagtatatattctaagaatatttctacttgtatacatttttaaaggtttacaaagaagatctacctcagcttaaagaacagtgcaaagagaaacaaaaaagtgctacttctaaaagaagagagcgggctccaggaaatagtattcgattacactttgttcacgggtataaaacaactatctttcatttatttgtttgaattttggttcacacttactagcttaacatctctaatgatagaactgactgtatcccctgaaatgacatatccgaaaggatacaacattgcccatggggaaaacacatcacctgaatctaatcatgaggagacattagacaaaaccaaattgaaagatattttttaaaatatctggatttttaagatgattataaaggacattgttgggacaactgggcatatttgacttagagtaatacattacattgtgtgtaatatattaatgatatgtgtgctttgtgactttaaacaagtcacttaacctctctgtgtctctttttttctgtctgtaaaatggagataatagtactgtgttagtccatttcacattgctataaaggaata

SEQ ID NO: 77258 - DNA, 1016 bp, Homo sapiens
cttttaccataaaaatctattactttatttcctttattctttattaactccagaaatttagtatggatctctgaagtacttaaagtaatttagaaactgaaattcagcattttcctgtacatctggcatatattgtttccatgtatttctgttcagcaacgtattgttgctgaattaatactacttgtgttatttatgtttactttatagtttataaacacttgatacagcttcacggtcattttagacatgtttgaaacggcattaattctgttgtgacttctgttcatgtagtctcatttttttctttttaacagagatatgacggaagttgtacatattaaagataggaaggaggcaattcatgagttaaaatattcaccagatggaacttaccttgctgttggatgcaatgacagctcggttgatatttatggagttgctcagcgttataaaaaagttggcgagtgtttgggatcccttagtttcatcactcatctggactggtcttcagacagtagatatttgcagacaaatgatggaaatgggaaaagacttttttatagaatgccaggtaacaatttctagcaaattatagatttgtagtacctatacaatattttagagttttactggaagcagagtgtaagttacatttgatcataggaaatcaaagaagatctgagctaatatttcaggcattgtagacttttctacaatataatacaatatattattgtattctacaataattctacaatataatacaataaggctgccttatattgaaatccttttgggttttttctcaactctattgaggtataattgacattaaaaattgtatatattgaaaatttacaatgtaatgttttgatagatacattgtgaaaccatttccacaatcaagctaaatgatgtatctgccacttcacagttaccatttttgtgtgtgtgtggtgagaacatttaagttccactctcttagcaaatttcaggtatatcatacagtaaca

SEQ ID NO: 77259 - DNA, 2299 bp, Homo sapiens
ataattaaataccaccttggttatatatagtcatgccttgatattttgggggggattggctccagaaccacagataccaaaatctacacatactcaagtcttgccctgggaaacctgcatatgtaaagccctccctatctatgggttttgcatcccacaaagattgtattttgatctgggtttcattgctaatgtggaactgtggatacacagctgactgtatttattgaaaaaatccatataagtgagccagtgaagttcaaatccacaaggggcaactgtattaagttcttatggacttacttctagattttcttttgtgttttctgatgtatttgtttattcttatatcctaccaaaatattgttaaattggtttaaaagggtttctaccttcatatagtagatgttcttaaaaaatatttgtcgttaaattattttatttcctcttctaggcaggaatttttagcatgaatgcttgtgaagaaggctttgctactggtggcagagatggttgtattcgtctttgggatttaacttttaaaccaattactgtgattgatctcagggaaacagaccagggatacaaaggtaataacaaaacaaatgtcttattactaggcaaactctaaacttcccaaagattatctctttctttcagtgagtataaatgtaagttttgtaaatataaataagacttatatttgcctcttcaccctgtatgcatttgattaaaattcttctattaaggagaaattttgcctgtaaagagtttaggttcattgttaggagaaagattctttcataagtctaatatctattataatgggacctatagagagatgtgagaggtactcacttaggtatctttggattttgaaagtattttactattagaatgctaaatataactatttaacaaactattctaaataaacagttgggggtaaatattgagggttgggaaacttttgttcaggataatttaaatgtggataggtgtatttttccttcacccaaatttgtcagcaattgggggattttttttttttctcttggggattaaaaaaaattgatgtaataaaacaggaccttttactataaaagctacccacaggtttgtgtttaaaccatattccagtcacctacaagttgtgtgaccttgggctggtaatttaccctcactgtaaataaggagaataagaataaatatattatttaggatataggatcctatatatgaattgatatttctcaaatgtttataaggatagcacataataagcatgtaaatgttaattggtattttattttcattagttttgctaaacattattgtgctttaaagcttacaaaataatttgagactttttcttatctgatcctcacaagaacattgtgaggtacacggtgtctttatattggccatgtaacacacatgagaaaactgaaaaacacggtagctttcctaagattacaaaagacattcaggagtaggcagaaaaagtaaaattctctctttttaatgatattataagtatattgaagaaatatagacaagtaaaaagattattaaaaggaaaagaatacaattctataaaggtaatttactaattgagtacttattgaacaatgcagactgaagtgttataagactggctgagcaagtagacatggctagagttgtctacaagggagaaggaagaagagtacatgtcttgaaggatgggtaggaactaggtacataaaaagacaaatatttcatgtagaaaacaacatggacaattgaagaaaatgtgagtatagatcaaggacttacatatttcttctgtctcacatctaagatataaaaggtacaaaattaacttcaatttaggaagattggaattattgacacaggatattttgggtgctaccttgccagctggagacctccatggcgggcgcaatgcccctgtcccgggctgcactgggctccaggctcgccaggaggtaccctgcccacttggcctggcaggctgcgcttggcttatactctggctggatcccacacttgctgcaggatccatgctcagcctgtggctgggccgggtgtgctgtgacctgcttctgccttgggcgttggcgtctggttgaagggaatgtggtggcacctaaaaaacttggggactctagcggccctgaagccccaaagggggtgttacagcatgttaatagctctttcagtcctgcccaataaatgggggcatgtggtgcccagcggctccctctcctgttgcttggtgagtaggaggggagtg

SEQ ID NO: 77260 - DNA, 2099 bp, Homo sapiens
tttatagttacttttaaatcattggaacaaattggaattaacttgctttacttccactgtctgatgtaacagttcctggtaacagttaattcctagtgaattaattaaggttctgtgttcacattctttatttcaatatgcctaactccatccacgttttctccagtgcatctttcactgctgctgcaattcttgatttgttattctggtattgatttgattgatggatagtagtaaatatttattttttgacaaatatttaataccaaaaaggctgtatgctgggctttaaggcacatgatataagcactgtgaaggtatttttgtcttgttcatctttgatggacagtgtgtttgatatggtacttgatatatattaagtgcttaataagtgattggcaaattaattatgaataaggagatcttactattttatattgtaagtaaagctaaaggctccattttcaggtttttataaaaagcttatctcaaactaaataaactatatttttataatgagttacatttctttccctttgctagaagaaatgaatagtaacatagttctctttgcaggcaatacatgtgaggaaattaattcccagagatgatctagaactgcactgtccaaccatacatagctatttaaacacaaattagttaaatgaaacttaaaattcatttcctcagtcacactagcagtacatttcatatgcttatgtatctagtagtggttactgtattggaaagcgtgtgtgtgtgtgtaatattttcatcatcactgaaatttctattggtcaatattgatttggattctagaacaatagttcttaacccttgctgagcatcaaaataatttgggtacctgggcttcatgcttcagagattctgtctcagttcatctcaattgggagtccaggcatcccattttatgatttcccaggtgattctaatgtgaagctaacattgggaatcactgatctagaagaaaataatggattcaaattaggacatgctgaaagaaagaaaacaagccacttatgtacacaaattatggagattttaagtttaaaaattacaaagtttaattaaagtactcattagatctttgaatagataatgatcataatttttagttctttgaggcttcaaattttaaaataagaatatatgataataaattattttaaatgttaattacttattacaaagttgaattttttctttgggcctaatttctttatgcagaactatttaatgtatgtatctctgccctgtcccatttttttggtttattttttagagatgggatcctaccatgtggcccatgctggagtgcagtagctattcacaggtgtgatttatagctcactgtagcctcaaactcctggcctcaaaccatcctcccacctcagcctcccaagttgctgagactacaggcgtttgccactgtgtccacttccccccaactcctttttctttaaatttctctccgtgaactataaaaatttacctaattccacctaatagaacaaaagccctggtaatgaagattcatggttaacttcttattttctcccaagaatgaacaaatcattccacatggacatctatcttatttttttaagctttacaagcaaagcaattgctcagctttgaaaatatcaaatattatagttacagtgagctgcagttaccgtgagctgtagcatactctttttttcctatccttaatgtttctatcagagagagtatgttagatttggtcctttttcttcttcttagtctatgatgacttaccttcattttcattgctaaccgattcccaactttttaacctaaaatttttttttttcttgagacggagtctcactctgcgcccaggctggagtgcagtggtacactcttggctcactgcaacctctgcctcttgatatcaagcgattcttgtgcctcagcctcccgagtaactgggattacaggcatgcgccaccatacctggctaatttttgtatttttagcagagatgggacttcgccatattggccaggctggtcttgaactcctgacctcaggtgatctgcctaccttgctctccc

SEQ ID NO: 77261 - DNA, 1057 bp, Homo sapiens
tgaaaaaaattactgtaaaatcagtgtttggattctttatgtaaacagttctgagtgatagaaagctataaaggtgtttcttatttctaggctgtgtaagtgtcacgttccattctgaatctcttttctgtagaaattatgcaagcacctcccttcgtgtcctaattctgttcaaccattcttgttatttatggaccaaatttttttaaaaattaaaaataaacagaggtgttaaattttactccagtagtgtttgaagttcatagaaatgaagaaatgctttttatttcttatcattttcaaatttactttatttctcataagattttgaagtgtgggatgttgattattatttattgaggaatattattttatgattaggagtttgggccatttggtcttttggacaggatttttaaatgattctggaaataagtattttaatcatgaatctgatttgtttacagatatttgatatttcttgggatttgtaccagccaaataaacttgtcagctgtggtgtaaaacatatcaaggtactagaagggtcttgttttataatagtcacgtttagttctctgctgctaagtatatattgcactgttaacaatttagcctactttcagaattttgatagtacttatttttaaaatggcaatgtttttattgttcttatgttcagtcaaacaaatatatatattatttgctttgaactattgtaaggaatataggtatgaataggaaattaataagccacattccataaagaaatctgtagtctagtgaggcaggatttactgtgtccatcctgtttcttcatgtttcacttacaaagtaaaatgttgagaataggaaagaaatgaagagtttttcatttacatagaatggtgtgggagaagcaacatgagtagacctggctttgccatttattagctgtttaacctgctatgagttatttaacctctttgagcttttattttcacattttaaaactgtgactgctgttaccatcctcaaagaattgatgattaaataaggcggcagtgtatattcaagt

SEQ ID NO: 77262 - DNA, 3588 bp, Homo sapiens
tttgccctttagcgatggcttcagcaatttgtttgccatgtgtcttgtgtgttttttctgtgtgaatgattatcctgcttgggatttgttgaacgtcttaaatttgtggatttatggtttcatcaatttaggaaactttttactattatttcttcagtttttttttttcttttcctctgtcttttctctccttctagagccatgattacctgtatgttagaccacttgatattttcctgcaggtcattgaagctctgtcaattctttttttctttttctttctgtactttattttggatgggttctattgctgtgtcttcaagtttatttatcttttcatcattgtctgagctgctgttaatcctttggagtaaattttcattttagataatgtaacagttttctgtgttgttcttttatatctttttttattcttggtatgtttgagataattcttgtcttgaaaatgttaattttaacagcaaatgtctcctaattttaattatctctgggtttcctgagtctgtttctattgagtgattttccccaggttattagtcacattttcctgtttcttcacatacctgtaattttattatatccttttaaagtatatggacactgttctggcaaatagtcaagttcctcatgaatcagtttcatctttgtgaaaagcttgctttcaaactttgatgaggcagcactagagtagcttttgctctagaattactggtataatttcactattaaggtatgacactctcctcctgacctcaggattcctaatgactgcccagcgagttcaaagaggtatcttcattctggttattgagaatttgagtgattctggaccctttgtgatctctgagaattttttgcttttagctctctagtaattgttctttttctagaatttcttctttgcatgacctcatagagttcatcctatgcatgcagagattaatattctcaaatcttactatagatagttttactggagctcttttcctgctctgcaaattctaggcatcttgtcctctctgaactccaggctctgtttgtccaaattagtaagtctaccaggctctatttggattccacctttctgtgccatggtctagaaattgcctcctagatggaagctcgggtgattacaggacttaatttatttgttttcccctctttcagggttcacagtgctttacttccagttgcaaatgtctgaaaacatttgtttcatgtattctgtacagtttctagctgtttatggcaggggtgggtcggggagggtaagttcagaccttgatactccttcatggctagaagtccatcttttgtgtttttaaacctctctcatactttcggtctcactgtccacttctgttttcaactttgtcttttcatctcctgctaatcttgtatttaactcttccattgaatttttaacttattttattttttgtttctggaagttccgtttgcttcttcaggtctccttggatactttttatagtctcgtattctttgctcatatacagatattttgaatccttaattttatttcgcacattaagcttatttctcacgttaagcttatgttatttaactaataatgccatatctgatgttttttgcaaggccgactttgctgtttgttgtgacttgcccattctcactcatggtttcttattttgttgtgtttgtgtgtgtgggtggggtggtttgtttattttttcagcttattattactattttttgagacagagtctctctctgtctcccaggctagagtgcagtggaacgacctcagctctctgcaacctctacctcctgggttcaagtgattcccctgcctcagcctcccgagtagatggaattacaggcgtgagtcaccacgcctggctaatttttgtaattttagtagagacggggtttcaacgtgttgcccaggctggtctcaatctcctggcctcaagcaatccacctgccttggccttccaaagtgctgggattacagtgtgagccaccgcacctgacccttttttttttgtttgtttgtttagcttattttgattgaattgctacctgtaggaattctttgagggatagatcaaagttgcggtacttcatttaggatttatatttgcttgggccacattgttgaagttgcttgaagacacagccaaccctgaagactactttgaattaaatttcctagttgaaggattcatgtttaatgagaatttaggccagcaaccatgtgaaggatgcttgtggttacaaatgttcagggaggtgtttctccctcttcatgagttgcctccgcttctttaggaaggggttatttgttgtttccgagaggtttactgctttaatcagaggcggtctgcaattcaaatccccaccttaggtaggccctagactttgtctcctatcttcctcagcccacagcacagaaatcaggggtacaagtattcacccgatgcctttagagtccagtaggtgtaggtgttttctcatcctccaggtttcccactggaaaatttcttaatttttcgacagctcatcagtccatttaaaaacatgattttacattttatctagtatttttagtttttggtaggaggtatatttaggatattttgtcaatcctactgttagaaatggaagtctctcttctgtttcataatgtgaagatctatacatatgtggaaacactaacaaggtgaaatacattcagcctttatgaggtctataaaatataggcatatatgttttatgtttataaaaacccatgagtataatttctttgctatttgtaattcagtttctctttgatttgtttgcctttttattccttcctggacttcttggacataaatcagcgcttggtttcagttggacttgattcaaagaatgcagtttgtgtttgggactggaaaaggggaaaaatgttgtctatggctcctggtcatacagatagagtaagtattctcttttgagatttctaatgagtactggaagggaaagaccagaagagagttcaggagattttattcttctgtattttgttattgccagataggtcatatgtaattaaaattttacaattggtaaataattgtacagatgtaaaaagtcttaaagtgttagagtacatatgtattgtaggacttggaaacatgatttgatatgtatagcattggcataagactttttttcttttttttattatacttttaagttctggggtacatgtgcagaacgtgcaggtttgttacataggtatacacgtgccatggaggtttgctgcacccatcaacccatcatctacattaggtataagacttttaacctggtgtttgcttcagtaaaaacaatgtattttctttacattttttaaaacagttttattgaaatataattgatatacatagggatgcacatatttaaggtgtgaagtttgatgggtttgacatatgcagacacccattattcaaatctcaatttaaaaattgaatggtttgagcctagggtctgtttagtttggtttaccactaatttgttacatatgtattatggttaagg

SEQ ID NO: 77263 - DNA, 1044 bp, Homo sapiens
gtctagtttgttattgcctgtagttgcagaactagatgtattgaggctctatttggatacatggaattttaaagtttttggccaattgtgttttgctgtgtgtatttgatgagctataccagacagaggagacattagtagaaagaacagcagtgcccctctggctattcctcacttaatatacttgtcttgtgaaattttaacctctacacagtattctgatagcaagaggtagatacatttgttctagctagatttttgctgatgccctttggttcccaaatagtaaatactctcaggaggtacaaataatctcctcttgttctctgggctttctgctagcttgatttgatggagagtcataacaaactgtattctgtatctttttatataaattattcattctaccaattttggagtttaaatagtaaaactttcttttcagaaattgtaactgggtactagatggcatttctcatttggacagttagagggcgtaggttcttaaagctaattaaggttatggtaaactaatagtaataataataatatgatgcaaacatttatgtaacatcagtcatataccaggcactctaactcctttaagtagtacatatgtcaattttcacagtaacccctgtgaggtatttttatttgtccccatttaactatggttatagtaaactaatagcaataataataatgatatgaagcaaacattaaataacattaaccatatatcaggcactctaactcctttaaatagtgtatatgttgattctcatagtgacccctgtgaagtaattttatatccccatttaataggtgaagaaagtaaggtacagggaggctaaataattgtccaaagtcaccctgctagtaagagatgatgttcaaacctaggcaatctgctaccagaatctgtgctccaaaccaccatttgataagctgtctatagtaagtgaaatagtaaatattttaaactttgtgggccatttggtctttgctataactactcagctctgcattgcagtgcagtgtgaa

SEQ ID NO: 77264 - DNA, 1822 bp, Homo sapiens
gttttacatctaccaaatactataaaatctgtataagcaatttttaataatactacttatttatttccttattttacagccttgcattgcatcctgaacgagtgttggtagcaacaggacaagttgggaaagagccttatatttgtatttgggattcatacactgtgcagaccatatcagttttaaaggatgttcatacacatggtatagcttgcttggcgtttgacttagatggacaggtatgtgacagtttttcatttttttctaaattgtatgttaaggtatattatagaaaatgattataaatctataaatattaaattggacacttgatgaaaattatttgtccaaaggtggaggtgggtaggtggggtgggaggttgatatataacaatggggtttttatttcatcatgtcaagaactttctcaattgaattaattattaccttgaaagccaaagtgattttgattcagtggaatattacatggttattatacagatttttctatgtaactcttttccagatagggtattttgacaggacagatggatgatatcttaggaaaattaagtttctcagaaagctgtatatgttttattttaattttatttttttatttttagagacagggtcacgctctgctgcccaggctggagtgcagtgacatgatcataactcatactcttgggctcaagcaatgttcctgcctcaccttcctgaacaactaggactacaggcacataccatcatgcctggctaatttttttttttggtagagatgggatctcactgtggtgcccaggctggtctcaaacttctggccttaagctatcctccagtgttgttgacctcccaaagtgctggaattacaggcttgagccactgcacccagcctgtatttcaattttcagttaccttaaaggttgtctattaaaattatatttttattgaatataatggaacaattcctatgagttattttttatacaaaatcaaagttcacaacaaaggatataattatcattcaactgactaatcagtttctaaattatcatctacttctagtcaatgattttaaaaagttaaacaagccaagagctttttttgtggtgcttttatggaaattgttatacctaaaaatactttaaagttaccagtaaaaagttggatcttgcaggttgttcatttataatctttaaaagttttatgttataattagactttaaaatcattttaaattttagaacaattttagttatctgctttttaattcataaaattagttttatagacctcaattttacagaaacaaattacagtgtgttctatccccttgaacatgatagccagtagatgtttttatatattactctgaggaatagcttctttgagtagcataggttaatgtgattttctggtagtgagatgagagagttcccttgacccctttgcaggacttgtaacaagggtgtagctcgtttagttggctgcccagctcaaaccccttgtgggagtggggcatgcaggtgagaggttgcaggagagctggggtgagtgcctttgggtgctggcttgcctgtggcagcatctaaggttacccacaacctctggagccccagagggtgtgtgttacaaacaatattctttgacaccagcagcttaagtgttgaacaactcagtgaagagtcagtgtgacagcctttttgggttcctgcacccagtgcatcctggattgtccagcgtccaggaagaaccaggttacacgaacagattgaagggtggtgtatatggaggattttattgagcaatggaagtggct

SEQ ID NO: 77265 - DNA, 1140 bp, Homo sapiens
actttcttttggtatagttgcacaacttatacaaaacaacaaacatactcgaatttctcatcgttgaatatacatgcttatgattttatccaaatgacacatctttaatgtataacaatgaaaataagtttcctgaaaagtttcaatgagggagtaaaatctgaatcatacagcatcttgaaattggtggcacaaatttaatatgatactgagaatataatttaggaatcagtgaaagggctctggacattttatttcaaatagtaatgacagatcattcatgtttgtgaaatatattgagctaatattaaaacctcaatattttttcagttcagtgtttgacttgtgagtatagaaacaactctagtaatttttaaattatgccacagcagaagatgtaatattcacaaatgtgatgcatagtgaaaaccaatgttgctgtaaccttagctttagtaataaaaagtcagtgctgttttcatcatctgttttgtttccacctttgcctgaaacttatgtaaaacttattggtcaaatattacttagtctgaggatagaactgttccagaatgagcagatcattgtcctcaggttttgaaaatgtgagtgcaatgttggtggtaaaggctgaatcatgactagtctatcatttgcttactggttctttgaccattttattatcacctgggattgccagtggtggtgccacatgacatttcatcattttctcagtaaaggctgaatcatgactagtctatcatttgcttactggttctttgaccattttattatcacctgggattgccagtggtggtgccacatgacatttcatcattttctcagtaaaggctgaatcatgactagtctatcatttgcttactggttctttgaccattttattatcacctgggattgccagtggtggtgccacatgacatttcatcattttctcagtgttgcttgtagttctccatcttctttttgccatctacttgtgtatacttctctagtcatttatcttttagttatatttatcttagtaactggtttatatggcaattagtttcaatgtcagaaataatatagggcttttggggtcacttttttgttctttttctcaagttatattgataaaattct

SEQ ID NO: 77266 - DNA, 1052 bp, Homo sapiens
tcactgatttccagttctcttcatcttcattaaaatactcctaaataagctacttttgtattttcttaaaattaaatcgctattggggggctatttttagtcttccttggacaataactcaaagttggtcccagagcttgttgacatttctttagtgagcggtatatttgaaatgtaattttcaatcagtgtcttagtacaacttttatggtaaagtcaagagcttcagaaatcattctaggccactgattattgcctcaagcacagcattttttgtcctttacagaggaaaatatattaaaagcaattgagaatgtgtttgtgtggtgctcttggggttttatcaaagattctacgatttgggtttggttacaaaatgttattccctcatgtatgttgcacaggatttaaattgggcatttcaaatacggtaccttggtttgaagtcttgtaggcaagaagccctggtatgtaaattccacaaataaagttgttcttctgttttgcgtctctgtacatctataatatgtaagagggaaaggatgcctaggacaaacagaggtagggcaagatggagtaaagataagaaaagacaaaattgagattgcagagtaaggaatgaggtggtgctctgtattcagttggttttttttgtttgtttttgttttttggacaccagagtgctttttcagattgtatttaatgtattactttgaaaaggtaactgataagtcatttcatttttctcaagctgggactctgtatcgtggtgattagggttacagacctattataatagcccaaattgctgatggaaaaacaaaactaaagtaaacccgtagtaattatttatcttcttagttatcccaagagtagagtttaccccagtgtcttgtctttttccctaatcctttcaagtctcccttcttttccatatgctaggtctcccaaagtaccaggcatagtagctttacctagctggagcagccttaactgaagccctgctccagataatttagtctgttaggttgaattcagctggtggagtaaat

SEQ ID NO: 77267 - DNA, 1090 bp, Homo sapiens
catttatttcgcctttaagggatactattttggtgtagaatcatcaaaagtctttaattattgccttgtattttctattaggatttctggattttatttttgatagtcaggctagccagagaggtatgatgtactatgcaacagcatgtttcttcagagtaatacattttaatttggctacaaaagaactgaagggtagattaaatataataatatggtgtttggtaatggggaagggttcttgaagaatatgggttctcaactgctttttctagacacagaatggtgagggacagaggccagccggggtctgtaagcatgaagagtattaaagttcagatctgttaagaataaagaaagaaagataactgattaatttattataatttcccttttttgattaaatataataggaataaccaattcatagagaagcattatctttttcaaagtgttctttaaatcgtgactgaaaaagtggttaaaagttgtaagatataaaaagaggaaatgcaaaacagtcctctccgtacagcactgtgacctagagagaatgtttgcttctgcagctcatgttgatcatcctgatcagttgcttaatctgtttactgttctttgtgttccatatgtcagattcatggctttaaaaccagtcctgatttttagctccattataattaaacagttaataaaacgtaaaggtttttcaggcagtgggatttttaaaagacaatatgctttcattaatggggtaggtgtctggtagattttcagattattaaaatcggtgattctgagggtgggacccattagctgtgtatcagaatgggagaaagacttttttctaacttacattctcgttttgccccaatctctgcttataatgagagatgttacagagaggagggggttattattgtaaatggtttgaaggaggagaaatggctgaaaatgactggcttagatgaaagacatgaaaccagggctccccaatgagctgtatgttagtagttggttgagacagtgatttggtgatccaagccaaagaacatatcgtgtgattatctaattggtttcctctttggggcca

SEQ ID NO: 77268 - DNA, 1010 bp, Homo sapiens
ctaataccactgactcaccctggaattatttccttggcagagccaagaaccctcctgggctaagccccaattttggggctcacaggtcctgtaacatcttgctctgagtgttctcatctgtaaatggtgatgatagtatacctataactcagagggtgttataaggctcatgaacatgtggtaagtgataaaaaatgttagctgctgttgtctgtatacctacagatatttgcatgcaggattctatcatctatatttttcttaaaggattgctgggaatctgaaaagcatttttgaggaagatgtccagtgaaatggatggtgaaaggatgttgaatatagttcataaatcattggcactcaataatttccagaataatctcccccttctctgactctcttatcttccatgtcttctgcttttcttttgttcacctaagtcatctataatttgaccacaatgtgagtatagtatttgacacattgtattgtaatttaggtgcctccccctctagaatgttgtggaattaatgtgttcttggcctcatacccacttaggcctggtctccattttccttcaatgcaatccctcacctgtctctgcacctccctactcattaggcctctcattttctcttctgacctgcacattgatgatttcctgtaatttccctacacactcttcatccacatgatcagccctaaatgtatccctgaagggcagaggaacaagacagagagatcgcggagactttcctcagtgagcagaaatcctctgaggctgagctggtggtttcattttgtgtcactggaggaatctacctgcccttggcaaatcacagcatccagtatcagtggcttctgtctcctttagctgttttttccttttcaagcattgtctacaatcacctctagtaaactttctccctcagttttctataatatattggatttatcttgtatctctcctaaactttacctttcattcctgccttactatgtccaactct

SEQ ID NO: 77269 - DNA, 1053 bp, Homo sapiens
ataagtagaatgtatggaaaggaggaaaaagaaatgtaaagaaagggcaaaaacaagaaagagatatggaatgatcactaaatcgtccttatcctagaaaattggagttccacagagacattttaaaaaaggaagtgacagaacttgatgatagatttgatgctagggacaaaggaaagacagacaggtcaaatttgcctcctagagatgctgtgagaagagtgatagttttattggcagaaatgggataattagggaaggaagtcagtttgtaaagaagctgactaagtgacttgaaggcgttttgagcttgaaatgacaaaaggctatctaagtggagataccattgcatgtgttgggagatgtgacattgaaatgtaggggacagcctgggccacatgtatagaatgtggtgttcatagatgtggttatgtagggaaaagaaaaaatgaaggttgggacagctgagaaaccatgcacacttctgtaaataaaagtcagccattttaacttcataaaaagctggtgaggggctttcagcatgatgatatataaaattatatggtcaaactgtaattaaaaagcattagaatgctattccatttcataaattagtaaatctcaaattactagagtatcataaagtgatactcttgtatttggaagattaatgcatatcaggggcatttattctttcatccaatgtatgtttgaaccacagttccagccctgagatcacacagtgaaacagacagacaaagtctctgctcttttagagataatattctggttgggcaaggaatagaaacaaactttaaaatgtatgaagtcttatgggctaatgagtactgtaacaacaaagaagcaggaaagcagataagggaataaataatgacgtgggggaggatgctattttggatggaggggggagtggtcattgaagtctctctgaacagaaaatatgtggctcagtggctgaatcccagcactttgggaggctgaggcaggtgtatcactggagcccaggggttcgagaccagcctaggcaacgtg

SEQ ID NO: 77270 - DNA, 1128 bp, Homo sapiens
ggaaaaactaaagtgctgtatttgcaatggtgttcattgtaactttagatatagtggcaaaactatatctaacctaaatgtttaacaatagggaatgagtttggtaaattataataaatagcatgatggaatcttatgtagccattaaaaaccataattataaacactaggcagaaacatggaaagtgtttattttataatgttaagccaaaagtataccatttagtatgttaaatagaagtataactctaaaaatatgcatttatgacagatactagaaggtattacttaaacattaaagtggtagtattttgaggttaagatgtattcattccacaaatatttgttgaatgcctatgttgtacctcatggtactaacggagattaagtctaactttacctttgttttaaaatttttcaacaataatgttatagtaaaatgaattataaattaggggcaataatatattaaaatgctgccaatttgtactctgcttgttattttcatctgcttacccccaatatacatacattttttgtagaacataaaatggagcaatttgttttgttcttatttagtgagaaacacaaattgttcctttgttttccattttatttactaattcatatattgatacatgcgttgattagtttattctttaaataataatgattgggttgtatatattggtactttgatgggtgctaggggtgctgagttggacagatgtcttgttctgtttctcactctggtacagtcttgccacattatagtgatgttgtggatcagattgttccattaaaatgtcattcttgcttttaccagaaatgttcttttctgaatggaagaaggatttagataataagtataaagcatgtatttttatatcttacatatattttgtaactttagctggaaaaagaaaacaggaattctgttttttaacatgttaagaaatcagaggtgttttcatatttagataccttgggtggcctccaaatttctctttaaataaagtatttaacacaaatacagagaatattatagacaaatataagaaataccttgaaatggtgtttaaatattaagaaagtataaaattgattgtccatggaaaacgatttttc

SEQ ID NO: 77271 - DNA, 1022 bp, Homo sapiens
tatggtctatttgctggaaaaaggtctttataaagatcaacttaaaatgtttagatatttaccatgtatgcctgaattaagctggctgaaaatatatttttctagtatatctgaaaataatgctaattgtagttatacttttctcctcatttttttttgtttcatttttatttctggctgggggcagggtggtgggggagaaaaataagcatatgaaagtactgtgtggcttctttttaattttcatagctttcaagtagagatgctgatttttcaagtccattagaggctcagcatggtgtcaccatttctttataagtagtttgcatatttaaagatctcccctggagcaagagaagatggggaacacaaggaaaaataattaattatacagtaagattaaggaactcgcattcatttcagaaaagagttggtattaagaagtggacagtaatctgggatgtgttttgagataatagaactgaaaatctaagaggtactttaactgagctcttggatatcatgattatgttaacactggctaaagaataaaaaactttcagccttgagagaaaaatcgtattacaaaaaatcagaattctctcttaactagtagccccagcttctattaatcacatctttatctgagcttcaaatttctacaaagactgatttgctttccctttgtcaaaaatggtttccacctcctctatgtaaaattctaattcttttttagtcacctcttgtctaatcttgaataaacaatagagggaacaaactcgagggtattaaagatatggggtaaacaaatgtaaaatatgaaaacaattgaagagaagatctttttcagtttgtggcaaagggcagtctgctccttagaatttactgggacttaaggtgatgtcagaaaagtgaaatgatggttgttgaagacaacagttatccaaatactccagctcctttcactcttcttcatgatcccattttccaagccttttctctacctgcttacttaatcttta

SEQ ID NO: 77272 - DNA, 1044 bp, Homo sapiens
ttgagcctcacaaagataaagtgatttgtccaaattcacgtaaccagtaagtggcagaacaagaatttgagctccctttctgacgccaattctcttgctgtttccacaattccatattgtttctgtaggacctgagtatttttatattctcttaatgtttcaatgtattttaaagcaaattaactgagagatcagaagagtcgtaatgaattttatgaatatttatatagcaactagtaaataagatctgaaacttgttgctgatattgaaatgcatatagaacatttggaaaaatagaaacaaatgaacaattctatttttaagtataaatatcttttattattaaaatagggtagacttcagttactatgagcacacttcaatatttataagcttcagttgtcattcaagtactctgagaaaaaagaagactataaatgggacaaaaagcatgtttattgttctgccgttgaaattaagactactttccatttagatatttcacataaaactctaaagtgttttttcctgctgctagatggagaaagtgttttctgctaaaaggtaattttagaccattatatcattaaactcttatgaatgtaattcctggagacagtcttgaaatcttgagctgccaagcaaaaccttcagaaatgcttgataattaaaggaaagcaaaactctgattccttttgccatccatatacgatggcatttaaatgagtgtaccttgtcatattaaattatccttcttttctgttctttaatacctgcccatctttatgacatattcagtattctttcacttatacattcattcattcactcagtaaaatatttaatgggcagctactctgccaggaactgggagtacaaaagattagattgtccgttctttcaaatggtttacaatagaatggaggagagaggacagtaaataattacgggttaagtatttcttatctgaaatgcttgggaacagaagtgtttcagattttgcaatatttgaatatatttaatgagatatcttggggatggga

SEQ ID NO: 77273 - DNA, 6443 bp, Homo sapiens
cgaccatttggtttcagcatgtcaggagatttctaatgatttgtggcaatatcagcaattttttttcttttttcttgtttttggtttggttttctttcttttcttttccttttattttgttttaatttgccccctcttctttgttttggacccttaagaattttatttttaaaggagattgaagccatagaactcatattgacactcagctgttttacaaaagcttttcattatctgaagacaaaaccgaaaaagccaaaattaccattgcttcctccagcttgtcagaaacctgtggctgaatccgcagggatgtcaacgtcaatatcacaggaacacacattcggcacctagaaggcacgtgggcaaagtaatcatcgttcaggcccaacccttaggtttaaaaagtcaggttgtccatcccattgggttcactgagtgaaggcacataaagcaattgaggaggaggaggaacccctcgtccccctaggagcagacccaagcttgtggcaccaggcatctgatggtgccaggaaagccactggaattgtcacacggcgagcacagagggccggccaccagtcctcgatgcttctgaaccctgaagcccgatgacatcttacgaggtggacgttggactgttcatgcgcatcgggtgtcagtgactcatggagaagaaatggggtaaatttttagtgatgttgctaatcattgaattctgttctctattaaattaagaaaatgttccaaaagccataagcctgaagattggccctgtgcacgcacgcacacacacacacacacacacacacacacacacacacacacgaaggagagagagagaaaactgatggggaaaacaagctgtgtcttcttaactgcccaagtgaaaagcaaccaagtccaggaaattacaatagctgttaaggaaaggaaataatggtacagatctttttctgtctatcaaaactatttgatccaagtgaaaaaaaaaaaaaaactagaaagctacggaacctgccattagtattgtggtgtatttttaagattaaaggtacactgatggacaaaaaaaaaaagtaaaacatggcaaaaaataaaataactcctatactgccctcaaaatggagtttgcaattaatatcaggatttatctttgcaaaaatcagtgatttccacattcagccagtatagccagcagaaatttctgatccacaatgcatggattcctttgaagaaaaaaaagaaaaagagaaaaaaatcacaaaaacaaactttttttattcaaaagtaacaaagttcttgtaaggtaaataatgtatttagcatgaagcatgaattattttcatataaatatagaaaatagagaaaaggctatgcctgtaatttttaagcccttaggcttagagtttcttttggttttcttcttttttctttccttttctttgctttctttttttcctttttgtttttgtttttgttttttgtttttgtttttttttcgggttattttgttttggttttttgaagcaggtgtttaaggtttaaccttcttcagggacaaattctgactgttggggaacttactctgcaatataaaaatatcttcatgctctggtagggcttggatggttgaactctgtactgccttgtgtgcacttcagccccgaccccctctgattctctgttgaaaagtgtgtcctttctctctgtctgtacatgtttaacatgacgcaataatttgagggcaaacttagtagtgagtgtgtatgatagaatcaagagaattatgggacgcttacttgagaaaatcattaccatgatttggttctaggaaaaaggcagtgaataattatgcaaattagccagaagaaggggaaccgtgctaatgggccttattgggtgaggggacgagatggggttcatgtgaaggaggaagcgatgccgaggtaggaaaggccagccccagacatcctatcgccacaatgccatgtcgcaataggaagcaggggccggccatcgctaccttcagcacactgaccaacctggaattaagaccacctagattgcgagagctgaatttagaaaccagacaacgtcatgcagcccagaaactcctgttgttacctttgcctaagaaattttctttaatggcgggggcggggggcgggggtacaaagagaaatctctaaaagaatatgatcttccatccaagtggagggaaactttaaaacaaaaacacccagtactgtggctcaggatatgatgcgtgaggagagggagggaacagagatgaccttaacttttaaaaaagggactgctgtgggccaaagccaagcccatctgccaggacgaggtaatgtcagagctccatcagcccggacagtgggaactaactggtgcattccccacacttaccttccggtgggttgctgatgagagaacctgaaaaaacctacacctctacagcaggtcgaattcatgacctgaagctgaatacttccagcatatttattcagggtgtaggtgggaataaagtatcttcgcagtgctctgttccctccgtctccccagacatctgacaccctaaaagccatccacagctatggaacctgagcgacaccttgatttgtgttgtcacctgaccaagcctaaagacctccagctcagtcccccaccttcatcccaccccacagatgataaaattcagacctctctcctgaaaggcagaggttcaacattcaggactgtttctggccgaggacttcttccaattaaaacccccaccgtgggctgtctcccctcatttcatttttctaaaggggcagaggcctcttttagaaaataataaaatgcaatgtgtgtgatttacttttctgatctctttgagaaatagagaaatataaaagtgtgttcttaactccagaaccactctttttgcataaatacctcatcgggcagctttctaagtgtgattttcctgagtctcccttcgttggatctgccggaagacttgtcggggaacctttagtgagggtacttcttcctatttttcttctgtttttggaggcatacacattatgcataaccaaaacaatggctcaattgtgtttaactttgtattttgattgttgagaacaaaaacaaaaagtatcaatgtgtatgtggctgtttgtagtgaatttattggagaatgaggttgtccgtgtccttaacaagccaaggggcaggaggcaccctctcttatcccctcctccaagagcagtagagaatttaagcacaagcctatttgtgaaagaatattttgcttaagtgtcattcactttagtcttggaattccttcccaaacgtcaggtgttcttttagcttccaaactagcatatgtatccattagtctgacagatcgcctgaacaccattaagaggtgtggcgtttttgctttcatttctcctgctgggagaagtggcggttcatgtgtcattccagtatctcacatactcacacggggcaggggggagggggaaacggggaactatagcaatatttaaagatgctttggaaaccaaccgtgaacacatcaacaccacgacgtctacgattacttgctattggccctcggatacatttaagagaaagagacagtcactcttttttttcttaaatgatatacatataaacagttatttttatcctattataattgtcttttgtctttatctagtactatgtggaaagggtttgcatcatagatttttcccagccttataatataccataagctcctacttccctgcccctccctaatcagtattctttcaagagttctttggtgaagccatctatctgaaactaaaatgaaccaaacccatatttcactggtggttggagaaaaccatggccaaaacgattgtggcaggtctcaatcttgggagtttttaagaaggaatgtgccagaggccgattcccaagaacagagttttcttttgttttgcagaggcattcaatgtgtctagtgcttgctggccacagcagttactaccacagagccttctgggaggggccgttgtgttgaaggaggctcctgcctgagggacagcatcaggcagtgggctctgtagagtgagaaccaggtggaggccttctgtgcccagctcagagttctgcaccacgccaggactgcccaggccaagggctactgacgcaagttccactcattccactctgtggggggcgccttgggcctctcctggaagggctcttggagaaggaattggagttacgtacaagtgacctaaatgggaagcttttctagatgagattggattaaattccatgtgatttctctttccctttaatccaggttgggactcgtttctttctggtggatcacagctgcccagatgttgcaattgatttttatgtttctgtagagaagtatttttctttcatcttcaggattttttttgccaccaaaagaaaacattggaactctgtgtttcctcttgattgtgacttcccagtgttgacagttaagtccttagtgtcgtaggtcccagcccaccaatactatatcaaacactgttatgcacataatgcagcactgtgatctaatttaaataatacttttttattatttatactactatatataatatacatcaacacttttgctatataacctaagtgataaccctcttttagttacctgccaaactctggacttggtttatattgcagttaacacagttacaaagctgtaatggtgtctttttttcctttgtaacggaatgtgtaaatcaaagtatatacattgtgtggtgttcctgtttctggagtttcatgaggatttacacatggcattcagtgttctgtatagatctgcctacctttgtgaattcatctgttaacccctcttcctttgagagagcaccggcgatggtggttaactccttgtgttttctctctctcctactggttattcttgaattaagcacagactcgtcagctcggttgctttatcatgaataatgtgtgtgaccttgcagttcttccacagttcagcaaacaagtgctagcttcactgaccaaaaattaaggaaggaaaacacagtttttaaaacgatccatcttttaacagccgaaaccgatgtgtctatggtgctgcaccttgctgttgtacttctgaaatcagacgtgtgtgaacgatcatttctgacttaaccgtgagatgctcacgagtacccttcctgttgttttgttagcattgaaatcgagactatttatttggaatatatacaacagtgtttttccactgtatttcatttgcaaaagttgagaactgctttctctaccttttgcaaaataattgatattccatattggattctcaaagacttcgatatggtgaacctattaaacctagaaattgtattcatcctttcatgactgtggcctgagttccccagcccctctcctccttttttttagatgagatttagcacactctcagttatttaaacatgcaacatttcttgagtatgtatgttgaggccatctgagctcatagctgattcagtaaccagtttcatgctgtgtcattcacactcactacttaatactgccatggtgaaaatgtggaggaaaaatgtatccatgtgtgtctgggaagcatatacacttgtacattttttaatactctgattctgtaacatttctgagttttgttttgttttacagaaaaaaaaaaaaagtgataaagcaatcagaagaccaagaggtttactattgatgcttagggtcgtctgaccttggctggccaatagacctacacggccaaattaatttacgagagtaataatttttcaaaagccaattttttttctgtattttctgtatgaaactgccaatatcatgaatagaaagggagaaccataaaggagaaagaacgtgatgttctgttatgttcatgtaaacctaaagaaacagtgtggaggcaggcgcgatcagccgaactctagggacttggtgttgcttggaaggcatccatacctgcattttgcattcttcgtatgtaatcatattgccaaagacaaactatttcatcatttattgtaaataacacttttccccagacctaccataaagtttctgtgatgtattgtcttccagttgcaataaaaattactgagttgcatcaattgaagaaaaacaccacgtagtgttatgtgtgctgcgcctccctgtgcagatgctggtccacaacgtcatttctgttccttacctgcggtcaggcgtgtgtgcagtttttgcagtctggtttcggggttctcagctgcatttattgtgcccatcctcacacgtgcgtaggcttgggtgggcatcacacactgctctgcaaacacaaatgcacattcggaagctgggcttacccgggatctcaagag

SEQ ID NO: 77274 - DNA, 1036 bp, Homo sapiens
ttgtcttccacaaaacattccctggcgtccacccttcgtccccttcagctacaagtgaccctcctctcctgcaagtattcatccttctgaaggctgggcgccaggcactaacagacaggcagctgcctcccagacataaggagcatgggtcctaaccaggaataagcttcacagccattgctgtcaggccaagccgtggtccaggcacctgcaggcattaattcgtgtcctcagccccacacccacggggagcaggtgtagttactattcccactttcgcgataaggaagcacaaggaaagtacatcgctcagatgtaaagacacaaagaaataatcagaggtgtgatgagtgctacagacgccttataggcatgggtagcagggaccttgttatagggaaatcacaaaggagggtcggtctggtgatgtagctaagacctcaagtctgagagtcagactttgattccagtccctgctccgcaagtgatcagttgtgtgactttaagtacatcactgaacttctccaggcttcacttcgagccactgtaaaataaggatgctaatatccaccttacggagttaaacatggtcctctgcacagacttagcagagcgcctggcaggtgttgagttcgggaagtcgtagtttattgccctctggtctgtgatgcgaccctggcttgcctctctgttaggctgcaacatcgctgtggcagtgtctatatccgatccaaccccgtgtccctcccccagaaccctccctaaggtcatgcatttctgttaggcgctcagtgagtatttgtagattgcatgaacgagggagggaatgcatgagtgagtagctgtcaccacatggcaggtatctttgctgaacactggtttagtcttctgacaaaagcctcctaatgtagccgcttcagacgagagcaggcttttttctctgaagtacccagccaacatcgtctggcggtgtctgactctgtggtgttggcggggacacgaaccaagcacagcttgatttttatggtttaatgta

SEQ ID NO: 77275 - DNA, 1031 bp, Homo sapiens
aacaaaaaatggcagatggccatgtcgtaaacctacaccttgacttgttagctgaaagcctgctcattctgggtttgaactaatgtgatttctctttttatgtttgatattttccaactatttgacaagagaatgagtaccaggttttatctgagatgaatagcacgtggttttgttgagccacatgctttaaacttttagaggcccagtaaaatcaggtggctctgatttatgctaattgcaatatcgttacacataaattcagctaaaactgaaaaattgcaggcatttcggatgtatcacatgttcactttaatgaatgatttttaagaaagtggttagaaattcaccttccaacatgttcagaatggctggtttcttttaagcatttgttgtcctgtaatggcaatccctgcggcgggaaacatttgacaccaagtcagtgcagctggcttgcaccatcgtgaataacattgcaccaagttattaataattgaaggagcttttcacttcctgctgagttttgtgtgtaacttatggattacataatcccaagctaaaatctcagggaaggttaatttcatcaaatgagaaagagagacatttatattttaattctcactccctgaagttatgtctgtgtacctgttttcatccagaaatattatcagtggatgtattggttttctgtcttcatcacagtaaacttccttcttcaggagtgacagggagatattttgaattcctgcttgaaccatctttgagactgtccgggccaccccactcaacaaccatggggctctctgagcttctgtttttctgtgaaatgggttaagtaggccagtgttccaatagggacttgggtcatggactctgttggcatgcagtctgattctaggtggtaccggaaactctgccccacacagcatcaaatcaggggctgtggaatcattctcttttctattctccctttaatccatgggatctctttaagaagaaagtttccatttggatccccctctttaatgctg

SEQ ID NO: 77276 - DNA, 1549 bp, Homo sapiens
tgtgggatgatttttaactattgatttaatttacgtaatgataataggatgacttgtgtttttaaatttccttttgaatttcttttggcaactctaggggtttttcttttcaaatatattggcaaagagttattcataatataccttgtcatctttcaaaacatcttttgtaactatgtcccttttttattccttatttcatttgtatcatttcttttttgcttaatttcgccatagattttttttcaaagaatcaactttttaaattagctctactttgcatttattctctattccattgatttctgctatttataatttcctttcttttttggatttattctgtttttctttgtctagattgtgtacttttatttcaagcctttcttctttttctatagaagtttaaggttataattttcctcaccctactgcttattacattctataggttttggtatatttattttaattattgttaaggtataagtattttctaattgccattttgattttttctttgacccatgggtatttttaaaatgtgttttttgaatttccacactaaagagaagatggttgtttttaatttttgttttcagttatctctcaacattgactattaatttgaatacattgtggtcagagaatttatctgtacattattgcttctttgaaatttgttgacatttgctgtgtggtctagtatatatcagtttttaaaaaatatttcagccaggcgtggtggctcacaactataatcccagcactttgggaggctgaggtgggagattgcgtgaggccacaagttcaagaccagtctggtcaacacagtgaaaccccatctctatcagttataaatgaaaaataaataagtagataaaaataaaaaagatgtcatgtgtgcatcagaaaatatgtcttttccattattagcacatgttctatgtttatgtcaaatcttctccatatgaaacttttgtgtgtgtgtgcgtgtcagcttgatcaattgcatactgaaagggatgcattaaaatctcccattccaatgtagatttgactgtttcttcttgtacctctttcaattttagacatatatattttgaaggtattttaatgaaactgtgaatgtttagaatggttttatcttcctgatgggttgaatccttagactgttgaatgactgtttatctggagtaatgatttttgccttgaaatctatctgatctcattttaatattgctataccagcatagcacaacttgttccagtcttacttttaacctgtttttctttatcctgttatttaggattgtctcttgcaaacagcacatggcttcttttttcttttttaaatttgagctaatgatctgtaccttttagctgaagatttttagcgcatttttattgacatttttgggtttggttctatcatctcgttttacgtttgtgtttgccctattttttcagattcttttttgtttctagcattattttaaattgattctcctactcctcattccatttttcccctttctaatggtttgga

SEQ ID NO: 77277 - DNA, 1290 bp, Homo sapiens
gagggtaaattggctgctgatcttttctagtgttgtattttgttctgtatgtaaagaccaaacacctgttggcctttgtctttgaaatcatggtctttgaaggcaattacaaaactcagtattagattttgctttgtagtgggaggagaagagaaaatactaaagagctaggtttaagggaaagtggggaaagaatcccagttacacaaagcatgcactgaattccctcctgggcccatttcagcgagcgtagtttttgttttgggcccttctggtccagaaatttaaacaacgaccagcaaactgtgaaatttgatcaacattctagagctgctcctcatatttcatatcaatgacgttcgttaatgcctttgaaagtcctggtggctccttttcatgttgtacctagaaatcctccaaactcccaatgattctggactgttgtaaatgcaaaacaattcatggaggagagttgtaggatcactcctatttgtgttgtgtgatctcttgcaaaaaggaaatcatgtttatctcagtggtttaggggagcagtttgcagctcatgggagaaaattgtggtccccctggatattaccactgagttagaactcttagagctgaccacctggcccctggacgtcctttacctttttagccatgcatctgccagattgcagaattctagggctgctggaagggatcttaaacctcaccttgattttacagccgaggcacaggtagaattagactggattttgtgaaaaaggtagggaagagctgtaaattaacaagttaaatcagtttaatgacctaaatggcatctctctcctaggtagaatttgatacctggtgagaagtattttatgcaacttgtattaaatgattctctgcatgctccttagtatttcctatcattcttcgtagtgttcatctttacagtttggggaggctactgtctttttatttttatttatttatttatttgagacagggtctcgctttgtcacccacaccagaatgcagtggcacaatcacggctcactgcagcctcatcctcccgggctcaagtgatcctaccacctctcagcctctcaagtgtttgggactacaggcactcaccgccactcctggctaattcttctattttttgtaaagatggcatcttgccatgttgcccaggctgatctcgaactcctgggcgcaaacaatccacacacctcagcctcccaaagtgctaggattacaggtgtgagccacagtgcccagccctgagttttttaaataactaga

SEQ ID NO: 77278 - DNA, 1306 bp, Homo sapiens
agactgccgtacaccacaattatggaaaccctctcccacaatccccaaaacaggcaaacaaaaagcctatcgttttagacaacacacatagatttcatccaaaggatctatctacaagagttctgctgtcttctacatatgtctgtccttgagaattattgctatttttcctcctatattttcttctggaagttttatcgttttagttcctacatttaggtgtatgatccatttctaatttttatatgtggtatgaggtgtaaggctcaaggttcatttttttcccaaatggatctctggttgttctaacacttgctttcccctccttgcattatctcagtacccttgtcaaaaatccgttgaccacatgcgtgtgagtctatttccgaatgctcttctgttcgattggtctatatgtctagacttacgccagtatgagagtgtcctggttcctgtaactttataggaaatcttgaaaatcagataagataaattaggtaatataaactttagacattcttccttatagagaattcatcaactgtgtaagacatgataattcgctgcataccacattctaacagttctgtgatttaaagatacttggtaagtctcctgcctcagataaggtggtctgttagcggaaatcaggctgataatcaggaatggtaggagctactgatctgggtctgcctgctctcacaattaattagggtaagtgacgggggagattatggaaccctggactgtaatagtagtactgacttaggcgagagtttccattctgtcacccatcccaccttttgtaagacctagtaacaaaggccttacgcaaaccaggaaaataaatggcaaaaattattagcaagaagtgcagaatgcccaaagaattgacagtctgtaaaattaccccgtattcaatagtggacattcatcctacatgatgtttgattcaaggtttgaaaacatgtccttagatacctaaaaattatgtaagtaaaaagtatggcaatgtgttttatgaaaagcatttattctacctatataatattggcttacacacctaatgtccagagtggttttcattttggaatacataattttctagagccttttcaacggtctttgtttgaaaaagcactatttacccaccttgccactatctgagactgtgccagggactatatgggcacagccagagctctggggagtcttgaacccatgatggtagacagggtcttagaagaacagtgttcggagagggaaacagagatccacagacctgcacagagtcacacaagagaac

SEQ ID NO: 77279 - DNA, 1052 bp, Homo sapiens
gtcttggaccttagacttttttctttttaagattctcaggattgcgttatcccatttagaacatagcatctacaatgagcagtgctgctctgtttggctctcttcttatgtgtgaaggttgccctcttgctagttaaaaccagaaagcttaagagtccctctctaactgcagagaacgtggctgatggcaagtgtggggaagtgtggcgccaatgtccctcatcctgagagcctcaggggtgggtattctctcatctaaaagataaatacgtaactggcctaacctgcaaggatgatgctagaggcctgggccttgtctggagagagccacaaatccgaggaagaagttgactttcaacgtccagcccttttgatgtcttacatagctggaggccagtgcacttcagtacatcaggtgcgtcagattggctgtaaaggttttggtctttcggtgtcttaatatgctctgagggaaacagagtaaaaggaagggaaagagtagatttgctggtagagaaaaggctgaagaatggactcatgttcccaccgagcttcctaatgtagagtagtgaactgtgggcctcagaatgcctttctctaacagagccattttagactggctgtgacttgttcttcagaagccacgttcctgacacttggggatggggacagaaaggagaaagacaggggtatagttaagtgtcacagctggcttctggcagctggtgagcaaacacgagcacatccgccatctctccatggagaagactgccaatgatgaggacggagaagtgccagggttggcagaggcagcatttagttgcagctcatttgagaacaagctgcaggattcagaggaagagctgagtctacatgccaggagtcttgtgaggttcaggaaatagctcagggaaagcctattaatgctgcaagagagctttgtccatgagattctctttgaagtgaatgctgttcattaatcaggaagatgttttaataggtaaatgcagttaggaataactacaaaaagcataatgggctgaaagtatttc

SEQ ID NO: 77280 - DNA, 1525 bp, Homo sapiens
aacttcctattgtcactgactctcctgctcctcaccccacggtaaaagctgtgggggtgcatagatcagcaatttatcaggaacatacagtgcaaattataaaattaacaaaatgagaagaaaccatgcttgtgtgatgaaaaatttactaacatgatccttaaatctcattctagaataccttttcttcttctcaaatcccactgggaagaaagtcgcctttgggatagctcatccagttgctggatattttttttttctctgttgcattcataaactgtaacttgcagggggaaaaacacacacacacaccggccccgttgtaaataatgttatttattggttgatttttccagatcctgacattgatgctgccagtgccatgatgcttttgaatactccccctgagatacaagcaggttgtgagtagatatttctatagcctacagcaccatagtttgtgaacttaaccttctcatttatacaccaggtcataggaagaactaatgctaaagtagaacttcccttatagaatcactttaaaagctacataagtgcatgattacatgcatatgcatataaacatgcagccatgcatatgtatgaatgaatgcataggtgtgtttccaagatgagaaagttcttatataatttcaggacttaagacttggggaaagggaaacagatcctttaatgagtcccagtgaagaggccttccttgctcctgcaggtattgttcctgtgagtttgtagtttctcctagaagaggctacatggggtcaacttaaccctaatggacctgagcagtacccatttttagaaatttctttctcttctgggacctcatcgccaggctgccattttggagaagagtctagtgaaataggcctgttggagcctggaatatctttgaaatgaaaccacgctaccagcttggaccatttctatccagcctcccaggctgccccagatagcagggtagggctgtttagctaagcaggactcccatcctcaccttctttttgttggccttcaacaatgtcaagtttgagacaacatttccttactgagacttctcttctcaccacctgaggtttttaccatctctggagatagtctaccatggttttagaaagatctcttcccaagggatgaagagtgacttcaaacaaagatatctgtcccttccttctccccactcgaggtcagtaccagtgcccacatcccatacccagctagaaccctgttgaacacacagacagctggtttaccaaggtctgctcagcttgttgttaggacattgctgtgttacagcctcttactgatgaaacacggtagtgaggaaatagtgacatgaagcagcagacgccactacaacaccaccgcttaggggctggcactcacctatctccttcttatggctaggccttcagctcattttgggttctggctctctgagggccacatggcttgctgagcagtgggaagtccctgcctttggagtggatgctacttcacacaggaa

SEQ ID NO: 77281 - DNA, 1005 bp, Homo sapiens
gataaaagaggtgtctgggatggcagtgtcttgtcaaagggctggaggtgatgcgttcacttgctttggaatcacagattcgggaatgtgacggcaatgtgacgcagacctcgctgctgaggcgaaaaggacgttagaattaagggactcagaagacatcaaagttaaagcggttcttgttgcccggagaaaacagaaatacgaaagcatctgcctggggagtatcaaggtactcctttcatttctccagcagaggagcagcagggacagtgatcgactctgaggaagtgagaggcccggagagcttccagcccggccatcctaacaccaccttagaattggggcgcctgagacagccctcagcaccaggctcccagcccaggatgctctttgagctctgtacttaccttccagtagcttttcctagaatccccttcctgattaagtgaaatgaggggtaatagatgggcaatttacacgagttagaaagatgccccctgttggggagctgacttggacagatgtattccgaatttgcagggttcactgtgatactgttcctcagagcccgtacattcttcatttagagtttaccagtcactgtatttaagctggaaagactcaggaaatgtgtgaatgggagcctcatacccagagtacccccaatgaaatgtagagcttacttggagatgtgtgtgtttgtttgtttgtttgttttcatctgttcttatccctttggccctaaaaattatccaagcacagtcatccgttgggtatccatgggggattggttccaggaccccctaagataccaaaacctgaggatgttcaaatctcttgtataaaatagtgcagtttttgttgttgtttttgttgttgttgttgttgttgttgtctgagatggagtctcgctgtgtcgcccaggcttgagcgcagtggcacaatcttggcttactacagcctctgcctcctggattccagtgattctcctgcctcagcctccca

SEQ ID NO: 77282 - DNA, 1465 bp, Homo sapiens
aaccaaacacttccagtgaggccccacctccaatgctggggatcaaacttcagcatgtgctttagagaggtcgagcacattaaactgtagcacattacaaatccccttccagatgtttgagaagcagctttctagtaaggaaatcaaaaggcaaaaccttttgtaacaaagagattgcctcagcagaacagtggtttatggcatagtgggaccgggtgtgtgattcaatatggtagaagtctacccagaaagaacacagtgaggttttgttctcagactacgtcctgtgtctctataatgagaggcaggtgtcaggtgtgggaacatcactggctccatagttcctttttaaattattttgagttagtataagacatacatccccaggcaaagtgagcctatgttcagagtcaccctccagttcttcagtgctcgagcattagggaggaagacagtggagaggtgggcacgcagttagtgtgtgccttgaagcactgatggcagggttctgcgtggtatttactctcactaacacacctgccagtgtcactctgagatggaatctttccttctgtaaaagattatttgcacattgacccagttgaagacagagttaatgaagatgccgtgcatgtggaaatactcaattctcagcactgacaagcactgccatgcctgctggggccaagccactatgagcacccccacagctgtgggaaagttggtgcaggggttaccagcaaccacgaacccttttactagaggaggaagtggcttctggcgtgggaactgggcaggagctatcttccaataagtggagagaagtgatggttggggaaagccaatcactggggaagatgaccttatagcatagagagggggaaaaacagactcaagaaagatgcactggtggtccctggctggccgtgcccaggcccctatactctgagcatctccctgggcctttggctgtggtctcaaggggcttcctggtcccacctctggcttctggccgtggcacatcctttctcttggacaccagtgtggccaggctctgaggtgctctggggtctcttgggagtctccattcctgttcctgccctgtggaagccttcttgcacctgaggctggctccagtcccctcctgggcggtgagcttcagctgtaacactggatgaagaaaccaggagcaagcaggacattttcaaagcaaagaatgccagactctagagggcttcggcattaatcgccctctcctccctccctgcagggtcagaatctcttccacggcaaccccaaatgtcccctgtgcacatggctatgagctactgccatccccagagaggggtgacccaggagacagaaaccagagaatgcagtaagcagagattcacaactggatgagatgcaaaggggaagagacttgagaggaatgtgtagtttctcattcatctatagggagctt

SEQ ID NO: 77283 - DNA, 1053 bp, Homo sapiens
aggtggaggggtcgagcagattgtggctcaagaccctggttgaacctggctcctgtctcagcctccatccagcccgctaattcaagtagatctttttcacactgttcatcagtaagatgatttcagagggtctcttttagctcaaaaattctattattctgtgcttagaactgagagagtctgtctatatgaaaatccaggcaggttgcatttccccacagacagttcagtctatataatggtttgggctgtaggagctcgagatattgctaggtggggccaattataaggtataatagtataataagtcagcatttttaaagtgaaagagtctctgtagcaatcttacaaaatactaaagtggaaaaatgatcagaaattgatcttttcaacttggtgattccatggatagacagtagatgcacatcatcactggcatattaatttgagtcgttgcttttgccttttccccagtaaaaagccctggctagtctgtgtctatttaaagaagtaaaatgctactcagtgaaaaatgataattagtaaaccctaaacagattgaagttccccagggaataagcgcggatgcctgacctcagaagttgcaaagggaccctggctgcccatcattgtcacgccaatgggtagggcccgtacccgcctttttttgtacttcccagcatgtaggccagcctgccacaagaggtcaatttggatactgtggtcacattttaaaaagagaactataattatgacctctcattatgtacagtgatgcctgctgagttaaagataatggcactccctgcctgaaagtatcagttaattgcctgcaggggtcagaagggtgctcatgtctgtcccctcccgcatagactcccccaaccccaaccaggcatgcactgaaggcagacacacttgggcctgctgtgcttctcacgctgtttaagcaccaggtttaaccactgtttaacactgattatagtggaaggtcaagtttaactcatctgcaagagggaaataaaacttcaatgagcttagacctagcctgtc

SEQ ID NO: 77284 - DNA, 1034 bp, Homo sapiens
ctagagaatcagggcttttatttaaatagagtatttgagtgacaacagtatgtgtcttagtccattctcgcattgctgtaaagaaatacctgagactgggtaatttataaagaaaagaggtttaattggcttacggttctgcaggctgtacaggaagcatggaggcacgtgctcagcttctggggaggccacagaaaacttacaatcatggaggaaggtaaagggagagctggcatttcataggagggtgagaggggcgggggcaggcgccacacacatttaaacaaccagatcttgtgagaactccattgcaagagcagcaccaaagggatggtgctgaaccattcatggaagatccacctccatgatccaggtacctcttgccaggccccacctccaacactggggattacaactgaacatgagatttggtggggacaccgatccaaaccgtatcagtatgctaggtgctgtgtcaagccacagttctgggactgtgaaaagtaggcacatattttgcaaaatacttgtgtagcatggaattggagtttctcagccaagtaagtacatgaaatgttccaataaataatgtaaaacatgaagaatttcccaccgaaaagtttctccttatctgttaacaatggtggaatgaagttcatcagtgcatccgcattggtatatcatgcagtgactttatattgagatgcaaatgcactaggcccaattaaataccgttgttgtgatgtatttagacttgttcctttgtgttgttttactgaaccaaaaggaaatagtcatatttcttagtagtgacatgcctagaaaaggagtaaagcaattattcttttctttaaactctagttttggccatctctgaatagtgggtaagttttgcttttctgaataaagaagtgtttacaaatatagagaacatcattcactcccaggttctattcaagaaaagcatattggtaaaaactgtatttctcagggccatttattcaaagcccatgccttcaagcaggaatcgtcac

SEQ ID NO: 77285 - DNA, 1046 bp, Homo sapiens
tgttatagcaaatatttcaggatcatcccagaccaaaggatcataatgcttccttttagcaaggggagagaatttcgttctgttctgttgatgctctctggggtgagactcaacctaatgatgagtgaatctgaagccagtgctacccctttctgtataatccactcctaaaagaattggataaaagctatggaccctttccagaaacatgcacaaattcccagtgtctacatgtactttctgcaggtttaagtcttcctgtggactgaccacctaccccagatccctctttgtagcctgtttcctgttctttcttcagtataagcgactctttgctcctccagaaactgcttttgtttgggtggtcatcagcaagccatggtactgttgatcaggtcccaggacactaatgagattcagtggttggagttgagaactttctgtccacatccagagagagaattggtttctacagttgcatacactgaagctctgattaggatctttcctattacctttagttaataaacatgaccaagataacttggccactttggaacatgaagattgtgataaaaatgaatttacttgcaaagcttaatctccaaaattgctttgaatctgggctcaggtccctccagaagtaaaaactgcacagtgaaacgtgtagagtgacatcagctggcttgggtgggacacagtatattctagttgaaaggtaatgaaactttttaaagaattggatgaattaacatctttatgtgaaatggaatcaatacaataaatccactatggctttgttagctattctcttttgttttttggtttttgcaacatgtctagatggagaaaataagctgccagagagtggagaaatgtaaaaattaattgtgttctgtagtccaaactgtatagtttctttggagaataaaataaagcaaaatgaagtgagccgaatttgccactcagcagatgccaggattttaccctgtcgatggagtgtttcactttgataacctgtctgatgaaccacccaaggaaggggc

SEQ ID NO: 77286 - DNA, 1373 bp, Homo sapiens
gattcacaactggagacatgccatatgaaaaacaaaaccagcttccagaaacaactgactttgacttcttgttctaaagactgagagtttttctgccactttcaccaagtccccaccttctttaaacgggtagaattcaatgtggtcggatgcattttgcctcaggggtataaaattaatttagaaatgacattttaaatagtggaagccttttatataatgatgtgaaaattattctgcttttgaaaatcaaaatcaaacatgaaacagtatgtctctctgtaaagaagtcagatatcttgttgggatattactttggctttctgccaaaaaaaaaaaaatctctattctcctaactctgaagaaatgaagcaaaaaagatatttgaggaaggaggaggggattgtgattgttttattgagactagaatccagatttgcaaagcagcacttcttttttttaactctaacccagacaaaaaaaaaaaaattgggttccttccccaaatagaatctctaaactgtatctaatgaaacttgaataactagtttggattttaaaagacagaagaccctgcccattgctgactgcagtttaattatgtaataaaccaaccaatcctgtttttgtctggtttagacgccttgcaaaatattttccatagaatatactaccctcgcctaatgtaccttctcccttttcttgttaaccatctgatggtaaattcttttaattctgcttatttaaagcacttggcttgcctcaccttacccggtaatagttttatagtcagaagcagcatctggcctgatgataagaatcagaaaatggaattgtattactcccaaggagctagttgtagcctgtgctttttctttcaagaaaatactctgcttagatagaaggcattcacattacgtggtccccactgggctgagaaaaaaacagtctgacaaagtgcagaaaatatggttagctccctcaaagtcgagccacttccagggtcgatgccagtgaaaggaaacttgggtagagtgggtcagcatgaagtgcctgccctggaaaagggtcctttccatctctccctcttttcacggccgtaattgagtgaagactatcaccaacttgacttacaaaagctgctgtttgcttccttcttgtgccccaaagtaaacaaaataggcaggttcctgattcggagtgagtggcatggagcccaggcctttgtttgctgttaagttgtcggggcagcggagcaaatagatgtgaagagattaaccaaacaagaaggcctggcaagggtgaccctttctgtccagccaagggagtgcagtcatccgcacggtgcaggaggcagggacctggtctctagt

SEQ ID NO: 77287 - DNA, 1320 bp, Homo sapiens
agaagctctgagcatctccaataatgcctttattagtccgttttcacactgctataaagacatacctgacgttgggtaatttataaagtaaagaggtttaactgactcacagttccacatggctggagggttcaggaaacttacaatggtggcagacggcaaaggggaagcaaggcatgtcttacatggaagcaggagggagacagaaggggaagtgccacacttttaaaccatcagatctcgtgagaactcactgtcacgagatggggacatccacccccatgatccagtcacctcccaccacctccctcccctgacatgtggggattacaattcgacatgagatttgggtggtgatacagagccaaaccatatcagtgcctgtcaagtattaagcaggaatttcttaggggaagaagggagttgacaaagatgcaggattgagaataacaatctgttaaataaaaggagaaaataagaataaatgagctttgcttatggaagaccttggaaggttagggaaagtcttagcgggtgctgaattgagaatagagtttgtgtatagaaacaaaggcttcctacgttggttcctaatgccacaaaacgtacaatagaagtagggtcataatggtgactgttcagtccagacctctcatttcacagatgaggaaagcaagacccagaaagtctcttttgagtcactttccctagaaaagcagccccacatgtccacagccagacgtgtgcaaggaggctcactacagcattctttataaaagccaaagattggaaacaacctaaaatgttcatgaccagggaaatgttgaaatagattgaatttcagcaatgaaaaggcatgagccatatccctcttgaatagaagacaaaacttatcattgaatgaaaaaagcaagctgtagaacaatgtatacgtttgtcttcacatgtgtaaaacacacacaaacttaatactcaattgttttgaaagacacagatgctcatcttcatagaaaaaagctcaggacaggtgcacaccaaggttgtaaggttacctttagggaaaaggcaagggaataggattgggtgacctctcttgtgatgacctgagttttaaaataagcagttgtagtcttgtattaatcttgtgattaattaaaaatcacatgattaaaaaggaatgctccattgacttgtccgatcatagtcactgaattagttgaaaaggcaagtctaggaccagtcaagtcttctggatcccaatccccacccacacacccaaatattacacagataggtgcaggcatggcggagaggggccca

SEQ ID NO: 77288 - DNA, 1229 bp, Homo sapiens
cacagtaggtgcctcaataagttgttattgaagatggaaaactaaaacatatcacatcatatgggcaaggtagggttccaaagcatttggggcagaaaaggtaattctgatatttactctttgaaattaatttttatgaaagttatgaaatctaaattctcacctctccttaggcttttgacaggtgttcacagatctcattttatttataagcctatcagtttttaataatcacttttaaggaggccttttattaatgtttggtctgatttgcaaacttagttaattaaactcctttaaacattttaagctgcatttgtaaaggaaatcgaacttattaaatttataagtactcaattgcctgactcaacaaacaagcctcttagagcacttaagcaattcttataagtctaattaagctcataagtatgttacaccttgtggtcttttaagttttcttgtatagtatatatgaccttactgagattttgacttcaaatcaaaatctaagttgattatttaatgccacattttaagttaaagtctcaaggctggtctgttattctaatggacagattctcttaatcgttataaatatttgaaatactatgtttgaaatacagtgagtatttcaaatagttagaacaattgatacattgatctgcatcgatatgttgatctgcattgatgtcttgtttaaggaattcattctacagacctgatttccttaagcatttctctgctttattctaaatgttcctgggggtaaaagatgctcacacaaattgtccaagcatggaaagacctgcttcccatgaggacgcctctccccctgacttccacacctcagggatctttggaaacgtctcttccccagcaaccagcgccgcacccggcccacctctcaccctcgactgcccagtgggagaattgctataaattccaaatcagatgctttctgaaagggacctaccaggggcttctggcaactttaagaaggaaagtctgagcaattggaggctcctggaggctgcccaggaatgcagttcagtcctcggaatttctaattcttcttcgccctgaggaagctcacaaaggtggacaagcaggccccttctcacccgaaatgtaggaagccatcagcaacctgcaccctgggcgatctcccaggagaacctgcccctggcctttgtggtgacctttgctgtgggaaaggggaggcaggaggc

SEQ ID NO: 77289 - DNA, 1053 bp, Homo sapiens
acaaatgggagtcagccagaccccagaacagcttaaaattcctccttcatgggtgctgaggggtaccagcatgttgactgagatcattcttgttttacttggagtctaattcagggtatataaaaaagcctgaaatggaatgagttggtctttgtataatgtaataggctattcctgaaattgcttttttcttctggctctgtttgcttagcatgttagtttgctagggctgccgtaacaaagtacccagcacggagcggcttcaacaacagagatttattgtctcacagtttcagagatcagaagtctgaagtcaagatgtgggcagggctgtgtccccctcgaaggctctggggaagaatctgttccaggtctctctctgaggttttggtagttccttggcttgtggccacagagttccagtcttcagatggtgttttcctcgtgtttctgtctgcgtccaaatctccctttttcataaggatactgcttatattagattaggggcccatcctacttgagtatgaccatcttaactatttatgtcagcaacaacctgattccaaataagaccaggttctggggtactggttaggacctgaacacatgaattggggttgggggaggcacaggtcaaccaataacacttaatgaagaataatctgaaattttcccactagtcatactactctagcgagtaaataaaagtctccctggccaggcatggtggtgcatgcctataatcgcttgaggccaggagttcgagaccagcctgggtaacatagtgaggccccatctctacaaaaaatttaaaacttacctgggcgtggtggtgtgagaccccatctctataaaaaatttaaaacttgtctgggcatggtggtacatgcctgtagtcccagctactagagaaggtgaggtgtgaagatcacttaagcctaggaatgtgaggctactgtgagctatgaccacaccaaatgcaccccagcctggttgacagtaagattctctctctctacctttctctctctctacctctccctctccttttcc

SEQ ID NO: 77290 - DNA, 1054 bp, Homo sapiens
aagaaacagagtgaagtaagagggattgtccattcagcagacgttttctgagtgctctgtacctgccaatgagttagatccctgggatatagaaatgaaagaaatgaaaagggtgtgtgttatccctccatagagggatttacagtgttcttgggttcacagacatataagcaaatcacatgatagcatggtgggatataccttcctccctggtttcctatggagataccatattggaagagcattggtttccatgaccctttggttttggactagtgaattcatggcattgagggccttacctttttctgaagtccattgatcagtggtgttgtaccctgtctctcactgcagagcttcaagggtaagaggccagtggggccattcactgctttgtttggattctgggccatggagccagggacttctgccatcctgagctgttctcctctgcctgtacctgcagggctggcccaggtcttgtggacatccttcggtttggtcggtggctgtactatagctcttttttgctcttttgagtgttgccctacctccttttatctcttattggcctcagcgagtgtcaccagagggacaacctactgcatcttaccacctgtacccagcactgcacacggacttgcactccaagcctggcagaggattggctggggagacacatgcctactaaagaaacaccatcggaagtgtattttctgctagggaagggtcagtagcatttggttcctgcccaaacagcaacacgttgattctcacaactcatctaacttctgcaactagggtgtcattacagtgtgtacttgggtgaagatggatcccaactgtcttttggcaaactttgttgttcttttctgtccctcatgtgatcccacagccaccaagatagaagagtgttctcgctgctgagctactttaatcccgtggtcagagtggcaagagcttaataaatacttttgtgcaataggatattttgattgtttgttttagggttatgtttgtttctctagttcttttgtacaacaaaatctttgac

SEQ ID NO: 77291 - DNA, 2205 bp, Homo sapiens
tcgcagcattgcatatacagcatcttggtagctttaaatcaatatctctcctaagggttcagaagaaatgtcacatacaaggtacattgcttgcacaagtgtcctttgtgtcggatgccctcgaatgtaatttctatcagtaagacataaaggacacatggagagggatcattttgctcggcagcacaggctgaaaggaaggaggggaggtggttattttttgttgttactatgactgtttcttgggttcctccaacaaagaaatgctgtgtggctttcaagtatctctcagtgcaaatgcttcctgtcacaagtgatcagtgtcctgccattttgaaatggcagaagtggctttagcagcattatgaaattatcattgccgtgctggatagctgagaccagcctctcagagaaattgacgctctcgccagctttcctcaaattatgtctcgtaaggctggcgcgctgtcactttaacaaactatcaccctgaaatggggttgctccatccagggctgtggaaaaacaaggttagaagagcagaggacttgtcgatggtgagtaagtgggattagttaaaccaatattgaaaaatggtttgcacaactctgggctgctcatgttccctctgaaaacgtgtgctctttcagcccgcgtaggcacggagacagttaaagctgcatcaggacctttgttatataatccttcccggttatataattaagggtcctgttttttcttgccctggtttacatcgattgaaatgtggatagaagattgcaacagttcatagtctcctgtaatagccgaggcagtaatttcattgattaaagcactcggggtctattggtcatcagtaacactatctgcagaatgaactatgtataggcgaacggtttgtgtttgtagaatattaaataagtttcagacacatgtatcctcctacagatgagcagtttgaaagaactggcctttggagtctgacttataggaaccttctgggttctgcccaggttactagcaggtcagaatcttggggcaggcctagatgtggaaaagtccaataaatcagtgagttctacatccgccatgaggcagctcctgtggctttttccagtcttggcccagtttcggttaggaaacgtgacaccctgaaggcagatagtattcttggggcttagctccacgccttcccgcaacactgagcttacctgtccctgaagcagtggctgctggcaccattggagcctctcccagctcttgcaaatgtcatctcagtggccataatttgctgccctgccatgctcccagccaatcgctttgagcagacctagagattaattacccgtgtgttccccgccaccacctgcttccatctgcttggtcttggaaggattgaaccatgggcatgtctgccttgtgccccagcatagaggcaccgcaaggtaggcaggtccgatttggagcacagtattgcatggagcggctgtaccattgcgtcccctcctttttctccagatgcgaaggttctgtgtctgtcccttagggccctggctgagaccttctgaatagctgctggtgcccacatcccgctgtaacagaagtccaggcaacagaaccacactcctctgtcatactgcctggcaaatcagatcatatccctactctgcccttccctccatagtggaccgagacccctgcattctttttcagtctcagccaccctccctcttggatcacctggcttgttagctcctggcagccctctcctctcctgaggctgggccggctcttgactcccagaatgctgtgtggccaacaggccagctagtgtctctcttggccaaacaggaattgtttgttgcaagtatttcctacaaagcaagttctaacattatatgggatatgggtaattttgattttctttatactcttactgcttttgctgaagttttccttggcgaacagatacttttttttttcattagaaagaaaagagtatattttaaaagagcagtttgggataaggaaaataaaaacacatcatcttttatgttcagtagaacaacaacaaaatcaccccaggtaagtcaatgcaaaaaaattaggcaggcatgcttctcctcatcaagtaataaatggcctgtcacaggtgagatgggtgggatgttatcattatcatcaacctcaagtcctgatgttccc

SEQ ID NO: 77292 - DNA, 1109 bp, Homo sapiens
ggctgatggtttccaagagccgctggtgctgattggggttggcagaagcccctcacacaggcacactcctatactttactttgtgtggttagcttatcttctgggctttcttttgatttcaaagcaacatggcatggggaaggaggtcacaaagagacagtgagggaatcagtaagccacaaggttctaacagcccctggttccaaagggccctctccatggtgatgttttcaaaacatcaggcattactctccattctgttcttctcttcctgcaggtttactttagcacatacttacagtcacctcctatgggcataaggattaaataagaaatagcccacgctctcagggggcagttgccagagagtgggcagaagtgaccatagttcaaggcataaagttacgagtatcatcagggagcagacaaaagccaggaaaggtcagaggcaggtgacttcatttcttgctgcgggaattagggaggttgcaagaagggcaaatttgagcgggcactcatagagtgagtaagacttcaacagctggggatggggcagccctgctggcaacgagggctaggtgggccaagacaggaaaacataagcatgttcagggtaagcacaatgcaggggtgtgtagggctcgactggggagagaactccactttccttaccagctcacacctgtccaacccttgaaaaataaagatcttctcctttactcatggtggaaggtgaagcaggagtatatgtgttgcatggcaaaagcaggggagtgggggagggaggggggcagagagagagagagagagagagaggatgccacatacttttaaacaaccagatatcatgagaattcacttactgtcacaaggacagcaccaaggggatggtgttcaaccattcatgagggatctgcccccctaattaatccagtcacctcccaccaggccccgcctccaacactggggtttcaattcaacatgagatttgggtggagactcagattcaaaccgtacaacagcagaggcagagagtagagcgatgcagccacaagccttggaacgccaaggcttaagaggaggcagggaaggagtctcctctgcaggct

SEQ ID NO: 77293 - DNA, 2579 bp, Homo sapiens
ttatcctgacttttttttatcatgtagctttctctgtatcagtgcatacagatttattcatccttgttattgatgtcagagtatttcactgtatggttgtaccagatgtattcaagccaccactggtagtgggcattatacaaacagtgttgcagtgaatactcctgcatgtatctttgcacacatgtcttcactattggttaaaagtgatattctgttgttatttatttccttaactggaaaggaagtccatttgtatttctttttctgtgtagtttctgttcatgccccatgctcattttttttttttcctattgaattgctttttcttgttacatcatattttccaaagagataatgatccaagtgctggtcagttctggggaaagtgatctgattggaggtttgctgagacccatcgtgtgtccatcgagaagtctgggtacccagtaaaaggcccttctccatgtttttgaggtgtggccatggcaagttttcagcaaggctcattctgtacttatctttttgatacttagtaaagggatgtgtctgctccacacagagtggagctttgaccagtcactgctggatgaacaagagggagagcatggccttgtgggacaagattgtctttacaaccactggtcttccagacataaacttgggtgcagaccctcttggctccagaattcatgggtcatgtgaccttctctgggtctcagtctcctcatttagaaaataggatcataagactggtgttgcaaggtggttgtgagcaatagaagaaccatatatttaaagtagctagcacatgattggttttcaataattggtagcttctaatattagtatcattgatatgactgttattatcatcaccataaataaaacgattgacagtagaggcatgggctaagactgaacaattggttaatgcggcaaccatgttatattggactttgacttcaggaacccgctccaaaggatgcaatttggtgtgcaggccatctgcatctttgcaataaaagcttctttgcacctatgtctatttcatttgccttgtgactctataattttctttcaggccttgcacctctgttgctagacatagtacataaatcccatgcagtttcctggccttgaaaagggagagtgacttgaaagtactctacttgaattctaaatgggaaagatgtaaaaaccgctcctcccccctccaagaaatctgagggacagaaaatagatctttctctctggatctcttaaaccccgcttacgaaattaacaaaggaagatggatggctgaaataagacttccaaagaagagatgggaacctcctaattgattcccacaaaactgctggttatttacaactaggaaaattgcctgcttggagataccaattcagctcttgtggttccgctggcttgacaggaaacactctctgctccttgctgaaaaagctctgagggaagaggggggcggagtgaattacatctaactgtttaacactatctcattcatagatttctgccttttccccctggttgatcattcgcagtctcttttttagtatataattgttcattttaaatgttcatgtgtgctatagctgggtgaatgttaattactggcagtctgcaattatgttgtctgtttgtcatttccgtggcggcaagggtggtaagctagaattcttccaatagcaagaattgtagtttataatctaccccaaaaccatttagaaatggatacatttcactcacactcttgatgtagttgagtaaatgcattgttattgatattcattatgaggttttaagctcaaaaatcccactatacactaactgaaaggcacccagtattttggctaattcgttaaactcacaaccattttttgagtatccaatatgtactagttgcttaggacatacctctaaatgaactagataaaaaataaaatattctgcagttctctatgtaactgtagggacttcccaagtgaccccttaagccactgtgtggctagtggcattgagtgtgtgtcccgtaggctgccgaacactcctccattaccagcactgtaattgtgaggaatatggtaagaagttagaagccagtggcaagtgaagttcttattttacatttaagtcctcctccgtgataatggcagctgaaacagacttggaaaacataatttgaagatcagatttgttccagatgtccctggtatctgtgtgcaaattaaattgcggtacatcagtttgatccagtcaagaaacagagtgggattgggaggcatgtttgtgctgtagggaccgggtaaacacagttaccattgatgttgcctgaagccgcagtgcctcaaggggaggttccagcaacctagaccacaactcacctgcggggattcccagtgttgggcttcgttctggtgctgtgagtatacaaggatgggaatttggaaaagactaaagactaaagtttcctcctttaaaggtagagggtgctgaagagcaactccttagaggagatcggatttaagagaacttaggtagttggaaatacactgacttaa

SEQ ID NO: 77294 - DNA, 1011 bp, Homo sapiens
acactgagggcaggagcgtgggattctgaagagaatcccaaaaaactatttataatcaactgtctgttgcctagtgggagaaaaggaatcattggtatgaacaactccagttactgtttccacagaaccagcaggctttctggttctttcctgaggcactccgctttacataggaggaaactgagattggaaggtaagtgtatcacctgatgtcacacagccagaaaggaggaagctgggtcactgatgctggctgagcccaaaatgcagaacccacgtgtgtctgtctcattcagccaccatggtggctttgggttgaattttcacaagctcacggtggccacctcatgagcatgcacagagagcagtagatagttaatagggaagtggctgagtagaagttggcctgaaatggaaaatttgctgggaataatttacaggccaagtaatatttgtgaacattcgtgtgaacttaagcttggcatgagctatctatacagaaatctaaaatcggtctaaacgtttgggttgcacttggagccataggccatcgaagagcaatgccgttgtgtcactttggttagggagtgtctggctcagccactacatgtcactcagaggatgccagtgtcagtgatatggggggtagcgctaattggaaaatggaggcttgtcagagtcactgctaactaataaaatcactgggaagtgggtgcagtttttccaagagtgattattgtgggtggcaagtattgagtgaggcgtagagggaataaaatcaaactgtctatacacatgctgctgcagtggaaagaaccctgggctgggagtcctgggagccaggcccggccctacccctgggccattcgtgggaccccaggcaggttactgctccactcaggccctttctccttttctttttagtatgttgtttaaaaaaatagtaataaaaaacattataccaaaagatatatagtgaaaagtacggcattctcttgtcaaggaagtaca

SEQ ID NO: 77295 - DNA, 4615 bp, Homo sapiens
aaagccgcatcctgcaaataagatgagaaaggaggtgtgggcgctgggtggggcgggcactcagatgagattctctgcccactctgtagaattactcttcattgtggctctcagaactcggagcctgtgaaaaccatggtttcagggtgaggggtctctaccctaggctgcatttcctgatggcctttaaccttcccaggcctggaggaaatcatgccccgggaaaatatatgttttaacttaaagatgtaacacaattaaaatgtaaacaccagttctcagctttagccctttactgtgagggtgatgtaataagaaaggccactgacattttggggttgatgaaaatggtaacttttaaaggtaacatgggttttattgaaatataattcacataccaaacaattcacctatttaaagtacaattcagcggttttttttcgcagagttgtgcagccatcagcacaagcagttttagaatattttcatcacccagtgcgggggaaaaaccctgtacccttaagccatcacccgtcctcacaccaaatgatgacttattaaatcaagctggcaagtcgtggcctgcaggaaagtgagcaatgattctcagcactctgattagcaagtggctttccagcaagtgtcacagggctgcgggttggggtctgggggatgccagatgcgggatggggggctgatctcactacttggagtatctcagggggctgcctctccggctgcgtgtcctcaggagtttgtttgtttaacaagtcacttggcccacatagaataagctccacttttttggagaaaaaggaaaaatgtgaattttgaagcattcttttatatctcttttatctgaaaatttcttctttctcactcaaccacttttccaaatgctggtcctgatggatggaacaggctccccttttactttatttcataagtggtttataaccctgaggctgagaaacgatataaatgagggggaaagaagtatcctacaagaaatacccagttaaagaaaagaaaactggagaaaccaagcccccatttcttttttttttttctccaatgcctttttgaagcacctaaaggccaaggaattttgaaatgagaactcgacagtgaaatgtttctcattttcaaacaaagaaacatttcttactcttgggtgttttgtgtgcagaaacacttttttgatatgtcatatttaaaggtgagaatgatccacttggtcagtagatccgtggagcgtcaggaagatggaaagaggaaagggccccgaatgacccacctgcgtatcttttgcatatgtttccaaaaatacaagtctgttcatcatactcgatttttcctttgtttttattcacgttttagcattccttttctgcattaaaaaaatgtatgcagtcctgctgctgccttcaaactagctttgtgatttgaagcttcactttctcatctataaaattcattcagcagcacccactgtgccttctgtagcacttccatccacctgacagtatgtatctttgttacttccaccacacccctagagtcgaaggtctgaggacagggactttcttcttcattcattgtgctatccccagcatatcgaacagtgcttggcatctggtaggttattggttaatatgagttgaaggaaatgaacgcacaggtgcccagtgcaaaaagaaaatttgatgatttctaaggagccctctagcttgaacattttatcatcgtgctgtagcctctctccagaaactgacactgttttgtacgtatctgaagggtaaccggattttcacattccctgatcttaacttttggtatgtttctcttctctgtaatcttaagcaagttaagtatggggaatcttcattcttgtagctataagacaaggtaagtggttttcctttcatcttgtttgaagtgaaattcttatactggtcttatcctgaagggccaatttctttttgtatttcagctttgatattagcatatgcccagaacctataggaaatcagtcaacagacctagaaaaagtctaatagctttgccttttcatactcttcacactttgcaaggttttcatgacagttggtaggtgaactctgagcatatttggccagaggcagattcctgtgtctctttgcttactaaggatacaataggagggcttatagatgacatttgtaggtatggcttagacggggaaatatttgaaggttcctgcattattttgggaacttgcctgaggttgcatttgtattataaggtcaaatttaaaggcagggaaggccgttaccaatatcatgtatgtatgtctaaggaaatattttgtcttttgcagggacttgatttcattttgcttggttttctcaggggtgatttcacctcagttctgtgtaaagaggattcccagatctctagtattaagattgaatgcctatcttgactagttgactaagagttgggtttgggggttggtttgtctgtagctgtttcctctgcaaagccaccttagcatcagtgcaatgagcttttcttgtggagccagggctgaagatagctttctattgttttcattctcctgcgagttggagcttaggggagcccttatgtgaactgatgcatcccggagggagggcttatgtggtttcattggcgggcgcgatgcagacgcagctatgtttagattcttccctctcagttaccaggtgcccattcatgccactccctcacttccataggttgtggaaaatggtgaaaataggattgttgaggtaattttttgaagcactgttattgtggttgacattgatcatttgctacttcaattgtattccatgatgtcaaatttactgtatttacctgtagcagaaggaagataaaccctctcagaaaatgaaagggcagcattattatgtgttcatgaagtcatactgtggcctcattggctatcattgcagtcatcaaggatacattcttcataaaataacacaataaggctgatgtgtggaggtcacgggttgtcacaactgtatctaggttaaaaaatgttgctatccacccagccctccttaaaagaggctatttataatacaatgcgggtgtttgtgctgcttgcatcgggcaggcgcatcctgaatgaagaattagctctttaaaaagaacattaaaaataaaactcatgttgtaaagatctgacagccaaaagagattgtgggctgttgtaaatgcttgcttatttcccaaggttgctgagttacttgctctgggtcatgaaatattttgatctggcaagtaggctttgctttttttaaaaaaatttacatgttctagatatgaatatacctacctacttcctaacaatcacttggcaggccctttggggataggagccccctcctgggagggagggtctgtcttctctcctccctgcgtcggccacactgctgcctcttattccaccaggctctggcttcctgcatgggccattccacttccgtctcccatcagggggcaggactcggggaagaaacttgggcataaagaatgtgtaaattacaccttaataaagctgttaagaaaaaataagcaccccgattaatggactgtgtcaccatcagatgaatattctaagtgatttttaaaaatagctctttcacgagagtgttttggtttggggtgtgtattcttggattgtttttattatttttctgcatagccttgataggaaaatgtagaactctgttatcataatacatgcagtatttagattggatacacttcttgctccccttgcattgatttcctacttttctcctttgccttttcccggtacttaagcattaagtcgcgggcattttcccagtgtaattgttgattaagtgctgcatatcccgtgatgattatgagaagattactgtattcagcttttaatcttgtgagtgtcaaatattttactttagtggtatcgttattattattattattcatagctctttctgtttgagtaatgcaatcaggcaaaataaaggtaatgccacaaattcagcatttttatagtaattctttgtctcagaatggaaagtgccaccttcaggccattctcaaatactgatggagatttatacagataggaatcagaatattttaggcttcttttggttgcaagtaacagaaagcaacaagtttaggaagaaatgcatatatatatatatgagggcagggaatctattggaggaagtactgtgggtctctcaggaccccaaggccaagcatgtataatagctggcggtcatcaagactggaacctggaaggctgccaggaacgcgggcaccactcgtaccttctctctgtcactttctgtgttctctttgttttctctaatgccatgtgcaggatgatcagtggtcaccttgtggcattcaagccaaatatcctccatggaagagaatagctcaggtggcctggctgtctttcagttccagtgcccacttcccaggagcaacagaagttctgtgaatggagtcactgaaagcatgtgacctacctggtcctgacgccttgtccgggggagcagcagcatggagaaaaaacgtg

SEQ ID NO: 77296 - DNA, 1007 bp, Homo sapiens
aggtggcctgtaaatatactgtgtagctctgcaggaatttctagaatgttcctttccactgttggcaagctttagtgagtacagtgtatctgttgtgtccagactctcaagagacttgatttgaatgagcccctgaaatacttattttataccttgtttataattttaaagcaagagctttctttataatttcaacccaggaatgatgtttggcattcaagtagcctggtttgtgcaggcacaggcttgtatacgtggagggtataatgccaggatgcacaaacaagaaattacaaccatttacttgtgtattattttctcaatttgaagcacttgaattccagagctcttaaatcaagaggttgaattcctgacattttaaagtattccacttgaataagctgtttaaaccattagaatggctttaaaaaaattcacctgtttcttggatcatttgctcttgagatttacttaattgaagtttttgccttttcattttacttcaaatcaaaatcatgtctatagcggaggaagttctaattttattcctatgggtaaagtcgatttcatgcctcagactgttccccaccaagtgaaagcaggcagttttccactgcctcacgtagcacagcacacgtaggcatgcacttatcttttcttccagaagaaatccttaaactctgacttttccccccagggcatcatttctgtaaatacagcagcttttacattttcagggtctctggcccatgtcagcttaaagctgaatttgactaaagccagtccctagggaagagagtagacagggatggggagagtattaataatgaagtcacaaaattattctgctgggcattttttataaatcatttgctcctgttggtggaaagtgagacaatactaagatgcaaaagtatggaaggtggaactaaaactgaaatgatcagttcacatatttgtaaactgcgtattttatatcagtcgctggattaggcccctagagacag

SEQ ID NO: 77297 - DNA, 1459 bp, Homo sapiens
ttgaaaagctcacatattaaaagtattaataatccttggctctatagcctggatctggctggtagtttagcaggttattagctgagtaacctttgtcaagttacttaatctctgtttcttcatttgttaaacgggcataagaatcactactttgtagggttgttgtaagaatgaaagatgatcatttaaatggccaagtgtaaaagtggcacctagtagacaatgaatggttgttattcaagacacagttcttccaaagaactatccctgtttcagccaaagcctactgtctgcagttgtagctagtttatcgcaaagcaaatgtctttgaatgctttaaaccttggatttgttatataaggttgagcatgtttgtgtcatttgtcttattgcttgtgctttgaggtcagggaccacatgtaaagacacctttgcatttcccatagcacatcattggtgttctgtaaatatgccaagttatttgtttatagtaatgattttatgaatccaaagcagcatgttgaattattgtacaaagaaaataaatttaaaatggaatatttcataaaggagatggcagttgagtgggatctttatatcgaaggaaaacagacattttaaatttaagtacttgattaggtccatgtactcttaatatttggaggctttttcctatgccagtaaagtaactgaaatccacccacattccacattaaatatcattatatgtaagctatgtaagagttgaatttagttgctcttgattggttaacatatgtttatagacatttaactgagcatttatttcaaatgtgcgaggtgcttttccagtgaattttgtgttttgggctgacccatttgcataggctacagaaagcttggaggcccaagcaccagaattaggggacctggtggatcaaacaactggtaaaggattctaggcagaaggggcagtctgtgagtcaggtcagctgcctagggtgaattccgggacagtacttgcatgggtgtgctgtggctgtaggaggcgtctgagaaatgtaggatatgtgggaagaaggctggaggctagaaaaggaggaaatgccaccttctaaggcaccagtggctcacaagtaggggcattttgttagaaaaaacacaaagcataaatccagcactttcaaatactaatctttttcttcagccatttcttggccaagataattttttccagtcagtgctgtggaactgtattagtctcttctcacactactaataaagacatacccgagactgagtaatttataaagaggattaatggactcacagttccacctggctggggaggcctcacagtcatggcagaaggcaaaggaggagcaaagtcacgtcttaaatggtggcaggcaagagagagagcatgtgcaggggaactcccctttataaaaccatcagatctcatgagacattttcacca

SEQ ID NO: 77298 - DNA, 1056 bp, Homo sapiens
gtggtgaaaactggaaccgaatctccaccttgaggccatgcaaagacgtgctggccctgggcagctctccctggggagctcttgaattcactcttccagaagcttcatgccctagagcgaatgccagatccctgccagaggctcttttccgcgatgccggtgagcactccctgaaaaaggaagtttccaaactcaggctccctccatttttggtcccctccccaggtgcaggctgtttcgcatcaggccttaatgagccctgacaacctggggcaggagggagccatttatagctaaactgtggtggctgcaggctgaccatcatgaggcagcattcttctccctggcacagtccaccaggatcagcaccgaggcaaaacaccagacacttagtgtccttgacaacccccttccaagctctcggagcttgtctcctttctctaaagtgactgcgcttcccactttggttcctgcagtcctgaatctacccaccctttgggacagtacctacccgccatgttgtgcacacactcagttgaaaacgcatgccagttttatatcctatttcacactgtatctgttgtttctctaaagataataatatctttgcatactttaactctttattccaagattttcatataaaatcgaggaataggtaaaatgtcccatttgcattttgagtcctcatatcttcacacacctcttcgagatatttatgtaaaatttcctgattttttttttttttttttttgagatagagtttccctcttgttgcccaggctggagtgcaatggcacgatctcggctcactgcaacctctgcctcccgggttgaagcaattctcctgcctcagcctccagagtagctgggattacaggcatgcaccaccacgcccagctaattttgtatttttagtagagatggggtttcaccatgttggtcaggctggtctcgaactcctgacctcaggtaatccgccctcctcggcctcccaaagtgctgggattacaggtgtgagccactgcacccagccaatttcctgatttttaagta

SEQ ID NO: 77299 - DNA, 2451 bp, Homo sapiens
ttcataaatcatatgtttgcagctgtgtgaccaaaatagacgtccacccagcctgtttgtcctggccttgtggaatgtggcgtgaccgtaggtcctcaaagacatctgtgattcctgcccctgcttccctcagtgccgttcatcaatcatctgtccaagcctaactctcccctctgattgccagtgacatggtcctactgattgattgattgattgatgattgactgattgattgattttcatatgagagagtttgaagcatattgtgtggagagccttttttatgccagttattcattgaaaaactcgattttccccttgaaaatgacaacaggtgtccttgaggggacagggcagtgtgaggagggtggcaggcagggaagggtggtgccagcacactcattctgacccgctggcaccaggcaaccatgagttcttttattagggcatgtcagatgtgcctctggggctggtgtcagacccacctccaccctgccctctagacttactgtgagcctctggcactcatggggaggtgtcttgttccttaggtgccttggtacattgcaaaaaacgaaagtgtgagagccactggaggctggttgtagaagggtaatggcagggtctctgtgcagagtggcactcctgcttcttactcctatgaagaccttttttcttgaggacagtcatgaatggtgtgcccagcggtttctcctggaaggtcagtttgctgaccccaggccttgttagtggtttagttggagtccgcttagaatgtcctgcgtgctgctttgaaaagagccctgggccaggagcaagggccttgggtttaaccttggcaccttttgtatcctcctttcatagccaaacagacatgtgcaatttatagtcaactccctgggcctcagatcctcaccaggagaagagtgttggatgggaccatttcttaagatcccatctagcctctggcattctgggtgtgagggagaagacttttgtcataggactttttgttcttaattgttctcgccattcctagagcctagtactgttgcgtctgacaccgagagaaccaatgcttgttgaatgaatgagtgaatgaatgaatgaacacagaccaacagtaattcatcttcataggcagctggtgcctgatttaaatacagagagccggtttccttgtgtttgactcaagtctacacagttggagatttgggcatcagttgaaatgccgcatttgtgaaaatgagaccggaaagtggcaacgtgggctcatggctggtgttgaaagaagtgttaatgtgtgaatttcttctaaaagacatttcacaatgcactgtgtccttagcgttctcgcccttcatcagaagaaggagtcgctgatgctgaggcctgtgctccctgtgttcagagagagctttatagagtagcccctggcctctgggaacttagcctctaagaatttgcactgcccccaaatgcgccgcacatgggaaatcctcatggggggaataaaaaaagctctgaatcgatacacaagtgtcattaaagcacttagctttcctgcagatctctgctaagtgctgctaagtgcgtcgttagtgggggagtggacaacagaaggcccatggctgggccgcagtggcaaaggtgtggtcagagaaggtggccttgagcactctgggtctgaaaaggtgagtaggactagtatctcttctcaggccccctaggaaggcctcatggaggagacgagtgttcagaggcagaacttggaggtgatcccaccccaccaggcagaggacacagattgatggccccgggagcagagccagcacactggtacacagatgggtttttttattgttggacagagtgattttgaaaatttgaattcattgccactacttaaaaatcaggaaattttacataaatatctggatttctagcttcccttgacatctgggagatggagcatccccgggcatgccttgctacagggcagcaactggctggacctgagcagccacactccgagctgtctgtctggccgtgcagttctgaccactcgctcctttccctgcaccaccccttctccccacctcccttacagacactcagccatttgaactgagtccctggttagggaacaagcttgctgacttctgttggggaaacgttccaggctcaggcaattcaagcagccttgcagaaggcaggatagcatggcgatgatggtggtgatgatgcagctaaaacatggaactttctactatgcgcagagcctcttctgagcactctccttgctttaactcattcatcctacagaaacgtgtgaggaaggggccattatgatcctgctttacagatggggagactgaagtgttaagtttcacaggggcaagtacctgctccatgtcatgttgttagtatgtgacacagctggggtttcca

SEQ ID NO: 77300 - DNA, 1996 bp, Homo sapiens
agacttccactatctgctgttacttgtagagaatcccatagactgacctgatcagttccataaggaccagcattttagaagttctgtctgtggatatgctggttgagagtagattcagaactgaatgtcaggattccagaggttgaatgtgtgtagctgtttttatttcacttaagtctttttgtaatcttaaaacatatttaatatgcagttcagataggcctccagatgttctgtgacaaccaaagctggaaggaaggtttctgtcgggggagttgaccccaaagcctggaagtttctgccgagccctggtctgtactttggtgctcactaccatctgctttagagctgctctgctgtgagaggctgtatgtcaatgactatatttaattaatttgtctaacatatcccgcctagttccaaaaagaatttgcaatggcctacaaaagtgctgtatacctagaggttttattttttatcttattttattttattttttaaaggaagtgcagaaattataagggaaaataaaggcaagaaacccaagataaagttagaggataacattaatatacaaaattaatattgtaaattctaggtattggtttgggagtgggatcagtcatgaatttggctctgagcttcctagtgaccagagcaaagagggaaacatgatcatttgtatggtttaaatgttcagaagattaaaactgactcattacccaagagaaacacagaggtccgtaatactaaaacctgagagatgcttgtcctttagattctcatagaaagagatcatcagtcatacagcaagacgcatccttaataatatgcctggtttcaaaggcagtttcctgtaacatctctctaggcaaagcaatgcaacagagatgtagaagtcaattattcagtgatagttccaggaacattgccttcttgtctctgagtgactgggtctgaggtccggcccagaatctgtagtcttcaaagccaccaggtgattctgttgtatagacaggcttgatgctgtctgctataggcagtgagaaacagataactaagctaggcaagtggccagagctggaaacacagagttggtgagttgttcgtgatcaggggataaccgagcatgtgagaggatgtgagaggtgaagctcagaggaagtgagcctagtaaggaaagagggtgtggacgaatgagcctgataggaccccaaaagaggaaaagacctgggcacattcccaagggagaaccttcatactcgttttaaaccctttcacaaatgtggtttagaagaagctacatagatgggaaaggtatactgtcatgtgaagaagacatttgaaggtaaagcgcattgaatatatctttaattgggaccactgtaactattagttacatttatcttctgaaaaaagctgcttacattttagcaaataagatgtaggtgttttctgggaaaatacattttagaaaataagatgtaggtggtccaggtggtatcacaatgactactatttattaacctggcctgttgtgttccaggcatggagcttggcacatacctgcatgccttcacttgagcctcaccagagatctgtggaggaaaagtggcatcatcatcatcgtcatcatcatcatctccctatcagtgacagtgatttactcagatttgcccattccaagagaattcataaacttggcactctatctgtggttatgaagctttctttcccctttccttttctcctcccttccagggggttgaaataatatagaacatgaaatcagaactgttgtccattgttggtgaactaagggaggtgggaggctgagggtcacttggctcagcctcctcctcagccccctacagaaaagccaggcaaacaccactgctccagggtgttgctgcctctcagagcactggcccaccatgattttgtgatgcatttgtcatggctctagtgcgtgtgtgtgtgtgtgtacactcaagga

SEQ ID NO: 77301 - DNA, 1209 bp, Homo sapiens
cctgtcagttcagtgaaccatttgttatcttcaattaaactgaaagtctccatacatcagccctttgtaaatactgagtggttaatgctgcctcttaggtttccaaatgtcttaagaatgtgttgtaataaaaaaaaattagcatcattttaatattaatactccgacatagattttatcttgagagtgtttctgaaccaaagactctgttagccccatattcaggggcacagggaatctcagatatgtttgtatttgttttcccgaaagagttaagacaatattttctttttttagttaaggttagttacccacatgtcctgattttgactagtttaactcttgaattcttcctctttagcatattttccctgttctagttgatcctttcccctctccaatgtctaataaaaagcttgttttcttggaacaaggtagtttaaatagtatttcctatgtgtctgggatcattatttttgtgatagcagcaaagtgccacagatcacactggcctccagtttgcatatttgtgtgtgtgcagggtctaagttaaatcatagcattttagaacgaggaggtttcttagatacctagctggccccatcctcaatgaatagacaagtaaactgggcccagagtcagggcttgccctgagtcacaggcaaactggtggtaaaacctgccccttctcaggtcagtccagctctcttttccagccatcaaattggaataaactctccttctcttcttcttcttctccttttttttttcttttgagacagggtctctctctgtcacccaggctggagtgcagtgcgcgatctcggctcactgcaacctctgcctcctggattcgagtaattctcttgcctcagccttccgagtagctgggactacaggtgcccaccaccacacctggctaattttgttttgttttgttttgttttttgagacggagtctcgctctgtcgcccagactggagtgcagttgacatgatcttggctcactgcaagctccacctcctgggttcataccattctcctgcctcagcctcccgactagctgggactataggcgcctgtcaccacgcccagctaatttttgtatttttggtagagacggggtttcatcgtgttagccaggatggtctcgatctcctgacctcgtgatccgcccgcctcagcctcccaaagtgctgggattacagg

SEQ ID NO: 77302 - DNA, 6175 bp, Homo sapiens
gattggcaatggggaaaaaatgaagtaacaggttcattctgcacaagcatagtcggggttcatggcatctcaaaggaagtatgttcagtaaatggcagcattagcgtgatctgggggaggtggagcttttggccctccaatgtcaaaaggccacctctccggcacttgctcaggcccagttgaaggggcagtggtcctaactggtttgaactggacaggagcttgccctagtttctgaaaaacaactgttgcgaccattaccgtggtgacctatgaatgttatctgtaaagtagccagtgaaggtcaagttccagcattcagtggcaaggcctcagcttcatggaaaaaggaaaaaaaaaaacaaaacaaaacaaaaagcaagtgaccaaaagcaagcagtacaggcagatccgatcaaattaaccccttggtttcaagaatgcaaactagactaagacatttgcaaagactagtttcagagaccacagggagactgcaagacagccagccatacttgcagtgatacggaactttacaaagtcattgaagggcttgtgctgaacttctccctacctcatggtcaccgcagcatacactggttggcccctctttccgtaggctgtgatttctaatggggcttgatcaggatgatctggtcctgctaatttgacacagttgcagtttggagttagaaccacaggtcttggtgttgatgacgtctgccagtagagatgctcccaacgtcctagttgtggattcatttcccacattttgaggaattttgtgaggatattgtgataagaaacaagaaggctgtgacatgtataaaggtcgattgtgtgctgatcatttgtgtattgtatttctcaggctctgggagacttttgtctctgtgttttgccatgcatggcctggaaaagaaatagttatgaagttttcactttttgcagctgtcatgggcccaagttgcggtggctcacatggacagtatgggttccaggaaccctgtcaggacagctttctcctcccacccctccacttcccatagattccaaatgggaggtgccagcttcttacagaaactccctggccttagtgactggtggagggataggcacgtggcccagtccaggccagaattccaccctaggcttcacatcctggctctgggagctccacagggtgtgctggcctcacgagccctgcacatggaatctgctggggtacgggaaatggcaccagcccagagacgcacagacaggggccactctctccttgccctacctgtggctggatttgatgggctcatcaattctcctttatacttaagccagcttgaattgggtttttcttatgtacagtcgagagtcatgatgaatacagtgtttctaattaacagtgttagttaaactaagtatacagcactggtgatttctgtgtgtcagtgtcatttcagcctctttgttgtcttaagaggcccacttagtggtttgactgtcccttgagagaatagaaggtgagcttggagagttttcagagacagtgacttgatttaaagaaagtaggatcatagtagtaatactcctcacatccacgtatcccccattatagctgcagagacctggcttacatgtaatttcacttacttcttgagaggtaggtggtatcttcctgatcttacagatgaagaaacagaagcttaaagtcgagcatttggctaaaccaagcagcatatatgtatatgtgtaaattaatgtgtagctgtatgtgtgtgtaggtgcatatatgtttaagtgtgatgagcatgtgtgtgtgtatgtgtgtgtatgtattattatgaaggattttcagagtcaggattcaaagccaggtccctcaaatgctaaattcaggtctatagcacaaatgctattttaggcaatccccatttcctccaagttcattgactcacatgtccaaccaatgccatttatagttagatggccttatatagagaagaactgtgttcaccccctgccacggcccccaccgccaacacgcacgcatactctgatcgttttggaaatggaacacattttctcttttaacatctgatcttcccctcactgcattttagattcattgtgaacaattttgagtctcattagaggtgtcttaattttaaaaattaagttgggaactagcaagtgagattgaagaggctatatctttggttctgacctggattttctttactcaattactcttcaaattatactgatttgagatgtgattattattatttttcctaagtagattggataatgagagaaatgcaaaggcatgctagactaatagtgatctgagtttctgctacctcacttgtccttccatttcccctcccccagccagagcaccgccccagcccctgcttcctggtctacctggtgagccacctaacctagcgaaggcagctgcttccctgtctttccagcgtcagcccagctatgaccactgcagcgccagggatcctggccaacttgcgcattgtaatcacgtgatgcagtgctcaccatcctgcagcagtttcccatgttagttcccagcccttccttatatgcctcatttaaatgtaagatttaaattgtaccgtctaccctgagaacccactgtgtagccaccctcatctcctcagggtcaaacctgctcacagtacctttatcagaattgcccctcaactgcttgaaacacatttctttcatctccctgtcttttttcctgtagggaagaagggaagaaggtaaactacctaaaagggagatggtgatgttttctccccgcatcctgcttcatcacttttcccctttgcttttacatacacacgtgtcatgctcaagtgctgtctgtgcattgactcatggctcgtgcctttggtatgagcctcattactgggtgagcttcgccaaatgagcttttggtgttgctgcaaatacaatggcgtctcttttgttttagggcctggagtgacattgtgatggagaagtgcacagttgaccatattgagccggtcaggagggtagatttaagagaggcagcaacagcagcctctcgtataagcagcagagtcttccctgacaccttacttatttcccccaggatctgagctcattcgccatggcaggaaccactaagattgtttggttatcccgttacttctgtcttccagccagactgtaatctccttgaggctggagttttcttatctctatctccagcaccttgcaggttacccagcacacggtaggagatcaatgaaggtttgtaaaatatatccatgtaacttactgttatggactgaattgcatctccaccgcccccccagccgcctccaaaatttatatgttgaagccttcaccaccaccgccccgcatgtgactgaatttggagatagagccgttaaagaggtaattaagatgaaatgaggacataaaggaggagtttttataaggactggtgtctttgtaagaagagataccaggaatgtacatgtactgaggaaaggccacgtgaggacacagtgagaagtcggtcacctgcaagccagggagacagcctcaggagaacccaaacgtgccacctctttgctctttgatgtcggacttctagcctccagaactgtgagaacatcagtttttgttctttaaaccacccagtcttagtattttgttctggcagcctgaactgacttaatatatttaccaactgtcctagcaccttgtatcccaaagctgggactgtaggggtcaactttggctgctaagggcagtttgggaagatcccaaggttggctgcttaagataaatccacagtaatgggcagctgtgtcccaccctgcactcctccttcaccaccagtgaggcaagtctggctaaggctgtttcaggcattcccaccctaccagggaacgtgaatgtcatcatcaactaagattctgggcctcttggaaattgttttaacttgacctacatcaccgtatgccccgagaccttggcagttctgtacacccatgaataatagcaattagcatgaaaagaaagctgaaagagtctcaagtaggacgatctgcagtctggccttggaccttccacttactagctgtgtatacttgcatgtgtaattttacctttttggggtctatgatttgtttttaaaagtggacgtgctgctataatggacagttccttttccctcttttaggcattaaccctggcttgcaggtggagagccctccatccccccagttcattcatctgtgtgcttccaagtgacgtctctaccactagtttaagtcactctcattcctctggctacactggtgtgtctgggtggtcatgtgatagaggctggtctgattacagtgattctcagaccttttccagtgaacactggggaaatgctagattcaaagctgctgtttgtagccccaggggctgccggcagccacctgtgaacagaggagagcctgtccaagcctattttcaccagcagcgttgctgagttgggggacagagagtagggcttggtaaatgccatttgaaaggcatcactgttcctggttttcccagtcacaggcgataaaatctcttcaattcggtttttaaaaatcgctaaagatggaaagattactagctgataaagctattaacacctgccctgtacaccatacaggagctacaggagctttcataatacaatttctaaataagatcatgaaggcaaaggcaaaggttgtgacatacagtttgaacacagggaattattatttggaaaatccaaataataatttggtgactggtgcctcttggactcaatatcatgctctttgaacatctgtgaaaagatgtgtacattcttagcacagtgtcacctggtaaggaatgaatatatggaagctgttgttatcatcagtaagaattattgcagcagtgataggagggggatgtagaagtctttgagaattttgatttgatgatgaagatagctgcatggaatcctacttgagaaggaactgattctgtttcttttggggttaggtggtaccagcatcctcctgatgtggatggcacttgtttgtggaaactgagtagcgtcctcatagccaggttcctgacgatggaaactcatggggagccctttccttgtgagcccaccctgagggtgttcctgctcttcttgggcctgattctcatctgatcaccttggctgtatgttgccccagccaaggacagtatacaaagacaggccaaggttctggttatccttgtgatgtgatatagtttggctgtgtccccaccgaaatcttatcttgaattgtagctctcataattcccatgtgttatgggaagggaccccatgggagataattgaatcatgggggtgatttccccatgctgttctgtcatgttagtgaataagtctcatgagatctgatggttttataagggttttccccttttgcttggctctcttgatttctctctcgtctgctgccatgtaagatgtgtctttcgccttctgctgtgattgtgaggcctcctgagccatgtggaactgtgagcccattaaacctttttctttacaaattacccagtctcgggtatgtctttatcagcagcatgaaaatggactaatacagagtgcaaggtaatgattagggaggacaagaggggggctcctcaggtgccaagagccccctgttagttcatagggtgctgattacatggtaaattttctttctttctttttttttgagatggagtcttactcttgttgcccaggctggaatgcaatggcgtgatctcggctcactgcaacctctacagtatcctgggttcaagcaagattctcctgcctcagcctcccaagtagctgggactgcaggtgcctgccaccatgcctgactgatttttgtattttttagtagagacagggtttcaccatgttgatcaggctggtctcaaactcctgacttcaggcgatccccccacctcggcctcccaaagtgctgggattacaggcgtgaggcaccaccctggcaattacatggtaaattgtttgggaaaattcactgagctgtacacatacaagggctttgctggacatacgttattccaatagaaagtttcaaaactgatt

SEQ ID NO: 77303 - DNA, 1416 bp, Homo sapiens
gaactcctgacctcaggtgatccacccgcctcggcctcccaaagtgttgggattacaggcatgagccactgcacctggcctgcattatttctttgtactagccttatgcatttgatatggttactaccattttgtagatgggagaaacaaggcctgaagcaattgttctgctcgaagtcacagaaacctgaactcacaccagtctttacttcaaaatggcataaatatttctaaacagttttctactttagatatttgggtgttctacagtgttttgcagactagggctgagggagaatcctgttacgtttataagtaatttacaataagacaaaaagatggaaatgaaaactttgtcttctttcatttaagtaattaaggtgcttcattttccctcctcgttcctacacagttcactttatgatttttaaaaactagatagagaaaaaaggaaatcctaaaattagtcattcaaagattaacacagtgagaggaacccacccattctttaatagaatgaatattttattttagtctatgtgaattttatattagtagatagacagatgcagatacaagtaattttacaccaattataattcatgtataggaatctttccttatttaatttttgagcatttaaaaatgtttttctagtctattaaattatatcagttagattataaaatataaagattaaacaaccttggatcacattgcactgcagaacctgcttttatcacagtgctcagtcttaaaatacaattgaaaaagtcattccccttgaaattctgttgaactgtaaatggaagtctagaaatatttttatacaattgccaagagattttaatgaggaagaataactctttagaatatattctgagcgagctgtttgcatgacagtttcagacgtggacttaaaatcatccacctataaactgcaaggggtcaagtttgtgttcctgtttggttcccttgacaaccaaaaggtgtggctcagagtttctggggagtacctgctgcggtgcacgtgacatgggagtgggtgtgtgtgtgtgtgtgcaggtatgtgcacatgcatgagtgaatgtggcccctgccctcaggcctttaccagtgccaagtgtgaactttcagaatgaatctctcctgccatccctctgcccgtctttctccccaggtcccctgttggcctttgtgagtcgtgacacacaggcatagggtaaatgacctcagcttttaagtcaggtatacttgagtccattccacaccttgcttcctaattgccacctgattttggagaagttttctaaccctctttgagctgctatacaatgaaaaaaaatccctcttgcaagattactatgaggattgatgatgatctgtgtagcatccctggcacttagtaggtgctcc

SEQ ID NO: 77304 - DNA, 1660 bp, Homo sapiens
taaatctgaaggagaattcgtacatatctttatctcagacacttttaattcctcataaataggactgcctccttgagaagttcacctagctcacaagtaccaagctgtactcgatactctcaaagtgtatattcacagcaggtgcacatatagctttgtgaaggagcacgggctttagcatcacagttaactggggctgaatccctccctctctgggcaccagctctctgaccttgtgcctcaggtttgattgcctgtaaaatgggcctgcgagatgtgtttctcacaaccccgttttacaatcaaacctgaggcccaaggtctttgtgatctttgtagtcttggtgaagattaaagaactgtgaatgtcagtcactctggtacctgacacctcacaaatgctccatacgaagtcagctttagccttcaatgtttcatgcctcaggtttctgaccattcattctcataggtatattccagttgaaaaaacttccaaaactctccaaacgagcattttcccaaataccttcctttctcatgatttccattttcagtgtcactgtctgatatgaccaggatgtcactaccagactcctgtgtctggccacagcctctggtctggagtcctggcaccccttacctctctgtaagggccaatgaatcccaggttttgtttgaatttgccctgaccctcgcccactcattgctttcccatttggttggagcttgaagcccctgggctctttggcctcttccatctaatctgctccgcaagctgactcttttgtccattttgcaaaggagggcatccacctaatgcataaatctcctgattctcaccctcaggcatacacattaaaaaaaattagcaatggcagaaaaggaaaataagaaaacctctctccattccccccaacacctaagtcctaattgccttctgtcctctttgggcctgcagaggccctctggtttcaaggaggggccctttattcttggcatcatttgtcttattgttctgcactgcattatttgtaaagatatttctgtaactacagtaatagagtcagctagctgcttttgcttacaatcagcggtgaatttacagggctgctggtctgcagctctgatctctcaaggttttatgtggtcagtgagaacatgcagaacacagtcttaagttactttaaaaatacaaggaaatgcaattttaaaagaaggctttggttgattctgatctttgccatctcttgaggttccaaatttgcccaatctccagttaccccccttcttccccagtggctacagcctggtgtggaatctgggaaaataccagtcagatatcctgtattttcctgtctgactttaatttcagctcttcccgctacccgtctatagtaaccattttaaccaaaatccagtgatgcacactgagaaaatggcagttttgtgaacagaaacagagaagtcaggaaatcgagggcctttattaagagcttcctccaggccaggtccctgctggggtgtgtgtgggcttaatctcatgtttcagggtaactgttcagtaggaggtggaaactgaggctggacttcggaagaggggaatcagggcggggaggaagcttatgggcataggttatgggcatagatgagctttgcagga

SEQ ID NO: 77305 - DNA, 1012 bp, Homo sapiens
tgattcataattaaagacattcctcacccctaatctgacccttcatctggtctctgatggtttcatcccaaaatgacataggcacctctgctcttggtagcttcatgccttctgctgaaagttgccacaagccatgctgattttatatcctacttctgccctcttggtcttggtaggccctgttggcctcagagctccccacggagttttgttcagagaggagctactgcctgaccattttggcctgcttttatttctagctcttcctccaagcaggcattccctgggcctaccctccccaccccacctgcaagcatttcttgatggtacatctctgtgtgtccagtcctgggttaggctggagatccccaggggaagtccaggtcccaccctctcaaccaggtcccaccctctcaaccactcacagcccgttctgtggtcagaccacgagtcctagcccttcttggaaaaggctgcttggcccacccactctaagaagcccagccactctcagcacagatgaaaccactggttttacaaacctttccagtgactcacttgacacccttatacccttctggtcattcttccctcttccttttctccgtcactatagtattgggcctctaattattatcaactctgtgtccctaggatgcggtggtagaattaaaataaattatctaacatattttatttccattcacttctgttggttgttgttattgttgctgttgttgagacggagtcttgctcttgtcgcccaggctggtgtgcaagtggtgtgatcttggctcactgcaacctctgcctcccgggttcaagtgattcttctgcctcagccttccaagtagctgggattacaggcatccactaccccactcagctaatttttacgtatttttagtagagatggggatttgctgtgttggccaggctggtctcgaacttttgatctcatgtgatccatctgccttggcctcccaaagtgctgggattacatgcttaagcc

SEQ ID NO: 77306 - DNA, 1108 bp, Homo sapiens
ctgatttataggccacgcaattgcatactgtgattttaatagcctgtgaaattgggaaatcaagcgtttctttgtatttttgcttcgtacaggtgaaatgtagtcaggcaagtttggttaaacctaattttaataatcatcgtagatatcctaaatgtttaagaaaacaaaaggaagtccctccactctcaaaaattaacacataatttaaaaaaatctattctgttttcccttcagatagtagaagtggaaactgattaggatcagcctttgggttcttttcaagtgagtttcaaagttatgtgcgtcatttttcctctagaactatagcagtgatatgaatatcattcaggtttggattattttgagaaaagagattttgttttcttagagccttttctcacgatttttattcattcactttggcattaggtaagttctttttgttcgtttctgtggggcaaaaacatgagggaaatattaatattgataaggtttctgaagttgagagatgtcagtatgagattatcctgcgggtgtagacttcttttctcttcctgatagggttacaaattcccccagttgctctaggaactgtgaattaaactagtacagatttcagatgcttattgaatccacatccagttaaatgcaacccattaaaattttgtacatttgaaaatcagaagaatcttgatgagagcttgggagggtgggcagagatttgttaacattcatttttttttctgtgatgtttcttcattccctagagttctggagacacttttgttgtgataatatttttttggaatatgtgggtattcttcctaattaatatttttgtgtcctttggtgggtggttctgggccatgggaaagttgctaaggcccacaagcaagattttacgaataaagatatgagtacctaaagaagggactgtccagtcatgccaggggaaggtttgggttagaatcaagtagaagaaaaatgtgcctgtttaatgccactctctcaggtttttgatttctcactttctgttttcaaaaatgtacgcacatccctcgtttttccctatagcaagtggaagaaaatttttctagataatcag

SEQ ID NO: 77307 - DNA, 1211 bp, Homo sapiens
atatccttaagttatacgctatgccgttaaaccatgtgaatttgccattttgtgtatctgtcggtcattccagtgcccaggtgtgagcagggtcaagatgataagcagaatactcacacagataggttctgcactgtgaaatatgaagcctgtttacaataaagcagacctcatggttttcgaggatgcattttcaaagggtgtcagtaatgcatacttggggaaatgttttgagggaagtgtgggaaggggttgcaggtgtgtgagtgcagatgaacttggccttatgctagtttcttttctctttcagcacatcaggtccacccatctggccgggcagtaccttcttcaagagaaatggagcccttctccaaggtaggtccctagtaacaccccttcctctccctccccctcacccacccgcctttcatcactcctttgtgcttggtgtcaaataggacagttctgtcccgtttaggagtggccgctttctggagaagtgtgactgttgtgggtggggactatttgtccagttctctttatttgttcctactcaagcttctcggtcgctgtgaatcatgagtctgaaaccaggcctctaaggactgcttctttggcccgccgtcactgttcatattctggaagtgttcggcttgctttggtgatgttggaattacatggtaattagaatgcgacagaaacataaactaggctgataaaagcaaacccctttacatgtttcaaaaacttgagctgaaaaaggagggtttggttattctggcacttgtatcatcatggaggtgcatgcatttcttactgttgcccaacatctacatgtacctggaaggttggccgtggtttgttctgaggttcggagtccagtcaccctacattggtccccacaagtgtcacctacaggggacacccttgctgttgtccagctcaactcagctgccttgtcctagtccctaggcggtgtgctcatggaattccaatgacctttcacctctacttttgccattaagttccttttgaaatggccaaagttaaggaggaataaatgatttaaaaaatagcaaagaggttcatttttaatccttttagaaattactttggggttatcgctattttggatatctgttctgtaaataaaatggaattgagtggttcccggggccttcgagctttctatccctcctacttctgttgat

SEQ ID NO: 77308 - DNA, 2015 bp, Homo sapiens
gcaggagctcttgagcctaggagttcaagagcagcctgggaaacatagcaagacccagtctctacaaaaaaaaaaaaaaaaaatgcaaaaattagccaggcatggtggcatgtacctgtagtcccagctactcaggaggctgaggtgggagtattgcttgagcctgcaagtttgaggctgcagtgagctgcgattgtgccactgcactccagcctgggtgacagagtgacagagtgagaccctgcctcaaaaaaaaggaaaaaaaaaatccttagtgtttgagataattctgtgtaggaggtgcaggtagcattcccgctgtttttcagaatcacttagaataatgacaaccatcttccgtgtgctgtgaacctggccaggttctaagagaggagtcactgttagcctctgctcacgtgacgtctgccaaggtaaggtgagacacacatacctgtgggttaaaggtataaggcgttagaatgggaagacactgcagagtgcaattaattcccagatgagctgcacagaaggtatttgccagaaggattcagaggagggagaggttgtagggtgagagtgaccagataaggtgtcctgggtacctgggattcgagttgaacattaaaggatgaataggctgtaacaggtgaagagaacatgggtctagggcatttcatgcagcggagggagagattgggctgggatgggcccaaaaagcctcctgggtgcaggtgttctggagacctgtgccaggcggcatattgaaagcaggaaggacatgctgggaaggaacaggagggcttctgaggggtaccagcaccgattggctctcaccctgccctgtaagcatttgttacaggaaaggggtcccgatcctgactccaagaggaggctcttggatctcaaacaagaaagaattcagggcgattccatagagtaaagtgaaagcaacttgattaataaagtaaaggaacaaaatgatggctacttcatatatagagcagtccggagggctgctggctgcccatttttatggttatttcttgatgatatgctaaacaaggggtggattattcatgcctcccctttttagaccatatagggtaacttcctgatgttggcatggcatttgtaaactgtcatggtgctgtgggagtgtagcagtgaggaccaccagaggtcactctcattgccatcttggttcggtgggtttcagctggctttaatgcaatctgttttatccgcaaggtctttgtgacctgcatcttgtgccgacctcctgtctcatcctgtgacttagaatgccttcaccatctgggtaggcagcccagtaggtctcagcctcattttacccagcccctattcatgatggagttgctgtggttcagacgcctctggcacattcacacttctgtagccaccaaactcttcgaatgaagacgcacatggagagtcggtgtatgagacacatgaaaaatgagaggctttgttgacattgggcagctctggtgataccattcccccacccctgatagcactctgggcacctctccacgttggcaagccctggggactgtgcctgaagatattgtgctttgagaatgctgctgaggtgtcaggcagggcggcctgctgtggggagagaggctggagacagggaggcctattaggattcaggagaggacatcttaacttgagctgaccccaggcctgggagtagaaacagaaaggaaaggaaagtgcaggagcccttgggaagaacgggtgggccccaatggggactggaggcagggacgtagctgaggaaggtgtcagagcctccagaattttgaactagagcatttgccaggtgattaccaaaggctgggtccgttgttttcttctgttttgttctttgcggaatgctgaattaaaggataaactttacttccctcaacagacatttgtggcagccaggttccaagcacagcagtaggtattagggattcaggaaaagacagccacaggtgtcttgg

SEQ ID NO: 77309 - DNA, 1052 bp, Homo sapiens
agcaccccctgttgtctaagttctcttttctatatgatctttgccgcctctcctgcccccacctccaccatagtcagaaatctcacatctcaacaaacatctctctcctgtcttcaccgcggttctgctcacagccactttccccttcaaactggacattttggattttccctgctaaccttaccgccccttcccgccccttcccgggctccagctcagcaggaagaaatgtcgtcagcagaggctgcaaacccaagcctgtcccttttcagtggtatttttactacgagctgaactacttcagcatcatgtaaacacgctggagtgtgttcacagctgcctctcttttaaagttgaaccagctcagaactaaaaggggaactgctttcaggttctgttcaagtttgcatgtgacagcatcaaagctatttttagcagagtgatcaccggcaagaagctggaaacggctgccttcaactatcaacagtggaaagaaaggatcatttatggactgctgcagctcttgagtccatttatatgggagacacaggggtgtgtaaatctcttcttcaaagttacaaggcgtcttgtcccccatcacctttgcagagacagggcagtgttaatttagtgcttggttgcctgggctccaagttaaagtagatacactgataatagtgaattataggactgtcctcaatgtctgttctgagaagaaggcgatgtatagatgctcagaaacatccattaaacttttgaagtgtttgtattgtttcttcagttttccttttcttttctgtagatcaccaaactcaagagacagcaggaaacgggaggtagttatgtaagcatcatggcaatgaagagagcatgagtcacttactagccatgcgaccctcattaagtgacttttcctttctgaattaagtgttcttagctgcaaaatgaggatcataataccagccctatatactttatagggctagttttttttttgttttttttttttagcagatgtttattgaacacctactccatgccagctcctgggg

SEQ ID NO: 77310 - DNA, 1015 bp, Homo sapiens
gtgagccactgctcccggcctaatttttcattttgatgttattttcatgctcttcttccaaaaatgcaaatactgacaaaacttgaagatctttgttcttttctttatgtcggtgcagagtgtacaaaagttacctatatcgggcacacattgaaatttgcattagcagagactgctataggatttacttatgagtgattctgaaaggttaagaatggcactttttctaagctttggttgaggttgggattgggaaggatggttcctctcaccatggttatgcaaaaactatgggttgtaataggatgcaaacacgtgtctcccaagaataagcagaggtgcaggctgccaacgagctttaagaaatactgtggctcggtaaatggagaaccgaagggagagagggtagcaaaagcaaagagacctttggtgtttccgactttcacgagagcctgtccaaattttcatctgcatcagcacttttctagcaaagttcaccggccatccagcattatctggtgggcggccttatttacacacatatatataattgattccatattcctctcagacctacaaacagtacccatgtttgtttttaataaccagaattatttcagcttaaaaaaaggtgtagatttacatagacagtctgatgagtgcctcagattgttccattagtaacacagaggagaaacaatcttaagaaaaacattttgaatttgtgtgtggaggtggagagaggattgggttagtgaaatcagaaagcttccaagtaatgattattacatttaataataattagattagcgttccacagggactgttttctggaaattttggtaggacagtcactgagtaacacacacactcagagcaacctaggtttcaggccattgggtgggacatggcctatttgctttgttttggtcgcgtttaaagttaatccaaaatcaatttctttttcaagattaaaatgtcactactctgtcttccacttcaggcttctgcaaac

SEQ ID NO: 77311 - DNA, 1008 bp, Homo sapiens
gcagtcttgtcagttcatatggatacacagtactctttttttactatgtgtgcaatgtccccttgtatggattcatctgtttgtggctggacattttggttgttttccatttctttatgttatgcctcagtaaacatgcagagacttagacctttgcacccttgcctggtaataaaaatcctaacagttgggtcttaggctggattctctagaagcagaatctgagacagggacttggttgtgagtgatttgctgagggactgttctagagttgtcctctttgggacaaagcgacagggcttttgtactatcagtcatttatcttgtaatcccaggcctcttgagaccttcagcgaaaaggatttctgtagaaggtggtggttgtgagcttacagggcagtcggtagtgggggcagcctctaacacagaggatatgggttgaggtatcactgcgagtgctcataacctctgtggtcctgtctttaggcctggtgctatgctaagtacataaatgcagttctaacagtccaatgttgtaggggctagtagtatatatctactctacaagtaactttcccagggtctaccagctagcaaggtgtggtgggattgtaagacacactcaggtctgtccagtattaaagcccgagtccttttattggtgggctgtagaatgtaaagtttaattcctagaagctgaatttatggaccaaggagatagacatatttatcccagtttctttccctaccccttctccaagttatatcaacttagatgtcctgtgatattatatttgactgttctcctgtcatccctgggtcttgtcagttttttaagtatctgctaatccaattgatagagatttttttttggcttgattttccttacttttacaattgctgaggctgacacccttgcccgtgtggattggccagctgtattcttctcttaaggcccagtttttagtccgagggccttggcttctttttttttttttttttgagacc

SEQ ID NO: 77312 - DNA, 1010 bp, Homo sapiens
atgggcactcagtcccacaggagccaccaggagaatatggctggatcagcacaaatctgatgttaatgctagaaaaggaactcagagctggtatgcaatatagcccacgcagatctttcggcagagtgacatctaaaattccctgcagttttctcagcctgccctgagtctgagctgcatattcattctgttcgacagcaattctggggtctgcctgttctttgttcctctaaccgtgctgtggacaacattctgaggacagcaaagccatggaggagagttcggggaagggggagaatcaaagacatgcctacgagactggacacccagattcgttagttgggtttgctgcccttgcctttgatctcctgtgcaagtggaagggtgagctgatggactattgacgcctggcttcatcctcgttgtaacgatcttattttcactgtatatcctttcagggttatgccgacgttaaagattttatttagcaattatttgtgctatctcatcaagatattgctgtgtgatgctgcaccaagagacaataattcaggaaatgattttaagatcagaaaggtgtttggatttagagtctagaatgagtaggagaaggaataaaaaggatcgatggtctttgtgccctagaatgatgctgggccctgggcatcaaagacacatttatcacccccttctctttgtttgtctgagccaggtgatatggagggggctgatctggtatcaaagaacatctatcaagtgcatttaggaaaataattcaaggagatgactaggctttctgagacatgattactggggaggtgacctttattgcaagccgtgaagagtaattaaatttgagcaagaaagaaatttccattcttttaggctgagtttatgagagtgtctcagattaagcaaattcaactgtcttggtcactgaaaatctcttactctgttgggatttttgaaggttctcggttagctaacatcaacatcattgagaaagatgg

SEQ ID NO: 77313 - DNA, 1055 bp, Homo sapiens
gtgtgcttctaagagacagtcgtataagtgaagtcttcctgcgggaccctacactttacccctgctgaaatttgcctttccctcaggtgacattttgagctgcttaacaggaaacaggcactttcagaagtacaatgactgtctaatgatttctgagtgattccctccagggtgtctagatttcttcctggctctcagaggtagaaggaactctcagaggacatttacctgtcagctccagcactaacacccagaactcttgccttctaaaacatcgcaggaagtggggtggctgttcctgaagctggcatcactgagctggtaggaagagttaccttgagtgagctgctgttgaatgtaaaacagctgtgccatgtgcagatgatttcatcctatgagcttcctcactcactgtcagaggccaggctttataaagtattgtcaattgcttttactgttttacttattttttgtttttttgcattaggtacccactaaagtcacctgtcaaactacatcttgaagccaattgcagtcttgaaatcctgctttgtggtgcaggttctactgcatagaatgttatatgagttagctcctgctgctgatcaaacacctcaaattaatggcttaaaagaatcatcattggtggccgggtgtggtggctcactcctgtaatcccagcactttgggaggccaaggctggcagatcacctgaggtcaggagttcaaaaccagcttggccaacatggcgaaaccccgtctctactaaaaatacaaaaagtagccaggcgtggtgataggcccctgtaatctagctactcgggaggctgaggcaggagaatcacttgaacctgggaggtggaggttgcagtgagccaagatcgcaccattgcactccagcctgggtgacagagcaagactccatctcaaaaaaaaaaaaaattcatcataggctgggcgcagtggctcatgcctgtaatcccagcactttgggaggctgaggtgagaggatcacttgagcccaggagttcgagaccagtctgggcaacataatg

SEQ ID NO: 77314 - DNA, 1189 bp, Homo sapiens
aaccttttgtttgaacttctattattaaaaatacattccaaatcaatgggtctgttttctgccaatagatagaatacgctgaatgaatacttgatgtgttggaggacactgaattttgcccttcagtgttcactgtgtaattatgttgatgtaaaatacgtgcccacccttgggaggctgcaagagatgatgattttgaataaattccatatatgagcctctgactttcccctttttcttaaaaatgaagtactgtaacctctatcttccccttcccggctgcccgcaaatgttttttatttgaagttgggggctagttaggtttcagttaattaaagttttaattgtgtttgattctgcagcagatctgatgtttacctgtcttagtaatgaaatgcaaagcgtcatccttgagcttccgctcttactggatggcaagggaagtaccagcaacctcgagacctattagccctggttggtgatttgtaatatgttgtttatttttgatgttatattcaaatatgagaaaagtattgactcaagtttaatcatctgaacattactcaaggattactatcttgtataaaatctgagcacttggatgttgcgtgtaagacatcccatgtataaaatggagctacatcatttcctccagtgcagaagattgaacatagcaagtctgagggttctctccttagaaagttctgcttgcaaggttagcccttggttggtgtctgcaaatttggatttcaggagggttctcagcactcccagacctagaagtggggctcctggtgcctgcatcgtttgtggaaacactgtggttggtggaagaagtctgacattttggtgtgctctaggcatagggtgtctacctgaagagtccccagtaaaaatcttgggcactgaggctctgaggctcttcccttgcaaacagcacttcatgtgtgctggcaggatgtgtagctggggaagcaagtgcattctgtgtgactttcctgggtgggggcttgcatctgggttcctctggacttcacccccatgcaccttttccctctgctatttgtgcttcatatccttttgctgaaataaatcatagccatgagcatgactgtacgctgtgtcctgtgagtcctcctagtgactcactgggggtggtcttggtgacccctcacataccttccaaagc

SEQ ID NO: 77315 - DNA, 1022 bp, Homo sapiens
cttgtgtggcccaagcatattgtctgtcctggcatttacactttaaaggcatctcttctcagtagactccaagttgtgtgagggcaggagcccgtatcctctcttgttccccttcatgcccccaactttaccttagcacctggcttcataaccatctactgatagatgaatgaagccatttaattgtatgggtagaaccacacaaaatatgttggaagcaagtctcacttctctggaattaaatgtttctttggcactacgagatcttactgttcaagctgtgagatttaaagggaaaatgcttcctgctaattattaacagttgccctgtaagagcagagccattatggggtcccgaaccctggcatgctgcccctcccagcagtgagcaacggcagcaagccgggaggaactttaaggcaactgtggccctggcacccacggacctcagattacccaaagagggttgcagtatcagggccagtggagtagggagtgggtaaaaggatttgaaatgagattataggacctaaaagattcttgcttttgttcaggaaataatttaccggttttctttaaggcagtgagacaatccagttgagggtctggagtggtagatcattgccgtgggcctcttcagatacttaaaaataagttgatctgtagttgtgtttgttgggcttcttgtttgtttttttatttaaaaaaaaaaaaggaaagaagaaagacaggaatggaaagaaaaagaaactcagttgtcaagtactctaaacaaacaaaattgaatgcaagatctattaagagaatacaaagacaacctcttttgaaagaacgtctttggccagtgtgtcttcaagccaaagtctagaaagtgaatgggaagtgtgatcagaatacaacttcttaatttttattttattttatttttttgagacagaatctcactctgtcacccatgctggagtgcagtggctcaatctcggctcactgcaaactctgccgcccaggttcaagcaattgtc

SEQ ID NO: 77316 - DNA, 1034 bp, Homo sapiens
attttctctttaagtgaaaatgtccccccacctccctgaatgtattaataatttctattccgtaatggtgctaatttaacccatcaaaaacaatagttacagaaaactttgcagatttctttgatgcccattggagaaatcactttagctaatgggcgtgttgcttggctattactgatattcggcaaagctgggaattggactatatgtttaattattttggtggatacttttcattcttgaatggctcacagacatcacatggtggtggcttagatgttgtctatatgatgtctgttgcaggttgcaacttaagctgtatctgaggagttgcccagggcaccacaaggaaactgaagcacaaaggcaccacgctagaggtccctgcctctaatgagtctctaaaacacatccaaggttacagtgctagtaaatgacagagccaaaacttggacccagcagcatggttccagtatctacacttcaccaccacccccaattgcctttgctctctgtcaggaactggccccctctgctacccactgtgcctgctcctttagatcgatgttgtcactgccatgggtcctctccgttttttgtttgtttgtttgtttgttttgcgatggagtctcattctgttgcccaggctggagtgcagtggcgtgatcttggctcactgcaacctctgcctcctgggttcaagcaattctcctgcctcagcctcctgagtagctgggattacaggcgtgtgccaccacgcccagctaatttttgtatttttagtagagacggggtttcaccatgttggtcaggctggtctcaaactcctgacctcgtgatccacccaccttggcctcccaaagtgctgggattacaggcgtgaaccactgtgcccagccgggtcctcttcttctttgggacctctccttctttgggtctttgctcaggtgtcaccttctcaaagacacctaccctaaccaccccttcaaaatactcgtgccccactgtcattctttctttctttctttctttct

SEQ ID NO: 77317 - DNA, 1224 bp, Homo sapiens
atccagggctgctggtgggaatgtctcttcccccattcatccagggctgctgttgggaatgtctctttgcccattcatccagggctgctggtgggaatgtctcttcgcccattcatctagggctgctggaactcctgtgtgccatgctttgtgcgggttacttgggatccttgatgactgagccaggtttcctgtcatcagagcgtacacctccagttagaaagatggacttgtaaacaaatctaatgtaacatgagacttgctttcggtcatctgtacaaaagtgctgtagtttaacgatcctggctgttttgaagctcttcccaagtattgaagtactgaaacacagtggtgacattttggaaggcattagcctgtggtctgggagaatgctatttgggagtctgaaaacctgggtttttagtgttgacactggccctgattagctgtgtgctaattcctgtaaacctgagtcacttcatcttaatggacttccctccctaggtttataaaatgaggtggttgggctagatcatctctaacgttccttctgattctggtagcctctgcttattataatgtttaaagactggaaacttcgagattagccagcctttgtgaggaggatttattgtaagtttttaaagtggcttccctgctcatttgtgcctttggggagacttgggcaactctggtatggtcagaagcctagcaacactttgaggccccatctgaggggtaaactagtagtctgaaagactaaacagatgtcttgccctgaagttccagaagaaagataccatctgtaaatagcctcatcaactttcatagggcttttggcgggtagaggtgccttttaccattatccttctgtccacttgtggatttgtataaatccattaggttaaaattatccattccttttgctcttgaagctgtaggtcagtttcctgcccagtttaaaccttgtcgcatacttgtcacttttaaattctgtaagcaccatcctcagcattccagggctggtaaccccaaagatggcagcagccaagctcctagcaaggggcacccagtcagggataagatctgtagtcgttaagcacatcatataataatggtagataaatatttggagcattcttctctccttagtgtacttcttcatatttcagttgctttgtatataaatctcaccttttctaaggaaacattatatgatctctc

SEQ ID NO: 77318 - DNA, 1474 bp, Homo sapiens
attccttcagcctaccccttggtgggcccaggtcctgaggattctgaggcaaacaggacaggctccctggccttaggaatccatggaaccgactgtggccaagtgtggccttgattctggaatccctggcaggtgatgactgctggcatttccacaggtgatgcattttacagcagcgagtgatgcttagccaatgacctttcatgtgctaatagctctgatttttccaattgcagcatttggataaacccacaatttgcttttggaatgccaaggaaaaacatcgtttatggtttttcttttggtctcacccctttcatcagttggtctttagccttaacccataaacaaatagccttttctctctttactcttccctctttctttgcaagacctccaggctccctgcaaatggcaattcaagcgacatgctcctacccacaagttacagtgattcacgctggctccattctgtactcttgcttcacatgtttggatatgagagtcagaagactcggggtgagccagaaatgaggtcaggggcagctgggtagcagaagcgggatgtctgtttctttcttgtagctgacttaagatttttgatactcccagtgcagggcaatttctgcccgtacaagctgtggcagataggagtctaccgctggctctatttgagggcattggagatttcttactacctggcaggcacccctgtgcttctagcccctccactgttattgacaaacaggtttgtgcttccagccaccctgtcagaatctctgcagccctcaagtcagcagcagcattaaaggaaacctggaggatgtctctctaactccaccagtgaaaatagttaactgggcttactgggagctaagaaaatagtttatttttatgttacattgaactttaccacaaatggcgggggagcagggatggctggcacacatcatgataatgatcttgaaaccgttagcatagtctgtgagttttaggtccacccagggtttttccgccttggtactattgacatttggggccagataattcttttttttttttttttttttttttttttttttgagactgagtctcgctctgtcgcccaggctggagtgcagtggcacgatctcggctcactgcaagctccgcctcccgggttcacagcattctcctgcctcatcctccctagtagctgggacaggtgcccgccaccacacccggctaatttgttttgtatttttagtagagacagggtttcaccatgttaggcaggatggtctcgaactcctgaccttgtgatccgcccgcctcggcctcccaaagtgctgggattacaggcttgagccaccgcgtccggcaggggccagagaattgtttattgtgagaggctgtcctgtgccttgtaggatgtctggaaacatccttggcctctacccaccaggtaccagtagcacccccacccaccaccaag

SEQ ID NO: 77319 - DNA, 1042 bp, Homo sapiens
tttaatggattgttcttgagaaaggaaggattggacatacggtgactccaatggaattttattcttattaaagccctttgaagttccctctttctaacaccaccctttcttaccctcaccccttagatgtggcatgttccatcatcagagttgttgaagttaaagttataggaaaaccaacctgaatttctctaatacaactctttgatgtagagtaaaacaaaaatctatttccatccgatattctaggcttctaagaaatgaactatgaaagtaagctgtttagcactataggactgtaaagaattttaaatttattttattccatctgctttggactccaaaccattctggattttgattgagaggcagaaaaccaagcatttattgggcacctactgtgtgtcagacttggtatacagacagcatgtgagaggctatcacgtgcctataaagagcaggtcacacagcttgcagatggctgagctgggacctgagccggcctcatctgactgttctgaccccatagcctgagttcttctcaaggtaatttgccaccttgtggtcactgtcttctgcagaaacattcttcgatgagctttggaaaggaagaatgacatatcacttgttaaaaaggaatttagggtttgtagcatagtgagagtaagagagatgggaggtgagagttcctgccattggaaactggcaatggtgaggaaacaatgacaattagagggagagccatggaaattgatgggggaggcgtggggaggaagcagagaggattctgtgtggatggatgaatggatggatggatggatggatggatggatggaggcaccgttaggagaatggggaaggggtgactaaggattatgaatgtgtgtgtgtgtgtgtgtgtgtgtgtgtgtgtgtaaggatcacttctgttttagacaaaatcgaaaagcgaatgtagggtggggagaatcacacaatattttagggattatttatacgtttgtttaataagaaaaaaagagagtcaaacctcaccatatta

SEQ ID NO: 77320 - DNA, 1472 bp, Homo sapiens
aggagaaattgatcctcatgttagaaataggaaaactgtcaaaagtgcatgaaatcaaccgtgtacaacgtgaaacaacaggcggcactttgtcttgtagaagcttaaaaatagcacatttttcatcaataatagaaaataaaaacctgttagcacatctaagatggtctcatagaatatttttgatctcagcattttgtcttctccaagttctggtcacactaaatacttgcaaattttctagattaacaaaggagggagattaagaagtagaggtgcagtataattagatgggaagtggaacccatcattcataaaagatttgaagaacatagaatgggggattgataaggaaagcgatcaggttggcaggggcatccatgtgttactgttgaagaacagggaatgtgtaacccgggaagagcaccttcagaaggttagcatgccagccatcctcaccatcagagaggacagatttggacttgatggatcgaagttatagaaagaaggatttggggtcaagacagaacagcatctgacagtgtgccaggcacataacagaagctgggtaaatgctagagttgttgggtgggtggacagatgaaggggatgaaggtagaatgagctacccccagggatgccagtcgaggctagacaaccagctgccagggtcgtcccaagatttaactcttactggagaactgcagggttatcgcttccagctcttgagatgttgtttctgagtttcttgggctgccatgacagtcgaggcatatccctctgcaacatggtgtttgtagtttataaggtggaaatgaaacttgagggaatagatgcatagctttgttagccagcaatgagaggtcaggctcttctcttgaaattaagtgcagatttcaagaccgtgatgggactaattcagttactcttcgttctgtgtcatccagctttttgattcatgccctacaattacctcccttgttttagtgacacttctttgcatttccttccgtgtgaataaaatgatcacggcagtgttttgccaagcagaagatcatttccaaaagctgtccatcaaatcatcccaacctcccccctattgtttatccactgaattgatgagaataacacccaccctttgcataaatctccatggaagagccaaactggtgtccttgttttgtggaagcacatgttcttggccagagtctctgatcacattcataaccttttgtttttcttacataaggttcgtgttgcattatttgtcaaagcatctctgagactctgccatggatgtgagaggtacggaaagagcgtgggaagcatcagagattccacattaattcctaacttttgctgatttttaaatcatctggagaaaacctccataaaccattgagacacattaaaaaaaatccttatcttctcaaattgagttgcttaatcaccatagtccaagttgagacatg

SEQ ID NO: 77321 - DNA, 1024 bp, Homo sapiens
aaccaaccaaaataaagtttcttttactctcatcttttttttttttttggaataaattccagacatttaagcttctccttttagctgtttctgtttgcttcctcagaggaatttaacgagccgcaaaaaagaaaaaaaaaaaaaaccacacacattaatggcctctccaaagattttggcctttctgatattgaggttcttaatgaaaatggcagattttagtgctgactcagcaagttctattatcctgcctgctgccctattgatgtccttttttttttttaatttaaatgtcttcatagagtaatactgctaagggtatagaaattgtacagagtggtcactgtatattcaaattaacaaagttatcagtcattgttcaccaggtaaataatctttggctgtcatagtgaggctgggaatagtagataggggaattgcattgggaggaggtggggaaggtactgaggtgtttagggaactcatccttttagacaattagaagattagaaaatccttaaaatgttaatcttgttaacataacggtgttaattcctccactcagaatgctgaatttgcacacagcaaggaatagcttattcattgcttggataggatccaataattttttaatttataagacatctttcattctagttattcagagtgttgtgcgtttaatagttggcagaagcactgcaaagccacaatgaaatcagttttaacttacattgaaggactttaattgttagattgtggtgtcattgcaagtgttaattcagtcaagcataaagaaagattgcaaggatttcgattagttgcttcattattacaaatatatttacttgaaagcaacatatttgatggaaacccgaaatagttttttaaatgcccctcatattcaatacacttatttggataagtttaatttaaaagcgtgaggcattatgcattttgaaagattatgtttaaacagcactttttgctgggagtaatttttgaaagaatattaaatttaaaaaaa

SEQ ID NO: 77322 - DNA, 1053 bp, Homo sapiens
gaaggaggggtggtgtgtttgggttgcttgcccgtacctcttcggaaaagtccactgagctgttctaatctttatgttgcctgtgcccctccttcctagatacgtcatttctcattaaagaatatgcgtattttaatgtttccagtagacattgccaaattgccttctgattttacactcggttctagtccacattcccaccaactttttaggaaatttctatttttctaacctttctcaatgtctgacagttaaatgaaaagacagttcctcaatgggtgaccttgactttgtgattttggtacttatagtgggggtatttaaacttcgtaacactacattaacaccctataaacagcagctctccccataataatgtttatgacaacagattgtttttagagagtgacatatatatgggtcttatgtaataccttctctgctataggcaccaatccaaagtcagtttccagaaaaacattttaatcctctctcaccatggttggagaacaggttttgcatttaatcaaacagtatggtttatggagagtttcctggatgattggttttcagagccagcgttgttttgtgtttccttggtaattccaaagaaatcccagcatcctacgtacctttggcctccatgatggattgaccatgattgggtgttagatggtcagaaactgagtgagatggtttttttttttttttctttaatgagctttccctttttttgctttaaaattttcaatgtaaaaataatgacatcatagtctatatttcatgtaaagtattgtggcttaacatgtacaaagttagaaaaatccacaagactcatttgctgatctaggtctaaagatttattttttggatgactataaaatttgcagagttagaacatttcaagaaagtttctcggctcgatgcggtggctcacgcctgtaatcccagcactttgggaggccaaggtgggtggatcacttgaggtcaggagttcaagaccagcctggccaacgtggtgaaaccccatctctaccaaaaaatacaaaaatt

SEQ ID NO: 77323 - DNA, 1074 bp, Homo sapiens
ggaaacacagtaattatttaataattcgaaggattatagaggagctctgggggttggaacaggaatgcatattcaggcgagaggcattctgagctggccttagcttaatgacttcatttgatttttaatatagacataaaaatgcagatgaaccagagcttttgtaatgaaaatcatttccgaaggaatatttcagaccccactccgtcacctccagcctttatccccagttgactgaggggggaaaaaaaaccagtttctgcttctgcccatgcggtgcttagatttcacctccacagaggtcactggcggtggagggagatgacagatgagattctagtctgcctcttccatgccttaagtccatgagaacaagtcactttctctttcctggggactgtcatcccttcatctgaaagctgagagtttgcttcaggatcctctagtgtgtgaaattgcactgaagccactgaacactgggtaattgtacaatatttctgtgtcttaacagtgatgtggcatttggttcaattctaagccatcaggccacttgttgacatgacctagagaagatggaagtgaaacaccgagtcattaaacagggaccccaaaatgccgaattgacgtgatctggctgggtccactgtgatgcggggaatcacccgtcagccccttgctggatcgctgtgaggggtacctgggaagtgcttggctttcatggggctggtacttagcatcctgaagaagatggtgattatactagatgggcggttattgctaggacttgcaggtgtgcttggcaaatgtcactctgaactgagctgcaggtggctggaaatgctgcgggaaaagcgagacatttgagagcactgcccagaccttgctcacatccaaataccatgctaaatattgagatgtgtagacccgtgcctctgttttccttttttgcttttttttgagacggagtcttgctctctctccaggctggagtgcagcggtgcaatcttggctcactgcaacctccgcctcctgggttcaagggattcttctgcctcagccgcctgagagtagctg

SEQ ID NO: 77324 - DNA, 1080 bp, Homo sapiens
gttgtccttcatttctttgtcatattatttttgtagcgttaagattaaatggtcccaccctgaaagccaccatgatgagaacaaaagccattgggtttccagaattgagacaatatcattgcagaaatgtttgggtcacatgtcagccatggccctcagtgtagctattgctggtttggagccttgggtgcaagggatcagaaaggcaggtcccactggcccagggctccaccgggagcctttgatggaatcaggccagacccctactgttgacaggatttggtggtttgttttatgttttccaaatttggtagttacctgtctcctgtctttccccccaaacctctccactccttagcttttggctttcttctgcacagctcttttccaaaggaagggatgaagcttccagggcagattattgagtggcccgcctgatttacttgcaaagtctcactgctccccctgaactattctgggtttgagaatgtgtgcgtgaaaggaaaaaacacgtaggaatgttgaattttccaaagttgaaatctttcaggtctttaaacatccggttggttaaactgagaacattgatgtttaagcatagagtgtccagccagactctgacctgtgtctggggtcaggcctgcacgtgggggtgggtgactagagtggtcagaggttccagcccctggctgtggttttgagcaattctcctattctcattgcaccagaaagagttaattccagttgcacggcttgctgatgttgttgataataaagtattttaatgggctctgtgaataatgtttgtaaggaaactactcgggtgaactgatgatgaaacacagatttttttaaacttttaaaaagattttaggagtaacttgtttttacagctccttcagtgggattttcttggattgtccccttcccccatgttagttaaacagcttcttgtttgctttctaaatgttggaggacaacatcaatcttactgttggctgaaagcaggaggtgggcacgggtttatgtaatttaacttcttttctctgcaaatcagtaaatatttacaaatgaccttat

SEQ ID NO: 77325 - DNA, 1032 bp, Homo sapiens
gggcactcatagtgaaataaacctaggccgtttccaggagaagccttcaagcctgccagatcctgggagaccgtggcatatgctggacagaatgacagcttgatgaggagtaccaactctaggccacctctctataaagttacaagtatcttttggtgatgaggaagtggaccatatccgctccagttcccaccatgagctcaaggatccgtgagagaacagtggcctcagaggcccagctgccccagccagggagacccttctcttatccacctctgcccactccagctttattctctaagtcaggctgttgccctgtcctgctcccttgcagtatcggggtcagggcctctcctccttaaggaaggaggtggcaggtggtaagccctttggggcaggacctctctaggaagccctggactgccataccggccggagcatctctcagtgtgcacgaagacatgactcaaagcaagtagctttctcaaagtcccatgtccttcttggcactactccagtggctggctctttgctttgttctatttcgatccttccatttccacctctatcttagtgcatctgagacaaaacgcttcttttggaccaaggaaattaacatcagactatggaaaacaaatagtcatgtgcaatttttttagatgaaatctgcatgatttcacaatttgacaagtacctattccatcaggcaggcactgaatggtttggagctcagtgtcaaggaaagctggctatttaatattttgttgccatcataataacaagagctgattttttttttttttaattttattttgagatggagtctcgctctgttgcccaggctggagtgcagtggcgtgatctcggctcactgcaacctccacctcctgggttcaagcgattctcctgcctcagcctcccaagtagctgggattataggcacctgtcaccatgcccagctaattttttgtatttttagcagagacaggtttcaccatgttgactaggctggtctcaaactcctcaggtgat

SEQ ID NO: 77326 - DNA, 1064 bp, Homo sapiens
ggctggagtacagtggctcgatcatagctcactgcagccttgacctcctaggctcaagcagtcctcccatctcagcctcccaaaagtcctgtgaccaggcatgagccactgcacctggccttccttccttacatattttgaagcagaggctgtaagttcatggtgaataacttggctctgttctgtttgttcttctgctagtaccacctaacttctactgtgacgtcccttgacagagaggagaattaagtggattaactgcctttcccatgctgagtatggtgttaggtatattgtatacgtcatcatcccatttaagcccaaaatgacttttggagaagatggtatttttgccaatatacagatgaagagattgtgaagctaagaggacaagtggtttgtccatccagtaacacagcaagttagcagtgtagacaagaaccataccacttgatccccttgttgggagctacatgtggggattctttccagaatgttctctgggaaagtcctggcattgcctgtggcccctcatgggcacatagtcatgggttagtttgtagtatttgtctctcatgatcttgaaagagacacatgaccctgggaacttggaccccatgcaggggtttggtgggaaggccagaggaggtatggtgacaagaacccagcctctaagaggctggggatgtgggggtgttactgtggggatagcccaggtgggagctggaggggcttcctgagcagggatgtgaggccccaggaggagctggtgcacatgtgtgtgcacgcctgcagttttaaccccttcctcccccagggctcatctcttttgtcctctgttgtctggcagcccattggccagcttgtgtaatcctttgtaatcacttcttgtttgtgttcctctagaggttccccaccttaaggaaacggaccctgcctttgtgtcacagggccctgcccaactcctgtgctgttagctctttacaagcggtgttcagggacctgcttcaaaatcaggcccaacgatccacctttcgttaggcccacggaagtttgaatgggtt

SEQ ID NO: 77327 - DNA, 1023 bp, Homo sapiens
ctctgggagacgaggggagggtttctggggcaggaggccggcttgctgagccctggctctctggacagccactgggacagatagctcaggcatcagtgccttttccacgtggttgctgccactgttcccaggggccaggtcagttggtctttctgggtagattctgtttgtttaattttttcctccatccccctacccgtgaatcacagtgtgaatttatcccctgcgtccaacccccgttctgtctccctgaccctgtgttcccgctggagcactggtctggcagcctcttacctgcagttttccctggcacccctgtcctctccctggcaacctcgggcatatcctctggttcccgggtgctttgtccatatcttacccagcgctgacaagaacgctggaggaatcgataacactgacaatgttatttggtccctgcagcttctcacatgtgggtcggagatggtttcggatttatctttggagccgggtgccgccacatcagggtgcagtcggtgttagacaccctttgttgaaagggatctgcttcatggttggagtgagtgcttgttctagaattgagaggcactgtagaggcagtgtctccttaaaagtggatgtgttggttggccggatgctgtggctaaaagccaggctcacaacccaggaactcccaggaaagttccctgttgaaaattagggaagatgggtgactggtgatctcgtggccaatggccactccgcaagaacaaacaccaaacaacccagtgtctgtgtttcactgagagagaagggctcatgattatttattaaaataaaaaaatcataactgaagctctctggcttagtacacacaccctgtcactgttacctggccaggtactttgaacaacttccagttatggaaatatggtgatcaaattatgtgccaatttgataagatcacattggaacatttaaaaatagatgagtaactacggacaaccagaagataaagtggcagtaggtgggccagttgtaatc

SEQ ID NO: 77328 - DNA, 1055 bp, Homo sapiens
tttttgagacagggtcccgctctgttgcccaggtcagagtgcagtggtgcagtcatggctcactgtagcctcgaattcttgggcttgagtgatcatcccacttcagtctcctgagtagctgggaccacaggcctgcgtcacgacacccagctagtttttaaatttttggtagagatgggattttcctatgttgctcaggctggtctcgaactcctgggctcaagcgatccttccgccttggcctaagcgctggaattacaggtgtgagccactgcaccagcctacatttaacttgttgaaagccattttaaattttatttttaacattgtgatattgacctggatttgaatagttccctcagcgattaaagagtatcagtgcatattgttattagtgtggtgttttttgttttatatcttgtaggtttgctggagattttttttttttttaccccatgagacagcgcatagtttttaaatttgaaactttggttcctgttttaatttcctgtgggttaccctgacctagtaaataacaacagtggtcttcaggatgaggttgactgttaagtcttaaactcttggaaagtttggttgtatggtgctcttgttacaataaatgaattcctgttataataaatgtagttaatatcaactctatatagtggctcaggtaagattttgtttcagtcagctgttgtcaaattggaagcctcactgacactgttgtcctatttgcaatttttatgtgcgtttagactgactctgaaacataatagtaaccattgatgatgcacttacaaggaattctacagagaatatttttagtaataccatacttttctaatactgtaatcgagttttcatgtttcaaagcttactgtgctttttaggaagatgaattctgttttttcaagttttgcaggatagtaaattattatggtagtttcggtggcatatttttttttcctgcctgattgctatcctttatgacttggggaaattgcaggggaattattatgtacatactgtggcatgtagattccaagaatgaa

SEQ ID NO: 77329 - DNA, 1026 bp, Homo sapiens
caattgacaggcagatgtgtgggctgcagacacaccaggtcaagcttaggagtagttgagaggatcaagcaaagggcctggggcattgccgcccctccctccgtccctccctttccccttcccttcccctcccctcccctccttctctgttgcccaggctggagtatagtggcatgatcacagctcagtgcagccttgaactcctggactccagagatcctcccatctcagcctcctgagtagctgggaccacaggtgcgcaccatcacacctggctaatttttttaattttttcatagagatggggtcttctatgttgcacagtctgttctcaaactgctgggctcaggtgatgttcctacctctgcctccctaagtgttgggattacaggtgggagccagcacacttggcctgtaccttcacttaagcaaaccttttttttttttttttttttttgctttttgaggctttttttgggctgcaggtgcagggcctagccagacttggcagcacactttacatggccaggatgtcgggcaatgttagaattagttggagagggctcttatggttatgtcaccagatgttggaaaggctttagttataaaattaaaaacaaacctatcatctgtgtgattttgtaggcctcggggttcgaggtatcctgtgagtcacccaaggaatcctgggagtacatagtccacagtagacaattattattgctatttgtcaataatatctgaagatgactgttacctttgtggtgatttatcttagaaggaggcttttctcctgtgtttgctgagtttgatttgagtcttttttttttttttttttttttttgagacggagggagtctcactctgttgcccaggctggagtgcaatggcatgatcttggctcactgcaatcgctgcttcctgggttcaggtgattctcgtgcctcagcctcctgagtagctgggattatgggcacacgccaccacacctggctactttttgtatttttagtggagatggggttt

SEQ ID NO: 77330 - DNA, 1053 bp, Homo sapiens
acaagtgtgactggaagactcttagaaaattttttacttaactgtctgtcttgataaactctatgttcattatctttggttctttgacttactttgaaactcccccccctccagccttagagatcagcttatattgggcaggcattttttcccagaaataataatattaatattaataaatagtaataaggtaattacactactcctgtgtggtatcctaaactttctcataacttgttcatccatccagctaatgttgattccatgcttgtaaacaggcttatgctaggcatcaggaaagccggatgatgaaggtatagtttctgtccaccaggaatttctagtctagtgggagagacagacacatgaagaaatagtcattgtacaccttcgtgtatgtcaggcatatgagatgctgtgctgggcaggagagggtgtgagtgctgcttcattttacacaaattggtgagagagaaagcttggatgctgtactgagcattgaactaggtgttaggagatctgggttttattgctaatttggttgctaaccagctgtgtacctctctgaaccttagattcctccattcaattcagtaaaccttctcttgtgggcccactgtgttcattcagtatgtttaattaatcattcatctgtaagcagaattgtcccggacacgtgttcctgaactacttgccacaggggactcttttattctcctccttattctgtgcttttgttagacacatgagcatcagtcacaggctgtgaccagcatcagataaccagtgtccatagggtgtgttgagaatatttctgcccaaagcaaaggagctagatgtggcagcttacataacaatgttgcacatgaacgcgtgatttccaaaaggctttggggaagtgtcagaataaaatcctgtcctcataattctaactctgcagaagagcctttccatagcagaaaacccggatgggttgtgtgtgattttcaaagccctctcctatgctgttattacaattctaggagatcccttagttggggagtcactagctgt

SEQ ID NO: 77331 - DNA, 1024 bp, Homo sapiens
ttctgccagttgccaggggattgggcaaaggccagaattatgtggttggggaagccaaaggagaaggggactcctaaggtttagcagtgccactggaagaatcctgaagacagcattttattagctggttccttcaggatagtcagactggggctggcgacagggagagaggaggtcccttgagtcatcagacgtggcttgtccagaggtagggacgcataagggggaagactgagtgtgaaagtgggaagtgacatttccataggacctgctgggtgctgtttggagtcatgtgaggcatttgtatccatggtcttacatctttttaacaactataagcaggtattatatgctctttgcagatggggaaactgaagctcagagaggttcagtggcttgctaaattgacacagccagatatttttagccaaggtctgacacttccttgctcctccttcactctaattggctaaaacaaagggtcacagtgggatagagagagaaataagtttgggaaggtaggctgagctagactggggggttttgagtgccagggagcccagactttccccctaaggtggtagggggtcctcagacgtttctgagcctagccacagcacagacaaaggagtcaagtgcttccttctgatgccctagaggttcttgcagagcctcggtctccacagcagggattctttttttttttttttttttaacttttattttaggtttgggggtacatgtgcaggtttgttatatagataaactcatgtcacaggggtttgttgtacagattatttcaccacctaggtataagcctagtaaccaatagttttttcctgatcttctccctcctcccaccctccaccctccaataggccccagtgtgtgttgctccctactatgtgtccatgtgttctcatcatttagctcccacttataagtgagaacatgtggtatttggttttctgttcctgtgttagtttactgaggataatggcctccagctgcatccatgttcccg

SEQ ID NO: 77332 - DNA, 1030 bp, Homo sapiens
tagggcgctgtaatgtagagccgcacacacggcccctgccagtgtaaaattggtctagctttaaaagagatcgcagcccctcccccttccagaaggaagggcttacagctgtaataaatcagacaaaagtagtcgctgtcagttgaaatagattacaagagggatctcctggcagaatttatttagtttagctcaaaggagaatgttacagtcaagggtacatttggttgcaaggacaagagagtcactcgagttggcttaagtaaaagggtacttgtcccaaaaacataacagccagtcccatggagcgggagcagtgtcagagagcaacaaagcatatctcaggtccacggccattggaagtgcctcctctgttcctctgcggccacgtggacactcatctctgcctttctctgaggatctgttctagcctcctctttgcagcccagctccctctgtgtgctcttgattcctgccttctcacactgttggcttgccctgctgggatgttggtgccagtccctgtgatgtgatggttccagtgcccagtggcatcagcaccatcatctctgcgccttgtctttgtcatcatttttagatactaggacttgtccttttcctgggccaagcgttcagccctggtcagaacaggggcctgtgcaccggatcaagatagctgctcggaaaatcccttcatctggggttgggctggggcttgagtctgaaacatatctgcaacaacaaaaaaattcaggaaagcctttgatcatttgaagaccattttattgattgattggctgatttgagatgaagttttactcttgttgcccaggctggagtgcaatggcacgatcttggctcaccacaacctccgcctcctgggttcaagcgattctcctgcttagcctcccgagtagctgggattacaggcatgtgccaccatgcgtggctaattttgtatttttagtagagacagggtttctccatgttggtcaggctggtcttgaactcccgacctcaggtgatctgg

SEQ ID NO: 77333 - DNA, 1003 bp, Homo sapiens
ggggaggaggaggaggcaagtggtaaatagtagttccttccatggacagggtaggtaatgtaccagattgtgttacatgcaatgaagatataaaacaggataatgtactaggggaggagggtgggatggtgggaggcttctcagaggatctgactaggccgtgccttgaatggcaagagggatgcagctatgcaaagatctgggcagagagaacagcaagtgcaaaggccctgaggtggcaatggctcaaaatgtccaaggaacagaaagaggggtcgcagttagtgtattagaaaggggagaatgttatgtctaaaggacaggaaggggatctacctctctggggcttgttccagtggtgcaagagagagatggtgggagtgatgctagcttgagccagggttgggggttgcagatgaacatgtgtgggcaaatttgggttgggaaattggatgggcgttagtgccaacattctcttttgaccatgttaaatttgagatggtttgcggacatctaagtggagctgtcaggaagtttcctatatgagtttcaagctctgtggagacattcgggtggaggtataaatctgaaacacagtgcataggtgttggaaaataaagagatttctggattacctctcaatcaaaaagagtgaaatcaaacctctatttcagttcttacaggaaattgtatttccattagtgtttgactaggaaattcattttggggtatattcagcatgggaaataagaacaaaagaggtttacatttagagggagaccctctcagaattatttcagcaataacttacctctagttgctggctgtagttttgcaggcagaagagaacaaacctttacttttgtaccaagagtgcaacttctaaatgtgcttggggcagccgcatctctgatatcaggagagaaatgtactccagtaaacatcttacttagcaaagccccctaacccatggcttctgcgagttctctgccatctggtccct

SEQ ID NO: 77334 - DNA, 1581 bp, Homo sapiens
tgtactcttagtagtttacattccagggaagcaggaaacataatgcaaaataaaaaagaataagttaccgtaagtactggaagtgtgccgatcagtgtgagattggtatcattcaaagttaggctggcttccctttcccaaagaggggcactgggtaagctaaaagatagtgatgggcgagttttgaatattccttatgttcacttgaataagctgttacaaagcattcttcgggtgtgggaatgagcattagacctccaaggatggattgatcagaaggaggcttgagtgtttattgtagaaaaccaattaacaatgatttaaacaagctaggggcgtatttctccattacatgaaagaagtcttgaggagctagacagagacgcacattccctcttctctgctgttcttagggcattgcgggtttccattctcagtcttctcatggtccaagatggcatcagctagcatgttcccattttaggaagcaagaaggggagtgcagggaaggacaggagggagtcttgctgacttctggttttaaggggctttcccagaaaccccaccctctgctttgatcttattggctagagcttggtcacatgacttctagctgcaaggaagcctgggaaatggactcttttgcctgatccattggaaccccaagttaaatgttgattctgttgccaagcaaacttggaactttctgtcacaaaggtctagatgtttaggaggcaaatgttactggaccccagggatgtgttggaacagcgtcagaggaaaggacggagagagatggtggctggaaggttatgtaaataagaatagggactgttggaggagctaggatgctaaatggaaaactttacattgcattggtaacttaagtaaagcagagatgctgacccattttttaaacattccaaataaccaaggttttgctttaagagattctggttaaattgcatttagtgtcatcaaaagcggtagcttgattgaggtgaagatgtagtctgtgccaaggatgataagaagaaaagcaaggaaatagatggttgaagatagagagtagtgtgaagtcgttcttttagtaataacttgatggattgctatgtaagattacagacagttccatgaacaggatgaagtctttgatttgtgtatgtgtgtgtgtgtgcttgtttgagtacctttccttgtgaactcagcaggagacagtaaatacaggcagagaggctatacgcttcccaggggaaaaagctctccaattacccttccttttcttcctttggtcttcacagggtgtgtgggatttccctctgggccccgtggggtcgagttcagtgtcttctttctatttattggagttctgtgaagtgcttcatagaaggctgtgactgtcctcctcgagggacaggaccgataagtgatttaactaatgtcattagacagaaaacacccacctagcagaacatgtgcacatgctttgtttttagaaggccaagtcatgtgagcgctgactctaatcgtggctatagtagagggggaagaaaagtcccgaatctccaagaatcaaggtac

SEQ ID NO: 77335 - DNA, 1068 bp, Homo sapiens
ttacaggtgcgtgccaccacacccagctaatttttgtatttttagtggagacagggtgtttgttggtcaggctggtctcgaactcctgaccttgtgatctgcccgcctcggcctcccaaagtgctgagattacagccgtgagccaccgtgcgcagccccatcctgctgatttgttccttccagactgttcgttccttcttcttccagtcagtaggtgtcttgggtgggggcacatttccgttgtcttgctctggcaaacctttcatttgtctgctcattcattcatttattcaacaaactttttaaagtacctactaagtgctaaaagaatacagaattgaatgtaccatggccactgcctgtaaggcactcatggtccagcgagccctcccctcagagtctccctctcactagtggaacttctctagcagaagctcttactccactgctgtatgccctttgtattctctgttttctgtctcacatcgttgcttttctggcccttcatggatacactacctttctactcctcacagtgacttggccaggaagatgccactaacctggataggggtctgtctgaggctgctgggaaagcttctgggcccgagggccctatcaatgtatctgtccagtatctccccctgtttcctattgagaaaatgttgcattctctttggtagggctttgtggcacctggataggtctaccagatacttcatcgatgtactgcctgtatatccaaccagcaagaaatggttttcagaaccttccccattgggctgggatttccctttgaaatcattttggctgcaggataattctctgcagtaaataacataggaagttggcactctgacctcctatttgaaagttatgagtttaggctgggcgtggtggctcacgcctgtaatcctagcactttgggaagccgaggtggggcggatcactttgagcccaggagttcgagaccagcctaggcaacatggtgaaaccctgtctctacaaaaaatacagagattaattgggcatggtggcatgtgcctgtagtcccagctactctcctga

SEQ ID NO: 77336 - DNA, 1158 bp, Homo sapiens
aaagtcttcaaaagcaattccagactgagaacgtggagaagaaagtgctgctcaggtcccccaaagcctcacagcagtgataaagcaacaaacagggcgtttagtttggtgtaaaacgagtctgcaagttcctgcatgcttgaatcttcgtgtttgacataatgccggtgcacatagaagtaatttagcaaatgcacactctgaaatgttagaaaagaccaacgccaaggcgtgcagcgagacttgggaacattattcatcagtcagccttgggagtgacaagtgggtgttggatgccctgtgttgaggcacactgggaggagctgttctcccgccatgcgacccccccgtcccccaccgctggattctgggagtcatgttttccagggatgaagattgtcaatccggatacattcaggtatcacctgttgaaagagaatggttttaaagacttgagattgttaatgttatgaaacattcagttctggcttcccagccatcctgacctgtgttgacatgtttctgatcaaatgccagtcagttttgtggttgggagtttgttcccagcatttgcgattctgtgagaacaaagcaagaggtgtgagtttttccacttttctcctctttcttgggttcccccaggccagctgctggctgctgtgagaggtgcaggctcccaggtatgctcaggtacacccaggtccttccagggcattgacctggcccagtcacttggggtatgctactatggcattctccctgatactctgcccagtgaaagctcctttagctctatgggtaaacttgttttttcctatgagattttatttggcgggagctcccacactgaagttgccttcaacacagtgactaaatgcacctgaaggttggtgagaaataccttaaattgaacgagaacattgaaaccttgcaagttgtatgcagtgaattagctattccacttttaattttcttctgaaagtgaagaatacggttaggcttgacgtagcagtgaaaatgtggaatcctgtgtgatccctgtccctgagggcttggaacacataccctgctggacaactgtttggctgggatgttggggagggaacatactagattacatcacctgtggcacttaaaaaacaattcccagccgggcac

SEQ ID NO: 77337 - DNA, 1812 bp, Homo sapiens
tgcctggccggtgttactggtcttattttatttaaggggcatcaggtcaccttgctatatgaatggcgggctgatttttctcatcagcctatctctctgtggtggaattgtgggattgtgttgcttagtgtgggagtcacaaggtggtgttcctgtgtagcaggggttccatagaggcggcagagggaggcaacaggatcagaggggtacagtctgcctttctgttttgggcctcgccagctcatcatttctttgtgatgtctttactaggagccttcacgtaaatgggtccagtcatgcctcccagtaagaagccagaaagctcaggaattagtgtctccagtggactgagtcagtgttacgggggcagcggtttctccaaggcccttcaggaagacgatgacctcgacttttctctgcctgacatccgattagaagagggggccatggaagatgaagagctgaccaacctgaactggctgcacgagagcaagaacttgctgaagagctttggggagtcggtcctcaggagtgtcagccccgtccaggacctggacgatgacacccccccatcccctgcccactctgacatgccctacgatgccaggcagaaccccaactgcaaacccccctactccttcagctgcctcatatttatggccatcgaggactctccaaccaagcgcctgccagtgaaggatatctacaactggatcttggaacattttccgtattttgcaaatgcacctactgggtggaaaaactcagtgagacacaatttatcattgaataagtgttttaagaaagtggacaaagagaggagtcaggtaagcctctgtgtctggaacccaaggttttctttttttttttttaatttaaaatttttctctattaaaaatgaatttctattcaccacattgaagtagcagttgtaagtgggttttagtctatttaattcatttagataattttaaagaatttcctttccctaagcctattagttatgtactgtttattagcatttgtactatttgagagtttcccactgatagggtttccataaagataaaacagtggtttacagaattgattagttctcagttaacatccctcagtgtggatgggtcactttggttttagggtcttaacaaaggtcagtattccaaggacagccattaaccgtgaagtatgtgtgtgtatatacactgccaccatgggctagagaaaaatggtgtttctttttttccctgaatatgaactaggagaagggaaatttctccagtgttctggcataagtggacagtgatgaacattgagaagagacttgagtatacttacgctcgcagactaaacagacatgagttgcccaggtgactgtcatgaaatctggtgtctgtataagtgacaactttgaaattcccggctcagagtgagggtcccattagagactgacttttaaaaagtttaatattgactttaaagcagaggtccccaatgtttttggcactagggacccattttgtggagagccaagggggatggttttggtatgaaactgttctacttcagatcatcagtcattagattctcataagaagcacgcaacctagatccgttgcatacacagttcacagtagggtttgtgctcctatgagaatctaatgccaccgctgatctgacaggaggtggagctcaggtggcaatgctgacctcctgctgtgcagccccgttcctaacagaccactgattggtacatggccccaggttggggacccctgctttaaagccatagtttgtacttcatggtcagtg

SEQ ID NO: 77338 - DNA, 1024 bp, Homo sapiens
ccataaccctctcttcgtgacaatgccactttttctcctaaaaccatattgctggcagtgtttgtttaaaacaaaaggaaacatggagaatagcgtgttagttcctctgggaagctactgacaaataagcaaattaaaaagaaagagagcagcatgttgtcatagcaacagtgcaattaaattactttactgtcagccatgatataattttcctgtttggaagctcaggagacataaaactttcatttagagctaaagttgacttcagtggctgggtagttctgttttatactctactgtgggcatatgctggtcatcagaaaattttctgatgggatctgaggaaactttaagaaagacaagtggtgctataattcgttcataaagaagttaaaagcaggatcagaccagactctgttgtatccccaagccaaaagatgctagcttgttttttgtctgaaatgtgtcagggtaacctccttatttgacagaaagaaatattccctgtgagtgaacccaagacgtctggagcatcctgcctggtctgtactgcaatgcctcatgaagttttctctccttaagagttgggcatcttggccaggcgcggtggctcacgcctgtaatcccagcactttgggaggccgaggcgggtggatcacgagatcaagagattgagaccatcctggccaacatggtgaaaccccgtcttactaaaaatacaaaaattaaccagtcatggtggcacacgcctgtagtcccagctacttgggaggctgaggcaggagaatctcttgaacctgggaggcaggggttgcagtgagcggattttgcaccactgcactccagcctgggcaacagagtgagactctgtctcaaaaaaaaaaaaaaaaaaaaccggttgggcctctcaccacagctcccccttaggccttgcgtctagcaggttctaccttttggaagagggaaggtactataattcacaggcacccttggctggtaggttagtgcccaggattatgccttc

SEQ ID NO: 77339 - DNA, 1241 bp, Homo sapiens
agaatagatgtagttttatgtgttcaaatttaaacagtttggagagggaagagggttttaaaaaatatggttgtgacatgtttattataaacatgagaaaatggagcttgtgattatgctggtggtatatatattgtaccttgtcaacaagaaagcttctatgtttgtgtatttaaggtggtattttctttctttaaaaacattagaactgatgatgtctcttggaagacttaaacacagtctggtttaaaatattgttccataactacgcttcttcctgaagtttccatggctttctctgggcattgcagaccttttgaaattgagctgtttttcagcagctgcagtcagttacttctcattctctaagctagtgcttcttggctatcagtgtgcatcagaatcacctggaaggcaattaacagccatctgggctctaccaccggactttctgattcaggaggtctggggaagggccacaacactggcatttctcccacattcccaagtgatactggtgctgccagtccaggtatgatactttaagaaccgctggagtttaaggccaggtgtggtggctcatgcctgtagtcgtagctactcaggaggctgagggggagaatcgcttgaacctggaaggtggaggttgcggtgagctgagattgcgccactgcactccagcctgggtgccagggtgagactctgtctcaaaacaaaacaaaacaaaacaaaacaagaaccactggcgtttaagtctttgctaagtgttgtccagaaccagcagcgtagatattgtactttgctgatgcatcacctggaagtttggcagaaatgcagaaatgcaggctccattccaaacctgccaaatccaaacctatattttaacaaggtgccccatgtgatttgtttgcacattaaagtctgagacatcttgcttttaactccttgcaacatcatgaatgctccagtgatagcactgggattccacaagtgtcgaagcaagagagaaagagaaagtcctaaagaaatcagaactcctaggcacttattctttcagagaacattctggcaaactgaggtcagtctgaccttgtttgaacttgcttggatgagttaacttctatactgttcaaaagtaatttttaattagtttctgaattctagagacaatgatatatgtatttattataaaccactttcctataaagcatcatgaaattataaactgtttatcaaagtag

SEQ ID NO: 77340 - DNA, 1069 bp, Homo sapiens
caacaagaggttggaagatgtgggagctgctttggctctgcaatttacttgttgcatggctttggacaggccatccttccatccattcatccatgcattttattcatccattgagcatttcatggaattcactagattggatagtccatccatccatccatccatccatccatccatccatccatccatccaacatttcatggaatcctctaaattggacagtccatcaatccatccattcattcattcatcaaacattccatagactcctctaggttggacagtccatccatgcatccatcagtcattccatggaattcattggatggaacagaccatccatccattcatccatccacttattcatccaccaagcatttcatggaatccaccgggaatcctccattctgtggagtcccaccaggctagatgttggtattacaaagatgaataggacattgtccccattctcaaggaacttcctgtttaggatgtggattcagacacataaaccaacaccctcagagaaatgctgtgggtgctttgttagaagcgtgtccaggtagaatggcatcccagaggagagaggagcagcattccttctggtgctctggagacgctttgtggcaaaactgacatggggttgagttgaggagagaaacagaagatataatcaaggggtcatgccatgataaagaatttggattttatacttctttataatttcccggtgatgggggccactgatgattttaaacagagaacagcacaaccattgtttttggaagataaacctggaggatgaccttatttaatctttttttaaaaatctttttaaatttttttttttatttttgagatagagacttgctctgtcgcccaggctggagtgcagaggcccgatctcggctcactgcaacctccgtctcccaggttcaagcgattctcctgcctcagcctcccaaatagctgggatttcaggcatgcaccacaatacaataatttttgtatttttagtagagacgggggtttcatcatgttggtcaggctggtcttgaactcctgacct

SEQ ID NO: 77341 - DNA, 1064 bp, Homo sapiens
ttttctttgttctgttgcatcgtgatatctggctatcggatttcatagaaaagtagaaacagccgagggcactgtttttgtaatttcatattaaactcatttccttgaaaatctggcttgagatgagtgttcttcagacttctcttccattttggtatgtttcctttttcttttctcatgcagcctatgtctagtttttcaagcacattgaagttgaatatatttttgttttagtatcagaaggcacagctgccgtggactaaccctaacgagcctccctctgtcacccatcagtgtctcacgcagcagttcctgaccatcaaagtgtgctctgtgctaagtactctgctggatgatttggcttgaatttctcaataaatacacctacttaccctaagaggcagttaatattattcccatttgactgatatggaaactgaggctgagaaagtggaagcaatttttaagtcaagtcacacaatgtaagtggtgagcaggacccaaggttgtgtttatatgattttgaaattttgttatcgaccctacttatgagccctgctttatttctccattatagacatcccattttgtttttcttttaaactgagacaatggcaaaataaaaacaggggagtgttttatgtatcattttcactggaccggtattttctgtgtttttcagaacactagccagcaagctcctaaaaaacaaacattaaattaatttggtcaaaactgcacattatatccttttctaggagatactgttttattttatttccttttctcaaatttccatttgactacataacctttttatcttcaaatgcctttaaaagcacaaattgggaaaggtttcagttaaaagacaagtgaagaatttggtattatacaactaaatttttaaaaataaaaaaaagaaaagtggccaggcacgtggctcacgcctgtaatcccagcactttgggaggccgaggcaggtggatcatgaggtcaggagttcgagaccagcctggccaacgtggtaaaaccctatctctactaaaaatacaaaaattagccag

SEQ ID NO: 77342 - DNA, 1045 bp, Homo sapiens
ggtggccatcttggttttggtgggttttggccagcttctttaccacaaagtgttttatcagcaaggtctttgtgacctgtatcttgtgctgacctcctgtctcatcctgtgacttagaatgccttcaccgtctgggaatgcagcccgagtagatctcagccttattttactcagctcctattcaagatggagttgatgtggttcaaacacctcttacagcaccacccacatgatgtgtttgaattgaaccaggaaggaaaagtgcttgtttctgtagctctggttccattcatatatccaacaaatatttgcgagagatctgtctggtgaggtcctgagcttccaatgacacaatgtacaaattgaaatcaaaatcggtaagaatcttagaattcttccaattctaacatactgtgactcagccagagatactctgactcagccacttagtttattcattcattcattcattcagttccttcatgttgcaaacacttattagacatttcctacttactactgcaaatctctgcacaacaaaagtatttttaagacccgatctgagtcacttatatcaaggaacattccatatagatttttcttagcagcagcagtctttggatgttttatcctaacaaaatttgatttttaaaggcatataactcgttcattttcctttttttttttttttttgagacatagtctcactgtgttacccaggctggagtgcagtgttgcaatctcggctcactacagcctccgcctcccagttcaagcgagtctcctgcctcagcctcccaagtagctgggaccacaggtgcgtgcgaccacgctcggctaaattttttttttgtatttttagtagagacgacgtttcactatgttggccagggtggtcttgaactcctgacctcgcgatccgcccgccttggcttcccagagtgctgggattacaggcgtgagtcaccgtgcccagcctcattttctttgtaactggttgctttaggtctccagccaactttatatgcgagattttaaaaaaatg

SEQ ID NO: 77343 - DNA, 1034 bp, Homo sapiens
tggtcggggtttttttgtttttgtttttttaataacccagcaccgtgtttctggcttctaaaccctactgctaatttcattgacttctacataaagacttagagcttattaatattacttagcacagtagaagctaaagaggtcagtcttgtgcctccttggcccctaaggaagctcattgtttcatctctgtagaaactacctcacaggcaatgggtgtggaccgtgagcatccaagttgaagggggagcagagaagactgacctcatttgcccccatacttactccaagtcctcaccaggtgtacttgttggctgtgccttccagaggcaaacttatttggtggttgaagctgctgtttcttcaagtatacgtgatccagctctgattgaaaagcacctgtgtattccttcctcttacacttcagtcaaagagtgtcttttctccttttgtagctaaatacttcaccggcaggattgatggtttccttctaccaggggagtttgtgctgctggcagccccattgttttgcttctgctgttaatgtaatagctttgggttgtagtgcaggaagatgatgcctaagtccagcgtcaggtggctggagttctttgccactgctgaaatgcaattttaataatggactgtatcagccaaatgtgtttccttgcctctttgtaaaacaaaagaagatctcagcatattaacccatcgatggcaggaaaaaatcaaaatctccaagaatgccaattaatgaaatggcacttgcatctcaaattataaatctccttaatacacttcagaaattctctgggtagacaaggaaggggttgctccaagccatctcatcagccccactttttctaaggcacaaatgtagaaaagatgcagaaagtagtttgtggtttggtagagaaacgagctgttctacaaaagcaatgacgaacttgactaacctcaggttgcgtttatttgttctgatcatgctgaactttattaattgtgaaaagtctgtcagaggcgttcgaaccaga

SEQ ID NO: 77344 - DNA, 1036 bp, Homo sapiens
ccacagatcagttaccttcacaagctcctgaggatacccattaggcctctttttcatattaaaattaacaactttttgttacctgagggcatatgtattgttagggagcaataataatttatcagtttccatcaagttgcactttatcatcataatggtttcagaggaggctgcttttagctcttgcagtgcattttaatgtgttgcaagaaacatggaaactgactaacggtgtaatggatgtgtaatggactgggagctggggaggccacgaatgggacatgctatggctggaccatgaaagtgcttctctagaagtcatatgcattctccgtgttagaaggagccagtaggcacagtttggtttcacccgacactcttagacatgtgggcacgattgctcgtcttcttgttttggttgcatttaccctcagtctctcctctggtggcccccgtatcgacgaatgagatcccaggttcagggttgcaaagaagaggaaatgtcctgtccatgccagtatgtgcagttttttgaagaggctctcactgaaggtgacgattcattacaaatgctatcaagcatgtgtttctcaaagagaaagaaaagttagacatcaggtgtgaaggtatttatggcattcagagccctggcaggtaggcctgcttcattccagaaccctgggaaaaactgaccacttttagagtccagccagcttgttcagtatctctgggaggcatctttcagaaatgaacatagtaaatgccaaattaaccttttgtggaagtagtccccacttatccactgttctcttcatgctttgagttacctacagtcaactgcagcttgaaaatattaaatggaagattccaaaaatgaacagtgtatatttcagttgcaccttgctctaaggattgtgatgaaatctcgtgctgtcccgctctgtcttgcccggtgcatgaatcatccctttgtctagcatttctacactgtatatactacccatctgtaagtcacccagtagctgtctccgttaga

SEQ ID NO: 77345 - DNA, 1032 bp, Homo sapiens
ttatctatgagaagtactattcaaatatttgttatttaacgtgcctttatatactcacctgtaaaatgggacagtacttggtgaggattaatttaataaagcatgtaagacagtcctggcttatagaaagtcatcagtaatagttagctgtcatcgttgtgacatctgcattgtcaattctttgcagataggactgtaagcccctttaagacagagtttgtgttttggcatctcttcgatgtacaggatagaacctgatactagctgcttggtctatttgctgggtaaactgaaagtccccttcttgttactgtgtgcagtacttagactctcatttttctctcttttcccaagacattaaaattctcactgaccactctttaacctggaggttcttaaatgaatagaaataaactctctgacagcagtgttgattttggctctaaacctaaattagtttgataggtgaattgctgtggtaacgcagatgtcatcattcaaaagtggcacaaattcattttcttttgatacctcctcatgaggatgtaacctgggtatgttttgaaatggagtatcttctattagtttaattgaccatagttttgacagcatcaaggtttgtgtgatgtccttgtaataaccctttgaaggtctacatgaggccagaattgttctacacattgtgggggagtttctggtacagtgttctgttccaccatcctgtgtagagtagctatgtaaataatagtggataggctgggcacggtggctcacacccgtaatcccagcacttggggacactgaggcaggtggatcatttgaggtcaggagttcaagaccagcctggccaacatggtgaaaccccgtctctactgaaaatacaaaaattagctgggcatggtggtgcatgcctgtaatcccagctacttgggatgcgagacatgagaattgcttgaacctgggaggcggaggttgctgtgagtcaagatcgcgccactgtactccagcctgggcgacagagcaagactctgt

SEQ ID NO: 77346 - DNA, 1065 bp, Homo sapiens
tttataccaaaacattaggtcatttgaagaaaaaaaaaatctgattaaatacctctgtaggcttttctgattagccgttcttaaaagagtcagtgacagtaatgaaagggtgtcatttgacagccacaatttacttttgaaaaaaaggtaaaatagtacagtgtgtatgggtgaggtttttacaggaatttcttgttggtctttactcgtgggatttgttttactaattgtcagtttctagcagttccgaggagcccaccggccaggaattatgtgagatgaaaagtaagtgatattctggggcgagggtcacagggacagcttaactgccaggatttcttttctttcttttaccccttcgctacacagcaggttttatatttccggggcgaaatgaccttgacactagcaggttagagaaataaaatgtagttgcagagattctccttgcatcccttgtattaattttctgcgtttggcagctcccagcatctctttgtgttaagttgctgtggcatgagggctgcaggccagatctgacgtgaagatggaatgattatgtggcatatggcaaatgcaaccaccaccactaattactctttctttccactttctccttgacttctacttgtgggcatagggttctggagtttgaaagtggtttcctttttttcatctcccctttggtagatatgagaccaaatgcctattttggctatgatgtgatagaatcctagagctttaaagctaaaaatggccttaggcctcgtccagcccaaacacttcatgtcaaagatgaggacggcgggcccagagagcttcacctgggcagggattgcagaagggagcctggaactcgatcatgtctcccaggtcctgggtgagtctgtgttttttcttttctgtcctacctcttaaaagtggacatgaagccagtggatttgtttctctgggttgccataacaaaagtgccacaaactgggtgggaaagcaacagaaacttactccctcacaagttctggaagcaagaagtcaaaatcaaggtgttggcggggctgtgcagcc

SEQ ID NO: 77347 - DNA, 1046 bp, Homo sapiens
tcggggctggatcacttatcgcttctcatttcctttggcagcactgtcaaactagaagtgcatctcggggacactcagaagcactaggtgacgcacctccttctcccttttcctgtatggcagaaggtagggagaggtgaactccccaaaccacagccctgctctagggtctaagcagaaacaggaccacctttgtggttaggctaacagaagttgtgtccctgcctccctctctgccaggagctgtcatggaagtgccacatggaaccctgttcgatgaccccgagcaattagaactcatttgcatggcatggaaggccaagctggggccccgaggctttttcagctcccccttcttccctgacttctctgtagacaggtgcatacttctggctatggcaagggccagctggcaggaggactctaacttgtcatcacagaaataaaatttgtcacctctgtgttcccaacctctgttctttcatgtttaaccagcactctgcatctttgtaaacatgtcagagttctatttttatttcctaattaattcagaaaaggagcagaagacattgctaatgataggaaaggggaagatcacaaaggtaggatgaagggtggcttttatttttcagttgaatgaggcaattgaatgaatatgtggcatccagcaattagaaaaattacttagggccagccagtgcctgggcgattctcgggctgccctgaaactggtcagaatttattcctatgagcatgtctaaacttatcaacttcagtggccagcttttcttcttatactaatagacagtgagacttcattttcccaaacacaagggagaatacaaatttccacatatattaatcttttaattatttgaaatgtgttttagcactgcttctaaagttatattctctgagtacattaaacctaatttaacctttgacttgatttaaaatcatctttataaacatctggaactgtatgatctgtatactttagtgattccagaatcttaacaatctcaagggtgtagtcttttaattaa

SEQ ID NO: 77348 - DNA, 1071 bp, Homo sapiens
agaagtgggcatctggtgttgcaaaaccacagggctggacacactgtagacattcaaagagagttagtttcttctttaatggaaaagtatcattcatccattttaggtctttcaaaggatattatattacctttcatcccagcataaattcaaattgccatggcattttttccctttcatatgtctttcaaggttgaaatatagagccctgaagagctgtgggttggtcacctctcttcgaaagcatgcatttgctaggttgcaaatccaccaagggaagatttctctttttccactggaagttcacatgatttaatttgcctgagtaacctgctgtcataggttttcatagagtcctgacatctaacagagtaattaatgctttaggcttttaggagctgtttcaggtttttattaatcaccgttgtgattgcacgtgtgaattatgaaggagttattttggtagttgaatttcctcctcaggaaaatttccatatttgttcatgatgaactgatagcctgaagaaaaaggagaaaatggagaattttccccgggtccgaagcaggcactccacattatccagggtaagaatgacttcctagagaacagaaggagtgtgaggtgtttgaagctggtggttaaccgttttctctttccctccctgaaatttaattagaaattccccgtgattgccccgggaatatatggattttgtgaactttgtaaagatgtgtggcatcatttcatcctgacatcatttgccatgaatttgcaggttttttattcctttatgattcctgccattggaggaatcactcctaggaccttcctgattcgtctactggtctttttggggttttccagaagacggaggtatctaggtaatcggaaggaaatagaaacctatccttataattttatttatggaggactacatggattttcaaaattatgtgattgtacttgagatcagtgtatgaaaaaggaatgcactgagcggagtctagtccttaggattctcttctgaagtgtgaaaaagaaaacacaatagctgttatcttggaaactcc

SEQ ID NO: 77349 - DNA, 1042 bp, Homo sapiens
ttgtttctgagacagggtctcactctgtcacccaagctggagtacattggcatgataatggctcactgtggcctcgaccttccaggctcaagtgatccttccaccccagcctcccaagtaactgggactacaggcacacaccaccacgattggctaatttttttttttttgtagagatgaggtctaactgtgttgcccaggctggtcttgaacttcttggctcaggtgatcctcctacctcggcctcccaaagtgctgggattacaggcatgagccaacacacctggccatttccccctattctctaggtaccatgtaagcccccaagatgtccctctgaccccagaaggggaataggtccctaaaaacataattgaaattaaatttccattaagtgaggccttgggatccagatttaatttgatttagaagaaataaagtaatgtcatgtcccttgccctcaacttgcatcaattatggagcaaatgtattcccactagaaataaaaccaggtcaagatccttagggaacacatatttgagggagagctgcctcaattctggagggggatcaggtgttagtacaaagaattacacagatggaggttgggcagaggtgggggaccatctagaaacgaactatttccatcctttgcctaacattttccagtaggatgagactgtatccccttaaagggttttgagaaagtggagtccatatatggcactgttatgtggtccttaactcttgactgtatttatacaattacccagcttgactgacagcccttggtggtggtttccttcgagcacagaacaggttttggctaaaactactcagcatggtacctggaaaaccatcctctgagagtttacagaacaccttgtaatctggaaggaaattattcctcctaacatgtctgtaagaaactcattttgttcatccattttagagatgaggtaattgtggtggaagagccgaatacaagttcctgggcaacttatttctggagactcttaggaggaaaattactgctcttgac

SEQ ID NO: 77350 - DNA, 1042 bp, Homo sapiens
ttgttgaggtctacgagtgctagtactattgaggggctggatgtagggagataagaccctgccccagagaggattagatggagtgtagacaaacaagggagaagcaggaaaaaaaaacaaaaacaaaaaaccttgcactcatttttcctttggttttaggcctcccataagaaggctgacctgtctccaggccagtgttgagcatatcaacaagcagaggaatttagctcttgaatattccccagggccatagataatctcagctgaaacagaccctaggttattggcctcaatatcaccctgtacctgagtttaactaattgctttgttgctaggttcagtgttttcaatgcctcatttttattttctgttgtttttggtcttaaatgacaatggcatatggacctaagttaaattgtggaatcatattttgttttcctttcattgagtcctttgcagtgtactatggatgggaaaacacactgacgttttagtaactctaatctattatccacttgctaggatgcaaacacaatgcatgtggcaaattactttatatgctgataaagcctgtgttttggaaaaatgttggaatgtttgtatccaaaacattgttttgaatcaagccatcttaaatatgcagattatgaataggaagtggtatcctgaatagcatcgtcaaaattccaggaagggtcaggctgcaaaatacaagacatggtgagtctataattaggcatcaacgctattttatctgattgagcatctccctgggcttggctctggcattaatcagagaacagctctccagcccaaaggagttcacttaagaagatgacccaggaggcaaatctagctctctcagaagccaagacagagcaagccctttacttattatgttgtttgcttcatggaataaggcatagaatttctgctaaatgaaagcaagatacagcatttctaataaaatagaaaagggaatatggtgcagtgctcttcttgcaaattgtactcactttcttttcaagtctaaggtttctct

SEQ ID NO: 77351 - DNA, 1027 bp, Homo sapiens
gctaagtctcattgccatttgtgttgaaggtattctttctccaagagtactttacgactgttttttaagatattttctttgtttttggtgtttggcaattttatcataaagtgttcagatgtcaacttatttgtatgtgtttattttgtttgggggtttggggctttataattttgtggattggctttctcatcagaactggaagattctcaggctgctattcctgctctgtactctttctctctaattccaggtttgagattaagcatatgttatacctttgttctgtcttttccatgttttagcttctctgtcatcttttctatttctatatttctatgtgctgcagtctagataatttactcagttttttccctctggtttcctgtgtctaatctatctgatctagctcgattcttatatactcgttcccttttatttatttaaacaatattttatgttttgtgtctaattttaaagtttgaagtctttgttggccgggttctcctctctattgttttcactggttgttgttcatggtgctttgtttctctctctctctctctctgtgtgtgtgcgcgcgcgtgtgtgtgcgcgcacgtgtgtgtgtgtgtgtgtgtgtgtgtgtgtgtgttttgttttgctttgtttttggaaactctattagtgggaattctttatcagtgggttggagttgaaagtgagtttctccagaatttgcatttgtttttgtcaggttcctaggatcattatcaacctgcaaagcaaggacttaaaattctcaacttgaggttttggggacaaaacaggtaatcagtttgtcctgtaaacccctgtgaggattaccttgtggttacacatttttagtaaagacttttccctttctacttagcacttatttttgagacaggcagtttaaagtcctctctgtagctggatgcctcttattatacactctatcttggtgggcctttgtaaatgtcaccaagtttatctgctttcccctgtgtcttgctaagttgtaaaa

SEQ ID NO: 77352 - DNA, 1293 bp, Homo sapiens
cttaacctaagactcaagtcctaggtgatatttccataagtactatggaaataaaactctgtaatgtggaaatcctgaaaggattattgggagggctaaatcatgagtccctgaaaagcacttggcacggagcctggcacgtggttgcaactcaaattattgtagctatttttattgttatgttgtcaatgttgttgtgttccttgtctactaagaaccttgatgccagcctgggcaacatggcgaaaccccatctctacaaaaaatacaaaaattagccgggcgtggtggtgtgcacctgtggttccagctactcgggaggcttgatgtgggaggattacttgagcttgggaggttgaggctgcagtgagccatgattgcgccactacactccagcttgggtgacagagcgagaccctgtctcgaaaaagaatcttgatggcttctcattgcccagtctaccaagttctctctttttctgcctcactttcaagttcttttataatcttgccccacttattaaactgctcagagaatgccccaggatctagtcagtgtctcttcacccctgaactcgctgtggtccttctagcttcccagcctttgtacatcttgttccctggccacaaccttcttcctccatgttgtacagtcaccactttcattcactggaaaactccaatgtacagagaaaatgcagtttgttcattttgtctacagtgagccttccttcccagcacacacccattgatcgtcaagagaaagaataacttttgatcacacccgttaaaaaacttagttggatctgctaatccaaacagttccctaagataattctagtcttccataggaaaacaatgctattccctcaggttgtctcgcctaccccatccccagttcttcgcctatgatagtgcatgtgggaaggaatgtcaaccttgctcttctgtttatttcttatgaaggaggaacaaactcagggtccctaggctcggtggcctctgctgttggaggcaaggtttcttgccttctgggagctgcttgtttagctatactagcagttgaagtctgtggttttataacacatagtctagtctagtggttttcaaagacctacagtaagatatagatacattgtacaccacatatatgtatgtatgctgtggatagatgaaacaaaagtttttataagatagcatgtataggccgggcgcggtggcccacgcctgtaatcccagcactttgggaggccgaggcgggcagatcacgaggtcaggagatcgagaccatcct

SEQ ID NO: 77353 - DNA, 1019 bp, Homo sapiens
tagacagcactcacttttacacttggtctgaacggctcaacaaactcaggtgttaagatacactgacatctccttgatttctttcagaataagaaaaactggcttaagtcagcagatcagcaagatattcagtcttctttttggggctcccctgtacccctaagtcatataaagtctacagagacgaagttaggttggggttcagcttgattttttcatctaagcaagagctctgctcttgcaagagtgtaggggaaacttaaaaattaaatcatcactgggcatgccactgtgcctagtatacgtgtgaccaggtggaactagcaatggaacagatgtagacattttcagtcaaatgtgtgtctgctgcttttctaattctcttaaagagttcaggtgaatgatcagaacttgatggaactaattaatatttcacaggtctgatttcacatatttcacatgtatgaaattattttaaaagatcaatcaagggaaatgccaaagacatatgcacaaatcgggggaaacaaatcatcctcacgttcattcagtgagcagttgcgggcacctactgcataccaggaactgtgccctatgatagggatacgagggtgaagaaatcattcccagacagactatcccctgttctgtaattctcataggtttcttaactggaaatatccccaaatgtggctcttttgaagttcatattctaagcagatatagacagactgaagtgccaccctcatgagatccttcctggagatattatgcctttggttttaatttagaaacagaccctgcaagggggattgaagggtggatggttttcttgggagaccatcccaggaagacaccagtaggtgcaggagagggaaatgaggaagggaaggcagccagtcgtgagttatcccgtcagatccattgtgggcggtggagctcagccgcactggggcacgtggggcacctatgccagccacgctgctttcggtcatgggttgaagactgctctcagggcg

SEQ ID NO: 77354 - DNA, 1120 bp, Homo sapiens
agccaccacacccagccagtttaagagctcttgttgcactctgaaatttcctaattcagcaaactgaatacttttgcagcttttaaaataaaacagtgactctataaggactacttaataaatatctctaaattaagaccatcatgttttttcttgtgactagattcagcatttagaatggcctcttgacacttctggggaagtgtggcagtattgggtgatacagaaaaatcacatcacactagcgaggggccttcctttgtcagatgctgctctctgcattattttaattggttctcatattagcttaataatactgctactaatacctaatgataatatgcattaatgtcccattctacagatgaagaaaccaaggcaactgtgttcccagagtcacccattctttggtacccgactattaatagttctcactgtcaagtcccctgactccaaatcccaggctttcctccgagactgaccacctcacaactgctcctctgactgtttctatcccagggttgaagacttccccttccacacagaaaatggagttcccttcggggggaagaaaaagcaggatgggttggggaatatttgctgtaattcccaccggaaataggattttgcttcttcacattctgtgttctcacatctgaccattagtgatggaaggggctttttaggtcccttgtcagtgattttttttttttttttttttttttgagacggagtctcactctgtcgcccaggctggagtgcagtggcacgatctcggctcactgcaagctccgcctcccaggttcacgccgttctcctgcctcagcctccccagcagctgggactacaggcacccgctgccatgcccggctaattttttgtatttttagtagagacggggtttcaccgtgttaaccaggatggtctcgatctcctgaccttgtgatccgcccgccttggcctcccaaagtgctgggattacaggcgtgagccaccgcgcccggcctcattatttttctttatttgtcttcaccttttgactttctcttcgtccatccctgagcacgtttacctacttggtaaataaaaagtcctaattccagaattacccaaagattat

SEQ ID NO: 77355 - DNA, 1025 bp, Homo sapiens
ccgggcgcaggagccggggttccggccgcgatctgctgcagctcggccgggagacggcgcgacccggcggcggggccacccgcgagtccagcgtcgccgcagccccccaatgcggccgcgagaagcagcgggggggcaggcgatcgaaggtaacgaaaatggggctcatttcctgcctcctaatctgctcgggtttagcattgtcacgagaagccctccgtgttcaggctgctgcattttggggcactctttgattttttttaaaggtgtccgcccccctatttccacctggtttcagattgatttatagcttgcagcccaaatgggaaagatccagccatggcaagttgcttattttcattagttttgtctcaaaagtaagttcattaaaaaaaaaaaaagtttcttaggaatgtgtggatagtcgctttttaaaattttttttaaaaaattgcagacaaatggatatttataaaaataatcaaataattgatgcaattctgttaattacttttagggaagcacacttctgtgggctccccgggcgttacttttattttcaaggaaggaacgtgttaaatgtggagtttgtttggctgggcagagtttacagcattgctgtcgcaactgtttggctatcaattataaacagtgtcaaatctatgggcagtttcagcctcttttcaaatactgtaacgggttatcctgatatgacatctacagatgagtttccactgagggtaataagaagatttctctttttggagaaacattgttttgaggggaaaaccatgattgccggctgggaaggctgaagagactatttttcatgctttgtttatactcccgggatgacatttggggaagggaaatgcaatctttctccggaggttttaattgtgggattattaatttatttaatttattagtttcaattggttgggctcggggagccctccgtcacaggctgtgcttaaggtgacacatttgctagcagttgggacacatgattgcaaatgtaaaat

SEQ ID NO: 77356 - DNA, 1004 bp, Homo sapiens
catatttattttcccagataaacttttgatttatcaaatttcccaaagaaagtaaacaaaaaactctacagtccttctatcatgtattattaaaaatatatcccactcaaaatattatactattaaaataagcattatttgacaactggtattttctgactctgaggaagtatgctttttaaaaggcaagcttccgtctaaacaatggctaacaatgtaattaggagggcatttacaaatggcttgatatttatagttcacatttcaacttcaactctatttgttgcattagcaaaatgaaactcattaagccttattcttttagtccatctctccaagcttctgaacccactaatactcagctttcttgtatggaaatatgtaatctttcctacattacacttgaaagttcagctcattcctaaacctccagtcaaggagatgaacttgttgctttcagagaggccacatctgtgcactgagccattatgccatctgttaaagtggtcagagttcattttattgcctcctttgtggaaggacttgtactgtaaaaagcctgtgttattgaaaacataattttcttcatcattatgctttctttctagccagatcataacctgctagaaatctattgagcatagagggaaaagctcttcagaatagctgttcttaagagattaaatgattgccatctctgtcccatttcttttatctcataatcaagttcaagatgatactgggtatctcagctgaagtgattatatatttgaaatagaaatggctttctctccattcatatttcatattgttgatggtaggatcttttttctttatatttatatatgcttatgtttccttataaatgtccacggggtcaaaggttcaaactacttttttttaaaaggctaaacatggctaacaggagttgggttacattttccaattttctgcatacaaagatactagttgtataactaagatctggcttagattcatcaaaa

SEQ ID NO: 77357 - DNA, 1010 bp, Homo sapiens
ctccccccagggagctattttcagtaaaacttccatatggggatatatttattactaaagagtgtcaaacgagtcaaatagtcagaccatgtagtcactgaaagagagcagcagccgaggaatgcgcgcagacaccgggcaccctggaactgcattccttctccgcagaagtcaagcacggttgtttctctaaaagttctgcccgtaacatcttttctttcattcctttcttataaactcacattatgtaaactctcgaagtgtgaaatggttttccttggttggccatcactcacaaaatgattttatcaaacatgaattttccctcagctatcagctgcacgcaatgggaaactcacaaaatagagaagtggttgtgtgctgagcacataggcattttatagcgggtggagggtagaaggtggggcagggggtgggaggtggacggttgggaggagatctggctgaagtaacaaatgctcctcatagaatatgttggaaatagagaaaggtctgaagaaagaaaaacaaaacaaaacaaaacaaaaaaacaaaccaaacaaccatattcataccaaaccaaagataattatcattaatattttggtattgattcttccctgtttctctctgtttttgttaagatgagtgtgagttttatataccatgcttttcaatcattttgccattttcctttataaataaccctacaataaacaaatttgtcttcacttttatcttcttaggagctgttcctagatatcaaggtatcgtatcagagagtatgaagttattttatcatttttacagctcctggttcttcttacccaattgcctaataaacaaattctgctcccctcactgtatatgcccttctcgtcctgttctcaccaatgaccgagtattatttttcaaatgtttacgaatctaataggtggaaagagtatcttatttttttatttctccaattgctaataactttgaacatttttacatgtttattagccttt

SEQ ID NO: 77358 - DNA, 1048 bp, Homo sapiens
gactccaccaaaaaactattagaactgataaatgaattaagtaaagttatatgatacaaaatcaacttacagaaatcagtaccatttatatatgccaacagtgaacaaactgaaaggaaatcaaggaagcaactccatttataatagctaccaaaaaaaatataaaatacctaggaagaaatgtaaccaaagaaataaaaaatctctataaggaaaactataaaacactgataagcgaaattgaagaggacacacaaaaaatagataccccatgctcatggattggaaggattaatattgtgaaaatgtcagtaccacccaaagctatctacagattcaatgtaatgcctaccacaataccaatgacattattcacaaaaataggaaaaaatgctaaaattcttttcttcttaatttttatttttccagttgaacccgagaaatgagtcaaaaccctaatctttaggatgttccagaagtactcactttcttccatcagtttatttcctcaccattgcccaaaactcaaatttacagcaatctatatagtactaattagaaaggatttcggccgggcgcgatgactcacgcctgtaatcccagcactttgggaggccgaggcgggtggattatgaggtcaggagttcgagaccatcctggccaacatggtgaaaccccgtctctactgaaaatacaaaaattagccagcgtggtggcgcgcgcctgtaatcccagctactcaagaggctgaggcaggaaaattgcttgaacctgggaggcggaggttgcagtgagccgagatcacaccactgcactccagcctgggcgacagaacaagattccgtcttggaaaaaaaaaaaggatttcataatgaaattcctttaattatgataccagtgctcctattaaaatcaggttttgtgaaagacttttttcttaagcccaacccagcctccgtggggggaaatcctaactaagaacttaaacaaatttttcacatgtacacttatgacaacatttttgaaacactaatattttgaaaagttt

SEQ ID NO: 77359 - DNA, 1028 bp, Homo sapiens
aacagagtgagacaacgtctcaaacacacacacacacacacacacacacacacacacacacacacacacacacacacacacgttgagcatccctaatctgaaatccaaaatgctccaaaatctgaaactttatgagagctgatctgacgccacaagtggaaaattccacacctgacctcatgtgactggttgcagtcaaaactttgtttcataaaccaaaattgttgaaaatattatataaaattaccttcaggctatacatatgtttataaagtatcagtgaattttgtctttacatttgagtgccatcccaagatatctcattacgtatatgcagatattccaaaatctgaaaaaaatcagaaatctgaaactcttctggttccaggcatttcagataagggacctcagcctgtatcagcagtgtaaacatgctgggcctctgcctccgggcatcctgctgtgttctctcaggcagctctttctggtttccacagaagcactttcaaacctttgccacttttctcaggctcctgccccattttccctgtcactctcagcaaatggccttgcctcctatatctccaagaaaatagaagtcatcaaagcataatgtcttttactttctgcttccctctgcagttactatacactgttggtaaggatgagggtgatgggggatgatggctaactttcttcagcactaaccactgcccgcttcattctggtcacaatggcaggggtactatttctcctatctcccagccccagacaaatccttccaccatagctttggattctgcccttttctacttcctctggtcctaactgcatcaattatcttctctgtctgaagctctgcattaagctgcagtcacttctctacttctcatatccaaatctctttcagtccactgtgattttatttctgccccagtaactctgctgaaactgccttgaacctctttgttgctatccgtgggtacttcagtccttgcagtattgggcactcttgagcctaccttcta

SEQ ID NO: 77360 - DNA, 1972 bp, Homo sapiens
ccacctcacttgtttccctcttgtttttattcttcccatcatgaccccaaagagacctcatgttccatttcttaacacatataatggatcctcctgtaagtatctgggctgtggcagactaacagagagacctccaacctcaacaccagctaatgccccaggctcacagtctgaccactctgttagaaaaagaagcccctctctctggttgtcccatccccattctactttgctctttatttgttctcactcagcctccacctttttcctctctcaaacttgtgaaagatgttcctggaatcctatttttatagtaaatacacccacctccttaactggatggtagaacattgtacctgccttcttgccttaactgaaatttgactcttccctgagagcttttcccaggtgagagaatcctgctccagaagcacagtgctgttcggagtccattgtttcccactctgttgtagaccctactcttctgatcatcctgctatctgactgatttgtcctctgtccataatactgtcatccactaacctcatagtcacctatgtcacatatagcctcccccaaaactcaaagccctgccatcatcaaaactactcagtcctttagattttcatttctttcacatcatcaattctagtgaatttatctgtgttactttagccgcctgcttccttagctataccctggatcattaccaggaaacacatctttgctaaaatatcacattgaaataactcttttttatgagtcaggatctctgatataatgttgggtagtagaaattatagtggacatccttatgtgcttttagcctttttaaggaaatacttctaaagtctcaccatttagtatgatgttgctgtagggttttggtggaagcaaaatgcgtttgtattcccaatctgctcaatttttccattataaatatctgttgggtttctttgaatatttttctacatatgtgaaatgctgttattgtttttctcccttaatctgatatttgcagcattaaatattttctctccttctgaaatttcttttagtttaatgttagcactttcccttgtgtcttctgtgtttttttgactttcctttcagggtttttttggtttttttttttcctttttatctctctgtagtgcatattgggagatttccacagttatacattccagttcatcaaatctcttttcagctctgtcaatcctgctaattatataatttttcattctaagactttcagttggttccttttcatttctacctctttttatttcacaactttctgattttacaatcttgctagtaatctctattatgactgaggatttttaagtctttattcagagtgttctgtagtacatatttcctcggatatgaatctcctcattcattgaactgcttttaatcatggtgcatatccttttgtaattttctttaattaagagcttaacttccctacagatttgccctataaaggttctctttgggaattgtctcaaccccaggcctatgaattcctcagctctgaaacaattcataagttaggcatagcttgggaatcctactgcagggaagtgatttctatgcccatgtgaaatgcagactcagaagctagttatatataggtgtcttatcttcatctctaatcataggtaatttggggccttgaccctcactgaaaaaaaagaaactgatatcacccccacagctccccgccccacccctagatttatgtggagtcatgctcaggattcatattcttttccctttgcagatgtagaaacctcagaccccatgtcttttcagcacctgcccctacctccaatctcacaatggccatagtcttacacgtcactaccagcatgggtttattatcgttttttattcacagagacttttctttcttgtttttaaaaatggttctatcagtcagggccccagcagaaaacaatgt

SEQ ID NO: 77361 - DNA, 1030 bp, Homo sapiens
ggctccatcctcagagtttctgatttggtagatattgtggtagggcctaaaattagcatctaacaagctcccatatgatattactggtgtgcagaccacactgtgggtcgcacagtctagaaacattcggaatgccaaggtaaggaagacacatggtgtctgtaaggcaggtaggattaatattaatactccatggtgtgctaatattaattatactgtatcacagtgtgtgtgtgtgcacaggaccatgtgttctaaaatcatttcagagaacatagtatgtgcagaggcttagagaattgaaactacatgacacattcaggaatgtgaagtttgcatcactgcagcagagagcatgtggctggccgggaggcagggggtagtctagtaggggtggggaggagaggaacatgtggcagaagagatgccaagatctaggtagagctctgatggtaattagggggcttgtgtactccaagagattggattgctttcctaacctgagaacaagagaaatggaacagagaaaataaaagattcactagagttctcaaggtggtagaattaatgatagcgtagaatttatctaaatataatctagttaacccattaatcctgctgaaattacacttcagttgaaagtcaatctcttgggtatctggtttcttcatttctggtcatttttgtgcaccatatgatgacttacgtgttcttaaatatgacctgttttccattattttctaggttctttttctatccagtgaatagtcagccagtaatccttgtcccaaattgattataataatgaacaggtggaataccaagatattagcaataagagtatcttaccaaaaaaaaaaaaaaaacagatttccttgttacaaaagcaatgcatacttattacggaagctacagacaagcaaagaaacctcccacaatcccactcacatttagaaaaccactgcaaaaccccctagacactaactttttagattcttttccatgtagatgtgcattcttccctaccaaa

SEQ ID NO: 77362 - DNA, 1033 bp, Homo sapiens
ttcttagctgagaacaatcagcaggtaacactccagcagctgggggatctgagtggtacactacagcatccacaacagtgtgtctccattttgtgtgtggttttccctttataacagacttttaaagattaactgattaacttctggtccagattgcttcaaataagagtatcttcactgcttatgcataatcttctgaaggtctcattgtatttgatcttctttgcatatgacagttgtcccatctatgatacaacaagactgcgttctcctgaatcctgtaaacttaatcacagcaaataaacgtgtgatgtgttggaagcacaactgatgttagggcctctgtccactcctaagtattttccagtatttattttgagattcatggaaccaacttcaggttttctttttaaatttccaaagactcttttggcattcgatggtatcctttggcaaactctccacttttgtactagagatcatcttcctttcgtgccctatgacctgtaggtctctctctgcatgttctttggtgactcttccgtctgctgcaaataactgccatccctcttccttttactttagccttttgccttagacccgcgtctctttatgatgatcccaaagctcctgacttgaatgatggccaatctccaggacgtctaaatttcattttggaatatagtcttccaattcttaaaacaggagccctgtttatatggttgttttgtttattgttagatccaaatttgcttttcgtttctctcagcttgctttgccccaaattgtcaatgctaaagtggaagtctgaatccctttgccagtgtgaccataaatatagcacaaagatcctatgattaccctatagtgtctgttttccttgagcattttagcatgtgctgaccttttagcaggaatactattcagcctcatttatgcttagcccttcatttagccaagttttgttttttccttggtttcaaattttctctctttttgtgaactgggagctgaagcccttcatttgacttgt

SEQ ID NO: 77363 - DNA, 1173 bp, Homo sapiens
ctgactaaaaaacaagacaaaggtatagcaccagtagtgaccagaaatcatggaatcattcagcagttcaggtcctatttgctgatggtgaggcaggagacctggttcctggcttcatactcagtttataatctagtcaggtaaatagactttatgtaaataattacactaaaaacaagatcaggccaggcgcagtggctcacgcctgtaatcccagcactttgggagaccaagacagatcacttgaggtcaggagttggagaccagcctggccaatacggtgaaaccctgtctccactaaaaatacaaaaattagctgggtttggtggcaggcacctgtaatccccgctactcaggagactgaggttggagtgggccaagattgtgccactgcactccagcctgggcaacagagtgagactctcaaaaaaataaaaataaaaaaaagataaataaaacatttttaaaaatgagatcattacacatttctctacctgctgtcatagaaaaccaaagaacatcatgaatgattatagcccggggcctgattgagctggagtgggggtggcttctctgagggagacatgtttcagcctagacaaggagatcaaggctgggtcagccaagtgacgagggtgtgggcccagggcttaggagagcattttaggcaagacgcatggtgtgcaagaccatggggaggaaacactcttggtgcctttgagaagtggctggtgaatcttgaagagggagaacctgcaggtgctggagggggcccttggagaggccaggaggcagctttgtcccacaggcctcgtgggccacgttttgaggatagaacctgaaaggcatggggtctgacattaggaattttaagcaggggagcaacagcttctactgtgtggccctggccatgcgtttaattggggcttaaagaagggaatctactattggtgagggcaattcagatctgaagggaacagaaggggctcttgccatacggtgtcatttaggggtgcccagaagggcccctgcccaaaaatgtctttccaaccatccctgacggtgtctaaaatcctatcattgaacttcatctcctttaaaacacaagtcctctgacagtcaagcaggatcagacaaaattgcaggatatttaaaaattttgtcaggccaggc

SEQ ID NO: 77364 - DNA, 1051 bp, Homo sapiens
tgaatgttcttaaccctgcctccctttgtcttatcaactgaattgtttaagacccaacgtaggtggccaggaggaaacatggcaaatagcaatagaacaaatggagagaaactgttgaattattatatgagaaggcatcttgttcataagaacacaaaggaaaagaatatggtaatgtaaattaggctgttacagacttttgtcattctgtggagcccctgaaactttcttaaagggatggatgataaaatttacatcttccttttcatcagttacttagtcattagttcagggcccatctctccatatgtaatcactgcctagccttcccaaatcggagccccgtcatagggctgcagtgggatctggagaacccactgtcagcagtctctgttctttaaccctagacacaggaacaatgcagctcttccccaccttttctgaaaaatgagtacaaattgcaagaaatgcagcacagattgtacgatgtcagtacattagcagtgacatgggaaatctgatggagtcagggggaaaaggtgtaaattgcaggataatatcaaggggaggtcagtatgttagtaatgcagggaatatgatggacttaaagaaaaggtataaattactgggtaatagaaaggagaggtcagtacattagtaacatgggaaaactggcagatttgggaggaaaaggtgcaaattataggataatgcaaagtaggggcatcactgtaaagatgcttcatttcctgtttataaggaggagttggggagggacttgcagtggattcacagataattgcctagaaagtgcccgggttggttgctacctctcctccaggcaggaagacttcctcaccaatgaggtggtcagccccaggtccacccattgaaacaactgtacagagattcatcctgggttggcagaaggctctaccctctttcagataatagttatatagacagatgcctatattgagtgagaatgtagggaaatttatgatttccataggcagaaaccagagaatcattagaagtttgttttgggaga

SEQ ID NO: 77365 - DNA, 1041 bp, Homo sapiens
tctcctgatctcgtaatccacctgcctcagacttccaaagtgctgggattacaggcttgagccaccacgcccgctggctgggtttttaattgaatttatattgaatctttagactagatcaatttggggagaactgacaatgccaaaatgttttaagtcttccagtgcatgaataaagtatatccttttgtttttaaaggtcttatttaactttccttgctgttttgtagttttaatgtaaaagttttacacatattttatcagataattctgaaatatttggtttttatgtagttatatagatttttaaattttattttctacttatttagatatacaattgttttttatatgctggtcttacaccagcagcatgactgaatgtcttagtctagtccgtctgttgtaacagaataccatagactgggtggcttaaacaacagaaatttattttctcacagttcttaagactgcgaagtctgcaatcagatgccagcatggtctggttctggtgaggaggctcttcctggcttgcagatggctgcctgcctggctgtgtgcttctgggtcctttcctggacatgtgcacagagtgggggatctcttgctcttcttataagagcactaatcccttatgatggtcccactctcatgacctaattacttcccaaagacaccacctccaaatactgtcacattgtgggtgagggattcgacacagaatttagagcaggagtgggcacacacattcagtacataatacaaagttaacttattctagtacttcgtcttagtaattgtaatagtatatattttatgttttctaggcatgcaatcaagtcatcttcaaacaatagtagttttatttcttcttttccaattcttatgtcattgatttctttttcttttcttactatatcagctagggtctcccacatagtgataaataaaagttatgtgagcaggtatcctgtttcttccccatcttggtggggggaggggaaaactttagtatttcacattaactatggaatatgcaat

SEQ ID NO: 77366 - DNA, 1055 bp, Homo sapiens
gagctggcaaatctggagtctggggagggcccactttctggttcacagatggtaccttctaaatgtgtccttgatatagtttggacatttgttcccacccaaatctcatgttgaactgtaatccccaatgctggaggtggggcctggtgggaggtgtctggatcatggggacagatccctcaaggcttggtgctgtcttcatgttagtgagttcttgtgagatttggccatttaaaagtgtgtagcacttcccctgctccaactcttgttcctgctctggccatgtgacatgcctgctcctgctttaccttctgccatgattgtaggcttccccagaagccaagcagatgccaacgccatgcttcctgtaaagcctgcagaaccataagccatctaaaccttgtctttataaattatctaagctcagatatttctttatagcaatgcaagaacagcctactacagtcttcatatggtgaaaggagagaactctagtctcttcagccccttataagggcaccaatcccattcatgggggttcagcctttatgacctaattaccttccaaaggccccacctccagccatcacattggtgattaggttttaacatatgcatttggggcaggcacaaatattcagaccatagcaacagcattttctgttttatttccttctttgtaattctcatcattgtattggccgtattatctacctcagtatgttgaacagtgacttaagggcatggcctttaaatgctgctagagggccatctgggatatagctgataactaagagcttgcctctctacaagtatactttagattatttttttagaattgaaatgagaagattcactatttgctatatccatttccaagaaaatatattatagcttcaagaaaaatgcgagtgttaacacgtgctgaaatatgatacagatgtttaatgtcttactgtaatattattttactgttcatagtcacctgcttttttgatccctgcctaagtttgctttctttattccataacacctgttcccaggaatatatttac

SEQ ID NO: 77367 - DNA, 1031 bp, Homo sapiens
aaaaagcaataatttacctttcatgttggcaaaggtaagctctagaagtctttctgtgatttgctgatattaattccactccctggatgtttgttttgctttattctttctaactctccctgattctgtggtttaatagattttcctcctgtttagaataaaattgtagaagtcagtaccacatttagtatctatctccaggcatggccaatccttcccactggctgtgttccggaaggttctggaaaacagctgacaaagcctgaatgtgacagggcaagacattttaggcagccctcatggctttttcagctgtgcttcttattttcttatagatgtatgtgtggtatgtaagtgtgtatgatgcatatatgaaatattcaagtcagaaaatttgtccatttatgttcctcccaggttacgaaacaaaatattccattctagccatggttaaagccccctgggtagccctgcctgattgccctagagatcatcactgtcctgatttttttttaatcattcgtgtatgtctttatattttatgacatggatttatatatcttaaatagtacagagtattggtttgcttatttttataccttatataaatgcatattgctttttctcttattatattcttaggaattatccacattgatccatgtgtctttcatttattctccctactgtatagtattctgttggggcaccagggggcacaataaccagcaccttcttttcccctccagaatcaattgaaaattcgactccaagtgcaagagagtaatagatagaaatttcagctttcttagtgacatagctctattggagggattggtttgctaaaatacagcccacattaagcaggtttaccctttagagtggagtggcagggtctttagtgtattcatatcagcagttgacttgtttcccaagtggttgggccagttcacagtattaccctcagtgcaccagaattcctttctatccatatactcaccagcacttgttactgaactctagtttttgcc

SEQ ID NO: 77368 - DNA, 1032 bp, Homo sapiens
catttgttatattcttggaagccttgagattaaggattttaaattgggctggcatatttttattaatctactggaaagtggttattggagcaccttctgtacaccaggggccattctggatgctgagaatagagccaccaacacagcaaacaaggtccctgctgtcagggagttcacagtttccttgggagaagacagataataactgagtaagcaagttaatttcagatagagataaaacactgcaagaaaagtaaaacagaataaattatagaaaacgtttgaatggggaaggggttgcttaaaattgggaagttagggaagatgtttttgagggctgacatttgaactgagacctaaatgacgaagagccatccagaaagaggaaaagcagttgcaaagggtctgagatgggtataagcctagagggactgagaaactaaaagaaaaccagagtggctgggttgcagcgaacaagaggcagcaaggtctgagcaaaatttgagaggtaggcagggcaagatgctgtgttagtcatgggtgctacctctttcttttatatgacggtgagtagcccttatcggaaatgcatgagaccagaagtgttttggattttggatttttttttttagattttgtaatatttgcattatacttactggttgagcatgcccaatctgaaaatttgaaatcttatacattccaatgaacattgtctttgaatatcatgtataatatcaaaaagtttcagattttggagctttcagatttcagattctggattaaggataactcaacccatattatattctgtattgtgttacattccattatgtcatatcatatttcacaccatgttgtgtatttatattgtattatatatttatgtccctgtaccttacagggaaatgaagagtcaaagaaagaccttagatttctcaagatatgtaggttttctggcattcccagtgtacaaagtcatgctagtgggttgctgtatcctggcttggggtccccagcttcttttcatgt

SEQ ID NO: 77369 - DNA, 2120 bp, Homo sapiens
cctcaacctctcgagtagctaggattacaggtgcccgccatcacacccagcaaatttttgtatttttagtagagatagggtttcaccatgttggccaggctggtctcgaactcctggccttaagtgatccgcctgcctcagcctcccaaagtgctgggattacaggcgtgagccactgcacccggtcactagacattttaaatcctctcaagacccctgattgtatgtgtggccttcacctcacacttaacgtggccaaaatgcactcctgccttctctttgtcccctaatcactgtaagagagatctttccctgtgctcttttattctcaggcttatatctttctttgttttggaaacacatatttgttagaatcttctgcattgcagatactgggattgtatgaaaatgaacaagatagaaactgctctgccctttaggagcttagagtctagttgaggatgtaggtggttagaatccaagatggttaatcctgaaagatgactacaaagtactatggagaagaagaacgcttgctgcagactggggagggggcaccaaggctgacatcagagaagtgatagccggcgtgagacctggaggatggtctccatttgcctgacttcgccttagccagggaaggagggagggcatattctagacagagtgcatctgcagaggtcagcgggagagcatgaataacagagttgttacgcatagttagcctactatcaaatacacctatttttttcagtgggtgggtggaacgagagatgaatgcagagtgatgagactggagagataggcagtgccaggtgatgagggtcttgtaagagttcagactttatcctgagataccgggaagccatcgaaatgtagggaagtgaggtgatcagacattttttgttttgttttgttttttgagacagagtcttgccctgtcgcccaggctgaagtgcaatggcgcgatctcagctcactgcaacgtccgcccccccggcttcaagctattctccctgcctcagcctcccaagtagctgtgattacaggtgcatgccaccactcccagctaattttttgtatttttagtagagacgaggttttgccacattggccaggctggtctcaaactcctcgccataggtgatccgcccaccttggcctcccaaagtgctgggattacaggcgtgagtcatcatgcccagccgatgtgatcagacttacatgatctctcctagtgtagtgtggagaatggattaaaatgtggcaagaatagcctctatttgggctgatcctagggaccgttttcccaactcagccttctctttaactccacagtgtttgtccagcccagcatgcatttttctgattagcatgagggttcatctcaaacatcagctccctttctctagcttcctgtcttaaaggccaggactgtgtcttttccctagctctgggctggctcttactctacactaaatgtgtcatctggagcaccaactggatccaggctttaccattgcccagagagtctgttgttttgcctactatcttggctcccctgggattttggtgccagcttagatctagcctgagttcagtgatctcctttgacccctgaaattcattgccattcacacgttggctcttcctgctcagccagtctagaacaaacctgccgctgagggaatccctctcttttcccacttgcagttgagtatcctagatacttcacaattgatctccattgtatacctacatagaacaataccttcgataagatggattgaggtaaggtgaggagaaccagctacaggttgagtatctcttatccaaagtgcttgggaccagaaatgtttcagatttttttattttttcagattttggaatatttgcatatcataatgagataacataagaatgggacccaagtctaaacacaaaattcatttaagtttcatatataccttatacacaaagcctgaaggtaattttatacaatatttttcatagttttgtgcataagaagtttgtcttaaatacttatgtatggaattttccactcgtggtgtaatattggtactcagaaagtttcggattttggagcatttcggagtttg

SEQ ID NO: 77370 - DNA, 1035 bp, Homo sapiens
gctcagtttttccagtttgtaaaatggagataataacatcttcccctcagagttggagtaaacatcacctgagataacggatgtgctgattaagtgctcctcaccctgtccttttctagtttaagcacagactcagttctttttgagcctccaccacatcccatgctcttagccagggccttaggaccggagtccctccttgggtgtgatgatgcctcatgctgcgttaatgagaagatgtttccaggttgtaaagttccacaaggattttgtaaagaactcacaaaagagatactcatattgttagctatatgtggtgttcagatatttgcccgtctaccctgggatgtttccatgttgatctgaatctgcctaaatgtttaagattggagaagggagcacagggttgctgacaggtgtagcaacagtgtccccaacagttcattcatccatttattccacaaacttttactcaacattattattgctgggtctccggcatacaaagatgaattcccagagagcctgaagatgcttctgagagctgcagactcaaggagcaggatgctttctgcttggcaggaattgataagcagccctgatctatgaaagagcaagaaagataaatttaaatattttttaaaatattattttacaaagttataagactgtaaaaaaaattttaactttgaaaaactctgatagttgtattaagcttttgatagcatcatgtttggaagaatgagcaaatcagaagaagccttcagcgtggttggtaaagtcataaaacactgttaattaggagctttagcccagtatagaattttaaaatacaactgtataaggtatatatattttttaggaatagcacaactaacatctttgattagattcgattgaaagattcagacccttaagatttagagattacggaatcatagaactggatggtggctgggactttaggaatcacatatgccatctcccttattttctagctaagaaaatggaagtcaaacaaacgtatgtgactca

SEQ ID NO: 77371 - DNA, 1042 bp, Homo sapiens
tggtacttgttaatggtcaagtgttttcataacctcaaaatgttattttcttgtttagaaatgccactgcctagtaatgataatgatggagtagactgaatttacaggtagaataaaatgtctgcactcccatgttaattgcagcattattcacaatagccgagatatggaaacccatattaagtgcccaccactggatgaatggataaagaaattgtggtatgtgtgtacagcagaatattattcagccttaaaaaagaaggaaatcctgccatttgcaacagcatggaggaatctggggacattatgctaagtgaaagaagccagacacagaaagacaaatattgcatgatattacttatatgtgacatctaaactagtcaaacttggagaaaaagagtggaatggtagttgccaggggctgggaagtggggaagatggggagatgtcggtcagaggatacaaaattttagttacagggtgaatgaattctagtgatctagtgtacagcatggtaactatagttaatgtgttgtgtacttcagatttgccaagggagcagatcttaagtgttttcaacacacacatacacacacacacacacacacacacacacacacacacacacacacgaagcatgtcaggtgatggatatgctaattagcttgactgtgagtcattacacaaagtatacttttataaaaacgtcatcttgtataccttaaatatagacaattttttgtcagtcatacctcaaaaaatgtctacacagacttagtgagactcatgacatgagtcatgttaaaggatataagaaacaaataaaagtttaaaaatgcttttcttaacccaagtcttattgttaggattcctcataatccagtcatgacttcaattagaaatccttgccgtgggatatcaagactcttgtccaaggagaggaaggggcaggagggtctcactcttgttctctccttgtaaaaatttaactctgtttgcaggagagagtatttgacgaatacatgaacaaataaatgaatga

SEQ ID NO: 77372 - DNA, 1337 bp, Homo sapiens
tctgtccaaggcccccgccctttgttctgacccatactgcagggcctgcactgttaagtgggctcaggtgcttggacctgctcttggccgatctgagatctgaagcttacttaccacttgccttctttctttaatgtgtctgcctccccatcatacattccacagtgaattagtgtttctctctctctctctctctctctgtctctctctctctctctcatcaagtgtgatgtctgagaaatctctaaactctgctatccaccttcctggatcctcttgcttagatcccctggtgccggccttgatcccagaatgggaccatgtcacagtacaggcagaaactgatctctatgtgaccaaagtgtttgggctaccagaatctgtcttctgtactcagttcccccaccctggtcctgtgtcattccagaatgccttccatttcatgcagagatctggtatgcctgtcactcaggtcagacaatacccctattgctatccaggagaaatgtaactcagctggcttcagttccctgttatagggatggcacgtagttgacatgcctgccactgacccctcctgtacctgtggctgccctcttctgcagaactcagagttcttctcagtacaataccccaagccagctcattagagttgtcatatgagatcaaatctcttgctctctctgtaaggatgtattctctgtgatggttgtaccaaacctttcccactactgtgctttgcaggtgatcttgcctttttcttcatggagaggatcatggcctcttcctgggtttactgccttctcttcatctcttttctgtattcctttaattttctttcttcttcttcttctttttttttttttgagatggagtctcgctctgttgcccaggctggagtgcagtggtgtgatctcggctcactgcaacctccacctcctgggttcaagcgattctcctgcctcagcctcccaagtagctgggattacagacgtgtgctaccatgcccggctaatttttgtatttttagtagagatggggtttcaccatgttggtcaggctggtgtggaactcctgacctcaggtgatccacctgccttggcctcctaaagtgctgggattacaggcgtgagccaccacgcccagccttcctttaattttatttctgaggaaaaggggtctcttctttttttcctaattcctctcttttgttctggtcttctctcttcccctttttttgatctaagacatttctccatcagccattcccacttctgtttataatgcctatccctgcctgaagatatactcatatccatcctagaaagctgctctcc

SEQ ID NO: 77373 - DNA, 1043 bp, Homo sapiens
attttggtttcttcatttaagctaacttatgaaggatatattattagattggaaggaatatttagtctcttcacatttaggaagctcagattttgaagtcctctctcatgttaaacccatccggatacaaattcgattcatccttcaaggcccagctgttaagatatttcttatcttgaaagccggccctactctgccaccttgcaacccccaaaaaggaaattgtcttcaccttctgctttaaactcctaatctttcataaatatctttcttcttcatgctttttcatagttatttgtacccatgtgttatttccagtgtcagaatggaagctaaacgtgagaaggcatagtagggtattcatcatcacactccccacacccgtagcacagttttgtaggtcttgaatagatgacttcatcttatgtaaatgaatggcttatttcattggaaaaaaaaccacaggctttttattactattatttgttttactctttaaataccacactggcaccatgttaaggtcaggagtctagtcaagccccaggatgagttctaggcccagctctgcctctgacccatttttccacaaatcagtgaacctctctggactgcactgtcatctgagaaaaaagggtgttgtgttatacaatctggcaggcttctccagctctgaaattcactggtggcgtcatctatcatggagaatggcatggccgtctcctttattttccctgcataccacagatattattcagaatccaccacagcatgaatatagatgtggtctgtcagtgtgacaaagactgttctcaagaggaaattactgggtttgacagctacccaaccctgggtttagtttttgggatgtcactatagcaagtgttgtggccgatgtatccaattcctcatctacatatatggctgaatatgctgttcttgctgtaatagcatgagggctatttttcttttaattcagctgtcacataggaaactgctgccatggtttccttctatgaccaaatgttgctaaccctttcagt

SEQ ID NO: 77374 - DNA, 1038 bp, Homo sapiens
catgccctgacccagcgtccaagatcctgagtgcacaggcagattgccacatgatgatgtaaagtggcaatatcgaggcaccaaatgctcccatcatgactggagacgtttaaagttatatcctgatatttttggtgtaagaatccctttcttcatattacacaagggaaggtcaaaggacataggacatctaactctccttttttgaatattagaaattgggtgaaaatgagaatgtcattgcttgttgaataagatattttcaaaatcagagtattagtgggggctgggtcttaggaatgcaattgtaaaagggagtgatggatattcccttggcagaaaaattatatagatgttatatcacagccattataggggtaaggactgtcaccagcttgggtaaaacaaataggctcttctgttatgctgattggaagagtcttacagagctgagggcctaaaggaaagtgatttcagagaacatttactttttcaagtcatttgcgtctcttttgaaatgttatttctcactgtaatttttagcttcccataattcctttctgccagcagccaacttgtggagtatcattttcctggtccatctctaacaagagaaaatttccagtcattattttgtgcttcagaatgattctgtgtatgatcatgcaacttcagtaagatcacagttattaaaatgagtacctaatttagtgactatgactattggtctttgagtatctgcctgcttccaggtatagaaacatccataaaaacacctacaaatcatatttcattctttgtagccatacatagataacagtcatcagctataccttctgtgtgaatggcatgaccgaagaagtagacttcttgaggtcccaacttttatttcatgaaattttgtgtcttctctggaatggaaatgctttagtttttatttcaatggttttgtttcaaaattatattgtcagagattcccttttctgattgtcctgttgcacatgcttataagatggggagtatgaatgtgtgtaagct

SEQ ID NO: 77375 - DNA, 1038 bp, Homo sapiens
gggtttctttacccaggtccacaattcactacacaggtccagaaaaaaagctgatctctgaaaagcactaggagaaggcagctagagagggagaattctaattaggccggggtcctctgtggcttgaatgactgaataagtttttatagtcttcaattcagtgactgccagattcttcccaaagaaatttctagagatcaagagtaggctctttcggaagtacttgcccgtattacactttaattttacaaaccaaacaacagcaattcaaccaatcaaacaacaaaaacaatccaaagaaagagacttggacataggcatcaaggaatcatttcactttataatttaatagaacactggtgtatcattcattaattctgaaagtgagaactaaatgtaaaataattttgtaaggtttgtgaattgttgcctaggtattctggtgatgtttactttagtgattttatcattaatgaaagcaatgtgtttttttagaaaacatattattagggttcataacgttgacattctgttgtgcaatcataatctcctgttttgttttagtcatagctctacagttgaatgaattcaaagctcacctccaggccttttgctatggtttctgtttagctgaagtttatcctcaagtaggggtcataagaattatattccccactgtctttcatgttcaaaaatgcttatctgggtcattgtatttgaataaaaatatgtaatggattgaatgctaacatttttgagtcacattctttttctttgagaacattggttatgcctattttggaagtccttttaagttttttgctaatttttattttaattgcttgctttgctcttagtatattaccatgtctcttcgtgtattttcaacaatatctattctcctttgtgctgcatccaatttggcatttttctttttctgttttggttttacttttctcttacatttctttcttgagctgtatctgctgatgtctcatatccttttgttattttgctgtatcttgttattttgtagta

SEQ ID NO: 77376 - DNA, 1036 bp, Homo sapiens
actcaaagtctaacaccgttgttagagtgcatgtctctatatagtgctatctctggtactgagagaatcagcaaaatgatagggccagaagtgaccttcaagatcagccgggactgcactgaaggaaagtattattagaatcttaaattattccgatgagacaatctcagattaccttatctgtgaaatcaatcgtaaactactgcttttctcctagtaatatattaaaataagttttgcacaaatgttatggctgaagtaacagttgataggtcttattaaagtaagtgaatattttttattgttttcaaatagatcgtggatttttaactttggaagatttcaaaaaagcatttaggcaggtggctcccaaattaccggaaaggactgttcttgaggtattcaggtaaggcatcaaaatccttctgtacaccaccttttgatttaccatttgcttttacatgtttttgactttatggaaagaacttatttattctgatttttgagtctggaacatttttctcttgcagcatagtgtcatggtccaggagggaaatctatagttagctatgggtccttccatgcccctgacagtgaactgtaaagttgggggagcgcttgcacaccaggcaggtgcatacaagcacttatgagtaggggcaggagaggaacaggaagaaagaacttcttcagatacttacgtgtgaaccaagggaaaatggagctttagtaatatttagcatggatgctggtgtcctcacatggtctgtatttcagacaaacacaggttacatgtggttcttgagttgtctggagagaacagctggagttgcctgatggtagcccccttgttcccttgctttcaaagctactgacacatgttgctgttcacacatacctgataaagtggatttaaagattatattatgtggttcttatgaacaaatcctgacaaaatggacaagtggcttaaaagcagtttttgttaggaaactgcagattgaaggtaatattaatagtgcaaacacatgctgac

SEQ ID NO: 77377 - DNA, 1101 bp, Homo sapiens
ttggttgtctccagagcactgaacacttcacacagctgaatggcaactcttcatctcgccccaattttgctcttcccccagactttctcctctctttaagtagctcttcaagccagaatctacgggatattcttgacatctctttctttctcacctgccacatctagttcttcatcaagctatgtcatttagattctaaaatatatctggaaaccttccactcctctcatccccactgccagcaacctggcaaccacatctcttgccagtaggctcctaactggtctctctttttacatttttgctcccccacctccgtccttttatcaggataatagccagaaagatcatgtaacttcccaattcaaaccttctgttgacttcctattgccacttaaataaaacccaaattatttactgtggcccacaagagcctgtgagttttggcccctgctgccctccccaacctcatcttgtatcacttctctctggctcactttgttccagccacagcagccttttttcattttcccaccttgccacacaacagcctcggcacaggctgttcctactgccagcaatgctcttcttcccaacattaggcagttggtattgtctcatggtttaggtcttggcttaaatatctcctccttgaagggctctctctgtcaccagagtctacttgacatgaggattcctgtgaatctttttcacaacctcctgtctttcccctcattgcccatgccacagtttgtaatgaggtgtgcatttgcagttgaacctgtgtaatgactgccttccccaccagatcagtagctcccttgggactggaatcatgtgtattctcttttcccctctatttccaaagcttaatacagtgcctggcccatagtaggtcctaaaaggaatcatttaaaaagagacagatttctttttcagtttataaatctttaaatgtaaataaagatgtaggaaattaagaaaatcatttctacatttttttaaatgattggaactattttagaaaaggtatacagcttagtattacatcactaaaagaaaaaatgtgcatgtggttattgtatgtttggaggctatttt

SEQ ID NO: 77378 - DNA, 1045 bp, Homo sapiens
gttccccagcacaagctctctcttgtctgctgtcattcatgtaagacatgacttgctcctctttgccttccgctatgatcgtgggggctccccagccgtgtggaactgtaagtccattaaacctctttcttttgtaaatcgtccagtctcatctttatcagcagcatgagaaaagattaatacagtggcttttctgatacatcaagtgtgactattgctgaaggcattttaacattcattattctcatagactttctttcttctgtatgttctctgattttgaattaaggatttgacttcacactgaatgttttctttccttaactagttctctaatgtgcagagaggtatggattctggaagaaagaatacagtccccacctgtattctcccagctgtactctagtgtgagtgtgtatgtatgtgtgtgtgtgtgtgtgtttatttggagaaactcaagaccacaaacattcaagaaaaggagtaaaatagcctagcaagaaatcactgctgtactctgattgctgctaacatgcaatttttctattagaattgttcaatactgaaccaatttcaaaccatccactttttcttctttccctcttattgatacgagtcaattttacatgctatttctcttgaaggaagagagcacatgtgcagattaaatgtttttccacatatattatctctcttcttaatgtttggatcttgaagaactgaaattggcggggtgtggtagctcacgcctgtagtcccatgcaatttgggaggccaaggtgggtggatcacttgagcccaggagtttgagaccagcgagagcaacatggcgaaaccccatctctacaaaaaatacaaaaatgagccaggcctgatggtacatgccagtcccagctactcagggggctgaggtagaggattgcttgagcccaggaggttgagactgctgtgagccatgatcacgccactgcacgccagcctaggtgacagagcgagaccctgtttcaaaaaaaaaaaaaaaacaggtctgaaatgctggccttgg

SEQ ID NO: 77379 - DNA, 1092 bp, Homo sapiens
aaaagggcggaggtgagttttactcagtgatgagacagttctcagcagagacgggaccccaagtggatggcccctgccctgaccccaaggtgggcagttcgctggtgtgactgagtctggggcttttatgggctcagaatgagggagtgtgtgctccatggtttgtgagtatgcaaaaaaggctaaaacaaaggcaccactcaaaggtgggcatgacaatgtaaaaaaccaattagggaagggtagatatatgtaaagtaggtgaagggtggggattgatcagaggaaagtgtgccaagtgggaagaggggttatcaatccggtccgtggatttacccaacacttgtagcttggctttcaggctttaaactgtctttggtttgcaggtggggtttcactggggccctgcccctatctgcctagggatttgtctgcctcctgccgctatcacatagactatcatatacttaatatttttgtttgaatccaatcattcttttacataaaataaactttattttgctatttcaaatataacgtagccataagataccttctgttgatggtaaacaaaattgttggtgcctgcagaagagcccaaaccctgctatttgttcaaaatcaagattaaaagcatttctacaacactacaactttcttcttgatttaaacagggagtttggattggaatggaaagggaagtactttcataatgtcaggtcccaatcacttccacttcaggaaacactgtgccgttctgattgagtgccaggattcagaatcaacacagctatattgtattctgattctttcagtaccacttacaaaaagtgtgacttcagatttatgctgtaccaagcactgcccaggcagggaagacagatgataaacaattgaaggaaagctctcaggttctacatttcttaaaactgtatgacttgattacaaagcactctgaaatgctgggcaccagagcctctatgagggaagtaaattctgttactggtgaccagttatccaaagtaaaagtttgatattggtgtttactagcagttcttttccaactgggcgggagccttgatgtcataaaga

SEQ ID NO: 77380 - DNA, 1027 bp, Homo sapiens
ggtgctttccagtctttctggaaagtctttctaaactgtccacatttataaaatctttctagaaagtttttctagtcttgagttgggagatttcctggagagggacttgaatgggtacttggaggaggtagaagttcagagatctgaaaagaatatgtatcattattgtccatattgagtttctaaacttgatcaatcattcagtactgaagttgtagattttggttttgcattgttttataaaagaatgtatgataaatattaaataccatagggaaattttttttgaattttatgaaacattaaagtctgactttgtagtaactgtttagcttactgtgttctgagtcagatcttgattgtcagtgactgttgaatgagttagtagtgattattatgactagaggatttttgtgagtgtgaatttgatatatgttttgtcttctcagatattttatctcctttatttgggacgcttgtttcttcagctcaggtgagtatacctttaagctgttttttctttgggtgaaagtagacaggtaattaaacaactccataagaaaatatgagaggcatagtttggggatctcagtcctgttcaaagactgagatggcacatacctggaggctggctcaagtgccacagtaatgagatccatggccatcaacatagaatggggatgtcactatcaggagagcatttgactcaagtcagcctccgctggccaagaagtcactttggacattccagcttgaaagactagaatgggacacttcttttggggatactgattaactcatgggactgagttaactctggtgcatagagtggtgaggtatggatagagtggtgaaggccaagtcaagtttgatttaatttagaaaaatgtgaattttcatgttcagtggctccttcctgactgagctagtccctttgtcttgataaatcatgtaatggtccagacccacaagtaagtggtccaaagggccctgtccctgaagaaaggcaggcttcctttatgtttgg

SEQ ID NO: 77381 - DNA, 1039 bp, Homo sapiens
aggttcttttaaccatgcatttaagataaattataggtttgttagtattgcagcataaccctccaggtttataaataatacatgtagtgtatcactattttagagtttccttaaatgtaataactaaacaattctccttatgaactgtttggcagaattacctatggcttagttactcttcttttctcccatctagtttaactactgctttgacgtggactggctcgtaaaacagtatccaccagagttcaggtgagttcctcagggtgacagacaacactataaactgtaaaggggctttgacacctaagatttgtatttctcaggtgaaagccactcatcttttgagtttttcttttgaaactgttgaaatcacacagacattaagttatatccggaaaacagcattctttgatctatttaatcctacacattctttttacggattttagcattttcctctgtgctctttcaggaagtagataaggacaggctttaactcaaataacagaatttcatgtccagtcttaatatgaaggaaaataccatctccacataccttctagatctgtgaatgtgccaacatgccgccaacgtgccatgctttccgtagcacatcaattctgttctgttttgaggatccctttgtgtttctgagatgaggaaaggaggcttatctgtggccttcccttatctaggctctggaggtgatggatttttaggccttctgcctgcacttcatcagcctcatgttaggcaatacagaccaaatagggcatcacacaggtgccacccttccctatttctaacacatttacggggcagattcccataacagcaagtaggatggaggaaaacacacaagaaataatgattgtcagggtcctcaaaattcttggtacatttagggcatcagattgtggaaacctttgacattaacagtagataaaatgctgttaaaatttttcaagcagctttggcacttggggcttttttttttttttttgacctgtaacacacagaattagttttagctgca

SEQ ID NO: 77382 - DNA, 1025 bp, Homo sapiens
acacagaacgccatttacaagccaagctcctagaagctgggagagaggcttggaacagatgtgcctcacagcctcaggaaccaatcctgccagcaccttgatcttggacttctcgcctccagacctgtgagacaatatattgctgttgtctaagcctcccagtttgtggtgctttgttttggaggccctggcacactaatacagtatccactggactctcagtaactaaagggacgaaagtgtcctccttctccctgcatccccttattgccaaatgcatcttgggaaggctattacgagccttagaaggatgaggagtgacctaaatggtaagtttaagtaacatccagaatttgtatgtagaaaaattcagatcataaggatttatacctcagtatgctattgttcaggtgccatctttttgtaataagtcgtagaaccaataaatttgaaagaattaatgaggacttcagtttctatcagtcatatttaatctttttaataacatgacttgatctaacattttttatttctaggtgctagatgcacgtgtgtttcttacattattctgtttttcttacctaatttctaaaaatcacaggtgcgtgtttcatagtttcattttacctgtcatgttagaataaagctattgggcaagaggtagtgaggtattagtactggaaatagatgtttctctctagttgattgttgttcctttgtgaatggtagagaatcattctgcagtgtgattgataaatgtggaagtgggtcggttgtttatctttcttgattgcttatatccaatttttgttgtgttgggagagcttgtagaaatatacttatttcttttttttttttttttttgaggcggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtattt

SEQ ID NO: 77383 - DNA, 1065 bp, Homo sapiens
gaagctagcattccttaatgaggcgagtccagcttcatgaatgatgtattttaattaatttatttatttatttatttatttttgagacagagtcttgctctggcacccaggctggagtgcagtggctcaatctcggctcactgcaaccttcacctcccaggttcaagcgattctcatgcctcagccccagagtagctgggattacaggcacgcacaaccatgccttgtctaatttttgtattagtagagacggggtttcaccatgttggccagtctggtctcgaactcctgacctcaggtagtccacctgcctcggcctcccaaggtgccgggattacaggtgtgagccactgagcctggccatgaatgatgtatattaaatactaatgctctctttttaggaagaagccaatcctgcttgtgcatggtgataagcgagaggctaaggctcacctccatgcccaggccaagccttacgagaacatctctctctgccaggtaagccacttactgccgttggagagcacgcgtagtctgagttagaaggaaacttagacatttagtccaccctctcacttagtgcagaaatcctctctccagcatcagtcatcaatagatatttgtctagcctcagcttaaacacttcctgagatagagcatcccattcatagtactcctcagggttggaaaggtttttctttttgtgggcctgaagtcttcttactaatttctactcattggtcttaattttccccttctggagccacacagaataagtaagtctttcatcttacacatgtcagtgattcatatatctaaagtgatctgtcctgtctcccttcgttttctctctttaattcaaacattctctttcttcagttttactcaatgtagtatggattctgagtctttccgcaacctgctagtgctcccctggttgcatgtagcttgtcagtatgcctgttgaaacctgggtttcaacactgaataggtcctctggatgtagttcagtggctgtgggtttctttttgtgagtatcctgtgagtgcaacttaaaacttgtag

SEQ ID NO: 77384 - DNA, 1358 bp, Homo sapiens
tgtcatgtggtaaggaggctggggtaggtagtggggagaggttgcagtagtgattgccacgattatagagtgcctattgcatgcaggcccccgttgctcagcattttacatatgtgatctcgttcctgacaactctggatctcagaatggtaccgttttaaagaggagaaagctgaggcatagagttagatgtattttccagagtcatacaaagttgtgaaggcaggatttgagcccatgtactgcgttcctaattgtgaaacttttacggttatttaaactctttcataatctgcatcttgtgacatattctgcttaaccaagatctggcattagtgggtattagataacatgttttctatatacataccctccattagtttgtaaaggtgtcattttataacatgaaaatggatttcatatgtttttattttcagcacttgctatgctaatataagaacatttctattttaatttaacatcctaagtctttatgttgccaccactttcagtgtttctttttttgtttttggagacggagtctcgctctgtcacccaggctggagtgcagtggcgctatctcagctcactgcaagctctgcctcctgggttcacgccattctcctgcctcagcctcctaagtagctgggactacaggcgctggccaccacgcctggcaaattttttcatatttttagtagaaacggggttccactgcgttagccaggatggtctccatctcctgacttcgtgatgtgcccgcctcagcctcccaaagtgctgggattacaggcgtgagccaccgcacctggccttcagtgtttcttttaaatatgctctgaaaactgtgtaccattaatttctgtataagccaaatatctaaaactttgcatagagactcacttgttttactagttttttgtcaactaaagaatttaggcttctcagtcctaattactgtaattaaaaatgtagtatatattctgtagtgtataatcattctgggtaacaaaatttgtgttttttttttttttttttttaatgagcgtccccagatgctattataaaagctgtcttgttattcaagggcttgcctggtagagatcagtaaaaatagttttaaaaaaaaaagttgacctgattgctttctaatgtaatttccagtagatatggatattagtgagttgtttttaaataaatgacttctttttcatcctaggcaaagttggatattgcgtttggaacacaccacacgtaagcactttttgtgaaataggggaacccctcaagcattgtcatttgtccattacacggttattcttaggagagactgagcatggtaggcccacctaggatct

SEQ ID NO: 77385 - DNA, 1016 bp, Homo sapiens
tgacagagtgagaccctgtctcgaaaacaaaagaaaatgcctaggaaagtaattacagttgaacttttcccaattaagtatctgtagtttacattttgttgaaatgacattatcttgtagaagattgagctcgtgtcttgaaattacttttagttgcttatttaaaaaaaaattttttttttgttgagacagtctcgctctgttgcccaggctggagtacaatggcgcaatctcagctcgttacaacctccgcctcccaggttcaagcaattctcttgcctcagcctcctgagttgctgggactacaggcgtgtgccaccacgtccagctaatttttgtatttttagtagagatggggtttcaccatgctggccaggctggtctcgaactcctgacctcaggtgatccacccgcctcggcctcccaaagtgccgggattacaggcgtgagccaccgcacctagcgtatttttaaaatgttttaagaattaaatacttcttatgttcttgacacagctcaagaggatatagagtttttattcttacagctttttctttggtgagagaagcaagacaaacatgtgaattagaaaaggagaatcaccttccagatcatagtgatggagggtaaactgccttccccacctcacagggtagagctagaaacagtgaacgaggcagtctttgagactgcatacactttggcacacaagccctgctctgtccagttttggttggatgccatgcaatcccgtggtctgtctcacagtgttttagaatgggaaagctctttggtttcctctagagctgggagcagagttaattcttatggctccaagaatcgatagaggggaaagagaaagccaaagcagctgaatgtcaaatatccagatccaggtggtggccagtagcaaaccacaggatgggcgaggcatgcctctttccactaagatctgtagtcaggcccccaccatgcatcatttagtcctctttcccaccaaggccatgtctcccccc

SEQ ID NO: 77386 - DNA, 1039 bp, Homo sapiens
tgctgggattacaggcatgagccaccgtgcctggcagcaaaatgtatttttgcatttcactcacaatagtcctgaagtggggttgatccttagagatacaagtggaaaactgaggctcggggacattgaatggcttacctagggtcaaagggcttctaaatgacaaagtctggagctcaggtcttcagacttcaaatggaaagcttttatctatatcctattccctctctctcactgcaattaaaataagagaaatgtgttcgactagaggcctggggaggtcacatggaaaaagagtggaccccactaagtctgatttgggttaatgaagaataggcaagacttaccccaagcccagataacacacttttgacaagtgtggcatctatggatacaaaaaaccactaatggtaatgaagcatcttttaaacttcttaaaatttcaactcataataagaaatacactttacatttcagtgtattgtgcactaacatacctttgtgccaaaacaaaatttcatgaaccagtaattaaatatatacagtataccaatttatgctattttagttgtttaaaaaatgccagccatgatgcagcaagaggttgttgaccatactttgaatctcaaacaccagaccagaaggttccaacggtccctagtagtaacaggtaatgctgaatagataataaggggccaggctggagggatgtgaagtgccaggactggcactagggttgaaagttcttttaccaccaaatactcaacctttctgaaaggttttcatcctatcacttaggcagactttcatcatggtaatgtatagaagggaagattataaatgttaagtttgggtaatatgagagtttaaaaaaattcctttagctatgtattacatttgcattggaaaggtattacatattttgaaagtactattaatgctttttgatcctttgctgtttttaaaggaaaatgatgctgctgctctatgaagaaggcctccgggttgtcatacacacctccaacctcatccatgctga

SEQ ID NO: 77387 - DNA, 1205 bp, Homo sapiens
gaattcttaactcttgtcatcaagtcttagaaagcaatatataggtgcagaggtaagaggagcaataaggaaggtttggcaagtgagagggagcatggagggatgtgggttggaagaggtgggcagagcccaggtcttactgaatcttaaattcatggcaagacattcaggaataattctgaatgtgatgagaaaccattggagtggtgttctcagatttatgtttcatgtttcctaagattacttaccatgtggagataccgagaattcacctctttcttaggatgaaggcataatcgatacagagatcattatgatcagttgtgtgcctgactgttaaaggttatttttttaattccagaatatggttgagccccttatacccacgaattgctgatggaacccacaaatctggagagtcgccaacacattttaaagctgatctcatcagttacttgatggcttataatgccccttctctcaaggagtggatagatgtcattcacaagcacgatctctctgaaacaaagtatgtgtcagcttatcaatttggggtgcttatgataggcttataccttgggagcctcatgaggtctggcatgcaggggcctggaaagaggtggggtgaaatctagccaagcttcaggatgtgatgaggggatgagcagattctatcacatctgtatcttgtggttctcaggcattaaagtgacagccagtgaatcctcatgtttaccttagcctcccactgggttactctcacaattattgagttctttgtctggtactttacatcttgtaggcattccatcattagttgatttgcttgaaaatgaatttgagagtcaattcaagaaaatggattggctcttagatcatttcttgattatattagttttcatgtgtattttgtcattttttttggtgcccaaagcacatcactatattttataacttgtgtttttatgtctttttagtgtttatcttattggttcaaccccaggacgctttcaaggaagtcaaaaagataattggggacattttagacttaagaaggtaacagaacttttactattttaacatttttaaaaaatttaatgtatattctctcttttaaaataattatatattttgatgcagcttcacaatatttctgcacaattctgggcaaatagatacttgataaattgataattataattctt

SEQ ID NO: 77388 - DNA, 1781 bp, Homo sapiens
caaataattttggaaaggagaacttctgtccatctactccattaaaaatatgtttttagtatttaaaaaaaatttcccaaagaagaagtatgtatgtgtgggtatgaaattgatcactagtattttcagcttttcttgttaattaggctttccaagagcagaaaactgttttcaaatattgcagcatttctgttaagattatttgagtcactttaacattcacttttattctttcccagcttctgaaagaccatgcctcatccatgcctaacgcagagtcctggcctgtcgtaggtcagttttcaagcgttggctccttgggagccgatgaatcaaagtggttatgttctgagtttaaagagagcatgctgacactggggaaggaaagcaagactccaggaaaaagctctgttcctctttacttggtgagttctcgtcctcattgaggtagtttacttttattctctacacaggagaagaattgaaaattggtcctctttgtaatggagagatgttttattctgtgattctttttttttttttggcgtggcgggggcggggtgcggaaagagcagtacattagcatcgtcatttgtaatcaagttgcctttgccttaatatccagtgctaagagcttgccgattcgttcaggagctccattgcagacacagactggcctgtgatttttctatcctttctttcaggttgttgaaccaaggtagaaaatatttgatgtagcacagccagcagaattatgggcattttaattatttagagaactgtgaattaataattaattttccattcaatgttaacttgaatttcaaaggaaaaaatactccaattgaagtataattttacatcaaatatggttcctgttgtttaattactagttcatttttttcataagatgagaacttttaaaaatttaaagcatattttctaatttaaaagtatttttaacagattttcatttccttaaaagctgattatcattccttttcttcaacatggtacattccgagttttattgttttcctcttatttttagatctatccttctgtggaaaatgtgcggaccagtttagaaggatatcctggtaattcttggggagactgtcttgattgtgttttatgtatatttcatgaatgtcctggtaaagttttactactattgcgtagaaatttggagatggttttcacttaactatataaggatcatgaaaataggcaatatgaagctctgcattccgcagatgatacccttcagtttgggtgtgttattaatccttacagaaaccctctgcacaatagttttcatttttaccagtaaggtaaccagcaggttggttgtccagacaagatagccaaataaaatcagcttccccttactcttcaatgcgttttcagagcttatccaacataccttcctctcatctctgcatatcctcccttcctgtgtttgaggtaccatgtggtccttttaaatgcctgctatagataacatttaaggtccggaatttttaaaattttgcctttggtataactttgttgatatgtctattctgtcaagggtgtcatctgcaaatgcctaagattttttgtaggcatctgtcaacgctgtccctttcccttatactcataccaggcactaaacctttatttagaattcagcagccccgctagttagtgtaatcaggagatgttaactgaaaacccacatagtggttgtctctggaaaaagcaaagtctaattggcatttgttgatggctgaaagcag

SEQ ID NO: 77389 - DNA, 1060 bp, Homo sapiens
ttaatgtgttcataattcttgctctgaatgttgaatgggtttctaaaaagtgattagcgagttgtcattagttttcagtatgtttgtgttacatgagccttatttaaaggcatcccatgactatacttcgtaaagtatatgatcatcacttacttttgcttataagtctggatgtttataagatttgcataaagttaatactgaaggaaggaaacctcgttaagagaacatatctagtgcaactatagacattttctttcaaataactattctataagatgaagtaatagaagtagtttttttcctgttaccttcttgctgtttattgtagattttcctcttaatgagggatcctcaaattatatttcataatttttattgttttatttttcttttaaaagctgggggctctcttccctatagcatccagacagctgaaaaacagaattggctgcattcctattttcagtaagtaattggtttagactgctgctattgcttctttaggaattagagtgttatttatgtcactggtttgtttttttttttaaaaggaactttatgtaatatagctatattctttcatctacatatgttagtgatagaaataatttaaaacaaggttttgaattttttttggaataggtttttaataccaaagaggaaaatttattgctgtgaggtttctatttaaatattggcatgccaagaaagacaaatagaagatcatgttgggtagtttagaatttacataagcagcattttagttcatttttccaaaatataaagtatcattattctgtctgtaccgtcacacatgcagctgcaagcttgttgagggcagattctttgctgccgtttcctgaggatacaggacagtatctggcgtgttgtcagagttcagtaaatgctgagtggacaagtgaagggaatgtccttcaccctcctccagccacagcagttgcacagcctgcatatgcaaggccagtctgtttcatgcttgtctcaacaggtgtttgctgtgctggttagccagaaatgaaagcagaattactttgaa

SEQ ID NO: 77390 - DNA, 1023 bp, Homo sapiens
ggaaaggctatatgctgaaaggttgcagtgcttcttgtgaaaagtgggaagtttataattctaaaatgggcatgcgttacttgaatggagtttcataaaatctcacaggtcacagagtcgtgtagccactgttgatttttagataataggctctttgttttcatgcagtttcctaatattaggattatgatcaattttatttcataattagtaacttttgtcttttctgtcactagcaaatggtcagctgagacttctggccgcagcaatgccatgccacatattaagacatatatgaggccttctccagacttcagtaaaattgcttggttccttgtcacaaggtaaatagtccttacattcctgatgggagaaatctttttaatgtgttcataattcttgctctgaatgttgaatgggtttctaaaaagtgattagtgagttgtcattagttttcagtatgtttgtgttacatgagccttatttaaaggcatcccatgactaatccctttgtaaagtatatgatcatcacctacttttgcttataagtctagatgtttatcagatttgcataaagttaacatttacttctgttatttaatacctcaataggggttatgcaaattgacatttggggtaagtacagaagaataatgaaatgttaaaattaatatttttttcttaattagtttctccttaggtaattgaaatctgaagcaatcaaatctcttatgtgtccttttctaaaacatctttaaggtgtaattcacgtaccataaaatctgcccattaagtctctactgtttaatggtttaggatagtcacagaattatgtaaccattaccataatctaaatttagaatattttcatcaccctataagaaaccacctacctgttggcatttttgtgtctatttttataggaagataaattgctatgccctttgaaaactagaactttagttcctgactcccaggctgaacccaacgattaggcatctctttatgattcagtaacataat

SEQ ID NO: 77391 - DNA, 1426 bp, Homo sapiens
agacttctcaactgcacagcaactatgaaggtttaaggtgccaactatggtgacctgtgggagtaagaagaaaggggcaggggagagaattgacctgcattaagtagccaccatgtggcagacacttctggtgctttacctacatagtagtgtctttcagtccccacaagagctgtgaggtggcgttatcccctccctccactcaatgaggaataaggcggcagagttgaggcagttctacccattactcagcaaatatgtattgcccgctgtggcaagaatagagtaattaagatgaggttctcacagaatttacattggcatgaaagagatttaccaaagaattcattgtatacatattagttaattgcacttgtaatgctttttgactattctacataggtgggtttttagccaaaacatcacttctggagcctggtggcttccataatgccctagattcctgcattgtcagcgttctttccctattcactgtggttgcttgtgtaattatctggcttcccctctagactctgtgaggccaagtccatgcctgtcttgttcagcataccctggtgactggccaggtgcctgacatgtggaggctgatgaagcctaggattgaagtggtaaccatgaaagcactgcctagactgcataatggaacatgggagggccctcaaaggtgattcctgagtttggggtatgtagatggggattgtcactgatatcagtatagaagtcagggaatggaactggcctaccacagtgggatgatggtgaatttgattgaagattgatttatcatggtggagacttcaggtggaattgtttgttggagatgaacttaaaagtttggtgtacatatagtatgttttggagttttggttagtactgattgttaacaccgtaatcctttgcgacttccagaggagaatatagcggatcaacgcctgggcattgaggaacatacaagaaatacatatcaggtgggcttttcatgcctaccaggtgttccattgccaaacaaatgaattggattcaagccatccctcctgggttgaagagcaactggtcacacattctccattacataatttttcttctacctaagaaaaatgttttatatatatattctattttgggtatcagatttaaccatttatccagcacataactactgagcacctactatgcaccacacacttttctaggtgctaagaatgcaataaacaataaaacatcttgacttttatgttctggtgctgggaattacacaaaaagcaaagaagtgtgtttatgtatgcaaatggtggtaagtgctatagagaaaaaatagaatgataatttaggtgcacaatcctttattctaaattcttggtaccagatgtagttcagtatttggattttagaaagataatatggt

SEQ ID NO: 77392 - DNA, 1035 bp, Homo sapiens
cgtaaaatcatcccatgtttgatgggcagccggttgttagggaaattattgggacatgatgacaaatgtggtatttaaattttaccacaggactaagcaggaggaagatgaggtttaagagaagccttggctaagaggatagtgcctaggtgtaattggcaaacccaatgagaacagttacgaaagttgtgtattgtgggtggtcagaagcaaggtgggtacctaacacatgctggatcactgttagagttgcctagcaactgacaggcaatgcggatagtcagggatgagcagaaatgttggtgctgccacttcgggagaaaacgagacaagtgcttgactgcaaaatcactggctttttgaggaaacataaaagacattctctctcctctgcttttcaatattactatgcagtactccttctctaatgtctgttgctttgattctgaaacaaatcatctctttttgttctcctttgtctgagtattttggtgaaaataaaattggattacacaagaaaatacttacagatgtcattgggtagacttgcttgcctggccctgtggctctaagatattgggattagctggtatgcttcatgtgctttgttacaaatgatggttatcagtactaacgcctacaagtgacttcctttatacgatagagatgactcaaggtcatattactaccctcacctgcctacatctggtacaagcagagtgaagacagagcatacccctttctgtactcatatgagaaagtcttgtgagcatcatcactgatggaaaaaagcttgagacccctgacttagtgcctctagaccctttgtacactggcattgctagtcactaagtgcacatctggcttgagatgaggaggtgctacctggaatttcccaccagggactggcctccaaagaaagcctctcacaagtaatatagcaaatacttgtatggtgcttactatatgctggccaagcgcttttttatactagctcatttaatcacccaaattgggagctaggtactgctacta

SEQ ID NO: 77393 - DNA, 1701 bp, Homo sapiens
ggtgtgagccactgtgcccagccgagacagcagccatttttataactcatgcgttgtcactgtgtccagcagaagctggacctcacaccctcccaagtcctccttcagcttttctaactcctggccctcaccaggtatgtattttttctgtgatgaaggccctgtcttctgcaagacatccacacctccagtgccagaggcacaaaaaccacatgggtttccatcctcacagtcttcagtccctgcctgtggctccagctagttattctccactttatgcctgtcctcctctggcttctgcctgctctgtagacttctagctccagcatcaggacaaagataacacccttataaagactttaaccagctcctacaattacatgataataaattcctttaagaaatacacacacacacacatatgtatacaatttcctagttatgtttctgtgattgaaccctgactgatacacccccagaagctactgtcactcaacatgactttagtaagggtttgggtagtgtttctggtagatggtagaccatgggacctccagagttctaccctaatgatctaaagtaaattaaataccccacccctctttagtgatgaagcatcactcggtatccagcagcaacaacacaaaccacagcacttgggagagaaagcagcccagtccagtagaaaaaagaacaatggaagagtgagggcagggggaacaaaatggtgaaaacgagttttcaacagaagccaggacaggcagtggacaatggattccatgtggagaacagaagctagaactctttggagttgtgggagcaagagacccctgtggtgtcgctgtgcctcatgaaagacatagtgcttttgctgtacatgacgggcgtgtgtgtgcacgcacacacacacactccccccaccctccctgcctcccaaccccacaagagtttggaaataccccatcttcctggctgccccaggtgcccgtgattcaaagtattaacccagaatgtaaaaagttattaaagatgatatctcagggaatgttgatttatcacctagacaacctgcaagtgactttcaggctctcagtgttcacagtagagtttctaaggttccaaatgcttagaaatctgttacaagccaaataaaaggagggattggaggaagccatctgaaaggctgtccttgtgatctctgttgaacattactttggaataagccctcaaatcttggaatgctaagaaaacacaactcatggggaaagaatgagaacagccttccagaagatacctcccgtctttgttgtcatgatactgatagtcaagagttggccagaaagcgatcatctaaaaactgagaaaaacacctcagacccactggttggttttgccgttagactttcctcttcgcccaggagatgacctgttttactaacaggtgaaagacctaaaagcaagatgtcatcttggacttttaaaaaaagtttttttcctagaatcataataccagtttatcataaacatcagcttcctcttcactttatgtctcaacgacgttatagacagtgatgttcatgattgtggtccttgtgcaaaggtttcctgtcctcaatatggttcatttaggaagccaggaaagcttgtaaataatgctctatttgcttaagtcagcctaatcgcttcaagagttttccttag

SEQ ID NO: 77394 - DNA, 1067 bp, Homo sapiens
agcttactgaacactcaccagtctgggtgcagtgggatacctgctttcaaggcatgtacttgattaggaattgactgtgtgcttccagcgaaattaataacatttaaaataaatattgtgaactacaatgtgaagatttatctcgaggtggtagatgacaagtcaccaaaggaatggcccaatcaagcacaagttgttttaggtaggggtgactggaggatgaagttgggaagcaggagagcttggcagagtatttgaaagatgcttaggatgtaggctgtatagagagaggtgggaatggcatcaacgttggaaaggaattggtagtagcacaaactgggaagcagagattggttcacatcatcggctagagtttggctgggcggggccagtggggtggcacaaaggacatgtgcttctggcccagtaagccccctggaaaagcaccgtgtcgaactggtctttcgagatgtccagcacagccagcttgtctcctagctctggagccacttgagatttctgtgtccaaacaccagaaagagtggctgtgtccaaacaccagaaggagtggcttgcacataggggctggggtgtacaagccatctgtttctctaaatgctagaatcacgcttgacccagagagatattctcaccataagaggcacatggactgagatctcccatgtcacctccttatactcactgtgggtacacacacacagaatacagaatcgcccacacaatgagatggctaatgctttttccttccttcctcccttcctccctccctccctccctcccttccttccttcctgtcactgtgggcacacactcagaatcgcccacacgatgagatggctaatgctttgcccacatgatcagatggctaatgctttttccttccctccctccctccctccctccctcccttccgtccctccctccctccctcccttccttccctccctcccttccttccttccctccctccctcccttccttccttccctccctccctccctccctccctgcctgcctttgtccctccctccctccccgccttcctt

SEQ ID NO: 77395 - DNA, 1043 bp, Homo sapiens
ccatttctctgatggccagtgatgatgagcattcctggcaagaatttctctgcctgttcctactggttgtcaccttctctctcccctggatgaactgacccttccctccctgttttccccatctcaggctactgctgggtttctacccacatgtcagggtctgtgttcctctgcccttaaaccctcagcagcaatctttggcccacgagatgatgtccggactcctttgtgtgacatcaaggtccactgtgagctggaacagcatgtcccccaggctccagccacccacaagtatttgttagcatattaatgcacgtaggctgtagcagcaatggcccctttttactagcagtgtgatcctgggatctactgctctttgtctcagagactctgaagtaacttggtaagagaatatggggaaacacattggacagatcccttagggacctcagatctctaggagccaaaatgagagaaagagaatgaactttgaagtgagacagagaggagctaggatcctgcttacaagctgtgttagatttggcctccttattctacttccgtaggcccctttttctcgttgtacaatggaaacaatgtaactcataggatctcatgtgagatcaagagttataacccataaagtgtttacaacagtgcctggtacttagcaagtctcagtaaaggttgcagttgacattagcagtagcagcaacagcatataagccacacagttcaacagaaggttgaaagcaggggctgatactccatgggttttcagtcaaatcagaatcttgatgtcacttctgtgatgacgttgcactcttttctttccttctgaactgcattcccccagccccacacaaacagccctttgcttatcaaaaacccatccttcaaaatcctgttaggtttacacttctccacaaagcttttcctaagcccctagctggaagcacttccagttgttgatcctatactgccttgcaggaaagatgccaccaccttcctataatttacttccttgccaattagttggtctt

SEQ ID NO: 77396 - DNA, 1083 bp, Homo sapiens
cttctgggaagttcagctgctatcactgttttatccaggaaagcctgatgccttgtgtagggttttaccacttgaggttgctactcggatagctgcaaataaaaacataaattacatctctaactgaaactgaagcatgcctcctgttccctatgattgagctaagctgctaaacataaatcatcagagcgacaatcagctctttcactcccaaagctgaagaaaggaaaagccagcaatttctcatgtgtgatatatgtccaccctctcacctggtgttttataaacgtattgtcttaactgtcttctaagtatctgtgcctgggagggtgccttcctctgttttgtaaaatgccaagtgataccactgtgatatataaataatgataattagaagacagcctcaaattatttgacattcagattgaaggggaaagtagtacttttttttgtaataacctagaatttggatcagaaatggcattcaaaataaaagcatattggtttctgtcagacagggatagttcaaaccttctcatatctgaggtcgaatatcacaaaatggagtcatgggtcgagcacacagcctcagatctgggcccaggctgtaaagaaccataacctgtggccacgatatatttgaaaatatcaggactaataggagctaaagaagagagaagtcattttttacctgaaactccataaaagtataataatcattaacttggaatcacttcccagccactagcctctttgttttttaaaatgtccaaataccagggtttctagaatttggctcatcttgaccctgcctgccttaaattttcaaggaattcttcctttgtcatagttcctggtggtgaatgtgagaccatttgtttgcttggtggaaggaatgtaggaccaagaatcagaaagacggtttgatttccagccctgccattatttttttttttttttttttttgagacagagtctcgctttgtcacccaggctggagtgcagtggtgccatcctggctcactgcaacctccgccttctgggttcaagtgattctcctgcctcagcctcctaagtagctgg

SEQ ID NO: 77397 - DNA, 1007 bp, Homo sapiens
gggacctgccaggctctttgccacctctgggcctttgcggatgctgttccctccacctgcaacataattctttccactcccacctgaccaaactctgctcatctttcagagtttaataaaggtgttgcttttttaagagaggcttccactgatcacccgctcctgccaagtctaaaataggcctgctattctcttatggcactcctttgcttttctttgcagcacttagcacaaatagtaatttttattttacttttatagatgtattttatgtccctccaccagactgtatactccatgaggacaaggatattgatgtttatgttaactcttgtacactcagtgcctggcaccatgcctgacccagaagagggactcgagaaataaagtgtcgaatgaacgaatgtgcagacatcagtcatttactcagcttaataaatgccagagaaaagtctagaacccagattatctgaagcccagtcaacacggacctccccatgttctttgacactgcccatgaccagcctccgcttgctaagttgcacctcagtctttgttctttttatgggttcctaagacatcagcactgttgggtatgtgcctattgaggatttgaagggtggatatgtgtgtggatgggtggacagaaggaatgagagacagacggacaagcagaatgccaggatgatccacgaaggggcaggagttggtcaatgtatggaagcacgagggggcacatcggtcatgtggtaagcacctgcactgcggcaggccttgtgttggaaggaagtggcagtgtgaacatcagcctagatatagaacctccacttccaccctgattaagatctaaaattaataccctattctagagttcttggaataaaccttccattttgataggtcttaaagaattttcatttttatacttctgtcacattatattggaacactttcattatacatgaaagcagcttttatttcttcttactccaggcagcctgttacta

SEQ ID NO: 77398 - DNA, 1034 bp, Homo sapiens
gcatgaattattacaaggcaagttgttctctcatgggacaatttaggaggattgcataaagcaggttttcctctcaaccagtgagtattaatgctgatttccaggagtgatgagttaaaagaatcacaaccaccttcttttctcctcctatggttatttttctagctttgcctccaggtagtgatgggcttttcagccagctatagacattctactcatttaaacagcagagtttagtttttgtattggaaaggctaaaaactcaaaaagcagagctacagggaatttgccaacagagtggttaccaggtccttgcttggtcatttatgacctaattttgagggagaggagtaaatgcaacagtgatatttaagttactggctgagtggtaaatgcttgtatcaaaaatcctgcattgctgaatagtatgtctaatagcactcatagcaagaattgggtgtcattggccttgggaatgaagcagagctgatgttacccaacagaacagtatacaggaaacgatgggtaaataacagaagtccaagcacagatggagtttccagtggaagagagcaagggcttgctgaggccaatgagtgcaatggggagtcagatctgtcagccctgccagaccctcagcctcttaggaaacaagcatgcaacacagacccaggtgtatggctctctaacaagcttgtttagttaacaaagaagtgtttggtttcatgctttcagaccatcccaaagccagagacagacaaacagcgttctgatgatttgctgccatctttggtattttttcctacctatcctgctgggtgctgctgttcgtatgatggctctgaacaaaccgtgaggctgcgagaagacagcagcagataccattgtttgtcagaccttcctgtgacctaccatctgcctctgttcaagagaaagggaaaggttgccccagaggcgagttcgcagttgggagacactgctttaacttggtggtccatgccagacccgccaagaagcagtttacaatgtgcatt

SEQ ID NO: 77399 - DNA, 1133 bp, Homo sapiens
ttacaagcatgagccaccacgcgctgccttattacacctattttacagatgaggaaactgaggttcaagggagttaaataacttaaagtccacggtaagcaatggaaccaagactctgctgtctcaaaagtgcacaccttcctgcattgcactacacacaagttcagcttggttttcctggattctttagtggaagttatatagttatccctaatataaattaatacagtattacgtgatttccagtgtgaatatggtactaacaccacattatgcctaggtcagatcctcttataaaatctttgacaaattttccaagtttagtagcccacttatttcaagcaaatccaggacaaaagaataccataaactgtacaatttcttactgtgtttctatcaactagtaagtttggtggccattgcttatataataggattcacacatccaaaaaatgagagatcaaaggtggtctgtggccatatgcccctgggaatgtcagcaatgacatgaccaaggcccacctggaggctggtgatcaactcagcctggtctgtgtccactggtccttgagcattaacattggccagcaagcactgagcgctttgtgccaggaactcttctatgggttttgtgtttatttaaattttcataaccttatcaaagacataccaccgtcatctccatttacagatagagaaataacagttatttttgaaaagtcgcatagctggcaagtggtggagctggaatttgaacccaggcattttagctccagggtcatcctatactgctgtgaggatccaggcagcagatgttcccaaggtccagccaaggggcaggctttgagatatggcttggctgtgtccccacccaaatctcatcttgaattgtagctcccataatcctcacatgttgtgggagggacctggtggaagataactgaatcatgggggtgggtttttcccatgctcttcttgtaatagtgaataagtctcatgagaactaatggttttataaatgggagtttccctgcacgtgctctctttcctgccaccatgttaagatgtgcctttgtttctccaccatccgccatgattatgaggcctccccagccacatggaactgtgagtcc

SEQ ID NO: 77400 - DNA, 1050 bp, Homo sapiens
agataccagagatggggagggcaagaggcagcccacactagcgggtggtgtgcagagcatgcaagtcttggtgcaactcctgtcccgtatttcacagagttccaatcaagtctgttttaaagcagaattcaatcgatgtgtataaattatattttattcacagtaggcctagaaggagctccacagtctgaccaactttatggttcatgtatctaaggcacatgttgcagtgtctcctgttccctttgtaggaaggttttcaaagagccccttgctattttttgttgctgttgttgttaaagagatggagtcttgctctgtcacccaggctggagtgctgtgtggcacgatcataactcactgtggcctcaagcagtcctcctgcctcagcctccgcagtagctgggattatgggcacaagccaccacacctggcgtccattgcttttatcaagaactggaaggcatctggaccagtcacctttttcattatacaaaaagagaagcttagaaaggaacggcaaaggggaaattgcatgcatggggcatttattacgggtaactcaaatcgtaatttatgatcataggtatatacatcttcacacaatggggcaggtgatactatcttaattttattatatagagggaaaaataaggttcagggttacacagctggttaatgaacaagatctgtgccccatctgaggtgctaagtctatcctagctaagccaatgctatccctttctggacctgaggacatagatgatgctactgtgtgtgccctggatggctgtttgctcataggttctttagaaattaacagttaaactgaatgctgattttgttctcatataattgacattactaaaatttaaaagcctcaaatgtttgctactcaatattttatgaatatttttatgaaagaatacattaggtttcttttatagttacaagaaaccaggttaattagatttgtacaatgaaagagactttaacaaaagtctggcaactgtgctggagccagggaatccctaatgtaacagactgtct

SEQ ID NO: 77401 - DNA, 1064 bp, Homo sapiens
cggaaggtgagatctgagcgcggcagcggcgccagcgcccgctacaaggcggggtctcggggagggggccccggcggtttgctggagagccttgctactgttctgcatgaggtgggggatgccttctgcgcggaccccgcgtccaggcaaaactctggaacgcactaggcagccaagcccggggggaagagatggaacgctccaaggtcaaggtctcctggccgcggagcccttccagcccccagtgtttggcctcctctccggaagcggggctggctcgcggtgcgcgcttggtccgggcggagcctactagtaggcgcagaggacgcccccgcgcaggatccagagaccaagggcgctctggcatggtcaaggcgagggaggctgcccgggggagaagcccctaacttcctttgctccctgttccaacctccctttctggtctcctctctccagcccgtccgcccaacggatgcgcagcgttggggcccggccggaggtcggagccctcggacgccgcagccctcggacgccgctcagcacagcccctctctccgtgcgcccgccctggaccccctccatccctaagccccggcagccgattcggagactcgggaggccacaggctcagcgcgacaccacgaccacaactaggaggcaccatcgtcgatctacctggggaggcacctacaaagccagcagactgacacccgtgtcctagccgtcggcggcctgcgaagcgatagtcaaaggaaccaggacccaggaccccggcgctctgcttacccgcagacctccggaccgcgccccccccccgccgccccgccccgccccgccccgccccgcgaccgtctctttgcgggaaactcgagttggctcgagcttgccctgaagacgcgccacgccccctcccctatctgagccggacagggagccggggtggaaactgcgcccgcatcccagcgccaagcagacgtgaactctgcgcccgttccccgggaccttcagcgttaaggagaactccgaggagagcagggggagtggaggggaacggcggcgacaaa

SEQ ID NO: 77402 - DNA, 1065 bp, Homo sapiens
acctgtatcatgaacggcaagaaggccagatctcatagaggtcttttttattttaattttaatttttatttttttgagacggagtcttggtctgtcgtccaggctggagtgcagtggcgcgatctccgcctcccgggttcaagcgattctcctgccttagccttccaagtagctgcgactataggcgcccgccactacgcccggctaatttttgtatttttgtagagacggcgtttcactctgttggccaggctggtcctgaactcctgaccttatgatccgcccgcctcggcctcccaaagtgttgggattacaggcgtgagccaccgcgcccggcctcatagaggtcttatacggatttctgggtagtattctaagcatgtaccaagtacttttccagcattttctcatttattacaacagttccctcgaggtaattactactgtcctcattttgataaggaagaaatggaaacacagtaagtggctgtgctggaacacaagccccatcgttttttttctagaacagtagagaaacacccaggttttggcattcagcaaacctgaatgtgattcctggctccatctctgacaagctttgtgacaacaggcaagtcatttaagctctctgggccttggtcttcttatctgcaaatgagggggtaatgatggtaccagtgtcatcgtgtttgtaagaattaagtgggataatacttggagaatgtttaggacactgcctggcatatagtaggggttcagtaattgatgtacttgttatttaagactgagaaacatgtaaaatgcccaagaggtgaagaagtgttggtgtattaatttagaagtgcctgtgtggagctgatttgagggagctgagtgggcccttctaatcagtaagttcactcatctttatatttgaaatgccaccatttctgagacattgctcagtgttaagcattgtcctataactgtagggtctcttaaaatcaggaatcccactgagtttattaatacactaagttcttaacaccttaaggtgatggagcttttcagattgagaagaaagac

SEQ ID NO: 77403 - DNA, 1033 bp, Homo sapiens
aactttatatttaaatttcagtgacacctcacactcagtgccggttaaaattactgaagttagagagaattaaagactatcttctcatggaggaagaattcattagaaatcaggaacaaatgaaaccattagaagaaaagcaagaggtaagttgaaaagttactatcattttcttttttacaaattgaattctataaaattgtcaacaaataaatgaaattcaagtagctgaacctgtccaggctttcatgagtattattagctgccttttacaagcatcggctgctttgtaaatctagcgaactatcaggatcatctactttgaggtctagtctgcttttttcccttggcattttcatatgtaggaggaaagatcaaaagtggatgatctgagggggaccccgatgtcagtaggaaccttggaagagatcattgatgacaatcatgccatcgtgtctacatctgtgggctcagaacactacgtcagcattctttcatttgtagacaaggatctgctggaacctggctgctcggtcctgctcaaccacaaggtgaggtgatagtctttttcagaaagcccacggaagtgctttctcttctcacttaggttcatcttcctgtcccgtggaagtagatcaccaaagcactcctcaggcagaaggatgccatgactggcattgctttgctgtaaacagatccagcaaacctcacgttcctgtgttaaaccttgatgtttcctgttaggtgcatgccgtgataggggtgctgatggatgacacggatcccctggtcacagtgatgaaggtagaaaaggccccccaggagacctatgcagatattggggggttggacaaccaaattcaggaaattaaggtatgattgattggtaaccatctctgggtttcagttttggtttctgttgtcccatttaggatactttgcaggtgttttgtatgtttgcttatttattaatcaaaccagtagctgagtcagagcttgccagttgtggtatttttgtatttgttaatactga

SEQ ID NO: 77404 - DNA, 1050 bp, Homo sapiens
tggaccatatgcagggcatatggtcattgaggatggccgtcggctctctgcatgatctttcatagggaagtcattccgagccatcacagatctctgctagggacctctgaggcagctgagaaatagctgtaatgtccctagatgggaacagccatcaggaagtctttcctagtcctatctgtagtttaattgaaaagggtcaacttgagctttattaagtctctcttgctcaagaagagctccaggctgacttctactagaaagtaaaaggggaattgggtgtggttagggagatggaacgggtgcggggaactcaagcaggacaggtgtcatcttcagtatgtctttgctgctaatagaaatcaagcacattgtctctaagaagagtaattgagatttttacttatttttgttgaaagcaagatattgtcatgttgccaattagtaaatatgctaataatttcagtaaagcctttcattcatactgtttttcataggaatctgtggagcttcctctcacccatcctgaatattatgaagagatgggtataaagcctcctaagggggtcattctctatggtccacctggcacaggtatgctctgtttttgacactttccaggcacccagctggtctcttgagcagcagcattggctagttataattactgaactaataagagaggacaccacaattccttagtttaaaacagggctgctcaaccttgtctgcatgttggaatcaccttgggagctttaaaaatactgatggaaaaaaaaaaaaaaagcctgagcaacttggtgaaaccctgtctctataaaaaattagctgggcgtggccgggcgcagtggctcacgcctgtaatcccagtactttgggaggcagaggcgggtggatcatgaggtcaggagttcgagaccagcctggccaatgtggtgaaaccccgtctctactaaaaatacaaaaattagccgggtgtggtgacgtgcgcctgtagtcccggctactcgggaggctgaggcaggagaatggcatgaacccgggaggcgg

SEQ ID NO: 77405 - DNA, 2074 bp, Homo sapiens
cagttgtgagcacaagtctctgccctggaggagctcacaggttgtagggatcagataccaaacatggaaacagaataaatgatacaatttcagacacagaaactgctatgaaaaaatatgatctgtaacttggctgatgggagcgtcttagtccatttgtgctgctaaacaaaataccttaggactggtatttgtataaagaatagaaatgtatttcccacagttctggaggctgagaagcccaagatcaaggcactggcattgatgtctagtgagggctgctctctgcttccgagatggcacctattctgcagaggagacaaatgctcaggggacaaacaaaagagcaaaaagggcctacactagttccctgcagcattttttataaggaatacatgctgtataaggcctttttctctttttagaaggaactcatgctgtataaggctctgcctcatgcctttagccctttccaaaaggcctcatctcttagccacacagtagggattaagtttcaacacataaatttggggaaatacattcagaccatggcaaggggtgctgaatttattttttccgagcataattgagggagtgccatgtgagttgaaacaggaatgtttgttaaggtgttttgtcacaatgaggtctttgctgtaattccccttgagcaggcgatcagttgagtcttcattccttccctttttttttttccaaagatatgactccaattctggtggtgagagagaaattcagcgaacaatgttggaactgctgaaccagttggatggatttgattctaggggagatgtgaaagttatcatggccacaaaccgaatagaaactttggatccagcacttatcagaccaggttaaatttgctttggtttcatcatggagattaatgtgtttatatatttgtgtttaagtgtgctttgggaggcctataaaatgatacataaaaaagcaaatactgcagtgaaacttaggataatttacaaaaaaataggtcctcttgagatgagggttaaaacagagcatgatatggtctgtgcaccttggccctttgaattccagtcttatgtcttgtcttttcttttccataacattccctttttagcctcaagaacttgctgctttttctggaagaaataattcatgtgatggtaggatttgtcctttttacattcaggtagcatcagaagaaacagtgatttgtttgctgtcttttgtaatgtttttaacacaataggtctgcccagtttcactcaggaattgctcctttcatttatttctgaaggtaccaaagcagagagagtttcttttaaatgaagagaattcaaatgtagaaatctacaaactacaaaaatatatgtttactttttaaaatttagacatccttcccacagaattctgtccgactgaaacttcgtatgtaaggagatgggctgaggcctctgagccatggccgagcctgggtttggatgttggtgtgacttcaaatctctttgtacctgcaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggtgagagcctagccgtgtcagcttatttctgggaatgtggccgtcaatcaggaaagagtctatatgtgctcttgggatggtggttggcctggacaggtgggtgtctgtattttaatcatcatattggtttacgattacatccaaatggtatatgtgcttgatattgaagtcattcttaatgcatcattttatgcagtgaatgacgctaaatcacctggagccacaaggctgagtcgctggtactaagccttaggcccaggtgactttctcaaggtgtgtcaaatgtagctgctcagtcccaggtcaggggaagggtatgtcctgggagaactctccccagagccgcagagtggggaccaagcacccgctgcattcatctcccaatctgtgttctggaag

SEQ ID NO: 77406 - DNA, 1046 bp, Homo sapiens
ttcacatcctttcagaaaataggatgcttaaaacattttttttaaaaatcaaatctttcccaaataagcaatttgtgtttagtctaggtgtctcatgctttatttcagaacagatttttttttttttttttttgaggtagagtttcgctcgttgctcaggctagagtgcagtggcgcgatctcggctcactgtaacctctgcctcccgggttcaagcaattctcctgcctcagcctcccgagtagctaggattacaggtgcctgccaccgtccctggctaactttttgtatttttagtagagatggggtttcaccgtgttggccaggctggtcttgaactcctgaccttaggcgatccacctgcctcggcctcccagagtgctgggattacaggtgtgagccaccgcgcctggcctcagaataggttttttggaattccttgttagaataaaaatgagtatgtcactttctgaacacactcttctttcttacaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcaatccctgaaagggatgaggttgggggagttgcccagaggaatccctgttcccactgatttttattagcaaaacatcctgtgtcttttggagtacgatgtgtaagtgcccattgggtggcctgttggtcactgtgcagcagtctgcttcccaataaagcgtgctctttcacaaacacttcctgtttctgcagtctccacacacacctaccgctcaacagcagcctgtgggtggacccagctacagggaagcctttggacaggaactcaggctgcggtcccaaggagtgtggacctcactatgcgttcgccacatcacacccccagagctggcgttcaacggtaattacagtgggaaatggtcactaccacagagc

SEQ ID NO: 77407 - DNA, 1117 bp, Homo sapiens
ctgaaactggccaagctgaagctctgcacagagttctgggagccctccactctggtcaaagagtggcagaaactgatatttttgcatcccaataatacagccctttggcagaaataccttttattttgccagagccagtttagtaccttttcgatatcaaaaattcacagtctttatggaaaatgcttgagcactttgtctgctgttaaggacggcagcatcttatctcaccctgcgttgcctggcacggaagaggccatgtttggtaaggagataaccagatccagttacgtgggaggagttagactttcttttggctttacttgaaaatgaagatctatttttgatttattctagaaaaagtctaaattgtttgatagaactgatttttttaaaaaagtattacgactctttttgataacaaatttgcccccagctcccagggcaggtgggggcaatagggccagtagagttaagatatcactggacaaggttctgctgattagccaagtaaacataggcaagtctcttaactgctttggcagtcggtggccttatctgtcgagatgcatgtacctgtctcacccaattgtagggtcccaggcagtaatgtccgtgagatgccctgactgggaaccactgcataaatagaagttttgggtattattatgctgttaacatttttggtgtgtcctgaaggaacctggaacattaattttgacagtaatgagatgttggaggctgcatgttatgcagagccagagagtatcacttttgaccttgaatcctgaagggtttgcccttcactggctctcttgtgtccttgggcaggtcctctttgagccccagtttctccatcagcaacaatactataaacctgctttacaggactgtgttgcacagtaaacgagataatccatggcgagtctagctcagtgtccggcacagagcaggcatttatttgatcacaacccctgttattgagtattaattactgttggcatctaaagatagaaatacattgctctcaaaatataagcatttatcacactgacacagagtcttgaatttgtcactgtatgtgatctacacaaatagcttagtgttatttagtagc

SEQ ID NO: 77408 - DNA, 1044 bp, Homo sapiens
aagtgcctctcccttcttcttcttcctttgtcccacagtcaaggaaataatgctgcagctgatactggacatcgctttgtttggcttgaggacattcaggctgtgacgggagaaaccttcagaacagataagaaaccagatcctgcgaactgggagtacaagtctctctaccgaggggatatagcaaggtagtcaccttgttttcccccagttttcactgtaggaaagtgacttttttctcctcggaactctcttggcactgtctgcctgcctgtttctctctttcatcagttctgttgggttttatttattgcattgttcaggcacatgtctcatctcctattctaaaatgaaggcttaacacttgaagtcaagtcagattaatcttatttatccctggtgctttgcatagtgcctggcacagtaggcgttcaataagtattagttgaataaatgaatccaaaagtaccttgtaataattaattgtgacagactatctggtaaccatttggtctaacctatatgtcattttttaaagttggaaagctttcatttatccactccccacatctgtcatttaaaaaatgacatttagtggtaaggactttttcaaaatgtttctggcatacaccatcagataatcataaaaatagatgatatttgctttagtaatgagtttgaacttttcccctctaatttggcaatcaaaaatatttgagtacttactaaaccctttagaccaaacttgtccaacccaaatttgtaaactttcttaaaacattatgactttttttgtgatttttttttttaactcatcagctatcattagtattagtgtattttatgtgtggcccaagacagttcttcatccagtggggcccagggaaaccaaaagattggatactgtattagcccattttcatactattatgaagaaatacctgagactgggtaaattataaagaaaaagaattttaatggactcacagttccacgtggttgaggagacctcgcaatcatggtggaaggtggagaaggagcaaa

SEQ ID NO: 77409 - DNA, 2054 bp, Homo sapiens
gttggatccataacgtccctgagccaacaaactgaagcagctccagcccatgtttctgaagggttaccgctgacaaggtagtttttgtttgacagatgtgttttcgtttttgtcagtttactgtctatagcttagctgaaatgaagctccttagaaaactctaataaaagaggtatgtaaaactcttacttaaagtaataaggtgatctttgactattttcccttacctcttgtattcttttttttttctttgctttgcagtggcaagtacatgacacagttagtgcctgtaattaggccaagagggaaatggcatcattgtgattctcgagtaactttactagcctcattagtaacctttagaacatcataattcaggtatttttttagttacattttcaacccttttgtaaaaatagagagggagcttgtataagattaaaaatggcatcaaaacgtcagggaaagcaagatggcacacatctctcctcagctgtgaaagaattttgttttagatcattgaactgagaaataagctgtcttacaaatacagactagatttcattaatagggtgaataggttgtgaaacccggtactctaaatgtgtaagaagcctttggaaattgagaagagttgatgtatgagaggaagttggtagatattagatatttcagtaatgaggaagaagagctcattgtcatctccaaaaacaaggaccacaattaaatgttttggtttttttattaacaacatgttgacataatatgtggcactgaaaataaacctttttataatgattttttttgaaaattattattattatttttaaaataaagatgaggtcttgctacgttgcccaggcttgtctcaaactcccaagcaccttcagcagtcctcttgccttggcctcccaaagtgctaggattataggcatgagtaaccacacccagccaacctttaataatgtcttaaaaatactatatttgttaagtggtaggttactttcatttaaagatgtataaataagaaagtataggtttagaaactattaaaattggaatttcttcacctgttattattttagatccaattcctaagtcttgcaggtgaggtgtaatccagtaagttactgtgtaatatatgggcaaatagtaaatctgtgtgaacatttatatagttccatcttaaatatttgttgacttatttacatagtattatttttcctacatctttttagaaagtaattttaaagttgattttcccaaacaggagtcatctgaaatcagagtcttcagatgaaagtgacactaacaaaaagctcaaacaaacaagtagaaaaaagaagaaagagaaaaagaaaaaaaggaagcatcagcatcataagaaaacaaagaggaagcatgggccgtcgagtagcagcaggtctgagacagacaccgattctgaaaaggacaaaccttccagaggcgttggaggcagtaaaaaggaatctgaggaaccgaagtaggttgctgttctcaagcacctatgatattttaagtcttgagtttttctcccttaattgttgccgcaaattagatatttgaataaccatttagtcactcagtcggaagagagctctaccattatatcagcttaaaaaagagaaggagaaaaattagggacacgattttatttgagaaatgttatttagacacagtaatgattgtgtgaatctcttttagacaaaaagtctttgggattttcaaaagatggcagatgtgccacagtgggtctgtgagtcagtgccgttatcacatagataacggttccctctctgagggccgtgggtctccacactctgggtaggagaaacatcttctttctctgccttgatatatctttcattcagtcactcctatcaactcctgtgtgtatacatgatcacacacactttaagattaacgtagcacttaaataattgttacatttgtccttttccttttctttttcatatttgtttaagaccactatgtcgaaggcagtggaaaacagctcatgattacagtgtttc

SEQ ID NO: 77410 - DNA, 1066 bp, Homo sapiens
tatccactcaggagaaatgaaaatgtgtccatatgaaaacttgtacatgaatattcagagtagtagtattcatattagctaaaaagaagaaataacccaagtgttcatcaactaatggacaggtaaaatgtggtaaatccataaaatgagatatttgacaataaaaacgaatgaggtagtgatacacactacagcatggatgaaccttgaaaacattgtggtaagttacaaaagaccacgtatattatatgagcttatttatattaaatgtccaaaataggcaaatctagagagatagaaagcaggttagtgtttggctaggggtgaggtgggcggggcagggaaacaggaggtgggtgataggagtggactgctaataggtctgaggttttgttttgggatgatgaaaatgttctaaagttatgaagatgaccacacaactctgtaaatatactaaaaatctgttaaattgtacatgactaatggctgagttatggtatgtaaattatatctcaataaaactgttcaaaaatgcagtcaccctcctcttttgtaccttcaaccatttaacgggttcttcctctttaggatatgaataagctctggcctcccatccaaacaaaacaggacaaaatacaaaccccccgtgggctcccttgctgctgccatcccatgttttttttcttcccttcacagctaagactcctaaaagttagaaaataagtaatttagaaatcgttcactgtagaaaagtaagaaattaggggtaagcagaaagaagaaaatctttagacatttaatgtaatcacctagagataatcatcacagtattcacatttatataattttagcattaaaagttaacatcttaggtttttatttccaaagaagagtactattataaggaaaagtttgttaagttagtgtactaaggtagaacatggaatattttttaaaagatcttaatcttctgtaataatattaagcatggtgggcttttatgcatgatttgatttgcttttgttttgttttgttttgtttgagatggagtctaactctgtcatcc

SEQ ID NO: 77411 - DNA, 1032 bp, Homo sapiens
cagcaccccaaactggaagtggccgctgcagacccaaggacgaggggcacgcgggagccggcagccctagtggagcggttggagatgttgaggtgggagggtcacccaggtggggtgaggctggggtaggtagcggagtgaacggcttccgaagctctgggccgcccccaggttggactaagcaggcgctctgtcttcgcccccgcccagggtgggcgtctcctgaggactccccgccacacctgacccgagaccgcgcgcccagcctagaacgcttccccgacccagcgtagggccgccgcgactggcgcgcagggggcggcgggaggcctggcgaacccgggggcgggaccaggcgggcaaggcccggctgccgcagcgccgctctgcgcgaggcggctccgccgcggcggagggatacggcgcaccatatatatatcgcggggcgcagactcgcgctccggcagtggtgctgggagtgtcgtggacgccgtgccgttactcgtagtcaggcggcggcgcaggcggcggcggcggcatagcgcacagcgcgccttagcagcagcagcagcagcagcggcatcggaggtacccccgccgtcgcagcccccgcgctggtgcagccaccctcgctccctctgctcttcctcccttcgctcgcaccatggtaggtcgggagtggcaaatgccggcgtagcagctgcccgagatttcttcccagatttctagttgttttgtttgttttttgtttgtttttggttcttggaggtttttcttttctgagtgttacgcagcagctgcgcttaaaggaggttgcattttggatttgcatctcggcgacctctgccagggagcttcatttattggttccccttggagctggacttggtcgtaggccgtccacgggcaggggctccggccgcaactgcagcgggggtttctgcatccaatccccctgccccccgcccagccccgcacccactgcatccactagcgccgcacccgggctgcctgcagcgcagcgtttcggcc

SEQ ID NO: 77412 - DNA, 1006 bp, Homo sapiens
gtgagctgagattgcaccactgcactccaatctcggtgacagagcgagactccattgtttaaaaaaaaaaaaaaagattggatttaggactaatttaagcatgttccagcttagccgccttgaaacctttgggaatattgtggtgtgtggcactgtttattgggagcagtgtttgctttatgggctgctgtatgaaggccagtccaacaggactattgtggtcattatttcagtagataaagaccagacttctgatacgttgcacaacttgaatggctggctttggcaagcccccggcaagtgtgtattgtgactgggttggataaagacattgattctaacgggtcaacttttgttttcagaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaagagctttaaaaccatgaatgagggccattgttgtgtaattcaagttcagacatgttacaggattgtctttcaggtccccagagcaaagcaaatgtgcaaagatcctttctgtggttgccccagggccattgacaattaaaatagaagatgatgggccttgcgtccatcctgcttagtgtctagaatgttttctgcatgggatcactattgttttcttcctgcttggtgcgacctagagctcaaatctatttttttttttttttttggagacggagtctcgccctgtcgcccaggctggagtggcactggcgcgatctcggctcactgcaacctctgcctcttgggttccagcgattctcctgcgtcagccttctgagtagctggaattacaggcgtgtgtcgccacgcccagttagtgttttgtatctttagtagagatggggtttcaccatgttggccaggctggtctcaaactcctgacctcgtgatccgccct

SEQ ID NO: 77413 - DNA, 1079 bp, Homo sapiens
ccgagctcaaagcttttatcaactggcccatgagtctgcactgagtcttgaggggggaggtgaaattaaatagccatagaaagtgctttttaacaaacttactgtgtttaaagaggaggaggaacccccagatgaagtaggtgacgagcactcttagaagttaccataaaagtgagtacagtgtgagctgtagatgtgtttgctgcagaggagcatgtgaggtttggaggcggatgtgtggtgactccaggggatagatttgcagaacctaacggaaagggaagctgtaaggtgcagggccagagggaaccagcagtaaccctgatagcggtctgtcatctgttcctctcgactctacagcagcggacaacagaactttgattgctgatttccatcagtaagcaggctttgaagcacacttccccacccctaaaaaaaaaccacgtattttggtaaatcctatatatattctaatgtactgtatgacagtatagaacatgatttttaaaagatgagttgggaggagaaaaggataaaagaaaaaataaaagaagcattaagaataaacaattcggatctagattttactttctagatgattgactcgagggtggtgtagtaaaatcgcttgtctggtcacaaacatttggcagcagagcttttgattaggttctttgacaaagccttcagcacgttagagtggttttcactaatagtgttttggaaagaaaaggttgtccatagttctctagtttgctaagatgatcagctacccaggaacgtggagtaacttcctcttgtttgtgggagccccgggaatctgtgcctggggaggggagaagtctgttaggctcttggattgtgtggaagaaggagaagttgtgccaggctacagaatcctgtgtttgcactgagaaaacaggatggtacctgaccttctctgcatggctgtgagatagcttaaaataatttcttttgtttttgatgaatatgaacaatatcttaaaatttttgaggctaaaaaagtcttgaagggatccctgaggtattttctttgaaaggtactggtgaaaatgagt

SEQ ID NO: 77414 - DNA, 2641 bp, Homo sapiens
ttcctctctcataatcttttctcctctgaaacactttatacacttaacctgcagctcagttctaggccttttttgtgttactgctgtcactaaccaaggcagagtgagacctgagtgatttccctaactcagggatggcagtcgggggcgctttcttccctcggagtggaaagattcagcctgcggagtggtgtatgctatttttctcttgaactgtacagcccttcatgacccttccatgggcttgaatccagatgtgcagtttcctttgtataattaaatactatcctgggcactgatgatgagtttgaaattatgtgaaattgccctgtgaagtgtttgaacgttttagacctgcagatgattgaacctagtaagatagtctgcccctttgtcctagtacatgtttaccgttccgtacagtggttctgaaatgattactgcagagcagcgttaatggagtgcttactttacatgagctttttgttttttaattcgaggtaatggcaccattgacttccccgaatttttgactatgatggctagaaaaatgaaagatacagatagtgaagaagaaatccgtgaggcattccgagtctttgacaaggtaatccagcatctacatagcagatggtacttaagtatggcttcttccgctttcacttctaaaagctataataatgttatagacagaagacttaaatctaactgcctgagcctctgatctcactttcaaaaatcctccttatggtaaccgtatcaggggagggtaggcataataaataggaattttggaccatgtttcttgactgttactttgaattgttgtgagcttttgcaaatcctgttttctgcattagctgtttgcatgtatttagtaggttagaggtgggaactagagatcagagaattgtttatggcagcagagttagcagtaacttgagagggcatagctaagtcaaagacctacttccccacactacatcattagcaataacaattgctgaatgttcacaggatggcaatggttatatcagtgcagcagaactacgtcacgtcatgacaaacttaggagaaaaactaacagatgaagaagtagatgaaatgatcagagaagcagatattgatggagacggacaagtcaactatgaaggtaaaactaaattctctgagctcagtgtttcatagtcttacctttagatctgtaagcaagccaactgcttcactagacagcctttgactttattttatgtacagtaaagatgttgtgttcattaaagctgttttcaaagataaccaaaagttactattatatttgtcttttcagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtctttttttttttttttccaataaaaagaccattaacttaaagtggtgttaaatgctttgtaaagctgagatctaaatggggacaaggcaggtggaggggaggccagtgtacatgtaaatgcccacagcccagcattgggtttccctcccaaggccccagcaccaacctctgagcccaagaccttgcctgaaaacaagcagataccgattgcttcatcctatttatggacatgtaggtctagttgcattttcactggggggaggggggaaggtgaattatggtaacttttaatgatctattcaggcagtagagctcttaaggaaaaaaaaaaacccactttctctcaagcatgtatttaggggttgttctcaattgtgctgctgattacctgtcttatgtaactacttgagaccatctgcaagagacatgattt

SEQ ID NO: 77415 - DNA, 1174 bp, Homo sapiens
tagaagcagtagtcacttttgtaagccagtctcttcatgcctaaaagacactaccagtcacctttgattcgcgacttttaatttatgattatacttagcctcctcctcctttttttttttttcccaagttgacttgactttgcttttttccccccaagtagaactaatgctagcttccagcttgaaagtaaaactccagtgtggagtgaattttgtgtctaattataaacctgtaaccaaaactcagacatctggtactggtctttgcattgagattggtccctgtaaaaccccctttaaaagcatattgcatttagtacagagctcttttttgaaatgaaggctggagatgtgcatttttcacggtgttaactggttgtatcttattagcaaggagattggggttttgagtgtttgcgtgggtggtttcaatttgccagggaacagtggcaggctgctagcaaggcagtgagaagctcttggcagccaaatgggtgcattcagggctgatttatagagacccttggcttctccttctcctactccctgtctttctggcattttgtagcttgttagattttctgccagaggggtgggtcagagcagtggaggggagacatcgcccatgtgcttctgctactggtccttgggctgggtggttggtagaggagatgttgacactatgagctaagggttggcttttgtaattacctgaatctgaaaggaatgcctaaggttaccttggggtttctcttctggtgagatagggttcctggtttgagtaagttaatgtcctggatatttcttgtggcagggggtggtcaaagagcctgattgctgacccagtctcaggcctgtggtcgatgacctctcggtagtttcaaagggggctggagggggatatttgacttgttttttcgaaatgtagccttctaaccctcaagtctttagaagctgggtggactcttagtggtcctgcagcgtatcctaaaagactacctttgaaacaggattcttgtatggccaggatcctgtctgggaaccagaaaccctacaccctccccctccagggaatgctgagttccagttttgagcagaggtgaggcagaatccactgtagccttccgccctggtatttggggggatgaccagcccaggcgttgggtgttagtct

SEQ ID NO: 77416 - DNA, 1201 bp, Homo sapiens
acacattgaaaatgagctattgtacatatttttatattctctttataaatgcatgtctgattgtacttgtaacaatattgtaatgaacggctgtgcagtaggcccagcgctgctgtgtctcgtcagaggaatagcttaccacgaacccctcagcatactgggaatctcttcctgaacaacgaatgtaaatttggtcaagtctactcttccgttcattcaattattttaagcatttgaattatttattgtatatcctaaatatatttctcctttggcagtgactagatttccactaatgtgtcttaatctatccctccagctggcagttactgtttttttaatcccctgaagttgtcctgtaggagacagaaattctttgctgtctgtatcccttggagtaagaaggtagtggcatgggtggagtgtgtgttctttctccaaatctattatgatgtttattaaacacttctgtagcaaagatggtggtagttcttttgttactgaagttgcccttcaccatggctatttgaaaaggagatgtacttggacgtttctgtaaatcttgagataaactgtttggagatttaaccacctctctgatgggggaccaactctatggaaattgtaaatacgttttatttataaacctggcactgtattcaataaacatttctgcagcctttcatctctaactgcgaactgtgtaggtttctagcttgcatagctttcaattccttttgctctcaacaagatagacctgccctcagatgtaatttcactgggtctctagtactgtgagagtgaggggccagaaataaccgtagacacatcccacaaccgtcttaccctagttttaagtagtttgagtgttaatagctgacattttaacctattctcttagcctattaacttgtccatgcttgctttttatgcggaaaatttacaccataaggattagtttccttttaaccccaatccaagcctctttaggacttgtataaagaaatacatttttttcaataagatgggaattttagatgacaaccaagatgataccttggttcatgtcaagagcgggacagctgaggaaagtggggtgggatgcaagtacaatttaggaccttggcattgaagccttccccttagtcaacactggcccagaccctggttcttagatgtagcaggagaggctgcctgcttc

SEQ ID NO: 77417 - DNA, 1062 bp, Homo sapiens
tggtatcatctatcattcaagcttgacctgggttgttggttacacaggtgttttccttatgattattacaattacagttattcatacactttccatttgtgtatgtcctcttctgtatgtctgccatgataatgatgatgaaaaagaaaaaaatggatgatggatttaaagagtcttgtaaactgaagtgctgtccacatattagggctcaggaagaacctcctcttctcacctgtcctttttctctaggttcagaatccagaatgtccacactaaaaggaaccattgtagtccagcctcccatgtcccattttacagcggggcaaactgaggcctaagaaggcaaagacatctcctcttccctctctccccctaccctcccaagggttccagccccaagatgtatgccctcctggaccccaatgctcccttcttgccttgagcacctgcagtgtgtgtgtgaatccagccaccttggaattaagagcccacagggcatttcctctccttgggaaccagttccaacgccttccatctcaggctgaaaaaaaaaacatttgcaatttcctcccacccacgactcctttcagatgcgctcagcctcaggcgtggacgagggctttattattttttaaagaacgcacacacaccctcccgagctcccatcagccctctgagcatccttctgcaaacctctccaaaggcataaaaaccaggctggggaaaagggctgggcctgctgcaggtgaatctaagatctggctcagacattacaagcgtgcaagaggctcccttgtctcctcgttccctcagcagatgcagcctgatttccctttgaataaattgcctccagcttggtgaaccaggaactttacgagcagtcctgctcccgagcccagtaatttgccagaaattagcagtgactaagatgcaccagcctctctttgttctgggcagtggggatcagcttgtcctgagttttcattttcagcactggtcagagagctgtggacactcagccacccagaggccccaggcctggggttaggggtgggggtgctg

SEQ ID NO: 77418 - DNA, 1048 bp, Homo sapiens
acccactccagctctgcacctgctgggggtgatcctcactgtgccactgtccctccctggactcagaatcagatgaggacagtcacctctgcccagcctgccttctgggctgagatgtgagtctgcaggcagctgtcagaggtggtgtgtgccaggtaggggacacgagggctaccgcccctcaggaccaccacacagggcctcagggccaggccagcaggcaggactcctcctggacactcaagccctgagtggggctgactatggagaggtggcaggaaggtggtgggggatcttctgcaggtctgcctggagccagcagctcccgctgaccatccgggccacccacagcccccaccaccctcctcgtctccctcatcttctgctgtttggcccttgaccccctgaggacaatagggtttcctggtgaccactgggctgtgggtcacacagatctggctggaatcccagttctgcctggccgtgtcacctctgatggggaagcactctgtctcctcatctctatggtcggggagtaacttcccttacgggcttttggggatattaacagaggtcaacctggacagggcatggggcccccggggtgcaccataaagtctttccttctttcttctatcctcaggcgaggggtgagtggctgctgggacgtgctgaggggtccctgaagcagggcaggaagggcagagctagctgcagctgaggcagagtccgagtcccgctctgcatggaggaggaggtgaggggcctggtcagcatgggcatggctgggggcctctgtgaccgccaccactcttgtctttgcctccttgaccccacagggtcatcctcgggccctgggtccagccaaggcctgaggagggtcatgcatccctgtcccacttggtcacagcacaggaggctcccatccgccactgcctgaggcggtgcctgtggcccaagggctcgggttgtgggcctgctgggctggagcctgcatcgggacctggccacctactctcctaggagccttaggtgagtcactagtcct

SEQ ID NO: 77419 - DNA, 1166 bp, Homo sapiens
actgactggaaactcgaggacaagtaggatgcagagctcctgaagcctccatggctgactgtctctctctctctctgacctctccaggccctgatccttcaccagctaggccgctacagtctggcggagaagatcctccgggacgcggtgcaggtgaactcgacagcccacgaggtctggaacgggctgggcgaggtcctccaagctcagggcaacgatgcggcggctacggagtgcttcctgacagccttggagctggaggccagcagccccgccgtgcccttcaccatcatcccccgcgtgctctgagcaggcgcctgccagcctcacctgccgctcaggcctcagaggccctgccgggcaccagggcttgtgccatcgccccaaggggatgaatctgccacactgaggccagggacgagtgttcagtgggccacagtgaaccaaccaaaccaaccccgaatcatcgctctcgccatgtgcgtttctcttgttttttttgccagcccaatggtagtttctgaacctattgacattgttcaaaatggatcatgtgccatattttgttagttgacatctgagttttcagtaaaatgattatggaattaatcagcaaatgtagaagaatatattcaaagttaaaattcagtggcagcacagattatttttatcagagctgtaaagaaaacaactgtccttttctccccaccacccctcctgccccactttggcccagaaaccaaatgtgaacttcctgtctcccacctcagcactagtccatgccaggacaccagctgacaatttcttggttttactgtcaataattgtaccatgtgatcaattactgtcctcacttagaacaaagcctgagtccgagaatatttatattttaccaatatatgcctgttacaagagaaggaaatatgagttatttaagtttaacttttttatgtgaattcagagtttatttatcgagggaaatatgtacaaagaagcttcaaatggaatatttaccgacattccttatacatgacagacacttggctacatgggaagatgatgttaataataaaatgatttttaaatggactcatagcctgtgtcattcgtaaaagctcaaagacctgagaaaggcttagttcctggggtggggagctgtctgtacc

SEQ ID NO: 77420 - DNA, 1024 bp, Homo sapiens
gaccctagtttggggagatttgccctaaggggaggatgtccaaatagttgtcaaggccgttccactgatcctcccccagggccactaaaaggagctcatgggggacactggactcccctccccaccccacccaccccaccaagttgttcctttttgtctgtttatacatagactgtgtgggtgttctctgtaagatttcatttaaccaaaggttttcagggatacaaaaaagattggaaatccactgatctaaagaacaaagaggtgctttctggaaagatgttcatgtctgtgcgatttggaacagcaaagagattggatgtgacctacatgtttctcccccgagggagaggttgagaaagtgagagtgtccattggatgagcgagtacacgcatcgcttatagaggtgcgcagcttggaaacgcaatgatgatgaaataggtgggacccacgggtacaccccaaccaaggaaaacgaagatgacagctgggcacagcctggggcaagcagagacagtgaggtcagggccttggtcggggaaggggctgtgagcaatgtaaaaactgtcgtcatcattctcatagtataattccaccaatggtttctttagtttaaaaaaaaaagacgacaggccaggccctgtggctcacgcctgtaatcccagcactttgggaggccgaggtgggcagatcacgaggtcaggagatcgagaccatcctggctaacatggtgaaaccctgtctctactaaaaatacaaaaaattagccgggcgtggtggcgggcgcctgtagtcccagctactggggaggctgaggcaggagaatggcatgaacccgggaggcggagcttgcagtgagccaagatcgcgccactgcactccagcctggatgacagagcgagactccatctcaaaaacaaaaaacaaacagaaaaggatgatagtcccatcccatgctgacgccgcgctgggtcagtgcagactgcggacttccaattagttcattcatggttcttaagtttt

SEQ ID NO: 77421 - DNA, 1216 bp, Homo sapiens
tagaatttgctgcttcattttcttgattagaacactgaggctgagagagaagcctctgcctaagtggcagttgatggaggtcacacagcaggggtgggagcgtggccctctgccccacgtgacttctcccagccctgctctcctgcagggggagcataccttcagccctctcgctgagataactggggacaggcctttgctgccagtgttcagtgataaaagatcagccctgagtacagtgaggccctcgcaaagggatgagccccgccccaccccacctgaggacaggtagaagcagagggcagatggggctctgtcagggtctttgggaaagagtggggtcagagtttctaggaccccctgtctcaggccgtggggctcccaggaagcctccccgtgcagcactgcagtggccgcatgggaatggctttctgaccatggagaccctccaacacttccaggtctgacgcttccctcgccagagccctggggtcatagccctgcccatgtcccccccgttccctggcttctgggggagctcagcctctgcctgggcctgctattctcccctgtggaggcagtggtcccaggaccccaggggaagcctgtgcctgcagcagggccaagttccctcagagtatccctgatgcctgcatctccctggcctggcgcacatggcctggggcacagtgccaccttccccaaagtgcaggggcactggcttccccagagggcaggaggggtctttagggggtgattagcactaaactttccaccacgaggatcagtcgggccatgggggagtgccagcttccaggctgctctgtgctgttggtttctgcctgacttcttgttggggaagataggtaaaaataaataagtcaaccagggaaatgtagaaataagtgaacaggagtctcttgcccattaccagtggaaaagtaccagcaagaggggctgtgttagcacccacagaagaccctggctggcatgcagcaggccccccagcagcaggacccaagcttcccccctcctatgagctgacagctaccgccacgttccagccagcctctgagctaaaactcactgcctcaaagcacgtgatttaaacggcagatgggggaggggaggctggagactctggaatgttaccaaggactgcccaggcttcagggtaggggggatgcctggcatccccacatattgctggggaccc

SEQ ID NO: 77422 - DNA, 1101 bp, Homo sapiens
acaggttcaacacggttcttagcacctgcccagcatataggatgtacccggcagctgttagtcttctgtgccttcccttctcccaaaacagagtggctgtgagaatcgtgtgtgttgtgagaatcgtgtgtgttgtgagaattgtgtgtgtagcacagaggctcccaccacgagtccatgtagggtgggctttagggcctcgtaacagatctgcctcttccccgttctctagagaaggaaagggcctacttttccacctagtgtcccaatctgagagccaaggggtgcccagatgggttgcagggaggctgatctcctcagctcctgagaagccagagctgccccgccagtgccctctggctgtaagcagccacctctgtggccccctgggcacagaaccgccactgcattcgcaaagactcctgcgagcactgcagaagcaatatgtgctgttgcttttactcttccaattccctggtctccctccaagtcattgtttagcccctgcccctggacccattctgtgaacccctgcaagggcttctggcttctgaggagacttggagatgctccttgttaactgacccatacatggcaggtggccgggtggatcctccaagctccgcgtttgcccggcctgggtaagcggtcacatcactgtgccctgcccgtcacagctgactggaggttttgaggaaatggctctattcttgatactgaattattccatattgaagtggtaactgataagagctcagttgtgtgaagaaagaaggtgccaggctgggtctctgccgtcacccaagcatcatttccgcgcccctatgcagtttccaggcggcagttgctcccctacagtgttccctgcctgtctgctgtcacctctgctccagccctgggcctgagtttggggccaagccctgggggccctggggagaaagtttgtaaaaaactccaggagtgaaggtccccatttctggcaagccgcccgtttctgttttccttgctaaccagtgtttgtcggcgctaatgcactagaatcgccctgcagtgtgaacagaggccggcagggcagaggagcgctggccggggagaccccgc

SEQ ID NO: 77423 - DNA, 1029 bp, Homo sapiens
gagatgactcactcactgtcaaacagacgcaaaggatctcccagcccaggcgcgacctggattacagagaatgacagcgacactcagagctgatatttgcggagtgtgaggcaccctgctaactcatttaacccgcacagcaacaccaccgggcactgttattactcccatttcactgtcgagaaaaatggaagcacagagagatgaagggacttatctcggggtacgcagttagtaagcgacacagctgggactggaacccaggcagctggcgccagcaccgtgctcccgatctttccaccgcctgtcactgaagctctgggttcctaagggaccacaccaacatacgatttcacgactttcttgttctgcttctgctcctaacttacaggtgacctggggcaggtgaccaacagcagggtccccatcagtaaacaagaaagtcccctctcactgtgtactaggagagcacacgcagcagacacgacatatgaggcttcaaagttctttgtagagaaaggtaatccttaagccaagtatcaataattgttgaaagggcttcacacagctatcgaagaagctaaaactatcaagcagctatcgaagagtgtgtgtcaccagacagaagacagagcaaagatcgaagatgaagtgtccagtaggaggcatccagtaggaggcactactttgtcctcggcactgtgagttggaactgcagttatagcgaggaaaggcaagagagaaatgagggcctgtgcacttttcagggtcctctcaacaagcacatggacgcattggaaggctgggcactaaatacttcataagccttgctctagaggaaaaaaaagttattctcctcaatttggaaaacattttttaattatgaaagaaagcaaaatacaattaacagatgaaaaggccttctcactggactatcatgaagttttgtttcctgccagtcattctttctatgtatggaaagaaaactgatacttcggatgaaagagatccacgtctaaagatggccat

SEQ ID NO: 77424 - DNA, 1928 bp, Homo sapiens
aactgctggtttccagcagaagaatgctgatgcactgggaattaggccccatggaaagagtgtctgcttacaagttacatctgcactcgaactaagccctggtcctgactcctggggaagctcggacttgtcacttaacctttaggcaccttgttgtgtttaggtgaattgggctcctaccccagtgggatgttgtgagaaagaatgaaatgatttacataataatcttagcagagttcctggcacctagtaggtgctcatgaaataggaaactgaagacagtcattttcagttttaaaaagaaatcaaaccttaccataattacagctacttaattttttccaacttccctttgtgagtcttctgtggccccaaacagatttataaataattttacatattatccaaatgttagtctgtttgattaaaaatactacatggcttttaatttttttctcactattagaagaggaatttgtaaagagcttgtcagatctctgtgcttttgctgagagcatctagaagacgtacaatccccgccatgtcccagcctttttattaaaaagaggctgcatgtttccatctcggggactatgaattattcagggaagtatttcttgttcatccccaaggggaacacatgagacaaaagatcaaataggaaaatcgcaccgggagagttttctgtttcacctttggagcttttcaagacacctgagatgcctgacacatgccaggcactttcctttctgaaaggagcaagcagttgacccagcacgagggagctggtgagtgagactagggccatggtgagccccgcctgctgggtccatcggcaatgactgagccttactaggctcagagacatgagctgctttggagatcttgccagtagagaggggtcatcataataaactattaaaacctctctccgtggatcctgagatattgaaaaaccatccagattggaggcaggatgagaagagcgagactacagatttgaggagtttagagtctcgcagtcagaaactttgcccagtgactgatcagtgtggctcccgaaggtagcttgagcacgccttcttggtgattttctaaatgatgcacctggcctgtgttctccccagcctgtccccaggagcccagcccacagccagggggagccccatgcagccaagggcaggcccccctcccactggtgctgcaggaccctctggtgcctgtggaggggcagcccatggaccccacaggctcttcagccctgagacatcacactccctctctgtcctcttccctacaagctacacagggaagctgtgtttctgtgcccttcgatggaggaagggaggaagggggtcttcacgtataccctagaggcccaggaggaggccctggagccaggctggcctgggttagaatcacagctctggccccattcgctgtggggccttggacaggttattcaccctcttggtgcctcattttcctcagctatataaatgaggataaccgcgccaatacaacatgcagacagattaaacccaagaactgacatctcttgctaagtcacaaaaggttctgtctctaccctcacggaaggtggattggtttgcaagcccctgagttaagaggaaggtgtcagcagggagatgagaggctgtcttaccaggtcaagccccagggaggaggcagggccccgacctgtgtggcggagagtggcggaaacagagctgagcgttgacagttgcctggcacacagggagagcggcgagggggaggccagggaggccagggtcagaaggtcaagactagaaggagtttaaagaacagagccctagggagcatcaaagagccaactacggaggctccaagggaaggagccaactgggagacaggtcgtggatcatgggagagggtagaaagtgtgc

SEQ ID NO: 77425 - DNA, 1042 bp, Homo sapiens
cttcacatagccttttaagaggtaaatttagaagaaaacagctttcaccgcactgtcgggttttaccttatgtggtttgagctcccccactctagtattttgccattacagataatgcttcaataagtatccctatacacagtctaccctttacattctcaggttctgcacccacggatttaaccaaccttgcattaaaaatatctgaaaaaaatctgtctgtactgaacaagtacaaactttgtcttcttgtcattattccctaaacaatacagtataagaactatttaaatagcatttacattgtattaggtattttaagtaatctagagatgatttaaaacacacaggaggatgtgcataggataatttaaaatacacaggaggatgtgcaaatcctgcaccatttcatatcagggactagaacatccatggattttggtattcaagggaggtcccagaaccaattccccatggatactgagggctgactgtgtatttttttttatctgtaagataaactctaaacagtggaagtgatggatgaaggggtgtgtactctttaattttgataagttttgtccattgccttccacagaattgtaccagtttacattccagtcaacaatgtgctaacgtccactttctcacgcccttgccaacacaatgaattctcagaatccttgatctttccagtctgacaagtagaaaatggtatttcagttttctgtccgtagcttttgaccatttatcttcttagatactgagcttttcctttttatttctaagcacttattgtgtgtcaaagaaatctgccttgtctctgaaataggtgctgtaaacatcttccaagggttttttttttttttttttttagtttttgtttgtcttttgccgttttttaaaataaatttatcaattttttcttacggcatctgtgcctcccatgatatttggaaagcaactattcatgtttatggtttcttttcctaaaagttccaggtatgttccagtgccatttgtctatatactattctgtaaa

SEQ ID NO: 77426 - DNA, 1086 bp, Homo sapiens
tccttcagactgcagccacttaactgaggccaccagacagttagaaggagagctggaatataatatatcctatttattcggcaacacttgcgtgtgacaaatacagggatatgaagcataactaagccacttaatttatcagttatgctttttcctttgtctttttcttctctttttttgtttgagacagaatctcgctctgtcacccaggctggagtgccatctcagctcactgcaacctccacctcctgggttcaaccgattctcctgcctcagcctcccgagtagctgggattacaggcacccgccaccaggcccggctaattttttttgtatttttagtagagacagggtttcaccatgttggccagcctggtctcagactcctgacctcaagtgatccacccgcctcagcctcccaaagtgctgggattacaggcgtgagccaccacgcccagcctgtgccttttcttaacagaattattggtgctgggatccctttggatgatgaactttggtggaagagggctcacatgtgattgccacagctgaggtctatgtgaaattcaccataggtgtcatgtgcattggaaaaaggatttttggaaaagcttcacctgcaaaggcaatatgagctagccgtcccagtgtcctacttggggcaggcagggtttctcaacagccctcagtgtacaataggagcacgggtcagaaaacctcaggaagggttcagagcttggactcatggtgccctgagatcagtggccttggttcctcttggttcctggtcctcttggcccgtgaggaaatgccttcccatcacagtttctaggtcctcggctgccttcccccctccttacccccatgcatggtgatggagagaggagcctagaaggaaaccctggctcagaatgttcttcaggtggcactttgcctctgtatcaggtgtccaagataacattttcgattgaggatctaggtgggagggcaaggaaagccattggcttgtggaaatgcagatggcctccgctccaggacgtcacacgcccttgcaccattcgggccgtttgacgacagacctgtgct

SEQ ID NO: 77427 - DNA, 1103 bp, Homo sapiens
gcggttttagtctctgttcctgcttaatagaataaagtagctttaaaagaaatctaggtatatatgggagcatcactctgtgatgactgtaccatttttgaggggtggtgatttttaaaattcagctctaatatagaacctttttttgctattttaattaaactaaatttaatataattctccttaattagttctgtagtatctttctttaaacaagattgagtggaatgataggagactgacaagccaacagtaagtggcactcaggtagaagttggggagtgtgtccagcattagaatatcatcccaacctgggaggctttccccaggacgccggcagtcaggcacttggaggctcagagagccttccccaggcagaaggcacttccaccccaagacacagcctcatgaatatgcatcagggagggttcaggtggagatggaagcatctgcccaatgtagtcctccagaaggtactgtctctagcgcagagccaccggcagcggctcgctctgacagctggcaccttcctgcatgcgtgtgaacggcttccctccatgctttctgtgtgaccacctggccctgccagcacccaccagcagcatgctgcgctagccccgcatgcccaccggtgatgacatgtccccggccctccctgccttactggggtccttccctggaaagagcttccccctttcaggacaagacgtgtgctgtcaggtttaaacggtgcttgatattatgttaaagtcagtgggaaactgatcccgtcttggggctatgagtcttaatccttttttcacttggtgaaaaatggaagtgtctactagaatggtgaccaaggtgatttatttatcagaggaacccacagcaggagccctcatggttggtgggactgggtgggcagcggccccgcccctgctgtcacactgggggacacaaggcgcgagggcagctcccagggaagcagcagatggagaggagagctgtgacagcgcggtgcaaggagccaccacctggagtcgcctcctcagaaagcaggactaccctacagcaaagatgggaattgtcctaactcccgggcaccagggagatgaggggac

SEQ ID NO: 77428 - DNA, 1027 bp, Homo sapiens
tgccattttgcacttcacagtgtatctgaagatgcctccatacccatctgtggagaattgccttattcttgtttacagccatatagtattccatgacacatggattttacattctggattcttatccatccagcatgaccgcagtcatttttcctccctttgcctttgaacagttttcagttcatgtgctaaaagagcctggctgactttgaacatccgctgcaacactgctcatccagaaaagcgactgggctatagaggcaaagagaaaaggaacttatccgagatcagaatggttcccagtgaaacagaagtgaccctgagatcaaatgtggcctgggagaacccagccctggcgggtggcagcttatcagcgtcatgcccgacacttaactgcttttctaagtcccctttaaagggcacaggcgtccgacacaagcagagccctgcagtgttagcatccgtgagggtgcacagccacagccacagccacagtgaacttccactttcgagatcctgccaaccctggggcacaggcccaggatcacccgctgtgcaggcagattcctttgtgaggccgcaagtcctcttggatctgttttgttttcccccagaactaaatttattttttttctgttttttaatttctattatggaaaaatttctaaaatgccagaacagagatactaatattcccgttacccaccagtgagttttagcaatcagcattctcattcgatctctctctcctgtcccacacttgcttttcctagagtattttaaggccagtccctaatatcctattttgcctgttaaaatttcaggatatatgtgtaactgataagagcttaaaaatatataactacaatactattattatatatcctgggtccttatacagtgcagcctcagtattcatgattttggaagtggttggttaactggaatacggtttcctacctctgaaattgtccatatgcagagctgtggaataacatgaggagtcacccacgtccataagctttga

SEQ ID NO: 77429 - DNA, 1072 bp, Homo sapiens
tgctcaacccataccaatgattcagttgtaatctgggtgactcgacagactcacaaaacatataaatttgctcttctttgagcctcaaaaatcattctagagcatcatttggaacctgctcctgttccttctcccccacccacaggggaccgtgtacaactgaatttctatctgggtatgcctggtcttttatgggctggctgcatgacagggaccacgaggttattttcttgtccttgtgccacatcccagctctgccagaacctttccaaagaaagcctgagagcagctctgagtcttgcactgccagggcttgtcctgggaaaaacctatccaggtgggctaaaagggatagggcctttgggagccagatgtgatgttcaagcctggcccaccccaacagctgccttgcagactgcatttctgccctaggctcccttgtaccaaatttaaagtcagcttgagaaatcagatccaaaagtcctgcagctcctgggtaaaaagatttttgggcactggaagcggcacaaatcgtaaattggtgcagtttaatctggcttgcagctgctgcttaaaatgtggactgagccatggagaaactcaccccctggagtggcctgaccactctccaaacagttcagcagtcattggtgggcttagactgcacaccaggcagagagcctggctggaatagcacagcagagttctgcatcatcccagctcctgccgagggacctgtttaggccccgtcattgtaggaaagaggtcaggctgtcaggactagccactgcaaggtgaggctcggacatggggaagagaaggaagtgaaactcactatagcaccagcagcaatttcagctgattcaaaacagctgctgtggctacccagcgccgtctccccacttttctccctcctaagtatcctgtgagaacagccacactaaattcagaccccctttccttccagctggcctggaccttaatttccctggaggtcccaagactttaaagccacatcacattgagaacaggtagtgtcagaaaataaatgaggtccttgttattcattctt

SEQ ID NO: 77430 - DNA, 1476 bp, Homo sapiens
aaaaatgtcgatcagcccaggagttttgatttgttcggttcacagtgggacctaggcgtctgttgtttagagatgtcctgggtgatttttccgtgcagcctgggttttagaagcgcaggtgtggagcattggttcatgaagacaactcttcatggatggcgtgttcatggactcacttgctaagacttcactttctaaggttgctaatgccagtcggtttccccctgtaaggtggatggaaaatgaagcttcaagttttcatttttgtgtcttctaatgacataaaagaggccaaaattagccagggtctgtgggtgtggtttatgccctgtttgtgatagtgaacactgaaaggaatcgcagcccaggccaagccaggaagcaggatgcctccttcataagaaagatgctgaagaacgtaaaaaatgcacagaaagtattcattggccttcaggagtcagtattggttgcctctctttccttccctcctcccaccttgcaggtgactgacatttgtagctgtgttttgcagtgattctggacgtgggagcagcctcttagatagaaccattgctgacagacgacagcttaatacaattactttgccagacttcagcgatcccgagacaggtgagaataaaaagccagaggggacgaaatggtgtaatggagaatgtgggggcctgggaccaagtgacatgggatgagactgatcgggttggggttggaaaaatttcttgcacaaatagtttaaacactcaaccgaggtgcattgctccagtgtctttctcaagtgtttcttcacagtggggacggtcatatgatttgcccagcccagtgctttctttgaaatctatttccccctttgctcttggaacttaaaatttgaaactaaaatgaggtggtttctgtccccatcaggtttcccctctgcttccctgtgtctccctctctctttgggtttcagaccttgctgaaagcaaggttcactttctaatcagttgcacatataaacacacatacacccagcacaagaccccgtagggtggcaggtgggttccactgtccccatgtggaagcccgaggcacttcctgcctatgagcaaatctgcacacctcgtcgtgtgtgtgttccacatttgcctaagtacaggggagtgagtccacctaactacaggggagtagaccccacagtggtgacacaggtgaagtgtcccttacccgaaatgcccgggaccagaagtgtgttgggtttgggaatatttgcataaacataatgagatatcctgggattggacccaagtctaaacacaaagtccatttctgtttcatatacacctatacacacagcctaaatttaggcaattttatacaatattttaaagaattttgttcatgagacaaagttttgactgcattttgactgcagcccatcacatgaaatcaggtgtggaattttccacttgtgttgtatta

SEQ ID NO: 77431 - DNA, 1047 bp, Homo sapiens
cttcccggcttccttgcttctgagcatgctgggttgtaatgggccccctgctctatctgccagtttcccagtcttcccacccccttccagatccaccccaggctctgcacaggcctccagggcagtaagatgaggaagacgtgggcagtagcagggagtgagtggccaaattgagaatagaccctagcttcatattctcagcaacccgttccctcttctcgatttttgcttaaagggggaaaaaaattacactgagctagtcactaaactgagcattggaaaacttgcaaatagtgttccacctgcagttggagatgcgtctcttgctgtgagcaaaatggtgggtggcattctcttacatttggcgaggtgtttgtcatttcagaagcctggattctatttctctcggtctgcagttttgcttgcatttaggatagaaatctgtctcatgctttgtcttctgtcactgggtgaagtgtaaggctccctcagtccttgtgcatattgacccagccactcaagacagtgtgaattctgaccagaatctcaccagaaggtcccagcaggctccctgaactgaatctcacagcatttcagccagggatggtaataaccacgtttattgaaacttctccatgccagcactgtactaggccactgatgtgttatcttcaatccctacattagccttgcaagatagctaccgttacttccattttacagaaaataaaattgaagctaaaagtggctaaataacttgcccaagtttttccaattgaatatgtagcagaacagtgattcagccccaggcctaacatcaatgctctctccacactggcatgctgcctctcttgagctgacaaccagtttcttttcattttttattgttaaccaattctttccccctcttgtcactgctactagacccatctccatcatgtacccatgaggtgacatctccaggtgattcaaagtcctgtttcagttacttgccaacaaacagcatttaaacacacacatactcacattcacatttctttgctctaa

SEQ ID NO: 77432 - DNA, 1047 bp, Homo sapiens
cccacagaggcaccctgagcggctgccatcccatttaggcagtcttggtaaggcttccaaagcatttccgcttcttgggatgtttttgagcagaagctgagccctattctcacatctagcctcgctctttatgctcatctgcttgtagatcagagactacattcctccctttacctggccctcgtcccatcattccaggcttctgcaagcccaggcatggggaggctgcagccgtggccccactgggagcaccgcaccgccctggacttcctatgttccatttggaggggtcgctgggggcgcttggtgtgaacccatcctgagcttgggcagtgatgggttaggaccactttcattccacctctcacacatgaaaaagagactttcctcctctaaggtacctttgaatgaggacatcacatcatgcagggtgaaggaattctcctggatgtccagctgaaatctctaaaatgccttgctttatagaaaaagtagtcagtgagtaaatgctgatttaaggcccatcaaactcagagcacaattcttggaactggaggtgaggctacagagaggcagagagagatgtcagggctcttgtcctcaggaagaaaatcacatccagaaaacaaccaaagggcaccagagcttcagtttccatatctgttgaagagtgttagacaccacctgccttgacagcttcttccaaggacattgacagcgtgtgaagtgccaaacacaaggcctggcacgtgggatgccttcggtcagcaggagctcctccctctctttttcttctttttattattaacaacaaatgccagctaatatggcacatactgagtagagaagataaggggttaaaacttgaagacttacttatttaagtggggttttggctgggtttgggaagaattaaagaaagatgtgcatgagtagaagttgaagttggggacgtggcatgtgtagccatagagttgtgccagaaaagtagcatttggcctatgaattacattggcagaagtaaagggtccaatcggatgagacagt

SEQ ID NO: 77433 - DNA, 1021 bp, Homo sapiens
agatcgagaccatcctagctaacacagtgaaaccccgtctctactaaaaatacaaaaaattagctgggcgtggtggcaggcgcctgtaatcccagctactcgggaggctgaggcaggagaatggcgtgaagccaggaggcagagcttgcagtgagccgagatcatgccactgcactccagcctgggcaatagagtgagactccatctcaaaaaaaaaaaaaacaaaaaacaagatagaaggacattctgatggatgtaccaacatagatgaaaattgaggacattatgctaagtgcaataagccagtcacaaaaggacaaataatgtgtgactctactcatatgaggtacgtggagtagtcaaactcatagagacagaaagtagaatggtggttgccagggctgggagggggaatgggaagctattgttcagtgggtgcggtttcagttttgcaacacgaatagagtactggaaatggaggctggtgatggttgcacaacagtgtgaatgtacacaatgccactaaactgtacgcttaaaaatagctcattagcaaattttatgttacgtatattttactacattttaaagaaacgaaactttctgagctccctttgttaacatgtgtggctgcaggagggtttccagcattcgtagatgacaagggacccttctgctcttgagattctccggctctgcatcacggagccaatgttcttctgggatggacttgctgagccacggaagcagcctcccagcaccccacgcgcatggatgtcctctttctgtgaggctttggctctgtgctgttgccttcactaaacatagatgcttgtcaagagggacaaaatcccccaaatgcaatgaaaaattgtctggaaactgaagatttggtttatgaggcaaaagtagaagaactggaagaggggaaatggcaggaaaatgtatttgaagccacgtttgtttatgagaggatcctcctttctccggggttggagacagccatgtcctgagattagga

SEQ ID NO: 77434 - DNA, 1286 bp, Homo sapiens
tgtgtaaatgcactaagatttccttacttagtctactgtgaatagatacgtgggttgttttcaggttttagctattatgaacagtgcttgtaaatcttctttacagggctcctggtgcacacgttcaaggatttctctatgagtgaaatagttaggtcgtaggatttgtgtatcttcaactttaccaaataattccaaactgtttttcaaaggggttgtattagtttacactcccatcagcagcgctcaagagccctgtggttccatacaccaatacttggtgctgcccgacttcatatttttggcagaatggttgctggttaatgatgtcaccttgtgagtttaagttgcgcatccctcattactaatgagtttggacatctttttatttgtctattggtcattcaccttttctcttttgtgaagtgtatgtgaaattccttcttttttattggatggtcttttccttaataatatttctttatgtattttggttacaagtctttttcttagttatatgtgttgcagaaatcttctcccaagctgtgattttgttttgctttctcttcatgatgtcttttgataaacagaagttcttaattttaaagtaatagaaagtagaagtcgtttcctttatggacagtactttctatgtctagttgaagaaacctttcccttctccaagatcatgaaggtagtctcctaaatcatcttctaaaagctctcttgtgctatctttcacactgaaacctaagggcccacctagaatggactgttttatgtgtgtatggtatgagccagccaatgtgattttccccataggatattcaattgtcccagcatcaaacgctgaaaagattctttgccctgttgctccacagttccacctttgtcatcaaccaaatgtccgcagttgtttctaagtttcctgttttgttccattggccatcgtgccagtcccatgtgattgccactgtcttgtcactgtcatagcttcattatatgtaaggtgggtccctctctgtatcctgctctttaggttgccatggcttgtcttgggcctttgaactttcacataaattttcaaatcagctcgtccagttccacagaaaacttctggagattttggaattagtttaatttaatagcttagtttggggagaattgtatatttatgacagtaggttttctaatccatagccattatagctccctaattatttaggcctttacaagtatttttggatgtttttataattttttaataaatattttgcccatttttt

SEQ ID NO: 77435 - DNA, 1041 bp, Homo sapiens
ccttcacttttaagttgtgtgaccttgagcaagtcactaaatctctctgagtctcatttcctcatctacaaaatgtgaataataaaatatccatctcagacagttgtggtcagaattgatttagctggtgcatttgaggcattgtacctggtaatcacgtaataattggtagaaactcatattactatgactattactaccaatactactgaagtatgttcaaatatggtattttagaatcctttagaattgttcttaaatatggaataaaatcaaatgaatgtttattaaatatatctaaaatcatacaatgaacatatgtgtttgcctattcgtagtttagaaaaaagaacattaatattacctgtgaatttcctgtgtagatttatttatacatatatacttacacgtatcttaaacatgtgtatgtatttcctaggtatatggatttttcgtgtaatattgccaatgatttttctctgtatcctgtccttttgcctgtcacctgacaggttaatgaccattctaaattctatgttaatcattctctcatgtttctataccatgtatattgtgctttttctttctctctctcttttttttttgttttgagacagggcctcactctgtcacccaggctggagtgcagtggtacagtcacagctcactgcattctcaaactcccagctcaatggatccttcagcctcccgagtagctgggagcacaggcgtgtgccaccatacccagctcatttttgtattttttgtagtgatggggtttcaccacgttggccaggctgggctcaaactcctgagctcaagcgatccatgcgcctcggcctcccaaagtgctgggattacaggcctgagctaccgcacccggcgtgtactcctaaataataaaaattgtgttttgcctgttttaaacttttggtagaaaatggaatcagactgaatatgtccttatgctgcttgcgttcattgcttaacatcccgttcctgaggctcctccttgttgcacgcagcagtgactctttggtt

SEQ ID NO: 77436 - DNA, 1036 bp, Homo sapiens
gttttgtaacttattaagcactttaatttcagtaatacttgaaaaaatgagaacagttcagctaaggcagtttaattccactaaaaatctctgacactttgtatgtgtctccacttagagcaaaatcatcttgggcataatcaaaagtagatcagttttgtggaaagaatgagaaagtgtttactcagggagaagggaaagacttggagcagtattggcagctacgtagagaaacagggtctcctgtatcactctatcagtcagaatgtcttttgaaggtggcttctgctttcatgtttgtggttaatatcctggggctgccataaagatttggcttaaaatgtgaatgaggcacaatgtgaaacaactcaatatttgaagagaagcagacattgaaaagatggcttctttcgcgcgtgtgtgtgtgtgtgtgtgtgtgcgtgtgcatgtgtgtatgtaaaaccttttttggttttgttttaaaccagatcccagaggctctggggtatgtccgccaagctcttcagcttcaaggtgacgatgccaactccctgcacctccttgccctcctgctgtcagcacagaagcattaccatgacgctctgaacatcatcgacatggccctgagtgaatacccagaaaatttcatgtaagtgatcctgggctttggttttcccttactcagaagttattaaatttacttcttcccctgccttctttccaatctgtctaagtccctcatggacaccctggcagtcaataatataaaatcccctttactgttattttttcctgatattaaaaacaaacttagggctgggcgccgtggctcacatctataatcccagcactttgggaggccgaggtgggtggatcacctgaggtcaggagtttgagaccagcctggacaatatggtgaagccctgtttctactgaaaatataaaatgtagctgggtgtggtggcgggcgcctgtaatcccagctcctcgggaggctgagggaggagaattgcttgaacctgggaggcagaggttg

SEQ ID NO: 77437 - DNA, 1108 bp, Homo sapiens
gcctgcacttcttccttttgcccagctttcttgttcagtatctgtctttctcactggactgtaggttccaggaacccatgcccatcattgtcattgctttaccctggcacttggaatgccacctgacatgtgttcagcactcaggaatactcgctaaatgaaggaaccagctttgaattccttcaaggcagctatcccttaaagacatcgttttgatccctgtatcagtttgtccctggttgctctggtcatccctgcaaatcaacatcatgcctatgctttgcctttcgacccacccatcaataccaggttgagtgctattcacatagtaggttgtcacctggggaaggatgagtaaatggagccttgtgggtgtggcagcagcctttgtgggcatgtagtgtcagaacaccagagctccgagggagtgtttccctgcttccccaggggagggggtttgaccaggaggagaggatggacaggaatcactctcttgtcagacactcaatagctgggtgacctttcccaagccatttcacctcccgggacttcagcttcctccctgtaactgaaggattggggtgaatggtctctcttccaactgtgagagctgtgattctatggttccaaagcagaaagcctccacagccagcagttataacctaaatccatcaagaaaagaagttcattgaggaaaagtaattggtttgggaaagagaagtcatagccttctactaaggagggaggttactgagggtttgggaaaaagcaggagagctgagaagaggccccacagaggactggagttggagcgagaccggaagccatctgtgggatggttgtgcaagaatgcttcagtccagagctctatttcgaaatctagcttcgggttctaattctccctggttactgccaaacctgcatggaatccagggtgtcacatacccattttgtgtgtattttatcaacccttgtgcttggatgattttgaagaaagtcttgaacagctgttgcactgaaaggttcaggatgtgtctggtcctacatgaatttggacacatctgctttgcatgcggcattgcaatttgtttctcagatcaacttattt

SEQ ID NO: 77438 - DNA, 1688 bp, Homo sapiens
gaaaagtcctgaggctatgtcttgaggccaagtgaagagtcccctggaatggaagtctatgtgctttgctcctaagattaatataaggacagagattagctttgcctcaccctggacctgcatatgagctattacatttgcataaacaatgacctaaattagtgaatttagcatattttctggatggcaaacacctgggaggtttgttagctcccttccctgcagcagacagtccaattaaaaggccttattattgtagaaagccatctttggcctgtttgccacagttgaatccataatgatttggttttcttttttatctcgaatttgttttctgctggtagaagatcctcctttaatcacagaatgttgacagaacagcatgaagttttgtttactatctgggtcccacctaattagtctgctccatggtgccttttaaagaaagtagaagtttgtttttctcttcccagcagttaaacacagaattatgtctagtatgtagtcaaattttgagttgcttatgctgaaatacaaatgacttccacatagaagcagagaagaccacgtttgcaatcagctaggaggccagtatggtcccttcctgtctgacgtcaaaggccagttcttaaaactgagcctagtgtctcaccacactcttacacgacagttatctgcaataaatcagtgaacggcatggaattttgtagaagcttcaaaagactgaatgagtgcctttctcttcccttttttcaccaaaaacccaaacctcattttataagcaaagctgggtctttgattttcatatggtttctctgaaatctagaaatttggataaagtagcattaaggaaggccaagccaaacttaaccaaagcagccatcgccttgccaagtgcacacatggcttcactgcgtcccagcacgacacagagacccatctgctggggagatcagacctcagggcctatggattcttcacctcgaggccctccgcaaagccgacaagcttcagctgccattttagatgctagacaaaacacagaaatgcactcctattctgtacctttatacagtggtaagagggaaatggtttacatgtgtaggtggacaaagaagaagagtttaaatgaagcattacatagttaaataaatacgggcccttagtataagaatgcaaatgtggagaagacttgcttgatagggaaagtaaaaatggcctcctctcccatgtactaatagccgtaaatactttttcagggcccacagcctgtcacccacagatcaccaagcagctttctacctggctctgcagcttgccatctccagacaggtcagtttctctaatgtttcctatacttgctgcactctgtatcttgatacaactccttcagctcttcagtttgaagtggtaggtgatcttcctttattccattgaggctgacctggagccaggaacccttctcagaggtttcagcaaagagcctggtgttttggttggtttgagcatcagctgtgaagacacaggagttccaggctctgctattggacattaaatccacacagctggagggcccaagctagggtcagatggcaacctggggagcagcacatggcatataccctgaacccaggagtcatcaaagagcctctgtcccttgccaacaggaaccaggtagcagaacccag

SEQ ID NO: 77439 - DNA, 1012 bp, Homo sapiens
caggaagcttagctgctgaagttgctccacgggaagcaagtattttagcatctacttgagatcaacacagggagctttttcttgttttgtttggcatttgccttatttccttcagagggtgaagtggtcagttgaattcattagccaagttgtagaaataaggtttttaaaatgtatatgtttcagttgtgcctcattagaaatttggcagttgaatatgcatcattagccaagttggaaatccttcagatgttgccctaatgcactccagaaataccaagatttctagcacttctggtttgttcctttcacggtgctgtggttaacagagaaaaatcatttgatgaggccagcatggggcctttagccagaactatctttatgtacaccctcaactcaacagatcattgccagcttttcagttggttggtattgcatagaggcaaccatgacttgatttattcgtgaagaatatgaattgaactgagaaaattataattctaagaagttctttttgagggttctgtaaatttattatttgtgaaagaagataaaataaatctaaaaatttcttcataattgtgtattatttttcctgaataattatgagagaaaccatgatttttcaatctcacttttataaacaccaaagaaaaatattctttgatgtacaaattcatggaaagccaatatttgtaaaattataaaagctgctatatactgagtggaccttagaaataagccatttagtagctgggcgtggtggcttatgcctgtaatcccagggttttgggatgccaaagtgggaggatcacttgagcctagtagttccagactagcctggatagcatgttgaaaccccgggtctacaaaaaattctataaattagctgggcgtggggagcacgcctgtggtcccagcaccttgggaggctaagatgggaggatcgcttgggccctgggaggttgaggctgcaatgagcagtgatcatgccactgcactccagcctggg

SEQ ID NO: 77440 - DNA, 1108 bp, Homo sapiens
gaatgtgagaccctcacctgttcctacactcataagctcaacccaggcagctgaaccaattcatttgccctgtactaaagtatagtgaagaagaacataatattgtttgcaaagcttctgaagatgctgaattgatatgacttgcttcttctgcaggctctcacatcctactgagaaaagccatcctgaaaacagttgagagcacctttcattgcatggcccacagtatgcataaagcctggtgctccaggaggcaggggtggcatggtggtgtttgtttatcactcattgtggcacagggtacacgatcttgctttgctttcccctttctgtcctagcttgagtttaagtgtggtatgatgtgtgcatatagggtgatcagccatcccaatctcttgaggactgagcgttttcccagaacatgggacttgcagtgctaaaatcaggaacatcctggacaaaccaggacaagttggtcaccctgtgtgagtaactaacgagagattcctgagcaatagatttaaccagggtttgcactttttaaaaaacttaatgcacgaatcccatggcccctgtaatcaggactgaagggaaattcaaggagaattggctaaacaaggcagcaaggttctggctttctctcatttgctggctgttcttggacaagaagcgtaatagtcgataacttcacaaattgtagttactattgttacaagatatgtgtcttatggactagggtcagcattgatcagccttctctatattcttggttcagctctagagaatgttggaaatggaatctaagagagccctgggttagatgccacaacatccttgggttctagccaggtgatctgggaagcccatccgatgctttccagtagcagcccagcatgcctatctctgggcactgctcccactgcacgatgatgatggtcattctgggtctctccctctggggcgggggtgggagctcatcaaggaaaggcactagcatgattcatctccatgctccccagaagttagcatagggcctggcatcacattatagatattgcataatgtggatgggtggatggtggatggatgggtaggtggatggttggat

SEQ ID NO: 77441 - DNA, 1009 bp, Homo sapiens
acaagcttcgttagactctttccttagaactggggctgcctactgatttatcatggtgtccgtatgccttttttcatgaaatcatgatcagtggtttcagtgagtctgaaactcttccgtctcatttctgtttcctagcaggcttgccggtagctacttcaggttgccagccccagtctgggtattgacaaaaagtaccaactgacatctgcaaacagatctcctgtctctgtgctaagcttttgttgatgttcctcagcacggagtgtggaaagcatttccatttcaaatgatttggagttttaaattctccagtcctagtttgtaaaacccacacatggatgcttaagaaagtggtcattacatctgtttcacttttcttaaatcagcacatcttactggctctctaaaaacagccacagtggtggtctgccttgagctgccagtataacttcatgttatataacagctgctccattggcctgaattcttttttgttcatcttttgcttaagtttaaattcgaagagatttttaaaatattagttcatatgggaataaagagtaataaaatcccgctaacctaactgatgatattgcagaaggctaacctaaattagaatttgtgtgaaatatagaatgtttttcattttatttcaagtacacattaactaggactattctagtgaattgcagtcctaacaaaaatctttaagggaaagattttaagtaagtgaaaatgatttgtattacttcttaaatgtaaatggataatttaaaactactttgatgagaagtactttctctactatttgttttaaatattctccccacaattctgtttatactaatgttttgcattttttgtttaaaaagaaaacacaattcaggaagggatggggttgcagatatagcacaagaaagttaactcttaattatgactgccagaattcagacatatttgttctctagtggatccaaagaggtgatttttgaagacatccaggttg

SEQ ID NO: 77442 - DNA, 1006 bp, Homo sapiens
gcacctcactgcgctttgagggatgattcatccacctagccttgcacctgcccctgtcccaccacttggtctgggctgtcctgtgtgaagggatgctggatcttaggtacaggaatgtggaagagtcagggccagacacttccaggaagcttcccttgactggtcaggaaatgccccttctccatttgcacattttaatttgtagatatgtacatgtgcagtgcagcagctcacaagacacctaggggtcttgggcgcagtgatttttggatgtgcttagagttctgatggatgggattctagctaagaaaaaatcttgtatacttaagttttcagtgatatttgcagaaaatttaacaaacttttcctgaactgttactattcttttatcatgttgttgttaaatataacacaaatgcaaaacaaaaatcccagaaacacatggttaatttaatgaattttaattagtataaggcaaaatatcctgtagtcattaccctgctgaggagctagaaccttgccagccccctggggagccctccgtgtgcccctcccaatcacaaactcccttctctcccttacgaggaaatactatcctggcttttgtaatacttcattttttctttatggttttgttgtaatttattttacaaattactccaaattctttcctctgccctaaaatatcaaaggtcctgggaaagttgtgcatattaattacttttcaatatggattacttgctaattttccatatacacatggtacattggcaatacccagcacatagcttttgacatagtagactttgagtgaggggcaaatttaatgccacatattaacccatgtaaattcttcagactctacccctcattactcctgcaactttgggagagttgcttgaccctatggggcttccttttccattcttgggtcagttgggtcctttctgaggttctctctagctgtgtcactgctgttctaagttagccatggtctccagccaca

SEQ ID NO: 77443 - DNA, 1137 bp, Homo sapiens
tactagggaggtaattgctaaatccctttctgatgccagaaaagcttctcattcctggagccccctcagagatggctgatttatgaaaagctggaaaaagagactggaaaggcataagctcttgctaccaaaaggaaacgttttcgcaagtgacattttgactcgcacttaaatgattaggatgccatttagagtctaattattgttctaccaaatattcatggtattaaatgaatgttatctgggattagagaggtggcagtcatgtgattacagcgaatggacctatctttcctggtagaaataataccactgccaaatccatcttcttttcttgtgagggaggtgatttggagatgtcacctgctgttttgtgtgggtgactcagggatctgcagcctggactggccccacttcccttcctaggcccacactgccatccctctgctggactccacaagtggaaaaggggccagaatctagctcatgccactcaaagactcctattcacactgcctttgccatccactggcatgcccaccctcattcccaggggttctcattctccccttcatctgcccttcagaaccctgaagatctactcttgctttgtttcataaaagccaacccattgatagccttcattgtgggccactcttttgagcatttcacatgtatttctgcatttaacccccattacaaccccatggctgggagtgaggagcttggattaagcctaggcagcctggccccagaaccagtgcctttaccatgtgactgctctttttgtcctcacgccctgcgagctgggcttgagtgattaaagcactctcttatatgccccccatgcacagaacacctgccatcttctgaaaagtccgttttcatcaatgcatctttttcactggaaccattattaaaatgtgaatgcagctgggtatggtggcccaagcctgtaatcccagcactttgggaggccgaggcgggcggattgcctgaggtcaggagtccaagaccagcctgaccaacatggtgaaaccccatctctactaaaaatacaaaaaattagctgggcctggtggcgggcacctgtaatcccagctactccggaggctgaggcaggcgaatcgcttgatc

SEQ ID NO: 77444 - DNA, 2940 bp, Homo sapiens
caaccagcattaacacttacacgtcagggcacagcatgtcttcctgcttcttggctcctctccttggctgacctgggcccacgggcaccacagagggtgggggcgcctctgctgccactgccagcacatgttcctctctctcctgtccttggcacccttgtgcagtgggtgtgttgtgcagcgttgtgcagacccagccttttaataactgtgctcacaggggtaagtgggagcagagcctctctttctcaaggaagctggcctttctcttatgcttattcaagatggaaggctgctctcccatctcaagaccggccgcctctgtgtgcaccacatcatcgtgcctttctttccttatggacttttcagccagatgctggccaaagagcattgtacaaaggagacacagaccaaaggtttatcacatcctcattctgacaggtttaaatagaagcacaatgtttaccatatctccagtgctgtgagtttttgtgtttttaaagactaattgtgagccctgctgaaaggtttgtgtaggaaggaacacttctttttttcctcttcattttaaacagcagcactagttggcatgacaacctgcgctattaaaagtaaagcagcaagcaccgcttcctctgtttttcagaatgaacccaagctgctaaggaggtttgtctcttgaatttgactattaatggctccatttcgacaggatattatggggtccttttagaaggttgtgtgtgtcccccctccataggcaaggcagctttaaagacaggaatggtatttttatctttcctgttgaactcatattcatgtgtttgtggtaaatctcaacaacaccatagttctgtgggtagaactgtctgactagtgattgtaccaaaaggacatttacacctccctaacctaaatgcttatttaatcagggagcacagtgaaaagcattgcacatctaacaacgtctgcttgccaggcccaccatttgtttaaagttcagcattgcgtgcagtcctgcttgtactgtagaaacccagccttgagctacgtgccaaggtttctagaaggtatcagtgggcatgacacaaatggatccgtagacttctgagaaatcaaggcagggtgtttggctaatgctaggtggttcataacaacttgctgaatgcaccagtgcttcaaagccagtgtgcaccctcatcctgccccctttcctttggttttagaggtccctagatgtgcaaggagtgtatcttccccaggcaggcccaaaggttaaaggtcattgagtggaaaatgggcagcagagtaagggatgggcctggcttggggcagagcacctggacagttcccagctctggtccagctttgtgagtcggctcaataggaaccatctttaccattttttcatgacaccctgccccaaagaatgtcagcctctgacatggcccctgggatctccattctcaccattatggaaatgttcttttgaattaagcattgctttcttaacgtggtcctcaatgaaaatgccaacacgtttgggaggaatggaaggggtttaaactcttagggtagcatagttcagagaaacaaggaatctaggtatatacctcatggttttgttttagttctttgtttaaaatttttttttaatatgccatgttaacctttttaaagtgtaaaattccgttgcatttaattacattcacgatgttgtgcaaccatcatcactatctatttccacatttttccatcatcccaaacagaaattctgtacccatcaagcaataacttttcattctctccttcccgataccctagtaaactctaatctaatttttgtctttatgaatttgcttattttgggtacctcatataaaaggaatcaggcaatacttgctcttttatgtctggcttgcttcacttagcctaatgttttcaagattcagccatgttataacaatatatctgatggcattaatcagaacttcattccttttcatgactgaataatattccattgtatgtatatgttacattttgtttatcccttcatctgtcaatggacacctgggttgtgtccaccttttggctattgtgaataatgctgcagtgaatactgtccttggactttccttccttctcctgtccccagccaacatcaacacttgcacataaagacacagcatgttttccgagttccttttttcagttcttttgggtttgcacctaggagtggaattgcttggtcatatgataattctatgtttaactttttgaggaactgccagactgtttttcacagtgactgtaccatttttacattcctaccagcaatacacaggtttctaatttctccacttcttcaccagcacttgttatttttaaattattattaatatagacattctggtaggtgtgatgtgatatctcattgtgggattgattttcttttccctgataactaatgatgttgagcatctttttatgtgcttattggccatttgtatatcttctttggtgaaactactattcaagtcttttgccaattttaaagtctaaataataaactctggtcagctatatttttagagataccacacctgcttttttttttttttgtagagacgagactgtagaaatcagcttgggctggtctcagactcttggcctcaagtgatcctcccgtcttggcttcctaaagtgctaggattacaggcatgagctaccatgcccagcttcactttcttgaaatgtcttttgatgtgcaaaagttttaaatcttgattaagtccagtgtatctattttttattttgttgcttatgcctttggtgtcataactaagaatccattgccaaatccaaggtcatgaaggtttaattctttgttttcctctaaggattttacaattttgctcttatatttgagctgtttgt

SEQ ID NO: 77445 - DNA, 1131 bp, Homo sapiens
catgttttttcaggccaaccgggacgctgtgctgagcaggatacctgaacacaagagtgaccgcctcatcagtctgcagagtgcatctgtggtctatgacttactcaccattgctcttggaagaagaggccagtatgagatgctgtcagaggtacagctgctgagtctggttgacatccaggtggtgggtggcagttgcacggtgaccccagggaagcgctgtgagacctggtcctgggcccccctctattagtggcagccatgtgatcttgggccagtcacttaactttggttttctcccctgtagaatgggccttgggctaaatgattaggtggtggaattgatctagtcttttaccatgagagttccataacccaccaggctgtgagtttgtgtgtgagggaaggcaaacatttctcaagcagtttctctttccaccaactgaaaatctcccatctgtgatattaatttcctcatagaacaggtttcctttaaagtatcaatgtgtacagtgaaatcgccagtggcctgacaatttcaggcacagtgtgttatgttagctggtatagaccgtttcatataaaggagacagtcttctttcagagtcttttgcttgttcagaagggaccctcgtggatttcagatcttgtgcaaggtactgtcatcttctcactccctcagtttctaagaaacgcttaggatggaggcttgcctctttcacagtttcaggagaagctggttcatcctgggctatggttatgcattattaggttcctgcccaaaatatcaaattctaccatggtaaggctaaataaataacaagaagatcactttatcttttctttagcaaaatagagaaaaaaaaatccctattttttaaaaggaacttttccatgttatttatctttctctttctaaatttatacccattgcaacagcctctgggcacgaggacagggaatgaaatacagtaacagattggctgaaatcagataagtgcccgactcaccctctagcctgccagtgcatcgccacattaggcaggaaccttggggaaacagatgagcctgtgtggcttgaatctttttttagtccatggtttggtgactctacagggcagtggttactca

SEQ ID NO: 77446 - DNA, 1063 bp, Homo sapiens
tggcactaggtggcattcaagtgaacgagtctccacaggcttccccaccgggtcatccatggagccagctcatcttggcctcctggtcagcattccctcatcccaagttgggtccttggcaggtagttccctttgggcaaacttggttggttatggtgtaaaagttctgaaagcatgatgactgtacattttagattacctggacaattctgattgaaaacattatgttccactgtcagatgatgtgttccagtctgcaatttggaaaacatggccacctctctaaaatgcttgcactaagtggagatgtctttggaatgatatctccaactctcctgcttcttaattgaagtgatagaaactaataatactcaaacattgagatccctttgagacagtcagatttggctctatggtatgtaattgccagaaaaatctcttcaggggatgttgaaatccagtgatgtcatcagtggatatgaaggatgaggtttctaaccaaaatgattatgttcttcctgtaaatcatttcagaaaatgtaggtagaaatctaaatgaaattgcctttggaagccttttttccatatcctttgacttctcgattgtttagtttttagacagaaaatgaatgtgctcaatttcaaaaccaaaatgaaaattgctgtgttttttggatgtcagaaaattgtgttctttgttggtactgactttaattcagaagcatgaatttgtccgtcgcttctccacctacaaggtatcatttagaattgtgctgttttctaactacaaatcaaattagtttcccctaggagaatgggattataagaacttgatttgcagaactaccactgaggcaatattctgggatatttattatttgtgggtctgtttgaggttctatattgtacctttttaatcaaaagatactgatactttctctaaaaatgaaaagaatgcatttagtataacttgaaagtctctcataaatagtatgtttgttttgttctcttccaggcattggtctcagtatggaacatatatagcaaataaataaaatgagac

SEQ ID NO: 77447 - DNA, 2444 bp, Homo sapiens
cttttcataaaattttagcctcagaagaatgatagaaaccatcctgcaggtggcttccttacctccagcggtatcagcattgtaacgagaataccaggcgctgcattcctcctgtcttgctctttatcatcctaagatgcagtacaaaaattgccagcacttcaaagaaaacaaatgtttgtaattatgtggaaatccttttttttttttgccttttattgggggtgtggggaaatcccttcaattacatgattgtaatattatccctgggaagacataaacttagttgtttttagtcatcttcaagatatctaggagttttttttaaaccaagttcatttttatttattgcactctcttcgtccatttcatgaaaaaatattgagtttgacccaattggtgataacattcacaattctgctcaaaggattctagagctttagaacaggagaaaaaatgctgcaattgctcacaacacagaaaataggctatagagaatacagattggggttctgctgactttttattattctctaatcctgagcaacattgagcttaaaaagctctttcttttaatccaagatttaggagttcagccaaattccataaaatagattaataagagctcttgcatgctaccccataataaaacttatgtgtctaaataagatagttcactaaattcttacagtattagagaaattattcaaactctaaaattgcttctaatctcttatttcatctaaacgacagtataagatatgccagttagcaggtaagaggtaagaagagtactgtttagtgaaatgcctgcaatttatacctctctaataggtttaggagaaagcttgtattatttagataatgtcaatttattgaaatctaaaattctgcctctgtaatatgtacatatgttatttgggcttttaacttggtttttacagctttactttacccttctgcctaccactaaaatgcatagctaaaatgtatgaattccatagattaccatagaaataggcaaattaattcaagtgtccaaattatacagtatttttcatgggtattatataaaattctggaagcttttagtgttcagttctgcttgtatttgtatattttgaaactgccatatatcaaagtcagttttctttcaactgcagcattttttgtcctcaagaaaatacggaagaagccctgttgttattgctgattagtgaatcaatggtaagtggaatgtgtttttacatcgttctttcccctggccctgtagacccttttttgatatagccattctgccagtatcatgactctttttcttaagagaaaatactttctagagggtatacctggatgggaaaaaacagtagaggtttaaaaagagggttgtttcttaattcctggaccagctagcaatgtcccttggttagcctggagcttggagcttctctatcttctatcttgaagcacgtatcttagttcattcattcatccacccagtattggctgaacattattgcagttgtatctaggtaaaccacagctaaaatgaccactggaggaaccttaaaaggagaaagaggcccccaaagggtgacctttataagcctctcaatttgccctggagtgggcgagaattttgggataagtcatttgttggatctataaagctctggtcttcacagcaggagcttgatgaaactctcatcctcctgcccttgttgtctcttccagctcctggctttgccagacactgtaaagtcccaggccgtgagagctcacttgtcactgctattgtgagggagtttttgccagaccctctgattcctttgaaacattttcttagtatttggccagaatatagaattttaggtctatttcaccactcatcatttattgggtttctgccctgtgtatctatcactaggcgctgtggccctggcttaaaaccttcaggatcatgtgtgtagtaatagtgaattcctcagcagaaaagtgatgtatactgagcacctgagcagaatgggtgggctcctggaatcaaaagatcttgagggctcgcgtccccttccctcgttttatacatgaggaacctgaggcctagagcaggcggaatgcgtgcatcacgcagtggtctcctgttcctgctaggagattgtactgccccctccccatagttgtcaccgcttaccgccaacccccggggcagcccaggggagagaagggaatcataactaaagcaagagaaggcatttccctttttgccctccccacacatactgtttaatgggaggtataaaatggactcaggtgagtatagacatggggtctgagcataataacgtacatgcgcggagagaaggagggttcagaagaggccagaactcatgagagggcagctttcttgcctttgattaaaactttgaatggtccactgatgttta

SEQ ID NO: 77448 - DNA, 1005 bp, Homo sapiens
ctttttattattgctgggttctatttgctgatattttgttaaagatttttacatctatatttataaaggatactattctgcagttttcttatgatgtctttgtctggttttggtattagagtaatattggcctcataaaatgagttggagactattccctcctcttctttttgaaagagtttgtggagaattggtattaatcctttaaatctttggtagacttcaccagtgaagccacctggacctaggctttctttgtaggaagttttttttgtttttttttaaatgctaattcaatctctttacttattttaggtctatttgtattttctatttcttcttgaatcagtttgaatagtttgcatctttctagaaatgtgtctgcttcatgtaaattacctaagttgcttccgtacagttgttcatagcattcctttataatttttttgtatttctacagggttggttgtcatgttctctcatttctcattttagtaatttaagtcgtttttctcttttttagagtcagtctaactaaaagttttgtcaattttgttgatctttttgaggaaccaactttgggttttgacttttttctgttgtgattctgttctctgtttcatcgatttccacatgaatcctatgccttcatttatcaccatcagtttttagctttgtaattttgtgggttcagagctctacttcttagaatattagtaaagaggaacagctgtgggagttattcttgtttggaggttcccttcttaccaaggctggactctgacccattcacattggcagaaagcacattctcaccattcagttatgctggtttggaggtgggaaagggaatccgtagataatgtgcaaacctcattttggctaacagtctccttctccacagtctcttatgagaagtataataagtgtcaagcaaaatttagatggcagagatccctctagctccagaaaaccacaaggaccattcagaagagttggttgtaa

SEQ ID NO: 77449 - DNA, 1293 bp, Homo sapiens
ttcagggatagcgttatctaagctgagtacaagcattttgccaggcttgaggttaagcacacatcattagtgatgctaatatctgcagctcacctgttatttataagagctcttgggaaagggcttagccaaaagtttcagttgtttcaggtataaaacatgtttagtattccagagtgtgacaggtggggtggcatttgaagtacatgaaccttttaagtgttcaaacatcttagtgaatcatattttcttttctttcttgtcataaactggtatgattaccatcgtaaaggaaaaatttttaattatgagccttgcagtagtgcttagcacaatgtgatgatataaatatttattgactgactgaatgaatgactaatacaagatagattcatggctatgcttttcctcgtttatgttcccagacaatagccaggcagctggcagagatcttgttgcggggtatgtgtgagcagagctactggaaccctctggaggatccaccgtgccagtcacctctggacgatcctctccgcaaaggagcaaacacaaaaacctacactctcactcggagagcccgtgtctactcaggagagaagtatgaaagttgatgtcctcacttgtaggttatgggttgggaggaaaacttgggaaaattcaaggatgatgagaagtacaagagtagattttttccttaaaagaaaatcaaatgaacaagtgtcattttccagtttagtagagattcctcattacttttcgtaacttcagcaaatatctgtgcactagcagggacattttaagtaggagaatgctctcatctcagtgcttgggtgccatttgcagccatcactattggcttttggaattttctttccatttattataagacctcagcatcagacagcaatcagaaataaagctatctgtaagccatctaacatctaacatcgatctcacccatctaacatttcttttcttcagcaattccttgatccttttgtttaaaatcttgttctaaatggaactagatataagaaggagaatctaatatttgcaagtgattggaaggtgatgtgtctttagaacttctttatcttttttaagttttaaatttgagacttgatcaccttggaggataatgggccagagaatcactatagacttagcatgagccttccccaggccaggggaagccagacagaggagggagagacaaggagaagggctgggaggctggaatggttgttgactcattctcaatgcctcccattcaagtcttgaattcccatattt

SEQ ID NO: 77450 - DNA, 1040 bp, Homo sapiens
tctttttttaatcctttcactttcctatctagggacgttcattaggtagacctctataacttgccctacacagccatagccagtgggtgcttgagtggaggactggtgcttattaaaactaagcaaatgccacatgtcacagttgatgtaacaacctcatgtaagattgcaatttatcttttattgcccatacttttgtcctttctttatcatgaatcctttaaatgctgtaggagattattcagttgggcatggctaagagattcatgtcataggaaatgacttcattgtggtgtctgcagagttttaagaggtggacgtacaactcatggggccagatggccaagctgggctttcctagaattatgggggtgagacaggatggacaacttcacacacacacacacacaccctgccatcaccaccaccaagagctcagttggccttcaaaatttacttaaatatcaatgtgatttataggtgccttaagaagttcaaacaaaatatttccatttttaggattcttcaaggcaaaagaacctacaagaatatggataaaagttgttgccagctgtcttttctctcaaatttacctcttctcagtattcataaaacttcccaactggtcaatatgaacagcttcttccaagatttggaagcacaatgaaagtaactgactgaattggcaagtgttttcgtaattgttttaaaagcgcatttaaaaagtcagtttttcaaaattgcttaagtatggagcatttgttcatattgttgactctcactggtatcttgatttacattggacgttagaaagtttctccatctaatgacattcataagcagtgtttccatcagccttaaaaactatgattttttaagattagctgataattgcaaatttataatattcttatgagatggaaaagttgctttgtaaactctatctggtgtgagatcatagcagagaaggatttgaaagtatattttcaacagttccactcttaggtatatactccaaataattaaaaacaggtgttctg

SEQ ID NO: 77451 - DNA, 1037 bp, Homo sapiens
atgaccagttcctatttgtaggcttccctgggttacaatatttaggtttgatcctgcttattccaggcctgatttctacctggtaaatcagccccttcaaccagggtctccacttatgttgcctcagtcacagcttatttcatacaattcaaagtaccatcccttctgtacccagtaggagtttaatccgtgattctggaacaaagttagactaccatatccattcccatcctttgtttagctgtagctatttccttcccgccgtgttacttaagagaactgagcttcagtccaaagcaaatgtactttgttgcctgtgaacatggatcccataaaaacaaatgaaggagaaagcagagtagattgcatgtcccagggcctgttacctaatctttattcacgtctctgttaggtttcctttagtgctgcttggcatcctgagcacagcttctctttttatgccaccatcaagcttctgatctgatatcatctgatatgtgtgggtgagaggactatgggagtatttatgtacctatgccaataaatcattatcttaaagttctggggccattcttgtgcatgagagccctgggatgtcatgtaggtataagatgcgaattaatagccctcatgagtgcttgtaacttacagaacccacattcagtttgatttaatatctttgcatgattcaaaatgtcgtccaagaagagagccaaatacctagagcatctgccacggcctgcagaggctggctgacacgtttgcactggctgacccacactgtggctttttggaaagatgagatatgttctaatgagcaggttataaatatcgccgagttatgtcataggtggtggccgtgcttaatgtaaagggaccagctggggagcgttcccagctcagcaggctggatgcagctttcagagaggacaagtggggcttgaaaatattgaccaggatgttacaaaataattatttgtctcttaatgaaacatgtcaccaaatgtgtccctgtggggtgtgagtggcagcgagat

SEQ ID NO: 77452 - DNA, 1010 bp, Homo sapiens
ctgagtgaatgctggcaggaacatttgttttgagaatagtttaccataatgaattctgacatcattgcactctctcaggcaagggtgttgaaatggaataaatgacctaatgtcagggatttgtggaaaccctcaaaacagggagattgggagattccttggctctcttatcttcattttgagtggagttttaagcaacagttccttcttagatgtttaattgatctcaacattttaagaattaactaacagtttgaagatatgaaagcaatcgtgtgggttttgtttgcctctctcaaattgggttatctcatagcatttggaatagaattcttgcaagttaacttcctcttttttttgttctgattatccgtgtacttgaacatttttccttttctgctctcatggcaacagtggaagcgattagttgaataaaattatgattatgtgatttaaacatgtttggaagacaggatttcctgggaatcatgcttttacatttgggcactttaagatgtgcctgtttcacctcttcttgctgtccgattgatctgtggtggggcgggcacccttctgggtgccgcattcattgcaatgggttgtagcttcaggccttctcagctctgtggttactgtggcttctttgtttacaagcagatgcttcccagattgaggaagaatttgcttctgaatcttaaactctctccaggaataaactggaaacagtttgagaaaaacttgtatttgcttcaaaggcttaattgggaatacgcacccagtggctggtgttgcctcatcctgcctggcctccttcggggcggagacttcctccgttcctccaccagagggcctcggtcctgcatgggagaaaccgtcttgcaccttaacgggggaattgaatttctctacccgtcattgatctctttcggcagcccagggcattacccgcattcactggacttcttcacctgggccaacggattttctttccagttttggaccagtaatga

SEQ ID NO: 77453 - DNA, 1081 bp, Homo sapiens
gtttccccaagaaaaatatcagaggcttttatttaccaatttaatggcaaagagcctcccttccctgttgagtttctatgttatggttttgaactggaggcctgtaggcttgcgacgcctgtcgtcccacagtctgtcttcacccacctctgctacctgcttggcttctgcagccatttggactgctgacccctgcacatgtaatggtctttttttttccctttctttcaaatgatccccttggatttttttctcactgttctagctttgaaatgtggtcgccagagttgtgttggaaatgcagttctcctgtcaattgaatggaagtgaacgttgcactcttatcctcacactcgaacttccagctcaagtgcttgtggtgcgtttggagggactttcctccccttgacatcctttctgcctttttttcctctccatagcccagtcgaggggatggacagggtggccagaagttcttttcctatgtgactttgccactcagaattgatgaatgaagtcattttgttagcaggacatttttaccttccagattgtcttttttctgcacttttctggactattaaaaacgaatattgttggcctgtgcccatcagtgttctgtgcagctaattgagccccgtcttatgaagcaggctgacggggaccccgccctcatgcttgtcttccagctctggccaggtctggagcagacacttccccagtggaagtggcgagctttcctctccagctttgtgttatgggctcataaagctttagtggttcacttttgagttcaaattttttagtgtgatctggcccttcttgatgaactcagaacagtctccacacgctcactgtgctaagtgtgatggagcagtcaggattcacacctgccagacacgcggtcatctgtccgtgccccaccccaaagccgtggctggagactgttcccctgcccccgtcaggggcaccagcactcttaggagatgtcacatcatttcccaggagggtgaccacaaggccccagagaaagttttttactgttcttacctgacatgggttgtcttttgtcattgtgagc

SEQ ID NO: 77454 - DNA, 1035 bp, Homo sapiens
atgtgcttagcaaagctttttcttttctgtagatagagccaaggtaaacctgagcttcgcgtcggagtgagtgagtgtgaactctgactgggaaagccaaataaatgaggtgctgtgcgatgaaagaactgacttcagagggttgacttctggtcagagcgtcttctgtgttgtcgccatcttatcaatgttagtctttttccccgacaccatctttcttctgagtcctgtttctgctgtgaagctcagacgcctcagcataaattctctgctacccctttgtcacccactcccagtgggatcccatcccgttctttgcagccagatgtgtctaggttcagagacttcagctggcctgtgccgctgggagccttcccaggctgctctcctgtccctgggatgcctttgttttgcgtcataggaggtagtcacattttccagtttgactgcaggcttctgcacgacagggatcatcttcaccttcccttagcactggcatcagatagggcctgagttcaaatcccagctcttctgctgtgggctgtgtgatcatgggcatgttccctgttatttctaagcctgtgtttcctcatgtataaagctacaattgagaagaagagtttggtgtagtacatcgtagaaaccggttcagattctgcactgttttctattaaaccaaaggttcacaatcacaccagtggctgcttttggcttttagccagtaaatgtttgtatgtggaatgaagggccggatggtgggacgtagcagctggttggggaaaggcggaggattcacgtgtttttgagcatggagtcagaagctttccaggtgccatctcattgcatatggcaagtaggtgttagtcctattttgcagatgaggaagagacaaggtgaagcccgttggccagtccttccccatctcagtgcatgcctggcatctggtacttgttccccttgccatgttcccagatggctcacattccatgctcacttccagtccttcttctcatgagcctcctcaacctttgccct

SEQ ID NO: 77455 - DNA, 1119 bp, Homo sapiens
aagaatacaaaagttatctgggcatggtggtgggcacctgtaatcccagctacttggggggctgaggcatgagaattgcttgaaccagcgaggcagaggttgcagtgagctgatattgcaccagtgcactccagcctgggcaacagagcgagactccatcgggagaaaaaataattctgttttctctatggattataatatatatctttaaactatcacagtcaacttcaagttagtattgacttaatttcagtactagcaactttgctccaatatagcttcatttcccccgtcttctttgtgttataaaaacaatgtaatatattaattttccctttacacaatgttattttttaaagatattaaaagaagaaaagataaaacaatatttatacagtcttttatatttacccacatatttacatctctggtgcttttattagtttattcctatatattcctatgaccctctgatatcatttgcttgtcatctgaaggcttccctaaaattttgtattgggcaggtctactaacaatgaattctctcactttttgcttaggtgggaatgtttttattttttcctcatttttgaaggatagttttactggatatagaattcttgattgacaaggtgttgttgtttttgttttttcttcagaagtttgaatacctacctcagagatattgtaggtttggtttcagaccatacaataatgtcaataaaacaagtcacatgaattttttggtttcccagcacatataaaagttatatttacactatactgtattctgttaagtatgcaataacattatgtccagaaaagagtacataccttagttaaaaaatactttattgctaaaaaatgctcagtcgtctgagcgttcagcaagtcatatctttttgctggtagagggttttgctttgatgttaatacctgctgactgatggggtggtggttgctgaagtttggggtggctgtggcaatttcttaaaataagacaacaatgaagtgtaccacattgatggactcttcctttcataaaagatttctctgtagcatgcaatgctgtttcatagcattttacccacagtagaactttttcaaaattggaatcaa

SEQ ID NO: 77456 - DNA, 1007 bp, Homo sapiens
gacctgcccaccaataaagaaatctgtaatatgattgtatgttctcatagcaaattcctgcattaaattacagggtttagaaaagtcacggattatttcttttctttttttttttttttgagatggagtccctctctgttgcccaggctggggtgcaggggtgcgatctcagctcactgcaagctccgcctcccgggttcacgccattctcctgcctcagcctcctgagtagctggaactacaggcgcccgccaccatgcccggctaattttttgtatttttagtagagacagggtttcaccatgttagccaggatggtctcgatcacctgacctcgtgatctgcctgcctcggcctcccaaagtgctgggattacaggcgtgagtcaccacgcctggctggattatttcttaattgacatttgttttttccaccttcctctgtattttgggtttgaatttttactttttatttgtgaatgccttctggtgatggttctccaggtctggtgtggacacgctgtatctttttttctgctagctcttcctccttctgcctccccctggcataatttgcgtcttctgtctctctgttctggctgactgatggttgtggtagctggttctcctctgaatctccctggcaaattagcaacagaagcagtgatccctgcatcctggaaataagcagttaaaataccaggaagaatctaaagctatattttttctgaagaatacccagaaaaactcattagccaggcttagtaaaacctgaattacagatctttttaaaagatgcaattatactgctttcaagtacattttgagctagtaaattaaacacacatacacacacacaaaaacaaacaaaaaactgttgcctactcaattccatgaatgtttattgagagcctgctgggtaagctctggggatataagatgaacagaagcattctctgagctatgggaaagacaaggatgtcaatggacaaagattccttgcttggc

SEQ ID NO: 77457 - DNA, 1002 bp, Homo sapiens
gtgatggttgtccaaagaaaagtccctgagtcaccaggacaaagggtaggtgatactaggtggtgaagacattagatgtgtatcttagagataacaaagggtatagagaccaagagaagtggatgcatttgagatgtctgttagaactactagagttaggactgctggtggattggatttgggggacagagggtaagggaaatggaggaaccagagatgactccccagtttcagccttgaaccattggttagatgcgtggagacaaggagaggatcagatctggaaaaggagaaatcaagaatttgcctttggcatgttaggtttaagatgcctgtgagatgtctaagtggaagtgtcaacatgaccagaagacgggtttgacttgagttataaatggggaatttcagcatattgattatatttaaggccacaggattgaatgagatcagtgaaggggcagagagtaaagagagaagacagcccaggacttggcctgaagacctgcaagagttggaagttgagtaaaggaggaggatcctgtgaaggaactgccagaggtggaagggaaatcgtgagggtgtgtccttgtgaaagccaaaacgggaacctgtgctaggaaagaggaagtggtcacctgtgctgaatgctgcttagatgttaataaagaagaccaaattgtgacccctggatcagataccatggaagacatctgtgaccctgaacaaacttggtggagtggtaagagcagaagctggacaggggaagttgaggagcagatgatacaggatgaattgcagctctgtatacaggccacttcctagaaatgttcttccccttccattttcttttctaaggtggagttcatgctggaaggaccgatggcagaatgatggtggaagattaaacagcaggctaaggaatagggaattcattctctaggtgtggagaagccattggatctggaaggtggggttttgggaagggtcaagaacagggtagtt

SEQ ID NO: 77458 - DNA, 1049 bp, Homo sapiens
ccgcttccgtgtccccagccttcctgtcagtatcctggcattcagcagggcctctccgcctctagtgcttcttacagcaccacctgctcatcagcacccccgactcctcagctttcggtaccaggagggccctgtgtgcccctgggttgcttgttgcttcctgtctagtagaaccattctctctgcttttctaatgcttgcacttctacacctgtgcctctgcactgatatttgcctgaggaagttggttttttaggtcgagcagtacatttagagatagggtttgaaggaagtaggcttggatgtgcatctgattagttttccaattttctccccttctaggtaatactttctaatattcaaaacagaagccctaagcctggccctgctccccacgatcaagaactaggttttttcctagaaacaggacttcagagagcccatgtcctctatttcaaaaatgggtaagccatcttcatttttttaaatccacttcctaaagaaggaaagtagaaagccttacaatgctgtctccagtttagttattataataaaggaattttaaatatgaactaccattggaactttttttttcttttaaagaatgaacattggctgtttttgtctcttctctacctggctctcttgctttcccatgagatgtgaaggtgggagaagggagggagggaacccaagtcaaaagtacacagcctcaagaccagtggggtgggcctgatgggagccatgccttcccatgccctccctccatgaatggctctgcatcggcctccccatttgttaaggaaaaagttaatgaattggaaatcctggcacacaggagcatcgccctttcagtggctgatcattcagggaattggatttgccaaatctcagccagtttttatgaaagtgagtgtggctttgaaaaggcttttaagaaaggttgaaggacatgaacgggagggacagctctcgagtgcatttgatgtttgttttcctttttgtgttgctcttgtgagaaatgtgctgattctgttccaaatctcttc

SEQ ID NO: 77459 - DNA, 2675 bp, Homo sapiens
aaagaacataatcatagttcctacttcatgaagcttttgtgaggattacataaggtcttgtgaataaaggcacttagcccagattcgtgaacatattggattcttggtaaatgtcacttatttttattaataacaatagctcctagcagttgctgttgctggcagtgtttcctggagttctcaccaaggacactgctattgaccccttcagacccagagatgtaccctacaagagtgtttgaaatgattagaaatcctatgagactttgaaaatgattggaggtcttgttttccagcaattttctgggctccttgtttttgtaaagattagaatagagagagactgccaaagtctccctagcttttgttactttataaatgaacagacaggaagtaactttttttcataaatcatattgtcatgtgttggtgcatatgatatgcatcagaattgcctttttaggaggcagggagattagagtgagaatcacagcaggagaggtggagagagtgatgggaataacatttgacctggcctcaaccagaatggattataagccatggtttaagatatctgggaattcaggaagatacatgtctgtcttgccagaattatgttctatcagaaggttgctatgagaagagaatttgttgttgttattcagaatttacgatatgatctttaaaggaatgatcatccaggctcctttaaaaacctccattatttccactgtctgcctccttgatggaccgtgcttggcagtcgagaagtctgcttatcccatctgagttgttccagctgactacacagccctggccacttagggccctatcttgctgcttactctccactgttgtccagccctgtcactttggagccgtcttctcccggctgggagaaaggaggctcatgtgttacatgtgtctgtagtgatgtaggaattggtagatctgaatacacttctgttatgttcactcacaacaccccattcagtgctgggttcttcagcaggaacatcaaggaggcttgtatagtcgtaggatttaaaagaaatccttttctttgattttggggaaatggtgatcataagatgttggattttgagaagaaacttgaggtctagaaagggagagcccaggcacacagaaagttaggccaaaactagttttagaactccactcacacgacacctagcttagtgctggctcactttattctcccaggctgctgcaaacaaagaaaaagcatgacatttctccacactcttacttagagaaagtgctcaataaggctgggtgtgatggctcatgcctgtaatcccagcactttgagaggccgagacaggaggatcacctgaggccagaagtttaagatcagcctggtcaacagagtgagaccttgtctctacaaatgaagaaagaaaggaagagagaaagagagagagagagaaagagaaagagaaaggagggagggaggaagggagggaaggagagagagagaaacaaaagaaaaaaaagaaagaaaggaagaaagaaagaagcgaacgaaacgaaatgaaacgaaactagctaggcatggtggcaagtgcctgtagtcccagctacttgggaggcttaggtgggaggattgcttgagcccagaagttcgaggttgcagtgagctatgattgtaccactgcacttaaaaaaaaaagtcaataaatatgttttatttgaccaagtaagctttagcttttggtagcatttgggaagcagcttctttagcctaaggttaaatctcagcgtaggtacacgattttcaaatttctggctctgattttcaaatttctggctctggcgttttcttttttggaaaaccagtttggacctccccagatttcagcaagctgagatattagcaatgagagagattgaatgaacccaacatctgttttgactgtagtaagtactcaagaaactaactgttgattaagcagaaggctagcgaggagaataaccttccttaggtgaccaatgggcttggtggaaagtttgcaggtttttatgtggcaagatagttgtgtgttatgcaagagatacttgattggcctttttctttttttaaatgttgaacttaattgacttaattttgaactcagtaagaattatgttgaattgaaaacagaaaaggggatggaatctgatcaaagccttgagcaatccaaggcaaatagggctttattttgggatcagccctgccaggtaggaaatcacacacgctgttcctgtttgctccgctgggcagaggtggcctctccatggtgccctgtcacttccccgccattctgtagtgaagaaacttctgctcgctggggcctgtgggccttttatttattagtcctggcgtttaactttattcactagcaagagtaaaatttggggagggtttttggagacagttaggagtgtcgtgaccagtgacttttcataattgtgcttctgagggagtgccgttctctgagtttctctagtagtggggatgttcagtgatgttctgggatgttctgagttgttgggttcctgaagggcagtgacacttcagaacgaggactgacctggcttcccctcgagggagctgacagaagctgtgggaggctgcagagcactgcgggtgagtgactgccagtgttgggacc

SEQ ID NO: 77460 - DNA, 1100 bp, Homo sapiens
ggaggttgcagtgagccaagatcgcgccactgtactccagcctgggcaacagagtgagactctgtcccaaacaaacaaaacaaagtagactatgccaaattaaaccttgaagcaatcactgatatggaaaataaaaattttagtgactaagccaataagtaaaataaaatgtaaaaatactcaaatagatgacagaaaaaaaggagaaaaaggaaaaatagaacagatgggacaaataaaaaacaaacagcaaagtggtagatttaaacctatctgtttaaaaaattacattaaatataaatgatttaaataccctatttaaaagttagagattgtcagattggaaaaaataagcaaaactcaactctgttgtctacaagaaatacactttaaataccaagacacaatagattaaaagtatagattaaaagtaaagggatgattaaaagtaaagattaaaagtaaagggatgaaaaaatttaaatgctaacactaatcaattcaaggctgtagtatctatattaatatcagacgaagcaggttttagagcaatgatgtcaatccatcaaaagaatataacaattccaaaggtttatgatcttaataacagagttctaaaatacatgaaacaaaaactgatagcacttcaaggagaaataggcaaatgcacagttatgcttggggattgcaatatccatgtttcaataaatgataaaacaagtggacagatgattggtaaggatatagatgccttgggacaacacaatataccaacttgacctaatcgacatttatatgacattccacccaacaacaacagagtcacattcttttcaaatgtaacatttaccaagattgaccatatacagggtcagaaacaagttttaacaaaattaggagacttcgggtgtgttctctggactgtgtcagaggtcctgaagactaccatcaggcattgatatactggaaagactcccatagcttagaaaagctgttatactcatggttacagtttattacagcaaatggatacagattacaatcagtaaaagcaaaaaggcacatagggcagaattcaggagagaccaggctcaagcttc

SEQ ID NO: 77461 - DNA, 1992 bp, Homo sapiens
gtcttatcacctttgaaggctataccatggggctgggttgtcagaaacttaccattataataaaggctttctggtactttcagttataaacacccctgtgggtcatgttatggcaaagcatcagggtgtacctgtcccaggcctggcttccagagatgtggttgagataaatgaggaagcagtgcttagagttatagtacatagttcatgtcattatattttatagtcttttcttgcattacatagctttataagaaattaatttcctgtccatttcaatgcagttcaaaaaaatcaaaatatttgttttagctgttagtctcttagacttgtacagctcaaggcagtatctcagtagttcaactcttcatgacacagacaaagaataggaggcccagcgatctggggaattgcctagggtgatgcagttcttggtaggaaagaaaatcagcaccctaaagttctagactttgatttcttgccttttcaatttgaaattcatttttgttgtcattgctgttattgaacactgaataggctgctgtcaacagctcagtgagacaggagattgtgagcaacactttgtagtcagatagaccaggggtcggaacctggctttatcatttactagctgtggagcccttaattcagtcttatctataaggtggtgttaacaccttcctctcagggtggctgtgggaattagaaatagtgcctgtcatatcccaggcatagtgctgggtgctgagtagggctttgataaatcaacctttattattattgaaactgaagtcttacatacccagataaggctcctagctgagggatctcaaatctagacagacctgaaagaatttggggtgctaacccctcagtgatcactgaattttcaggcaatgagatgtgtagctttctccacgtcctcagccaaacttccagagaatctacaggccttggggagagaaaatagctccctgtcagaggtattgagcctgaatctttctttttttaaattaaattttttgtagagatggggtctcactatgttaggcaggctggtctcgaactcttgggctcaagcaatgctcccaccttggcctcccaaagtgctaagattacaggcatgagccactgcacctgacccttaatcttgatgtgaaaggaagcaaggagtggagagtccggtttgttatactatattctgttagttacatctacatagaacagttcagaggctgggcatgtttgagcttttaaaagtatagagggtcctcagcctgctactcagctagctgcccagcacccctccccgtgtgatgtcccattggtctgctggcttctgtctagcacctttgctttccacactccaccctgtgcactcagcagtccttgttgcccctctaggacattacccagagcagatgcattggccccagctaatgggctcccttataaggggcttccacttctgactcctgcatggaccttgggcaagtcacttaacttttctgagactcttattcttttcccacgagatagagaggagaatagtacctattgaacaggaccaaacaggcacatggaaggggtttgaaagcaagtgtaattataattttatcatcattaatttatttaaaatgtgttacctaggctggggccagtggctcatgtctataatcccaacactttgggaggccaaggcaggagcatctcttgaggtcaggagtttgagaccagcttggacaacacagtgagacactgtctctacaaaaaataaaaataaaaaataaaaaataaaaaaataaataaaaagaaattagcaaggtgtggtggcatgcacctgtagtcccagctactcaggaggctgaggcgggaggattgctttgagcccaggaattcaaggctgcagtgagctgtgattatgccactgtactgcagcctggtagacagagtaaaaccctatctcttaaaaataaagtaaaaggtgttact

SEQ ID NO: 77462 - DNA, 1105 bp, Homo sapiens
tgggacagaagagcaggaaggaagctggggccggcctggctgggccttcctcgaaccaggcagaggcaggcagctgccctgcagggcccaccgcagtctctcaagacagacagaggaacggtttgttgagtgcctactgtgtgccaggttctggaattgtaaaaatataatacattattaataatgactacagcattaaaataattccttctagacactgttctaagcacttgtcccttacctccctttatcctcacaacaactccagagctagagacaggaatagagcccccatttgagaaggggagtgaggggtgcctgcttcctggactgcggctagcaggtcatttggggaggggctcccaggtgcagattccgccgagtccggactgaaggaggacacgtcgatcctggtgtgctgggaggtgccttagtttgcgtttagcggcctgtgaacgagtcttgggacctctaaaagctgactcagggccacatcagctaggactcgctgctagctgccgcccaaggtcgtcccgcagcccctcggcagccgccgccaggggtcgcgggagccgcgttctagcgcagtcgcgcgccacagttgcgcatgcgcggagctgctccgggcgtcctcggccgggtcggccttgggaccgtgccccccctgccccgccccgcccatctcccctcccctcgcgtttcgccccgccccgctcactgctgtccccgaccccgccccgccccactctcttgccccgtctcgccccgcccctccttgcgctctcgccccgccgcgccccgccccgccccgccccgccgtcctggagccagtgccctgcatctcgcgcaggtgccgccgcaggactgcaggactggttcctgccgcggccaccgggacagtggtgccccaaggccggctgaccatttgaagcccctgtacttgggttgattccgcgattcaactcgagttcagggatggagaagaaaggcaaacttgccaactctcttgattaacctcgcattagtgagccttcttagggactcaccaagccgagctctctgggaggcgttcacactcacaggccctggctgttcgcaggcagca

SEQ ID NO: 77463 - DNA, 1038 bp, Homo sapiens
agcaagtaacaagacagctccacctataagcacaatgccccccagggctctgggctagtgaaggggtggagggatgccgatgacacagagctttcccctggggtttacaatgcctgaaatacatgagcatttggacatttgtgccggatttacattctcagttaaggtgatgttaaaatgtggtgaagagtgtaaatagtggcctgagtgtcaggacaagccagtgtgaggtttaaatgtatcatgttgagataatcaggagctaattatctcgaaaaaagagtcatcctctcccttattgcttgaatctcgagttcaagtcctcctgctaaccctggcaggtctaggtatggcatgcacctctgcagactgtggaggatatgtcctagtcttggcaggctggctgcatgtcctgctgtgtcccacccatcctctgctccaggctgcctgcctccttgcccacctgccctcacccctgccaggccaaccccccacctctgtttatcttctccatccatctgggagtcatctcttccctgtgctgagtccgcccttggtgacacccgttgttgcatacagacctctccagccccgtttgtccacaccaatctctccatcctctgattccacctctatttatagctagtaccatctaatttggcattcagattttaattatttcacatctgccatttgcctctctcaaactagactgtataattaattaattcattaaatcagcaaatatgtgagtgcttattctgggttgggtgttgaggctgtgtcatatctaagctgcctgctttatctccctgcatgtgcgccagggacaacagtgcctgctgcacaggggtgcctgtgacggggccattctttaacattttgccctggcatccaggggcacactattgaagataaactctagctgaataacacacaaggtgcctaagcaaaagggcaaacttctcagtatattctgagatccactccatttcagaataggttttggtttgggcctgatataaaaacaaatactct

SEQ ID NO: 77464 - DNA, 1071 bp, Homo sapiens
tctgttctacagcaatactttgaataggagcccatctcatattatagagcaaacccgatacatgtcatagtcaagggaagcaatacttcctatatttgcaattgattgacaaaatcagcctggtggataagtcctatttttttctgccaggaaactgccagcccctgacaagttttaagcaggaggaatgacttaattaagtttttaagcaagaaagatctttctggcacagagtggagaatagattagaaagaattaaagattctagcgaaggagactggttaagggggttagttggatttgggccctttctctgttctgtatttcagtgggctgaattctgcaggctttttcccaggtgcccaagtcagtggtttctgcctgggtttggtcaagcagaggcactggtaggaaattggaagagacagataagccagggtatttctctctgcctcaggcagcacctttgccagcaatggtgtctcttcagttgtcctagctcctgtcagatgaaacctttctctgtagttttagtgcccattagggagcttcctctgggttttggctctctatggccccagcttctgggctcttaactctgcctcctccccatgttctttccagtcctagggatgttagtggcttcctgctatttcagaattctggggtacaaaaccatcctgtttggcctcttatctctttcatctcctatgcagacaattccatacattcaattccctttatttgaaagaactagaatgttttcattatcctaactgtatcctgacagatatcagaggtattgcaaaagcctagattccaagtacaaagggctgaaccaaggcaggggcaggcaagtgagaatccagagtcatttgaaagagaagcagtaggccagagagataggctgtgtgtgttgggagttggtatgggaaggtggttgagggaggaatccagatgacagtgaaatttttagcttagctcactgggcaggtaatgatgttgtcaaaccaagtgaagactgcaggagtgtaatcgcccattgcattcttcctgcccactgcacagaca

SEQ ID NO: 77465 - DNA, 3166 bp, Homo sapiens
gcctttccatgggcatgcatggtcaaccatctaattttccccatgtatgtagttgcctttgaatgctctagtcttgaatgtctggccctcaaaagggagaaagagaaaaatgaggctgggggaaagggcactggccctttaaatcctctggatgtcacttctgttggtgtatgtggggtggcttgcaataatgaagggaggtgcagcaacaatggctactgcctcttttctgcacccctgtgatcagaagcagcagtcagtgatcagaacacagatacccaatatttggaggacagggtgctctttgcccaccctagctcctgcaagctttatatttgcttctctaggaatgtgttcacagcttctactatgctaaaagctgaaattaactgcaatttaccatcaagctttcccctggaaattgtaagccttcaagagaccctggagttccaaaatagttatattgaacagattgtgccagtacaatagttgtctatgtgggaagatagattcctggtgcttcatagtccaccatcttcccggaattctgtttatagctttttaaataacagatttattgatatataactcatataccatacaattcaaccctttaaagtgtacaattcagtgggttttagtatattcagagttgtgcaaccatcaccacaatcaatttcagaaaatttttattactccaaaaaagaaacctttacccattagcagtcacttcccatttcctgaacccccaccccaactctatagccctagtcaaccactaatctataccctgtctctatagatttgcctagtctagaaattttgtataaatgaaatcatgcacttgactttttgtatctggcttcttttcatttagcataaagttttaaaggtccttatatgttgctgcatgtgtcatttctttttgtgactgaatattacattgtatggatataccattttgcatattttgttaatccattcatcagttggtggacagcaggttatttctattatttgactattattaataatgctgctatgaacatttgtgtacaggttttttggtgaacataatcccatccaaaacattttgggttttcatttatcttggatgtatacttaggggtgggattattggattacatggtaactctgagtgtaagtttttgaggaactgcaagctgttttccaaagcagctcacctgcatgaaggttctaatttcttcacatcctcatcaacacttgttgttatctgtctttttgattatagccatcctagagtgtatgaaatggtatctcattgtggtttttatttgcatttccctaatgataagtggtattaagcaatttttcatgtgcttattggccatttgtatatcttctttggagaaatatctattcagattctttgcccatttttaattgggttatttgtctttccattattgagttgtagtagttctttatatatcctaaatataatttcttttacagatatatggtttgtaaatattttctacaattttgtgggttgtctttcactttctaagtgatgtcctttgaaatgcaaacatttttcattttgattaagtccagttcatttttttttcttttattatttttgttgttttggttttgtatctaagaaaccattgcctagtcaagtttatgaagatttactcttgtgatttcttctatgagttttatagtttttactcttaaatttaggtgtctgatccattttgagttaatttttgtatatttttgtgaggtcagcatccaacttcattctttttgtatgtggatcttcagttgtttcagcccaattttttgaaaatactgttctttctccattgaattgtcttggcatccttgttgaaaattagttgagcatatatgtaagtgtttatttctggactctctgtctgtaccactggtctgtatgtctgtgcttatgccagtaccacactgtctttattactgtagctttgtagtaagttttgagtttggggagtgtgttttctaactttgttcttcttttacaagatttttttggcttacatttcatataaattttagggtcaggttgtaaattagtgtaagaaataattcttggtagggattgtgttgaatctgtagattgatttgggaagtattgctttcttaacaatatcaggtcttccaatccatgaacatgggatatcttctttaatttctttcaaaaatgttttgtagatttttttggcattcaagtcttacattccttttgttaaatttattctaagagttcttttttatgttattataagtgaaactattttttaaatttcagattgctcattactaaggtatagaaatacagctcatttttgtttattaatcttgtatcctttaaccctgctgagctcatttattagctattatattgtttttgtggattctttagggctttaaaatatgtaagatcatggcatttgcaaataaagataattttacattttcctttccaatctggatgactttgttgctttgtattgcctaattgtgctggatagtatctccagtacaatgttgattagaaatgaccagagtggacatccttattttagggggaaagctttcagtttttcaccactaagatgttagcagtggcgttttcatagatagcctttatcaacttgaagaagctcttttctatttctagtttgttgagtgtttttatcattatagggtttagacactgtctaatttttttattgcattgttcgtgtaatttttgtgctttattttttaaatattgcattttacgttgaatgattttcatatattaaaccaaccttgcattcctgaattaaatcccatttggtcatggtatatgattttttaatgcattgctaggttccatatgctaatattttgtaggggattttaatacctatattcataatagatattggtggtattcttgtgatgcctttggttttagtgtcaatgttacgctggtgtcataggatgagttgtgaagtgttccctccttttctgctttttggaggagtttgtgaagaattggtggtagttctttaagtatttggtacagttcaccaaggaagccatctgaccctgggcttttctttgtagacattgtttgattgctaattcaatc

SEQ ID NO: 77466 - DNA, 2047 bp, Homo sapiens
atagaagcctttcatcatataggtccagggctctttatttttttctttgaggtggcccctgcagggaagaagagaagggaaaatcagggagcagccaggtgactgctctgtgagagggtcactgtggactagaggtgaccttgggaccagaccgtgtgaggccgatcaacactgaaggaatggggctttttgggggaagagcagcctccaggggtggaggagcaggcctcacctgtgtggagggctcttggaggaagaaagactcggtctgttttggcctcagggacaggaccagagccgggcactggaaactgcatgaagttcagtgttagtcccatttacagaagccaatttctaacctcacagctgccagagagctcagctgcatggagaggcaggggttccctgtgcctgagcatttattgagcgctgatggagagtctggcatggtgcgtggtgatttacctgcgtgattgtgcttatcctgagaacaatcccggaccctagtattatcgttccctgcggaggggttaagaggctgcttttcagagttgagatgggattcaaagcaaggcctgtggactccagcatccatactctttccactttactgagctgcctgtcagtgggagcataatcactcattgtgagtgaggatatggttgatgcgattctggtgtgagataacctgcttagccttgattgtgttctgtgatttgtgagtgatttaagtctgacttttcttatctgcaaaacagagctaataatactctcacaagagtactgagaagactaaataagacaaaatgggaagatgctttgaatttataaatccaaggtcagtggaaggggatttgaatagtcagatctcatggacagctgaggctgggagcagcaggtggctgtgatggccttgcccctcctgtccctgaaggccctgcctgccacgctccttagctgagctagccagcaatacttctagctgtccctagtattgatctcttgtttcatcccccacaattttattttattgttcttttaaaaaatttattatttatttacttttttgaaacagggtcacgctccgttgccaggctggtgtgatctcggctcactgcaacctctgtctcccaggctcaagcgatcttcccacctcagctgggactacaggcatgcaccatcctgcctagctaatttttggtattttttctagagatgaggttttgccatgttgcccaggctggtcccgaactcctgaactcaagagatcctcctgccttggcctcccaaagtgctgggattacaggcatgagccactgcacccggctttattgttcttaatatagacaaaatacatgtgttttatataaaattcagaaatgatgactaatcaaaagaacataaagatatccattacccatctactcaaggcagttgctgttaacactacagtgcatttccttccagatcttctctacacctcctgtatgtgtgaatttttttatataaaagtgggattataccacatatactgctttgtgacctgctttttctacttcactatagatcgtaaacactttccatgacagtatataactttctgcaacatttaagcagctgtataacatttcatagtatggatgaagtataatctatttaactaaagcctctatttttggacatgtaggttgttttcagcttttcactgttatacacgaggctgtgatgagtaccctgtcagcctggtctctgtgcctgttcttaatgatttccctaggagaggtttcctgaaattgagtttctgggttgaagggaggtatttccagattgccctgcagaacggtggtacctgtatgctttccttcctgtagtgtgaggaaccagcctcctcccattccagccaacactgaatgcaatcccttcgatttaaaaatgagcatttattctttagctgtgtattgagtgtaggctgtttggaaaataaagaaatatatatatatttctttatttataatatatatattataaatatatacataaattatat

SEQ ID NO: 77467 - DNA, 1024 bp, Homo sapiens
aattttgtatttttagtagagagggggtttctccatgttggtcaggctggtctcgaactcctgacatcaggtgatccgcccacctcagcctcccaaagtgctgggattacaggcatgagccaccgcgcccagcttcagcaaagtttcttgataagtagtatgcaacttcagcaggggcctttcttggtaattaaaatcctgcacagcatgtagggattcatatcatatggtcagttggccacatggctgatgatgtttttattcattaatgccacctctgggttcattaaggctaatcagttgacacacagcaatcactagcaatcagtcctctcttagttaactgtgtacctattcagggacaagaagaacgtgtaaatatctcactgccatgaagcagtttgcactctagtgtgagataatgcaatctcatgggaagaaaaagtctggaagcacaggacacacagatgatcggaccgttccaagctgctgcttcctcaatctgtaatgggcataatcacacccacttcatggggctcttaggaggattaagtcaaataatgtatgtaaagcattgattgtggtacctggcacattctaaatgctgcataaatgatattttaaaatctcgaccaggtgcggtagctcacgcctgtaatcccagcactttggaggccaaggcgggcagatcacctgaggtcaggagttcgagaccagcctggccaacatggtgaaaccctgtctctactaaaagtacaaaaattagccgggtgtggtggcaggtgcctgtaatcccagctactcaggaagctgaggcaggagaattgctggaaacccgggaggcagaggttgcagtgagctgagatcgcgccattgcactccagcctgtgcgacaagagcgagactccatctcaaaaaaattaaaaaaataaaaaataaaatctcaaccccaaacatggcagcaaatagtaaaagctagggatgggtaatacggagaggtcacttcaggccagcagggccagga

SEQ ID NO: 77468 - DNA, 1021 bp, Homo sapiens
ttcatcacctcccaaagaaaccccattatcaccagcagccacctcccattcctagccaagactaatctgttttctaactctagacttgactatcctggacatttcatacacgtggaagcatacaatatgtggccttttgtgactggatttttcacttggcatcatgtttttagggttcgtctatgttgtagcataacagtacttcattctttactacaactgagcaatattccattttatggctagcccacattttggtggacatttgggttgtttccactgtttggctattgtggataacactgctcagaacattcacgtccaagctcttgtgcggggagctgtggggttttacggcagcagctggccagactctgagggagcatcatgcctgatattgtaggaaaatgcttttctttctctccttttgcttctagtcagaattcctacaagaatccaatctgatcatggccaagttgaattatgtggaaggtgattataaagaagctctgaacatttacgcccgggtgggcctggacgatctgccactgacagctgtcccgccctacaggctgcgggtgatcgcagaagcctacgctaccaaaggtgaggcccgtgccttctaacacagtgtcccgtgacctggagccagcagcgcctcttcggagctgcctatttgacccttggcccttggctggtgatgaacctggcagttcccagcaaggctgctggggccgccctgcagcacatgctgggtcatgctaagcccagcagggatttgtccctccaagccagtggccatcagctgtcactgaaggggatgaaggaaaaacatttcagcaaagtttctttcctttctttctttctttctttttctttctttctttcttttctttccttctctctctctctctttctttctttctttctttctctgtttctttctctctttctttttttttgagatggagttttgctcttgttgcccaggctggagtgcaatggtgtgatcttggcttac

SEQ ID NO: 77469 - DNA, 1035 bp, Homo sapiens
actaatttttgtatttttagtagagatggggtttcaccatgttggccaggctggtcacgaacttctggcgtcaagtgatctgcctgcctcggcctcccaaagtgctgggattataggtgtgagccaccgcactcggcctggatgctttttttctcttttctgagtctgctttgatttctctgtctccagatgtaattctaattcctctggtgcctctcccttgggccacccataaacacttttgctcccatcagtcctgcttgtccactgcaccatcctttccaatgctgcctgatgtccctccctcttccaagaaatgcctggaagccgaccacgctggctgagatagctgctgtaacacgctgtacctggctacctggccgtgttgtccactcatcaaagctctaggttacagtataaatagtgcggtttcatggtgtgcttctgtaagcaaaaacctcagctttgaaccgcttgggctctgaggagaaggtctggccacagaagataaatctgtttccttatataggtggcagggtggcctgttctttccctaggtgccggaggacgggtcagggaggaaggcaatgatgaggctttggggagagggggactggccaggccagccttgctgactgggaggaaggggggcccacagagaacttccagcccttagcctctagggagggtaccaggtcacctcagtttagaaacttcaatggctcagtgagaaacttcgccctggaaagcaagcaagtcctgatcttcacatccatttgggaaggctctccttggttatttgggttacagggttgtggtgcatctccagtgccatggccagacccaccaggatgtctggccgcttccttttctgagacaggtgcttgtatgtttaacttatgaagcattccttccttcccagccggcccagcccagccacaggcctgatgaagggagccgcagggttttgttttggtttggtttttgcaacagctttattgaagtgtgattcacataccatacaactcacccatt

SEQ ID NO: 77470 - DNA, 1076 bp, Homo sapiens
atcttgggacgttacttaacctctctgagcttcatgtttctcagctgcaggcctacttaacccaggattgttttgaggctcaaatggagaaattctttcaaagctgtatagcactagatacacatcatttcttgctatgttattagttctacctagagaatttttttctcccattgctctttttcaccttcctccatcttataaagaatgttccaaagccgtacatcttttgcatgggtgtgctgtcctactcacaccaactaatgtgaaactttctctttccttgagcttaagtccagcttgtcttaagtgaattgaggctgggaagaccagagccagccaggcatgtagtgggatggaaagagtcctggactaggagtcaggacatctggcttgtgattcaaggcaagaaaatggtccttattgtgagcaaggtggcccctgacactgtgttggggctgttctcccactgcccaggcagccgaggcgccctggccaagctgtttcctgtacttgggtggagactggactcgcccagggaggctctcccagtgtgtccaagctgtgcctctaggcttgcaattttcttcaagcgttttctccacctggctctccagtttgcttttgttaacctttttttttttcccttttggtaaaatatacataacttacaacctaacattatagctctttgtaagtgtacagtgtagtggcgttaagtatattaccattgtcactcagccgtcaccaccctccatctccaggactctttgcatcttcccagagcgaacctcttgtgatgtgtccattaatgctaactcctcattccccctcctctttcaattcgcctttaatccaacggttcttagaggctagaagcttggggaaggagggtagacttcccagaatgtcctaggaaatgttttcaaaatacccaagcctggcctgtcccctacctgggtggagaacccctgtggtggatgcttttttttgagacagagtctcgctctgtcatccaggctggagtgcaatggcgtgatcttggctcactgcaacctccgcctcctgggttcaag

SEQ ID NO: 77471 - DNA, 1032 bp, Homo sapiens
gagctgtgggaggttccatactggtgccagcaggcctggcgtcacagttgggagggggccaggaacttccccacgtctcagcaagaaccctcaccctcaggcacaaggaatcttaggtgctgccccctatctgtccattctgttttccggtctcattacacccaggtttccattccctctcacgtggctttccttcctttcttcttggactcctcatcagttccttttgcttttcatgggggtcatctcctcttcccgccctgcccttctgcctcccaggtggctcacactcccctggctctagatgcttcccctagttcagatggctgtctgtggcccgctccatgctgcctgtcttccccaggatgtatttcccactgaggacagtctttggtgaacttctggagctctgacttccgtttccttttaactttgatgacttctttctcatttttcttctcttcctgtctcggaatcctctgagactccatttttggtctttattcttgtttgtgtgtgcacgcttccccccgggaagccatgctttctttggctttacatttcatatctgtactgcaaactccagcctgctcccgacttgctgtgtgaccccggggaggttactcgcctctctgcagctcagtttctttaggtttgaatggggtgggctcttaaaggggtgagcttggaccttcccggctcctgcatgttctaagcctgtgagctttcaatttgagctgttcctcctcttggtcatctggccacctccttggccctgctgcaatggagggcctgggcaacctttgagtaagttagtattggtgttggtcagttgtgcagcaacaggcttctggaaaccctgatagagagctgctttcaaaattgtctctgtgtatgttgtatgcacgggacacagctccaggccgctaggaggtggctggagagcgtcatctcaacacagggatcttgccccaggcccctagggggtggctggagaggtcagctcagcatagggatcccaggtacttaaag

SEQ ID NO: 77472 - DNA, 1106 bp, Homo sapiens
tccagaggcaaaggccacagccccaccttccccgggtgggggggatcaaggaggccaagtgcctgtgggcattgaactgtgccagccacagggctcaggggactggctctgttgtgctgagccagggcacggacccccctgcagggtggctcattccccatatctccttggtgagggtctcactagtggtctctctttggcttcaggctttatccctatataagccattggggagctagttactgcagcctcacttaacccccaaataatgcccaagagaaaagcgaagccagccctgggtacccttgagtccctctttacccctgtcccctgagaatcctagcaagtgaaggagagggacttcaaaaccatccatccagcctctgccccagaggggttaagtgggccggggtcacccagctggttgggagggaagctgggccccttctggaggctgatggtatagtttgtgcatggcgtgccggagagagtgtagggagactgcctgcgttcaaacgcagctccaggatgaaccagctctgtggccttagggatgctgctcccctctcctgcctggttccctgtttgtgagatggagatgataatagcatcctagtattgtttccaggactatcaggatcgggtaaactgctcaccatactgcatggcacttcgtatgagctcagcatggctgggctattaatgactcacacagcattcatatcctcctgctacattgcaggcctgttgaacacggagcttgtgtctcctagagctttctggccccacaagatccaacataactattctgggaaatagtcaatcctaaatggatggtaataacagtagctaatgtttattcaccacttacttcagactatgtgcgttacatattatctctaatcctcatgatacccaagtgagaaaactaaggctcagagaggttaagtgtcttgcccagtgccacacggctagcgagcaagggaggtgggatttaagcccagggctgccagaggccaaagctctttcccctgcattgcactagctgtggcctctcctttctgtaaactgcacttctggccccactttgcagtccggctgctcca

SEQ ID NO: 77473 - DNA, 1848 bp, Homo sapiens
ctgacccagagataggtcaaatgggtgccatataaaatatgaaagacggccacagccacaggaaagctaatggagtggctgcagcccttccacccatgggatttgtctgtccctgctcatcaagtgtggctagtggtggcagcaccagaaccatgtagagcagatctggtctggtccttttagaggccaccaggcctggagtcagaatcttctgcatttgccctccaagccaccttgtacacatcacatgatcatctgaaactgtagctgtcctgacttgatgagtgttaaaatagtgctagcagggaagaagaatgaactgcatttcttgggtctctctctgtctttctctctctctctcttcattttttctgtagagacgggtttccctatgttgcccactctggtctcgaactcctgggctcaagtgatcttcttccctcggcctcccaaagtgctgggattacaggcgtgagccactgtgcccagcctcttgcgtctctcttgtgtgccagattctggctatgaacttttacacagatctcagttaatcatcacaacaagcgaatgatgtcaggggtaattctcattcagggcttgagtagactgaggctagagccgttaattgaactggattctagcccacttccaactagtttcactgttcttctattacactaatgtttttctaaactgattggatcaaagaatcacttctagacagcttgttagaatccagattgcaaagccccactcccagagatactgatatagtaggtctagggtggagctggggttctgcattcttaagctcccagtgttgcaggtatgcagcatgctttgagccaaatactaaactaagtgtagtttatagattaccagacatcttggctgagggtggtgattctctcggcccaaggtagaagctggaaatctacatttgtaaacagcctcagttagtttgagtaggcaagtgtgggagcctttgctctgaaccacaatggttagcatttaatgtgcacctactatgtgtgggcacagcaccaggtatcagaggggcatcagaagaaatagagtgagcaggtcaccaggcagggaaacttacagttcaggattgtcgctcaacctctgggcagcagggtcccctgggggctagttagcaactcagatgggcaggctgggcctgagcttctgcttcaggaggtcttagtggtttagggactcaggaagcaggatcccagggccccaagtgattatggtgcccggagttctaggaccagactttagacgtggttgtccgagtgggagacagaatgtgaccctgtagcctgaggacagcaatgacagcattgcttacaagcacagagggtgcagctgggagcctggagaggtcagactcagtggcagtgagtgggtaagcagggcctggcagggcaccaggaggaggatcttgggcagggtggtggcgtgagggtgaccaactcgtcctggttggcctgagacttttctggttgtagcatccaaagtcctgagtcccagaagctccctcagtcctgggcaagtggaacggtagtctttcaggtagatagaggtattttagcaaaggggaaaggaaccccgggcaggagaaagcagtgggctttgccctgttagacctgggttcagatctcggttctgtcacttcctgcttgtctggcctcaagtgagtgagtgacttaacttctctgagcctcactctttttgtttttgagatagggtgtcactctgtcgctcaggctggagtgcagtggtgtgatcacggctcagtgcagcctcaacctcgcaggctcaagcaatcctcccaccgca

SEQ ID NO: 77474 - DNA, 1295 bp, Homo sapiens
cagaagcccctccactgagcaaatgttccctgacgtctcattggtcagaactaattcacatgcttgcacttcagccaatcacaagcaagggagtgtatctactggggccagggcccctacagtgaagcacacagcaccactgctgacagctgaacaaaactgggcccaatcaaggaggaaaatgggtgggagtccgagctggaagacagcggtggagaatgctggattgacaaccagggaacctctggctggccctgactcacaagaccccaccaaccccaagggcaaacacttgtccttgcaggacgccatttctcagggccagagtcatcacgtaatattgatgtaacttggccctcgcttccattttggaaaaccctcggcctgacttccttacttacacctgttccaactgctcatgaaagccgagccaattcaacacagcatgtgctgtgagcccaactccatgtcatggggccagaaaggtagaattggccctctagaagctgaccatttggtaagaagacaaggcacatgccaaaatcggtggagtaggggagggaaacagccctgagctgggagatgggagtggataacacccaccaccaccagcaacagaaaacagctggtagctagtgaaggctcactctatgcaggcactaagaagcacttttaggtattttggttttttcttcatttgatccttacaacctccctataagtttggcactattattacaggttcataataccttacctacagtttctgaaatccaggactctctaaaaaccaaaagttgttttttgttgttaatcatttatgggatggcagaaacctcaactgaacccatgtgaggctatttatagtctatttctcccttttgcagtgactgctcatatgctttgatgcagaaatactgacccattttattacaaaatgccgccccagaccccattgggaatgtcacataatgcccagtaaacataacatgtttcaaaaaattctgcattctgaaatacatctggccccaagggcttccgaaaaagggttttggatgttgtgtcaccaaagggggctttgcaagttgaaggttaccccccataggaagcaggtgagccatgctttgaaatcaagcaacccaactccaagccagggctcttacccactgtgcttgcttctgccacttgctggttggtggctttaaggaagacatctccctctctggcactgttttgtcatctataagaggttggactacatcaatgggtttcaagcttctttgttttaaaagtgt

SEQ ID NO: 77475 - DNA, 1044 bp, Homo sapiens
tgttctaaatctggtagccatttattattaaatgattaatgattaaacattaatcatttaataattacttaggaattataaattacaatgtcaaatcttcatacatcaggctccttgcactataattacttaaaattagtttgcatcaatagtctatataaacagatatcttagtttagaggaaaaaatattctattttctaggtactttaatagtttggtcttgtgaaaattacataggtgtgtgtttatgtatgtgtatacacacatgtattgggggcttacaataccaaattaataagactgcccctcactccttaaatcgactatctgccctgccagtaatcccccacctgtactggtatatacagagttttctctggtacaaatgattaatcaagaaaaagggtgtgaaatatttgtgttcgtttctttttaaatgaataatgggatacacataaactagtaacaccacattgatttcctaaagacctaatacagctttaagagggaataacattccagagctccaggattattttaatttagctttcaagatggttacgattttgatttaatatagagacttcatagtgttaaattttagggtttttttttttttttttgtatttttagtagagatggggtttcaccatgttggtcaggctggtctcgaactcctgccctgatgatctgcctgcctcggcctcccaaagtgctgggattacaggcgtgagccactgtgcccaacctaaattttaggtatttaaaacatccattgatgctttgttttgtttttgggttttttttttattgttgttacttaagggatgcatcttatttatttggttgacttttatctagacatcataaatgtgatgcttacttttttattagccacttcattgttgatgtcttaatgggagatcttagtttgatgaatctactctttgaaattttagtttgattagtcatttgtttctgctaggttttggcttttgttttgttttttgagtgataacctaagaagtttctacagtggaaa

SEQ ID NO: 77476 - DNA, 2324 bp, Homo sapiens
gagaccctcttccagttctcggactcagtagcttaggcatggtaggagtgtatcagtgatccattgcacctttattccctcagcatatgcctgaggcgatcttttatgcttttaaaaatgtttcccgttggtctcattggaatctgcctcctaatgatttttttcaggaaaacctgtttggttatcctcattcaaaagcactggacagagaatgttactgtgaatagagcacatattactctttttagcaacctagcatgatgccaacaagactattcttgaaagagcaaaggttcctgtaaatttaattagggctagatttgagctgcttgtaagtcacaggttttccagatgtctgccaacaagaaatgactcatactgtgatgataccttttgctttgccttgtggacaatgtgggtttttgaaatttgcacccttcaaacaatgatttatcagagaaaggggtctgttttcaaaaaagattctgtaatgaattttatgtgtggcatatacttatttcttgagagaagattttaacttattgtttttattttatggttacatatgatgataacctgctattattaaactttttctaaaaagtgaaaaaaaaaaaaaaagatataagaactcaaggtcccatactctgtattcgggatccatctgagatgcatgctaagctatgtgtatgtttttaattttgcactgctctttcctggcaatttgttttaatggttattgcagaatattaaggtacatgtctctctgttttaagtaatattgcactttataaaaaagtatgaataaagcaaactattttataaagtgcactgtttaaagcatttgcactgtatttttgccatttattttcattttctactttaaatttgtcctcacattcctcttctactttgtatgcaacaagtagaatggggcatgttgtgtcatgtagtcagccacttatgcaccaatgtgaggaaaacctaaagggaaattaaactaaacactgtgcttcatatttgtacactgtgttgtactacagtgaggaatttcctcctgtagtcatatattatgtacataatattttagaatcatacctatgacttgtttggaaatttttctgttaaattttaaatccagaaagcatattttataaacttatgcagagcacttttattgctcaaaagttctgaattcatacagaaaacaagtactatgtgatgaaaacatttcattaaaagattgctgcatttaaaaatacaattaattcgttccctatgcaaaaaaaaaaaaaaaaaaaaaagaagtgatagggtttgtgtgttatattttcttttaaagccatcatgtgaaatgtcaggactgagaaaagtgatttttttgctttgtttacaggaatcatgcttaaagagataatgcccaacatgtttattttatagtttttgttaatgataaccttttgagcattagtttggaatttggacatgatatttatttattcctttcttgaggttatagcagcattaatttcaaccagttatgaatactaaaaatattgcactctatgtaatagtagtatatttattactaaatcaatgtatatattaatagcacaggcaaaaaatggcaaatattaaaatattttcaaaatattatattatcctgttcacattttgtccacagtggttattgggaataatattttacactttttgctggcccaaatggctacataatattgagttaatgaaagttttctactcccagctttcagttattcctagtaattatgggaaattttgtgtgaattattaccaaactattgctaattcacaaaatgtgattccatcaggcacagatctctagtaatcaagaaaatgaccatatttataattatattggacatattgggaacatatttggctcttcaagccattttttaaactgtgcatcctggtagaaaatactagttataaagtacaaactaaagggactatgttgctaatagaaaatgatccagaaaaatggtcagacagtatacagattgatgatgtgattgatttcattgtgaatattggaaattaatgggtttcattttcatttatttcccttgcctcttcttgaggaggattcgacaggcgatgaaatgggtaaaaaggcagtcagactaacaggaagaaggaaagataggctagctgtcaactgatgagcctgcctgaataatctcaaatgggcttttgaaaagaccttaacaaacactgttgcactcttgtcaaatatctttatctacaccctacttataagtaccaaaaagacagcattt

SEQ ID NO: 77477 - DNA, 1020 bp, Homo sapiens
ccattaactcatcatttagcattaggtttatctcctaatgctatccctcccccctccccccaccccacaacagtccccggtgtgtgatgttccccttcctgtgtccatgtgttctcattgttcaattcccacctatgagtgagaacatgtggtgtttggttttttgtccttgcgatagtttgctgagaatgatggtttccagcttcatccatgtccctacaaaggacatgaactcatcattttttatggctgcatagtattccatggtgtatatatgccacattttcttaatccagtctatcgttgttggacatttgggttggttccaagtctttgctattgtgaatagtgccgcaataaacatacgtgtgcatgtgtctttatagcagcatgatttataatcctttgggtatatacccagtgatgggatggctgggtcaaatggtatttctagttctagatccctgaggaatcacgtaatcttttaaactcaatcatgctagttgtagcaattggtaaattacaccagttacgttactattaggattattagagtggctttaacagatctgggtagtcattctgttttgttactttttccctgatagtacacaatgttgtcaggacaggttcccttccaatctcatgaccgaagtttgacgtgtaccagcgcggtggaaatcatgaagaaaattaaaaagggagatttctcctttgaaggagaagcctggaagaatgtatcccaagaggctaaagatttgatccaaggtaagaatctaatgaaattttacattttatatgatgtgtagtgattgaagtagaatcatggccattacacatacattcatatgttaattactcgaggaatccatgtgtattctaaaaggcttccaggctactctcttcagccttgttttcttatcagaacattctctttagtaatggtatccacatttctaacatgagctagcacttgacttccactggcatctcagtcaagcacatctaaaacaaaccaat

SEQ ID NO: 77478 - DNA, 1352 bp, Homo sapiens
ccctgtctccaaaaaacaaaagtcctttctttttagaggtacatgataaaatacagatgaaaatgaacaaaaataataccttcattaaactatccgaaaaaaaagagtgctttgctaacttttctatataaatgaatgcatatctagatacaaaggctgaattatcccataacaagcacaaaatttatttgaagtctcctgatttgtttcagaaataaatggaagttttgtattttacatctaataaacatgtatgtggatattttaatatgaaaacaagttatattgtcctcattgaataaaataaatactccaggaaaatacatcatgtagtattatgaggttttgattacaacccattatacctgatggatatacaatccctgtctgaaatgtataggactttaataaaaatagagcttacacggtatattaatctgcttaggctgctgtaacagaataccacaaattaggcagcttgaacaacagaaatttattttctcacagttcttgatgctgggtggtcttacgaaccagatgccagcagtattggtgtgtggtgagggccctctctttggattacagatggccacctgcttgttgtgtccgcacacagcctttccttggtctgcacactcacaaagagaaagtgtctgtccctttaaggacactaattctcttggatcaggggcctacccgtataacctcatttaaccttagttacctccctaaaggccctgtctccaaatacagtcacatggagagctggggcttcagcgtgtgaatccccagcgggtgcaaggagaacacaaacattcagtccacggtacacagtatttagagaaagtaggataagatatataacatacctgtgaagtgttataaaattttgtttaaagtgttttattctcaggaccttattttttaatttttttcccacaattttattttgaacattttaatgctagagaaaatatgagagaatattactatgaacatctgacattttgctgcatttcctttttctttctctctaattatttctagtgtgcacgctcttctttatatgtatgtgtatatgtatatatatgagtatatataatacatatatgcagacatacatatatatctttatgtagagatagagctataccttgctacagtatttgcaaacaatttgcagacacaaagttatccttaacagatatttctagataatcaactaaaattttaagagcttggaactgagaggatcctaaagtttgtttaattctgccttttccagaaaagggatcttttatattatcaccaatatcctctccagtacttccaaagttggaaagttagttttt

SEQ ID NO: 77479 - DNA, 1024 bp, Homo sapiens
tctagtgatggaacttctgaatggaggagaactgtttgagcgcattaagaaaaagaagcacttcagtgagacggaagccagctacatcatgaggaagcttgtttcagctgtaagccacatgcatgatgttggagtggtgcacagggatctgaaacctgaggtataaaatcactggatctcttacgtaattcagtctagcaccattattaaagatctcccaaacatgggggaagtttctggggaggtttccttatttttttacttttcaaggctgttaaatagataattgaaaatacgtttctttgatgttttttcttttatatttcagtctaaaataaatttgtctttgtttattttttgccagctgatcatcttgaggttatatttgtaagtgtgagaaccttttatggaaaaaatactttatgcaacagttgtggactaaaaatagcaatggaaatttttatagcagaaaataatatctcttacatataattttagagggttttttttccaaatgatgtattttgaaaacttattttttacatttgtaatcaaattggttagctcatgaataaaaatgtatataattctattctaaatacttaaagagttgtcttggtttaattagttatgccgtctttctatgtgcttttctatgatcgtgctataatatttatagaactatatgtagcaatgcaaaagtaacagctatttatatgtctcctcttatgaaaggctaataaagaatgttctaactcttagaatgatccctttttagtatcaaaaatatgaaaattccctccttttagaaaatcaacaaaataatgaaaattgaaaaacgaaaatcaatactgtataaaaagataatgatgactcatcctttaccatatacaagattatacatattctctccaaaatagaactttgtttaattatcatgtgattataatatgttctcgagtatatataaaatattatttgatgttccttttgtgattaagccacaaaagattatttctctaaa

SEQ ID NO: 77480 - DNA, 1167 bp, Homo sapiens
ttctgtaaattaaaagatatttattttaattgaaaccagtattatattgtaagactttcttacccaaaggtttaaccacttggctcatcagttggtccattatacttttagctctaattgatattttctgataaagtaatccattttagacataaatcatagtcttatttgcttttgagtttatctagagaaaacgtctttgtgacagtgacatatttaatcaggctcacatagtgattttggcagccattgccatttctactagttgtgtatttgaaatatttttctctaaaattatttagcaagctactgatagctttgagagccatctagttgttttggtaactgatgattattattaagattgcatattcttattactctaaattgtcaggaaagtagagcattcatttcctcatatgatttgtacttttctgactcagaaataataattttctccagaatattactttttctagtgtgtggtataattcattactttcatggaaacctcattacagtatactgtaacatgtatattctgaatgcactgtaaataagacaaaattagtcttggggcagtactgatataaaaactttcttgaagagacatgtggatgctaagtgtctcatcttgcaggatggaagccaatactcaaaaggaaataacagctctgaaactctgtgaaggacaccccaatattgtgaagttgcatgaagtttttcatgatcaggtatcctactttttttttttttttttcccatgtgtactaattcacttacagggttgtacttttcacgcgttttgttggtgctgctgggtcagagtcagggatatagaacatcacccagccaccagaaagggcagtgaaaccaccctctcaaacccctccccaaccacacactgtttcccaaccccaaatcaggttatcccttcacctctcatgcttttctcactcagcagttaaccacctatgacaggaagacggagggccaggagctcagtggtgcagtcactggctacaatgtgcttgttgccagtgccgcttctacccaccatcacttaatcctggagtacctctcaggactcaggaattttgagcctccaacttccctttcacttctagagtaaaactgagagagcctggagcctaattaatgcaagct

SEQ ID NO: 77481 - DNA, 1025 bp, Homo sapiens
tcttttgatgaaagatcccaagaagagattgggatgtggtccacgtgatgcagatgaaatcaaagaacatctcttctttcaggtgaaattattgaatagataaatggtttcatactccttgccgttttcagggtccttggcgttcttggtgaaattagtgaacacagtcccctttgggatcattttccactggcattttcacgtacattgcaccttttgttttgttttgtttttaatgatagggaccctttcagtagggccaaaattctacttgtataaacattaatggtatttttctccctcaatggagtgggagtggggaggatcataatagcattcaattttctacatactgattcattagagtttctaggtggtggtttccatttatgatcttgagatctagccatatggactgagacttttactgtacttttcacttctgtctcagttcatgagctattactgccactatgtttcaccttttagatagtgatttcttcacttcctcttttcccagaagtaatctttaaaaattttaaatttacctatttctcagttacatattcatgacacatagagtgttactcatttatttcctttgtcctgtgacagtgcttctcttattctgaaaaagcctaatgagaccattctactgaggaccaactatatctgctcagtttagtacaaaaaaaacaccaaaatattaaacaactgagaaaaaacatttaaattaactgagttggctagttatttccagcctcagtcgtcaaactggggatgccacggctttgatttctaaaactctggagatatgacttttaaataacttcatcatatcagtaagcctgacctaaatatttatggtctaaagggaccatctaggttttattttttattctgtaaattaagcttttacattattatcaccaaaacaaatgaaaataatatagcaaaatgaagaaaaactgtcagttaagcttcatgttgttattattttttaaatatataaaaataaatattga

SEQ ID NO: 77482 - DNA, 1090 bp, Homo sapiens
ctgggcagaagagggaaataagatgcttcatgtggccggccgcagtggctcacacgcctataatcctggcactttgggaggctaaggagggtggatcacttgaggtcaggagttcgagaccagcctggccaacatggtgaaacctcgtctctactaaaaatacaaaaattagctgggcgtggtggcgagtgcctgtaatcccagctactcgggagactgaggcaggagaatcacttgaactcaggaggcggaggttgcagtgagccaagattgcaccagtgtactccagcctgggcaacagagggagactccacccaaaaaaaaaaaaaaaaaaaaaaaaagatgctttatgtgacagtgaagaagagtatttatagcttacataagacatgccctggggacgactcccagagttactgggtgggtgagacttttgagtgcagtcacagattccacagaagcagataaggataccagccaaataatctcaatttattattattaatgacctggctggtgtggcctagggaaacacaggttaagtggatcaaggaagaactcagtaacaccaaaagtgaagtgacagcctgtctcatagctaaaggaagacagactactatagagtgacatcaacagcaccgttcacctggggaccgctgtgtgccagcctctgtgctgagaagtcacccacattgtattctggaatcctcagaaccctgaaaaataagtggtagcatatgcagttttacagatgaagaaactaggatgtaacttgcctgggactcaatgctactgtgaggttggactgggatcaaatacagagttactggaaagttactccatgctgtcttcacgggtatcacttgtttccatgctgctgttttctttccaagtctggcaggtgcttatttcaggtaaaagactgggaagtactggcccacggactgcagggaattgatttcattaatcagtggactatttgttgaataattctttactcctaaggagaaagagaaatagagggtaaagtccttgtcctaagaacatttatttatatagcatttgggaggatatggaataaatacatgaa

SEQ ID NO: 77483 - DNA, 2592 bp, Homo sapiens
ggatagacaaatgatcaatggcaaatgatttttgacaaagatgcaaagtcacttctgtaaagatagttttgaataaatggtgctggaaccactggctatccagatggaaaaaagtgaacttcaagaaatacttcataccatatagaaaaattaactcaaaatggattatagacctaaatgtaaaacctgaaactataaaacttctggaaggaaacataaaggaagaccgttgtgagcttggtttaggtaaagatttcttagatatgacacaaaaagtgcaatccataaaacattaataaattggacttcatcaaaattaagtatttctgctcttcaaaactgttaagagaatgaaaagacaagccacagactgggataaaattttaaatcatatgtctgctgaaggactggtatccagaatgtataaagaattcttaaaactcaagaaaacaaacaactgcatttaaaaatgggcaaaaaatttgaacagacagttcatcagagaagatgtgtaggtggcaaattagcacatgaaaagactatcaacacctttagtctttagggaaatgcaaattaaaacatcaatgaaataccactatatattcaactagtatggctaaaaataaagagactgataataccaagtgctgataaagacttagaggaactggaactttcatacactgcaaggggaaatgtaaaatggtacaaaaactttggaaaataggcaatttcttaaaaagttaaacgttactcactgtctaatctgtccattccattcctgggtaattaccaagggaaatgaaaacatatgtctatataaaaacttgtacatgaatgttaatgacaactttcatttgtaataactgaaaactggaaataatccaggtatctgtcaacaagtaagtggttaaacaaattgtggtttattcatacaaatggaatactccttagcaatgaaaaggaatttatctaagacatgtgcagtagtgcacctgtagtcacagttgctgaggagggtgaggtggggggattgcttgagcccaggagtttgaggtcagcctgggcaatgtagcaagaccctatctcttttaaaaaaaaggaatgatttgtttatactcttgcaaatggatgaatctcaaaataattacaccaagtgaaagaagcgagaaaatatagaatatataccatatgattccatttctggaaaatgcaaactaacctacagtgacaaaaagcagaatagcagttgcctagggactgggattgggggaggtcaggagagattacagtacgtaggaaaactttggaaggtgatgagtatatttgtttcttgattgtggcaatggtttcacaggtgtatacatatgtcaaaacttatcaaacttagaacattttcttccatgaaattaaaaaaacataaaattatatactttgtatgtgggaattttattgtacgtcaattgtacttcaataaaactgttaaaaatttaaagtgtaccttttccaggacaggctaggaagtaaatgatttctcactgtttcaatttatttaatgccaaagttaagtgagcagtacttctttttaaaatcagggtgagttaaaatctcacctcttatgaaaaattataaatatgactttgtttattttaaattgattttttggcagtttgaaaatacctcagactataggaaactgtggccaccgtcctgagaatttgggtccagttgtaagatcatacctgtcatggtgacaggtactaagggtcgccttagcctgacaacattaagtggtggcttctctaattcccctctttctgattccacatatacaggcaatctttataaaataattttcctttccactgtaggtctgagtgtggagagaagtatatttcttatgatggcaagaatattctgaacaaagtaatgttcacatttaaattgcttttattccctttatatcaatcaattggcattctggttttagaaagagaaagagagcctgaatcagattgtttaaaaccttacaactaaagcaaatagacttttcaagaatttaaataggattccttccctttaatcaattaattatccactttgtcatggtgtcaacctgtaatttcatggttttgtgtgtgtgtgtgtgtgtgtgacagaaatttacaaacaatgtgataactaaattatcctacactacattttcctttcaaaataatcattctgagtatctttcctggcataaatcttgtatgtatcatttagataaatgtgccattatctgtccccagtgtcttaattagctcaggctttttatcatcattgaatttttccattcattaattattatgatcttccctgaactctgcatactttccgtattttttgtttgaaatggttcaaagtaatgtattatttaagttatctgttcgccatttttgtctacaggtagcctagaataaaaatgtttttctagtatatcaaatttcaaaatatgctaagaacttagaatgagaagaaacttagagtccagcttttcccctgacataagaatccctttctctgtaagaatccctgatagttgtgccatca

SEQ ID NO: 77484 - DNA, 1026 bp, Homo sapiens
gactttggaatatggacttttgagttaatgctgaaatgagttaagactttgtgggactgatgggaaggcatgattggctttgaaatgtgaggacatgccaggggtggaatgatatggtttggctgtgtccccacccaaatctcatcttgaattcccgcatgttgtgggagggacctggtgggaggtaattgaatcatgggggcaagtttttcccatgctgttctcatgataatgagtaagtcttgcaagatctgactgtttaaaaaacgggagttttcctgcacaagttctctctctctttatctgcttccatccatgtaatatgtgacttgttcctcctttccttccaccatgattgcaagacctccccagccacgtggaactgtgagcccattaaacctctttcttttgtgaatttcccagtctcggatatgtatttatcagcagtgtgagaatggactgatacactctgcctgccttctcttctctttaacctcttcctctttgaccatttctgtcactgtttaagtagacatagtctttccatcttaaaattttaaaaatggggagatgaatggactgataaataaaaaggaaaaaaaatctcagaataccatattcccgcctagctattgtctcattgttctcctttgtcagtatttgtctctacttactcacatgtcccttactcccttatcaattccaattctgcttgtacctccttgcccccctaccccgccaccatctgctgaggctgttcttgccaatgttaccattgacgtgcatattaatactttttagttactttatttgactgcctggtagtactgaacttgaaatcacctctcagcttggctctgtgacacaacacccacctgactttccttctctctctcactgccttttgttggctcttcctcttctacctgagggttcccctcagctcagtcctaggtactcttcttttttttatgctgtactcttcttacatgctgctcattcccagccttctcttggccaaccttc

SEQ ID NO: 77485 - DNA, 1870 bp, Homo sapiens
tgtgcctggcccctagtgtttttctgtatgcaattttgatttccattttaagagattattaagaactttctcatattcttagcattgaggaaaacaatatttctaagtttagaaacatttaattcaggctgacataactgaaaacatgaaacagaattcatgcagatcaagcacctcttatatgagttggatagattatttgttatatagctgaagtgttttgctatagaacttacaaaaaagtaagttttataaatgcaaagtaaaacagagggatctataaatgttacttaattgattttctttgcttatttagaactaaagtttgagcctagtgcagtggctcacacctgtaatcccagctactctggaggctgaggtgggaggatggctttagcccagaagtttgaagttgcagtgagctaggaccacgccactgcactccagcctgggtgacagagtgagaccctatctcaaaacaacaacaacaataacaacaacaaaaaacaactaaagtttgagtaaaattaacctatgatcttcaacctttatgtttaagagcctgttaatcaacaattctttataaatttcctattttatacatggtgtgctgcacaaatacctataaatacataaaaagtgaaaaaaagagttagagtataggtatataaagacaagtaggaaatagctagaaaatatcagtcatgtataggtaagtacaatgtaaacataggtgttgtaggatgaaaaacaaggaaatgacaggggatctggttagtcaggagagtcttctgaagccgttaggaagtgatggacaagaattggctatgaaggcacctgaaggtcatctagagtgagagtgaactaggaagaatagagacatgaagaagcacgagtcaagagggaggccctaaagaagctgacccaacaaggtagaccctgtgcacaaggagaacaaagacgtggttggagaggtccagagaacgcagcagataaaagaatttccattttccctgaccaatcaccaagagccattacaggatcctgaggagggaaatgccttaaaaaaaaaaataaataaataaaggtagacgagaaagactgccctaattcatttttttgtaaattattttaaaatttatatttctttgtttttgcagttggggattatatatcgtgatattaagcttgagaatattctacttgattctaatggccatgtggtgctgacagattttggtctgagtaaggagtttgtggctgatgaagtgagtatattttaatttgaagttagtaataacagcatgtaaacaaggatgaaaacttagccgtagaataaacatttagcagaaaactgccctgtgaattctgaacttttgtgcagatttgtccatggaaaatgtagagatttttagtttaaaattcgtatggagccgtcctgttaaaattgcggtaaaccttgatgggtatatcagaattcctatttatttaaaaaagaaaaaagacactatgcatttaactttccccataaaatatgtaaaatataactgaaaaatcaaataactcttttggcccttcaggagaattatggctttgatagtggccaataaagaatcataaagcaaagtacatacagtttacattgtggtaacaaagtaggacatgctatgaaggccctttgaattcgcttgacaagaatgacagagatctactagacccaatttttaaataatattgctggtttttgctcaacatgaattaaaatatggtggctaatgtgcagattttacatttggagaactttaattttcagtattaattagaatttgtttaatattacaaatgcatttaatgacacttaaaattgtac

SEQ ID NO: 77486 - DNA, 1050 bp, Homo sapiens
ctaattctttattcattattattattattatcttgagacagggtttcactctgttgcccaggctggagtgcagtagcacagtcatggttcatggttcactgcagccttgacctcctgggctcaagcgatcctcctggctcagcctcctgagtaactggaactacatgcctggctatttttattttttatttttattttttttctagggaagaggtctggctgtgttgcctgggtttgtctcaaactcctggcctcaagctatccttctacctcggcctttccaagtgctgagatttcatgcatgagtcaccacacctgacctaaaactaagggtgcttttggaaaaaggaaaaaaaaaaaacaaaggaaattttggtggtaagcaatttaagaggaagccagtagctccattagagcaacaagcttaactctgtcgtatgtggacaactaagaagggtcctcctggggtcagaacaaactttaaacactgtcctcaaaagctactcctgcaaatgggcctgaatttattggactagaccatggagtaatttatgctccagagcattattgaaaacaaaatagcgaccagccagcaattagtgggtcctaacagctgggtgtaataccagcaagaggcagacagcctaacagatcagggaaagaaagtgcaaagagagccctgctagaaccattgttcgaatgcccaaggttctgctctctgaggagcaacattggaggcttcacactgcagataaaatactttactaaaatagtcaagccaagttattaaataaagaaaaaataactataaaaacaggctaggtgcagtggctcatgacggtaatcccagcactttgggaggccatgggaggcagatcacgagaggccagcagtttgagagcagcctggccaacatggcgaaaccctgtctctactaaaaatacaaaaattacccaggcatggtggtgtgcacctgtaattcctgctactgagaaggctgaggcgcaagaatcgcttgaacccaggaggcggaggttgcagtgagctgag

SEQ ID NO: 77487 - DNA, 1058 bp, Homo sapiens
taaaatgagtgggtgacatgaggaggaggagatttttacatagtctcaattcctctccctaaaatttaccagttaattataaagggaaacatagtaacttcatagtggagaaacgtggcaaactccactttagtgactccacattaatgatgttctcaaagttaacaccaatgttgggtaaactaacatccgtgcttcctgagatgtcgtagtgagggtaacatcattttattgctattccttccaagaatacataacctgcatcatgagaaaacaaaagataaaacccagattcagagttagtccacaaaatatcaggtctgtcctcttcaaagataccaagaaagaaagaccatggattccagactaaagagatgtgatttctaatgcgttgtatgaaattgaactagaaattggactggaaaaaagtagccacaaagagcattattggggtaaatggccaaatttgaatagggaatgcaaattaggaaatggtatttttatcgtggttaatggctctgatatttacaattatactgtggttatatgcaggaatgtcctagttcttaggaaatgtacactgaaatgtttaggagtagaggagcacgatatctccaacgtattctcagctggttcaggaaaaatatgcacatatatgaaaacagaaagaatgctaaagcaaattaaacaaaatgtaaacaattagtgaattttcataatgagcatatagggattctttgtattgttcttacaattttggaatcgtgccaaaattttgtactacgttaaaggtacagtacttttttcgagaaaaccgcccagggttcatactgcactccagcctaggcaacagagcgagaccctatctcaaaaaaaaaaaaaatctaggccgggcatggtggctcactcctgcaatcccagcactttgggaggccaaggagggcagatcacctgaagtcaggagttcgagaccagccaggctaacatggcgaaaccctgtctctactaaaagtacaaaattttgcacctatagtcccagctacttgggaggctgaggc

SEQ ID NO: 77488 - DNA, 1030 bp, Homo sapiens
gtgattgtttcctacaatatgctgtatttactggtagttgccttctctttatttatattgtatctgtcatcttgtaaatcaggcatcaggactttgaccagtgaagggctagatggtaaatattttaggctttgcaagccttaaggtctctttgaccataggcagtagtgaataaataggcatggtagggttccaataatttttttttctttttgagatggagttcactgtcgcctaggctggagtgcagtggcgtgatctcggctcattgcaacctctcccttccaggttcaagcgattctcctgcctcagcctcccgagtagctgggtttacaggcatgtgccacctcacctggctaatttctgtatttttagtagggacagggtttcaccatgctggccaggctggtcttgaactcctggcatcggtaatctgctcgccctggcctcccaaagtgctgggattccaggcatgagccaccgtgcctggcccaagttccaataaaattttatttacaaaaatggtggtggaccagatttggcctctggtctgtaatttgttgacccctgctttaaagttatctattgttaagtcacatttctggtttttttttttaattcaacaacattaatatcttttaagcctctgatttatagctaatgatattggatttggtggatttttccctttatatttcttttacttttcccaaatcttgtaacgtggagatcatgtctccttttataactttttctgtacctgtgcatggttacaacaagagatataaaaatatttttatctgttctctctctcttaaaactcatatttatttcaactaacactgagagggaattctatgtggaaaataatctgtaaaaataatttttcttttgatgttttctggtttctgttagtggtgattttgttgaaacaccagctgatctatgactgtaataaattgttacattaatcagaattcacaagatgttaaataagcaaatcaccaaagtgtttgtaaaggtaatgcca

SEQ ID NO: 77489 - DNA, 1017 bp, Homo sapiens
gtcttcttccagtacttgcatggttttattttttgcatagagaacttggatccatgtggatggcgtatgacatgaaataaggatccaacttaatctttttcaaatagctaattttcccaacactgtttagttaaaagtccacatttacattgagttgaggtgcttcctttttcctctatgaaattctcatatatgtttgggtctatttgatttttttctgtttggtttgttaagtcatgtaccagtactatactgttttaatttatcaaggttttacaatgtattttaattcttggtaaggttagttgccctctgcccctgatctttcattgcctttatttttcagagctttttggaggactcttcctgttggtttatttttcagcatgaactttagaatcacattgtctggttttggggggaaaaaccgtaaggtattttcactggaattgctgtaaattaaaaaattaatttagggagacttgacatttttatgatattggttattccaattcaagaacatggtatgtttgctgatgttgaaatccttctaagaccttcaggtgtgttttagcatttacttcctagccatgtttcttaactgaatcttagatattctgtcatctgttgcttttgtaaatggggtcttctcttccaccataccttctagctgaaagctattacttttatatattagttctatatcctgctatcttactacattttcctaccttcccacattgctcatgtcttgcccagttccttcttagcctgccctgaaccatgttgtttggtgtatatgggttttctttctctcagttttgctgaaggagtaggtcatggaggtttacagcttttcttgctgtttttaaagatgttttaggagcagatgtggagattcatgtctaggctgccatcatgtgcctactagtatttatggctcactgtagacttcttgatggggcttgttccattgggattaaattcgccttgtttgcacaggcttctccaaatgat

SEQ ID NO: 77490 - DNA, 1076 bp, Homo sapiens
ctgggccacctcttttctcctccatatggcctctcatcctccagtacagtagatcagctttttcatagcatggtagtatcagggcagctagcaactactgccaagagggcaaaagtggaggctgcagggcctcctgagcctggacactggaactcacatagcttcactgtcaacacaagaccagcctggattcacgggatgcagaaatagacttcacctcttgaagaggggaactagaaagaattcatggccatttgtcacacaagtccattttcatattttactaattgtaacataattatgctttacagctgtttgtccaatccaggaatgctcacttggttgtgtccttatagtatcttttaacttattcctgcctctgctgaattctagtagtaattgggaagctagatctaaagtctcaataggttaaacttaaacgttttgagctggaatacaccataaatgatgttatgtatttcatgttatatcacgttaggagaaacctattatccgatttttcccaattagtgattctaagattagattacatagtgacagcctgatcccttcatcataaggttatattttttctcctagaagtgaaaatattctgtgtggtgtttggacactattttttttttttttttttttttgagatggagtctcactctgtcaccttgactgtagtgcagtggtgcaatcttggcccactgcagcctccacctcctgggttcaagtgattctcctccctcagcctcccgagtagctgggattataggcacctgccaccacacctggctaatttttgtatttttagtagagacggggtttcactgtgttggccaggctggtcttgaactcctgaccctcaggtgatccgcacgccttggcctcccaaagtgctgggattacaggcgtgaaccaccacgcccgccctgatactggttttaacataatataacgtggttgtaatgtaacataacatatgaacaccatataattcataaagcttttccttgttcttttttttattcctgcacagtccttcgttccattccattgtatacttaact

SEQ ID NO: 77491 - DNA, 1116 bp, Homo sapiens
taaagatgaaaacttttcaggaatttagaagaggaccatagactgttttaatggttcagttatttgtttgcagtgccctaatgcacactaggtcagtttcccaaatatcgtgctatacacttggtccctatattagtttgctagggctgggtggcttaaacaatagacatttattttctcacagtactggaggctggaagtccaagatcaatgtgccactagggttggtttctcccacggcctctttccttggcttgcagatggccactgtcttaccacctcttcacatgttgtccccctacgcatgtgtgcccctggtatctctttttgtgcccaaatttcttcttcctgtaaggacaccagtcagattgctttggggtccaccctaggggcctcattttaactccatttacagtcacattctaaggtactggaggctaggacttcaacataatgagttttgggaagatacagttcagcctgtaacagtcccaaaaggtttattggttgactgactttatccagctttttgtgaggtattagcaagaacttacatgtctagctcttcaggaaccttgctaacagtttgtctgatgactaagtaaatactataaatctttttttttttaaatatgtgttttcttaaagttttattactgcaaaggcagtatatatgcatacagaaaatacaggacagcaaaaataagaaaataaaaacttattttcactacccagcatgaaccttattatatacccctctgttatcagtatatattcttctaggtctttttgtctgtatgtctatctgtgtgttttatcaaaatgagtttgtcccgtatatgatttgtaagcagatctttccgttaatgatatctacctttcccagctaataaattttcatttaaaacccagttgtacaagttatttattgctgtataacaaaccacctaaaatttcatagcttaaacaatgatttattttctcatgatcccatgggttggctgagcagttctctaatggttagcctgggctcactcacctggtgttcagatggagagttggctgggctgtgaggtccaagatggtttcattctcatgtctggtaattggtgctag

SEQ ID NO: 77492 - DNA, 1227 bp, Homo sapiens
tttgtctacatcagtaataaatatatatatatctagaagttttatctgatgtctaaaatgtcctggttgttccagaattggattgtggttagttgaccgtaataacagctagttttctacagctaaaaatattgcggagagaataacagtaaaagagtaaaagcataattttgtcatcagtggttagatatgtaaacattaagggttagacctagaaatatatttggtataaaattgaagaaatctatcaaataactatttgaactggtaccaagggtactttttcctttaaagagtgtattttttgtgcattaaataaatttagttgcactaaattaccattttgcctgtgtagcattttaattctttttattttttcttttcattttcagcttatggaaaagtatttctagttcgtaaaataagtggccatgatactggaaagctgtatgccatgaaagttttgaaaaaggcaacaatcgttcaaaaggccaaaaccacagagcatacaaggacagaacgacaagtcctggaacacattaggcagtcgccatttttggtaacattacattatgctttccagacagaaaccaaacttcatctcattttaggtaagtgtcagttgttatcagactttttatgaaaacacttttctttgggtcttaagttataatgtacttaaagggcaagatactatggacttagaagaagtgaaatattttgattctcattctttgtggtggcatctcctggaatatcatgcattgctctggatttgaggcctcccattatgccattatggaagaatttacctccttctattccacactcttttcttagtctttttttcttttctttttttgaggcagagtctggctctgtcacccaggctggagtgcagtggcacaatctcagctcattgcaacctccgcctcccaggttcaggtgattctccttcatcagcctcctgagtagctgggactacaggcatgcaccaccatgcccagctaatttttgtattttaagtagagatggggttttgccatattggccagcctgctctcgaactccagacctcaagtgatctgcccgccttggcctcccaaagtgctgggattacagctgtgaactgtcacttccagcctttcctttattaatgttaagaaacatttgaattgttaggggtatctacctccctgagcagtatgcttccattcaaatgtgagg

SEQ ID NO: 77493 - DNA, 1961 bp, Homo sapiens
tccctaaatgattaaacttaaggcattaatataaaaaaattctaagagcttttgagaggagcatggtttaagctgattcacaacagagataagcctgaagtagaccttgaaaagatttaaaatatttattgatttagtccaaatttactaatatttaacaactcatgtggtcatcagaattgacaccagaaacaaataactgatatggtcgtactcctgtgtaccagttgattagctctattctaagtttttagtttgttgatactctttgttgttttgtatatttgtcaaaagttttcataaggcattctttctatgggaaggagttaatatttttctaagttaggatttagaggctgaaggtaaggttttggtgccactatgctgttatagtcagacatccacaaatgcccaaactctgctctcccaggcccctcttttccctcagagtcatgagtgatccatctgcaaggcacaagtagctggtgggaatcagagtaacaaatttaataagagttgtgcaaacatccaacacaccaatgtaaaactcttctgtagaagctgcattggtgcagtagtttaggtttaaggcctaagtgaggtgtcctacttcccttccaactacatctaattataatcttgagaccagcatgttcaggtgtgtgacttagaaggttagaatgggccgggtgcggtggctcatgcccataatcccagcactttgggaggctgaggcaggcggatcacctgaggtcaggagttcgagaccagcttggccaacatggtgaaagcctgtttctactaaaaaataaaaaaaaaggttagaatggagaagaaacaccaggtatcttagtttcaggtttctttaacaaagacaccataaactatctggtttaaacaacaaacatttatttttcacagttctgaaggctgggaattccaagattaaggtgctggcagctccagtgtctggtgagggcccacttcctggtttgcagatggcagtcttcttgtgtccttgcatagggaaagcagagagagaggaagcatagtctgtcctgtctcttcttgtagggcactgaatccatcatgagagtttcaccctaatgacctgattacctcccaaaggccccatctctaaataccatcactttggagattaggattttaacatatgaattttggaggatacaaacattcagatcatagaaccaggtcccaggagaacccctgaatctgcttagctaactactatgtatgttgaagggagaagtgcaagagaatggccaatctgtcaggccatggaagaaatttgaggcaaaaaaaccaaagaggccttgtggggaggctgatcttttaacacagtgagtctacctattaattgtgcccatctggagttttggactcttgaataaatgaattagtcacgtttcttacctttggggagaactagaaagggggttgggcaaaggcatgcctggcataggaaaaggagcaaaagtccttttttcccacaactagactaaagtaccatctccttttgagtgtgaagaaagacagtgtacaattctaacaggtctgtttctggcacagtctgatctaggcatgcaggtagctccacatcatctgagcagcatattttgggctttactaaagcatgtgaatgactcacacatacagatttcagcaattggttgatgttttatttcacctgtagggtgaaataaatgtgtaaatattataagtcttgttctaatactgttaatattattgtagagaagtttgagctcttgttcttaggttaacaattaagagaaatgtgatttatttttagactttcatgcacaaaagctttaatcacaatgacaaaataatagcataggaatgaaaactatttagacacctagactcacatgctcaaatatgtgttttttattgcttaggattctatataatatgat

SEQ ID NO: 77494 - DNA, 1039 bp, Homo sapiens
ttttgaaatctggctttttttctcattcttcccctattaatggttcttaaaaaaaaaaaaaaatcgctgttgacctaaccaaattagagtgtctcagtcttcatgcacttccaccttcttgctgcatttgactgcattgatacttcttttttgatgttctttctttgaatttcatacatggttagttgaaccacttctctggctctttttcttcttgcctcataactctaggtaatcatcaagacttgcctttcctttcctgtggtctcttgaagggcgttcgtcttaaagctttagccattgcctttctcctagtaactctgtgcatgatgtctctgcagaactttagttccttgtctagagctgcctacatgaaagctcttttggggtttttttctgccattcttcaaaatcagtgttgaaaccaaaaaacttccccttttgacttccttattctgttggtaacactgccattcaccagacttgcatttcttatgctttagatatagggctgtcttagtctgttcaggctacaataattaaaataccttagacatggccaggcatcatgcctgtaattccagcactttaggaagccaaggagggagggttgcatgagccaggagtttgagaccagcttgggcaacatagtgagactcggtctctattaaaagaaaaagcccagcaaccttggattaggtaatttataaacaacagaaatttatttttcacagttctaggcaccaggaggttcagtgtctggtgagggctctctgcttcatagatgatgttttctagctgtgtcctcacatggtggaaggggccagcaggctcgctctagcctcttttataagagcactaatcccatccatgagggctctgccctagtgacctaatcactttccagtggccccacctcttaatgtcaacacactggggattagatttcaacatacaattttgaggagaaacattcacaccatagcaggggccaatagggaaaaaaatggaacagaaattgagttaatttatctttgaa

SEQ ID NO: 77495 - DNA, 1017 bp, Homo sapiens
cagaacatcaatttctaaaacttaaattttgttcaaaaccttatccaattttcagttacttgacagatttttttttctttgagacatcagttcatcaattaaaacaaaaaagagggaaacaaagcctaatatgttagtaagaaagttcctacttttggcaaagaaaggagtttcagtcctagcccttattccctattcctcaataaacagtttcactttctccgttccaacacttttggtattaatgaaatctcaatactaacctctaattttcaagttctggtatgaataagatcatgacactgtattgcacatatttttgtctttttaaaactgttcctatgttatgaactatgacaaagaaagtcttcaggggaaaaaaacaactatatatggtaatcctatcttccgaacactagctactctcatttttatatgttcaattccagtcttttcttgttgtatgtgtactctagttgttacattgggcttaccagccccttataatctacactcaatactcaaatctgcagtgccaaggcctgtgcaagtccaaagcctcccctgtctgcccaggtttccctcaattactgggagagctgaccttctcagaactcttagagctacttggtcaccaacgcttttatgcactgcaataatccagtgaggacacagctcaccaacttctacacaagataaacaaaaaccaaacatgttcaaaaagcattccttagcataccagacttcagtgaagatttctgaagctaggcaaaagagtggtacaccaggcaacagttaaaacaaccccctcaaaaggagctggaggaaggaaccttctcaatctgtctttccatcatccaaccgtggggaaggggatctttatctcacctatccctgaccttacatcacttttctgacttgttttctctctcctcttccctattaggaataagaccagcaatcccatccccttgtttgctctacttcttctgacctctcagaccctgtgaacatcca

SEQ ID NO: 77496 - DNA, 1066 bp, Homo sapiens
ttagggagcaacagagtaaatcaaaaggattgcacagaggtttttaagatttactttcaaaagctagttccctcaagtgttagtttataaaccattaactatttgacaggttggagacaatcacacctggaacccgaatctagacatataaagaacagatacattctatctacactcagcacagcattccttatcctcaaattaaggtataccttcatttacaatagaagtcttgcttcagtatttttgcaagcaaaaatttgataacttgtgaatgattaaaaaaaaaattaaaccattacagcaaggcaaacattccagcttccaaagtgctaccaaatttattttgtttattatgttttgaattacacttttcatacaagatatagtttcttatagtccaaagtactatttccaaggataagatttcaatttgatgtaagaaaatatagcagcactttgttcctcctaagtcataacctcatttttccactgcagttctactgtcacttctacacgtaattctattgtgagaaagtactttatcaacaccttttcctttttctgttttccagactacatgctgctaacagtgccaatttggtttctattagcacagaaatgtggcagccttacatcaaataacagtttgtaataacttgttcttacagcaataaactttcataggactacagccaactcatttttcaagaataatcctactttttaaaaaaatgttaactcagtgagctatataatctaatactatgaaaactggtgaccaaagaaactagattcaccttgtcttgtcccagccttcattcagctttcctttcttacctcattctaactgtttaatcaaccacaactgccctccaaccccaattctgaatgtagaagaaaaaagtccaggggtgctgtggtgggacttagaggcactagagagctagagcagtgtgcagccctggtgtcccctcctgctctcatttcaaacatgaagtgtgtaacccactcccctgaaacgaagttaagcaattaatgcttctaattttatggcaagggtatc

SEQ ID NO: 77497 - DNA, 1037 bp, Homo sapiens
tgcctcagcctcccaagtggtcaattaatttttttaattttatttttaaatgatttaaaatgcaaagttgccaaaataagacaactgtcatattcataatctttttgcttattcaaaataaccctttgttcataatcaccaatttttaacattctgtcatatttttctatcttattaatacactcatacatactacatactacttttttggttctagggtacccagatatttagttatgtgtgtgttgtgtgtttctgtgagtttttttggataagatcaatatttaaatcactgggctttaggcagactccctcgataaagtgagggatgcacagcagcattccaccatcaaatgaaagtggtatacactcggttcttcgctttgcttgaaggaaaaacgaccagacatcggattacatatcaacttatggactatcaccaatagtttggttggatggtcagggacttagaaggaacatgattggaaaatcgatgacaagaaagtgtaaggaagaggtatttggctagagctctctaaacaggcaaaaaaaaaaaaaaaaaactgaaggtatttgtattctcctatgtcaatgcccaccaaaggatgacctcagcagagaaggatattaataatcaagtagataggatgacctgttctgtggataccagccagtctctttcccacctgtcatcctatctactgtcatcacccagtgggctcatgaacaaagtggccatggtagcagagatggtggttacgcatgggctcagcaacatggacttctactcaccaaggctgatctggctacagctgatgctgagtgccaatctgccagcagcagagaccaatactaggtctcgatatatggcatcattgctgacaatagtaagccaagctaccatgccaggttgataacactgaactgcttttatcatggaaggggcagtgttttgttcttgctgtaacagacacttactctggatacagatttgccttccctgcacacaatatttctgtcacaactaccatccatgg

SEQ ID NO: 77498 - DNA, 1619 bp, Homo sapiens
tcttttagcttttgaaatcttgaggacaagagatcagccagttatcaatgcagggtacactgtgaaaagagggcctatggcagcatttggaaagatccccattgcttgtgactataggacagattatgccaaaaatcaggctgaagatttaatcataagggtgaaagagctgtataccttctgtggtgggtttgtactgtgtcaactgggctaaactggaattatgtttcccagaactcccttctaggctctagattagcactggccatgagacattttgagtgagatttggaagacagaagtgaagcagcagcagctggatatattttatggctaaagattggtgctggtactaggcactgttgtaactcccacacatgattgctaagctgctgtgtcatattgttggtttggagcagtagccaggtctgcggctccttcagctcttgttgcatcactgccatcagcttctggcaattctgggccagtgtgtacagcttttctgcaggttatctgaatcattgagtttggaagcctgaaggtggtgagagacagacatggactcttgtttgtcctcatgggttccagattgtctttgggattccagtctattcttacttttttctattttgtattactctttcctttacaactccagatgtggaagcagtcttatacagactctttaaccaactcccacacctgtgtgaggccaaactcctatataagtctcttattgtataattcatagtggtcctacctctcatacacccttgacaggtgttcagggccaaagtctgaccctaacatgggaagagtaggaccctgatgaaatctcagaaggagacttctaagtggatgacctgagaatcttgaactccttaattttcctgagtcctctggataggcaggatcaacaccttgttagagagaataacttttccttgtttggaaaccaggcagagatcacatagagatggatttcttacaaggtgatacttgttctccttaagctctgtcccatctctcacccctatttcctccagaacaatagctagacacaatctcagcatagcctaatcagggatgtttttcttattctgggagtaaatactcaagcacgtaatcccaggacctggctaatatgtaccagtaggaacagaaggaacatttagggaggtggatcttgcaggtcttgcctggagtgggctggcggaataataaggatgaataagggagaatttattaacatgggaacgctattcgtaactcaggatttgacatcctaataacttggtcctaggatacactggtgggatggtttcttgaagcttggacatgagtatgacctatagtacattagataaatatgcaagaacttctttggcagagtatattgagatcagaactcacagagaagagagagttttagaatggatttactatatgagactggagaacacactatctgaccatacttcttaggaaggtccaaagaaaacacttcattcaccaaggtaattaagaatgcactggtgaggggacacaggctggagttgataggagatgcttccatggagctatgttccctagtatccatagcaatgataggattttgg

SEQ ID NO: 77499 - DNA, 1006 bp, Homo sapiens
cttctagcagcccactaaacacaaaacatttggatagtccacaggcaccttagactctgaggttaataatactttttcttccagctttccatgttttattttttaatttaattcaatttaatttaatttaagaggcggactttcgctcttgttgcccaggctggagtgcagtggcatgatctcggctcactggaacctccacctctcgggttcaagcgattctccggcctcagcctcccaagtagctgggattacaggcatgcgccaccacacccactaatttttgtatttttagtaaagatggggtttctccatattggttctaggctggtctcaaactctcgacctcaagtgatctgcccgcctcagcctcccaaagtgttgggattacaggcgtgagccacctcacctggccccatgttttatttagtggcatgccattcactattctgccaggactctagttagaaacatccagacttcttcctctctctcacattctccccacccaccaacttactctcctagttgtgtcagttataactctgaaatattaatacctcctttatttgtttcttgctcatcattgccattaccatagtctaagttcagtgtctaatctaatgataatagctatcatttatttagctttatgtgtcaggcctcttccaagattttgcctatcttacttaattttcacagcacacctatgtgatgggtactgtatttgacacctgtggtgcgcaacctcatccttctatctgccttactctggagtcaagctgtggctgtgggctgtgacaaacagttctgtttgggcttcagctcacttcaaggtgatggcacctggttttaagcacatattgctgcacattgtttactttccgtcccaggcttttgactcctccaaggcttagttctctggtgggaactggctcaggaagcataaatgtgcatctcagaaacataaggaccttgatgtcccactggggcaaccttcaactaa

SEQ ID NO: 77500 - DNA, 1041 bp, Homo sapiens
gttttcttattgactcagctttcatactggctcaatcatgtaattccaaaatcggttggatatgtaaacactgccgttttatacaccagaagtacagtaagtcttcaaggtaagtgacctgacaataagagcaaagtgggcagcattgttttaaagtacacagatattaaatataacttggttctgcctccagcagaatgctgtccagagacacggtttgaggcccaaccacaaatctaaacagcttcagaatagcttagcacctggcagttaaaaggacttgaatgtgctagctatttagcttatttttaagttcttatgtatgccctagacttgggctaattggaccctgtagacaggagttaaagattttagatttcagagttatgtatgtgttgtcaatactatactgggcaaccactaaattagagcttatctggtaaattgctttataaataatttatttccgcctgacaaaaagaaaaaaataatctcaaatagcagaaaaagatttttttctctctgcatacaattgtcaccttttgactgaagctaaattagtctaagaagcttatgttttgtgatgttgagtaaaaaagacaagggaaatgaaaaaaagttgttgtcccagtaaatgagagactaaatacatatttcctagttggcatattgaaagcgaatccaagcctattaaataaggatgattgagtcagattgtgctttgcacctgtttttgaaatcttctgcttcctcagagactttactccatgttgttctccccttttcctgatcctcaggttctccttcccacaaacacatttgagtctttttgtaaaaagaaaaaagaaaaaaaaaattctctgtcgccctctagttatttctattatccctccttccactagtttttgcaagagcagttgataccagctgtttctacttctttatgccccattcactggatctgctggaagatcaagcttccatctcaagcactccactgaaactgctttcactaaagttactaatgtctccctgttccta

SEQ ID NO: 77501 - DNA, 1023 bp, Homo sapiens
gtataggaaaactgagtcttagtgtgctcaccggcttgttcagggttactcaagaagtaagtagaagaatcggttgtgaaactgaagcagtttggccacaaggcccatctaaagcactgtgcttagtgggatcagtaggatatgggtcaggagcttgtaaaagaggtctgggttgcagattaaaatcctagcatcattgaccattagatgacatttaaagccaaggtagtaggttagatcatcttaggagagattttagagtggagaggaagaagactcagaattgagtcctgaaaaactcccaaaattaaaggaatcgatagaaaaagagttgctaagaaatgatacagaggaggaacagccagaagaaaaaccaggagaaaacctaggaaagttgtggtgtttggaagctaaggagaaaagatgctttagggggtggcaggggatcaatttgactgactacctaatggcctcatcaagaacaattttggtggagatttggtgggagaagccggattggaatggattgaggagtgaatgcaggtgaagataacttttgagagacttggttctggaggatattaaagagagggacttagccagagagctatatggggttcaggaagggtttatttgttgtgtccttgttttaagatgagtgatggtagagcgtgcttaagtattactaggctggacctagcctagtactacagtttcatagctattaaaactgtacaagatgggatagacgatggtgtcatggtcctgagaagggggatgggatgttgtgcacctggggggttaggaggtccgataaaagacttgcttttattatttaatgggaaggaagaggtagaggatacaggtccatttgcagatttggtggcaggaagatatgggagttttgagtttcgagcatgattctttttcttctcaaattatgaagaaaaggcaattctttatccaaaaagagaaaaatagcatcattgttttttaaaaattgtgattctggtcttcaaaaaa

SEQ ID NO: 77502 - DNA, 1365 bp, Homo sapiens
agttaagaaatacacagttctgtgagagaacccaaaagggatgatggcaagcttctgggaagcagtcgtgttgaagctgaggccctggttgttgtggggtgaagagcggggaaacaaagcctttctatcaaaggaagcaacacagatggtcttccaacacaatgggaaatggcttggcacactggagttactggaaggaaggtgtctggcttgagtgtgacattcaagcaggagagtcacaggaaatggggctgagaagggagccagggccatttcatgcaggggtttctagagtttagacattgagtgtcatgtgaagccattgaaagatttccagttgaagaatgatgagattagttttgctttgtaacaagatgactcctatttctgtgaggagagtgggtatagagattatatgaagggaaaccaggtaggaaactactgtggaaattcaaatggaatataaaggtttagaataggtaacaattgagattaacaattgtgaatgtgtttgagattcacttaggaaataagaatcagcaaaggccaggcgcggtggctcatgcctgcaatcccagcactttgggaggccaaggcaggcagatcacctgaggtcagagattcgagaccagcctggccaacacggcgaaaccccatctctactaaaaatacaaaaattagccaggcatgatggcaggtgcctgtaatcccagttactcaggaggctgagtgggagaattgcttgaacctgggacacagaggttgcagtgagccaagatcacgccgttgattgcactccagcctgggtgactgagcaagactccatctcaaaaaaaaaaaaaaaaaagaatcagcagaacttggtattgtattgacatggggttttgtggctggaacaaatgtgtgtttgaagatgctgtttattgaaatgatgtaattattttctattgctgcataacaaattaccacaaatgtagtggcttgtaatagcatccatttattagctctcagtttagtagattataaatccttatgagacctaaattattgtgttagccagactgagttcttgtctggaggctgtgggtaaaaatctacttccaaactcatttttgttggtagaattcagttcctgtatttgttccccaaggttccagtttccttgctggctgttagctgggggttatcttcattcttctcatttgtctcttccacctttttttttcttttttttttttttgacacgtctcgctctgttgcccaggctggagtgcaatggtgcggtctcggctcactgcaacctctgcctcctgagttcaagcgattctcctgcctcagcttcccgagtagctgggattacaggtg

SEQ ID NO: 77503 - DNA, 1062 bp, Homo sapiens
tgtaagagggagacaggagggccagagtcagagaaggtgatgtgaagatgaagcagagaaaaagaggaggagatatgaggaaacagatcagtgatgccattgctggaagggaggccatgagctaaggaatgcagacagcctctagaagcaggggaacagattttcacctagaatatccaaaaggaacacatctctgctgtcaccttgattttagctccatgagatccagtttcagacttttgatctccagaactataagaaaacgaatttgtggtgttagtaagccgtgaggtttatgttaattttctaccgcagttacaggaaactaatacaacttactaagattggattaaccaggagataattttgccccaagatatgggtgactaagggtgataacagaatgtgaagcagtcagttatttaaacaactgttttgccagaaaatggtaacacgtgtcattctttgtagaagtagaatggtgtcttctctaatgaatctgcagggagacattcctttctgatcttagcaccaaggctagctgtgctgcttttgaccagctgttctgtttttcataggagtgctctgaagtgggtggctgagcagacctcttaccaagttggtggttagaaagtgtcaaatctcaggcctacaccacttagaagtatggtttggcatgcatattgagtcttatcctggcagtgttttgtgcccttgttctttcttcttattttcttatggtttaattaatgctggtaatttgccttacatcttttctggaccaaggcaaggattaggtaaacatataattaaataagtacatttatatataaacataagtagtagggaaaatatgggaagatatttgactttatgtccagtgttttgcttcttcttcttttttttttttttttggagacagggtcttgttctgttgcccaggctgtagtgcagtgatgtgatcacagctcactacagcctcaatgacctcctgagctcaagtgatccacctgcctcggcctcccagagaagtgctgcgattacaggcgtaagccaccatgc

SEQ ID NO: 77504 - DNA, 1030 bp, Homo sapiens
tactgagattacgggtgtgagccaacctgcccggcaaaattaatccatttgtagcatgcatcagtacttcattttgttgttgttgttgataaattgtgttccattgtatagatataccaagttttgtttatgcattcaccacttgtttgaaatttgggttgtttccaccttttggctattgtaaataatgctgctttgcacatttgtggacaagtttttgtgtggacctatgtttatttctcttgggtatgtaacagcagtaaaactgctggatcacttgttaaaacaaagctaaacaaagtctgggtttacctttgtaagaaactgccaaactgttgtccagagtggctgtatcattttatattcccatcagcaatttatgaggcctccagttccttcacagcctaaccaacattgtctgtctttttgcttatcatagggagtgtgaagtgattttccatttccctaatgcctaatgacaagcatcttttcatgtgcttattggccatttgtatacctttggagaaatttgattcagatcctttgcccagtttaaaattggctagtttgtctttttttattattgagatatgagagttctttatgtattttaggtacatgtctcttatcaggaatatggatttgcatatattttcctccataaatgagctgtcttttcacttttttgatggtttccttaggagcacaaaagtctttaattaaaaaaaaatttttttttttaaataatagagatgggttcctgctatgttgcccaggctggtctcgaactcctgggcttaagtgattctccctcctcggcctcccaaagtgttgggattgtaggtgtgagccactgtgcctggcctaaaagtctttaattttttttttttttttttctgagacagagtcttgctgtgttgcccaggtggaatgcagtggcatgatcttgcctcactgcaacctctgcctcctgggttccagcaattctcatgcttcagccccctgagtagctaggattacaggcgagtgc

SEQ ID NO: 77505 - DNA, 1028 bp, Homo sapiens
gtccactggaagaactgggttgcatcaggaaccattggaagcagaaacttagcattgtctgtattttgtccaccttgaatctctgcttgtcactatgtgatggctttattcttccccactactgtgccacttttcccacatgggaaagatcatgctgttgatagactgcaagttttacatcctacagcttccactactgaaaagacaccgccgccttctcagcttcagttataaagatctcagggaaggacttttttggcctgcctttggtgaggtatccacttttggatcattcacctaaagccaggggatgggatcatgtttttgtaacatggcagcaatttctgtaaacatggatagggataaaactaaactctaagaagaggaggagttgctgggaagacatttacttagatgcctgttattaggagagagagcctaacattgaggagaaggtcgaggaagtttatgtattgtggtgtaacaaattattccaaaccttagtggcttaaacaacatgatttgtgtgggtcaggaatttaggagtggcttagcttattggttcttttttttaatcctaagtgaattaacacaggaagcttcttgattctaactcagggaccctcatgaagttgaagtcaaggtgttggccaggactgcagtcacctgaagacttgtctgggtctagtgattccccttccgagatggcttactcacatgttggcaggttccttgccatgtgggcctctccatagcgtggcttgagcattctcatgacaggcagctggtttccccaaaaacaagtgatctgagagacagcgaggtggaacctaccatgccatgtcttttgttgttgttttgtttttttggagacggaatctatccaggctggagtgcagtggtgcgatcatggctcactataatttcaaactcctaggctcaagagatcctcctgcctcagcctcctgagtaactctgggactacgggcatgcaccaccacacctggctaatttattatttttttgta

SEQ ID NO: 77506 - DNA, 1096 bp, Homo sapiens
caaacgttccaatcatccctccccgcctctttcggcagtagccaatcagagaccccgagcgcctcctgactactagacactgtttactaacagatcgaagctggggaataaggggtgtgaccgttctggggaggtcagggaagggaaggtcttgactgcgagtgcgcaccagaggaaatgggcggggcagagctttgggtctcaccaatcggagtggcggcgctcctccctctcctgcctccccgccaagcaacaacaattcgaggagcgaggcggggaggctcgtgaaacgtcacagcgtactgcccaatgggaaccggcgttggcagacgcgcgcgccctgtgtccaatcagcgaaggcggctcgaatggctcccttaccttgctggctgtgggcggagcggcctgaggaggcggcggtggagcagggggcggtttggttgcgcggtactagcggtgcccgccgaagggggaggaggcgaggagcgagccgtgcggccagagcgggaaagagactcgtctttgcgtccgagttctggagccgccgcaccccgactcctggggccgcggcagcggctgcgaggggacgggcgtccgctgtctcctgggttcccctcgtagcgacccgcgggatcggaaaaaaaggagaagatggaggaggagggtggcagcagcggcggcgccgcggggaccagcgcggacggcggcgacggaggagagcagctcctcactgtcaagcacgagctgcggactggtgagcgaccccgccctctgccggccgggcccggcgcgggggcgcgcctgagggcacgcgggtgcccgcgcggggctgggggcgcggggccgcagccgtgggcgcggaggggcgggcctggggcggggcgtcgcggtcggggcgcgtgccccgggggtcccgggaggtgggggcgcgccttgggggaggcggccgaaagttttccccagcccgggaatgagcggcgggcaccaggcatcggggccagcgcagccgccgaccgctgcccgtggcacgcacctccgaggatgtcgctgctcccccttcccgcacaggtgacacacgtgtgtctgcgtcctgtca

SEQ ID NO: 77507 - DNA, 1065 bp, Homo sapiens
gaaatcaacttacatttacattaaaacagtacataaataaaggaaagagaaggcaataaccctcagactttggtctcctggctaaaatgtatttgcaaaacagcacacagcttgcacctgctgccctctagggtaataatgagggtgggtggaggtacctgtggggtggcccattccagtgggtttgggcaaatgaggacggttatcagaggagtggctgctattccccacaaggttatggaaagcttctctctttggcctttgctgtgtgccaggcagaggtgctaggtcctctctgcagtgtgcagtgaccctggggaaccacagacattcaggaccctggctggtagctcagttgcttggctaaggtggtcaggcttgccaggcccaggcgttaggcaagcccaggcctgacctgccaaagcagctgctttaagcctcagaatcttcactgggcaatggaatcctacctcacctgactcctcccagcaccccctcccactagcctgcggggactaagtgttctctcccctgtgtccccacagcactttgttcccacagctattaaagtactcactgttggctctaagtacatctctcctccttccaaagcaatattctttttgttttgtttgctagagatttcatgtaatctcaaattctttgttaaaatggccctggggtttacattattttctatctaggagattagagttgaaaacataaattggtggtttggaattccactgagttcttctctttagatagaattgtggaaagtcaggcttgtccagaaccctcactatgggcactgtccttgaatcctgctctcattcattctgcagtcagctagtcatccaacaaacacttactgaactcccacctttgtgccactatgctaggcactgggtatatttggatgaaaaggaccttggctatgctttagagaccaacacaatgtggttatctagctctagattttgttgacatactaaaacctatctttttttttttttttttgagacaggtctcactctgttgcccaggctggagtgcagtggcgtg

SEQ ID NO: 77508 - DNA, 1032 bp, Homo sapiens
tgcaagctccgcctcccagatttgggttcatgccattctcctgcctcagcttcccagtagctgggactacaggcgcccgccaccatgcccagctaattttttgtatttttagtagagacggggtttcaccgtgttagccaggatggtctccatctcctgacctcgtgatccgctcaccttggcctcccaaagtgctggagttacaggtgtgagccaccgcaccaggcccaacaaagcactcttaaacttagtggcttaaaaccattaatctcacaattctgcaatcaaggttggtcttagcagggcgcttcttctgttccatgtggtgtctgttggggatagaccatccaagatggcttcttcctgacatgtctggcatccagtgggacatctgagactggctgaacatttcttctccatgaagcctcttcaatagtggtcgccaaacttctttacatgggacgccatgagacagattccaagagaataagtcctaatgcccaaacgcataccaagcttctgcttgcatcacacttactaatgtcccattggcgaaagcaaatcacagggccaaggccagagtcaatagggaaggggctacaatggggtgtgaatactggggagcatagtttatataaattggtgcaaaagtaattgcgatttttgccatttttttttttttttttttaaataaaagtaatggcaaaaactgcaattacttttgcactacctaatatatacagagagagccaccaaggtattagtctacagcaacctgttatatacgagcagcgaacaccagcttaaccccaggttgacgactgcttgctaggaccctgggaggcaacagagcagagcagccagggtcttggagcctggagggagacagcctgagtatgagtcccagcttcgctctttactagcaaactgtgacctttctaagcctcacctacacaatgaaagtagcagcagaaccttcccagtgggactgtcgggaggggcacctgagctgttccccgctgccgtgaaatg

SEQ ID NO: 77509 - DNA, 1048 bp, Homo sapiens
tgggtggatcacaagatcaggagttcaagaccaacctggccaatatggtgaaaccccgtcccttctaaaaatataaaaattagctgggcatggtggcacacacctgtagtcccagctgctcaggaggctgaggcaggagaatcgcttgaacccaggaggcagaggttgcagtgagccgagatcgcaccactacactccagcctgggcaacagagcaagactttgtctcaaaaaataataataataaataaataaatacaaataaagaaaattcagcttgttcctttcctctcctctcctgctgagctttttattcagtagttcttggctggggccaaagaatttgtgtttctagcaagctcccagatgatactggtgctacgggaccgtggaccagtcctgcagatagttctgcttcctagaggcaggctgacagacacatgacttttccaactccatgatggaatcttgttttgctgttctaggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggtaacaaaccccagccagccgctcgcctggaagcagcttttaccctggatgagcagcaggcctgaggtcccaagccgtaagccgagggctggcaccctgctgcccctcaaaagccagaggcagagccagccttgaagcagaggtctcctggattgggtgccctttaagctactcgcagttctgaatcgtgtggcaggcctgatccaagtgaccattttccttctagtttgactttgggtgagttgcttagcttctctgagcctcattttcttcatctgtaaaatgggggtggtcagcattgttgttggaggaaccgaatgcctcacccatggtgggtacttcatactgttagtggtgggcaggtgtcctgtcagccccctccaaggaattcaccacccagcgaggccactaa

SEQ ID NO: 77510 - DNA, 1098 bp, Homo sapiens
cctgcttagctggctcacttgtctttgatccatctcctgcagggtctgtgtggctcattctcccctcaaggtgccaaggtctccagcctgcccttgttatccatggagcatcctatgcactgttcaccaggattacctcccctcaatgttcttggaaatgcccagtgatgctcctatgtcccacaaatccattctggttggcaccaggcccatatctcgccttaaatcaccccatcattccctgcatgtcatctcctatctccctgtaactagcttctgcaggctgcagccacactcaccatggccaccccatggatacaggtgcttcctcaaagcacagtcaaggctaggataaaagaggaaagctgagcaaaactactaaaggtctgagcaggaatcctacagtggaatggacaagcatcaaaactggatcctggaatgcagagctcctgtggtccttgggctgggccctgctaaggggtcttctcccttgcatcagagcccctgatgttggaccacaggcctgcctctccctgtagcggggtcaggggtttggatgtgtcactgagtctaggacccttattctcagctttctctgggctcaacctggtgtcagcctctttaccaaacaactgaaatcctctccccatgaatttctgcccacagtgaagacaacccattacatggttatgcctcagactcctccatgccagaagagaaccctgctgttactactgcaaaaccaaagacccatttgtgtcttcccccaaaacatgagtcagaagcgtgctggcagctttaccatggtgagggcttctctcttctagccatcaagattgcagaaacgtcggggtacaatctcaatcagaggccctcgctacatggaactctgcagtcccaaatcagggacaaaaatcctaattggaggacatgtggtcagggaggctgcagagctgaggtggcttcactgagccgtgagatgccgcagatccccatgtggctgagttctcaggatgctggaggtgtcagccctgctgccgcaccagcactgagcacagcccctgcctgtgggaactcccctagaatgacaaagggaga

SEQ ID NO: 77511 - DNA, 1499 bp, Homo sapiens
gtaacgtgttttctgtgtctgccgcttccagcagctgatatctttggaacaaataatccacgtcagcatggggaccaattaggatgcaatgacaaactgacttcccccaaagcagacactactccagtatgtcccagtagaacactcatttgcaatgtgttgagctccgttaagcacacacacactcacacaacaggcttacgaggctcaggcctggcgggtcagaaagcccactccctctcccaaggccactggatcccaggagaagcccagactggcgatactacaaaggtctccagggcctggcagaccccagagtcaggcctgctgttaaaaagtgagagtgctgctgttccattcctggggtcccaagcacttccctttaccccaggacccagggcagcctgcagggcagctggcggtggccttggccatttgcccccagcctccagctggctcctgagctctgcaccagggggtttggggaccacacaggcacctgccttcctagatttccctggctcacttttctgcaaacactggatctgccaggcctggggattggggggcaggaaagaggcccccatccagccccctccaggccagtgtgcacagtgcaccgaggggtcatccgcacagagcgaggtgcaagctcgatgtgtaacctggctgcggcacccgacatccccggtctcggggtgttgatttatttctgaataactttttgggtatagaaaccaattttttttaatatatgacatgtatatgtacacactcatgtgaaatatgtatactttggggggatctatttatgttccagtgggagtcactctcttctgtcgggaatcttatctgctgctttgtgtctttggtcagattcctgacaatttagtttcctgttgtaaaggtgcttttcctggggtgaactaaacctattgattttttttttttaagatttttttttccttttgatttaatatactgagaaagaaatgggagacttttgaatgttaacaagatccattttaggagtgtttggggttgtgtattaaatagccattcattctggaactcaaggacaggactgtaataaaatggaatggaaccgaagtgcgttctggctttcctcactgcacattgttagcatcgggtgggcccctggggacttggggctccctgcgcccctccttatgcacccctccctctgctccccttcctctgtgcccctgcacccctccctctgcgcccctccacccctccctctgcgcccctccctgtgcccctccctctgcacccctacccctgcgcccctccacccccctgcgcccctccacccccctgcgcccctccaccccccctctgcgcccctccctctgcacccctccctctgcaccgctccctctgtgcccctccctctgcgcccctccacccctccctctgcgcccctccctctgcgcccctccacccctccctctgtgcccctccctctgcacccctcc

SEQ ID NO: 77512 - DNA, 6714 bp, Homo sapiens
tggatttctgtcacaatgcacatggctctaccatccccagccctgtgccaaactgagaattaagttctagctcctgagccccaaatatgattaccatggtcatgagcgtcattgtcctgaaccccacgtgagtggcctagcttcccagactggggaagaacatcccagcccatgttagggaaccagggacccactgggggtgtgtgggagggctggctatgtcctaaacatctacttctaaccaggaagaaccactggattggagccaaagccttagtcaaactcatcaaaccaaagaaagagggttcgagggaacgcttaaaatccaccgtggacagccctccctggcagctggagtcctcagaccccgcctcgccggcggcctctcagccgctcagatcacaggccgagaaccccgacacccccgcactgggctccaactgtgcagaagagcgcgacgcccacaacgggtctgtggggaaaggtaggggcggccgtcctggccgtggtcgggtgaggaagggggtgtcctgaagggtcccgcaccggtggctgtgcacacgtgtgcaggaacgtgccaggggtgggtgactgcatgtgcgccttcgcttagatgtgttacgagccaagtagaaattcagcgtggcgaccgttttgtcccataatgcttttgttactttattttatattttattttaatttttttgagatggagtttcactcttgttgcccaggctagagtgcagcctggctgcctcccaggttcaagtgattctcctgcctcagcctcctacgtagctgggattataggcgcccaccaccacgcctggctaattttttgtatttttagtagagacggggtttcaccatgttggccaggctggtctcgaactcctaacgtcaagtgatccacccgcctcagcctcccaaactgttggattacaggcgtgagctgccacgcccaaccacttttgttgttttagaacaaaaggtatcattcatcatgtagccgggcagatatctcaatatccaaagctgacattcgtgcaggtaccatagagacaagcgacatagcttattttgggctgcctcgtatgtgccagatttgtagaaagctgctttgtgcagggagatcccaggtgcactcaacacgttctccatgtatataagacctcccgaaagccttgggtggtttatctgttaccactttgaaaggtgggttaggacttcttcagcctgatctggccttgtgtcccaccagccacaggacacactgtgccttttccctaagggctgtcctttggagtttgccagaggttctgaaacaagaacaggatttctcatcatgtatgctgtatttcatcaactctcaggagccatgaaagctgcacagttactttatataccacgaggcaatcaaacggtacagggccaccacttcgaatttttcttacgctcttgttgaaagagcttttctaaataagaattcgatttttgtacacacacgtaaaaggaaaataggaccaagatgagttggttatgaccatgtcagttttgtcaccgtggccacctggccagtggtgactgagacatcactgaaattgcctcctaatttccaagacgttaaaggtgtcttagaatcgattagacacagcatttaccttacacattgttaaattttcagctttacctttaaatatcattttggggagattatttatcccaggcctgcatcccaagtcatttaaatttttacaaaggacactaggactttctgaagacccagcctatgcctgagacccatggggtcttggaggcggaggatataacactgaagaccagcgacaggctaccctctgagtgtggtgtgtgcacaagcctttcagggggcacattcacaagtacctgttgtgtccccttcagatgcaaaaaaaaaaaaaaaaaaaaaaaaagacctggtgcagtggctcatgcctataatcccagcactttgaggggccaagacaggaggatcacttgaggccaggagtttgggactagcctgggcaacacagggaaacccccatctaccaatatatatatttttatttagccaggtgtggtggcacgtacctgtagtctcagctgctcagtcgacttgagcccaggaggtcgtggctgcagcgagctatggtcataccactgtactccagcctgggtgacagagtgacaccccatctctaacaaaaataatgttcacgcacattgttcagggactaacacactgtcattctttatggggataagattagatagagtcagcaccgtaagacagggtgagaaggaaaaaaattagaggcctcacatgcaagtaaatgagaagcttaactttttttaagctagaggggttctgttgcctcaggtttttatattggctcctgtttaatttttggacatttgtcatctcaacttgtattactctttaagtggaattaattaactataatcagtctgagttaggaaaactttcagagaaaaaaatgcttgactggtccaaagtgatccgtgagcaagcaggtctgtaaaccatgatcatgttcactagcagccaccatgtcttgggtgctccctctgggcccagcaccctctaactactttatgtgctttatgcatctcattgaatcctaacgaccctatcaaggcaggtggacgtggcctcccctgtgtagaggtgagaaagtgaggctcagcagtgtaaaacatttgctttgggtaagtgggacccaaatgcaggtcggccgcactccggagcctgagctcttaactgcatgcacttaactgcatggactgcctccagttaaagctctctgggtccctgaagatgccgaacaagagcctagccctgaactggccacaaggacaccagccttgaataagttggtcccttattctgtggtgtgagccactgtggccaccaggtggtgctgtggaggaagaaataatggaaatcctggtatcaactttaatcctacatcagaaattggttaggtcgattaatgttactataagacagtttaggaagttagcccaattgtctgctttgttaagacactagaggctaaggagtggaggattggagtggaggatgtatatagaagatctaaaaggaaatcatgattcttggtgttgaagggttttttttagtatgcaaaggaggtatttaaattattttaaaactcatcctgccgaaagattattttagagatacagaatcattagtgaatacttcaggtagagtatttgattacagcgccctgaaacggatcattgaatgttcccaaggtctttgagtgggaacgggaggattgtgtgagctgagctgttagggaccccatcattaaaatggatgagtaagagaagttgggccctaaattaataagcattagtgtttaataatttggcacactgaaaccgaaaaatcatccagaccattggctccttgggcagtatgtaattctcctcacacgctgaggaaataaattgttggcgttcaggtgcctttaaattaattgagtcagagcacagatgattactgagccctgattctgttcttgagtactgtgtactgttttcatctttcctgggcaagacgggattctgatttcttaagtacatttagctaatttcgattcatttgtcattattgttcatttcatttatttgtgttttctttttccttcctcctttgggttatccgattgataacaatttagcacctccgcgcaaaaagagtccctttttgaaaagcaaaaacaaggacaaagacaagtctccaacgacccacccagctctctctaaacgcctgcggttctggtcttcctccgacatcccatcctctcctaacgagcctctctctttctccgacattggagatttctaatccctttcctttatcatgtgtctgtattgtgtaccctccttcatttccgaaattcaaacaaacaaaaaaagccagcgtctaaaaggccagatggccgatagcggacccctcctcctgcccccaatttcaagcttaaagtagccagcgtggattctgatttcaaaatagaagatgagttgtcacactccctggaccatttcttcagcacaacacagttttagggggagcctcaggatatacgtgcacatgtccttgggccaggatgtccgtactaagtaagtcgagtggccgtgcccccctcccgtctcttgcacctgcgagcttatgttttgcccgtgtgtcaagcagcactggcgggtggttgctgcacttcctaaaatgtacagcctctgtcaagtgagggttttttttaagacttatttttaagcagctaaatttaaaactgctgcccttttctcctcttcctttgtcagagcactgagttgtgggccttttccggtaaggcccttataaaatgtgttctgttttgaaggattgattgctccattcaggcattttgactaattggattgattttgcccagacagagttcagcccagagtgaagttttatgactgtgctgtggttttatgacatcttggatgctgaagttaaaacagcaggagacagaaagaacatcagcacacaaatcatgcctcgagcaagggaaaatgccagccggccagctaggccattacctatggagcatttcctgtctctagccatccctgtaccacctccgttatttttgtcatatcctgataccgtctatgattacctacaaaaatatgattacctgcatgttttcccttacattgattcacagtttgtagttaaatgtattaaaaggaaagattagtatcagtcctgtaagtggaaaacacacatatcatcataaaaacaaggtaatcataagaataaacacataattactaaaatatgagagtcggttaatgtgccactgacttcatctcatgagcctcgctctgggaaccctgggctgccgtggtgccgggtcctccagacctgccttccgcgcatgctgttggaattgtgctttctctgttcgctgctcatgctaactgttcactcatctctgcctcccctgtggatcctcattttagcttcacctgtaggatgacctgtcccgattcattccacctgtcccgattcaggcagacttgaatcttgcttctcatcaaggttatctttcaaaatccaaatttccccttgatttcaaatcatcagctctgggcacttaaaactgcacagtgagcccagactttgagtggctgggagggcagacggcttgatgggtggagaagccgaactgcaacagtgagtcctggctctgcacacggagtgggacgctctgcaaagtgctttgtcagctcttaggaatgccagccatgttcatttttatcttgtgttgggagagcctgtcctctttcctgtggggtacttggttttatgggctgtttttcttttatgattttatatgtttttatttaattttgaccagagtttatgttcatggtagaaaagttagagatttcagaaaagcacaagacacaaggtaaaaattttcttgcagttcgtctcaccatgcagagattaaggcttccctttttgaaaaaacagaatattgtgaggttagcaataaacttctatttgaagtccttagtgagtcaggttagcaggaccttcggatcctcagctacaggcttggatccttggaagtcagggattggagttccggacagtgttacacaggagatgtgtcctagagtgaatatgtgtgacttttaccaacagtttatcccctcaggggctccctttgtctcctcccagcctctcagggctggcagtatgaccccagcattaaagccagagccatcctcatggggcctctgacaccacctgaagccaagccctcttgcccccacctgccccgccaggccccatttaagttgcagcccgagagctgtggcagccccgcttttgtctctgtggtcctcatgccctgctgccctgcttctaggccatggtgtggtttcccagcctgggtacaggacttggcagcctcatttctcaatgtcctcttctgcctcaggccctggggatctaaaaccaaagcgaggctccccacacagaggcagccttgaccgcacagatgcctccaccgatctggccatgaggtcctggccctcggagctgggctcccggacttgctcaacttcagccaccactacagccccttccaactccacccccatcgcccggcacccaggccgcaccaaaggtgagtcacaggcccttccagagccatgagcgtcgggcctagtgtccttcctgaagaccccaggctctcggaaatcagagaggttgctctccctctcagtctgagaggtggtgagtagaggggtgaggctgctgacaggctttggtggcacagatgcagctgtgcttaccagccaaggactttgggcaggaagcccttcagaggcccaactgcaatggggcctcagaacccactgccaccaccggcattcaggaaatgaaggcaccaaatagctccagaagggaggtgaaggtgggctgagaaccagagtttgggctaaaaccaggcaactgccattgccctaccttggtaaaagtttggggtttttttctcgagagaagataaattatatattttaaattagtgtgtgtatgtgtattttaaagtttttgtagatatgtggtctcatcatgtt

SEQ ID NO: 77513 - DNA, 1011 bp, Homo sapiens
aggagagtcgcttgaacccaggaggcggaggttgcagtgagccgaggtcatgccactccactccagcctgggcaacaagagcaaaactccatctcaaaacaaacaaacgaaaacattattgatgagatttttcgtattctttttatttgtactaagccttcaaaatctgctgcgtattttgcacttgtgcatcatgattcagactagctgcattttactgctcagtagccatgttgccagggacatctggattaaacaatgcagctgcagagggaactcagccattcccacgttattggccgtttggccctttccaagtttccactggcgtagattatgctgcgttgaacatctttgtgcagtggccttcttcctttgggagctaggttcccagcagtgggaacaccgggtcacatggtgtctgagacgctgttggtctgtgttctagctgctctcccgtctcaaggggaacttggaggaagaaaatcatcacctcctgagccagatccagctgttgagccagcagaaccagatgcttctggagcagaacatggagaacaaggagcagtaccatgaggagcagaagcagtacatgtaagcagggagtccctgaacccctctccgcaccctcaccacagctgcacatcctcagtctctggaggtcctggcttcccatgcagagaggagcccctgggcccgttgggatcctgagggcagggcacagaccgatcaccagcacggactgcccttagtttcctggaatgttctcagtttctagagttctcagttggcttttgtttgctctttcagaggcgctttccaccaccagaaacttcttttctctgcttctagaattaaattcacttgaaaaaatcatgagaacactgaagtatctcaagggggagaattcaaactgaaggctgggaatgagtgctgtacacctgcctgtgtccccctggatggagggaagtgggcttgttgggccctgtgaggtgcacagaaccagttccc

SEQ ID NO: 77514 - DNA, 1354 bp, Homo sapiens
cgggtgcagtggctcgcgcctgtaatcccagcactttggaagaccaaggtagaaagattgcttgaggccaggagttcaagaccaacctggaaatatagcaagaccccatctctacaaaaaatttaaaaattagccaggtgtgctggtgcacacctgtaattccagctactgaggaggctgaggtggaggatcacctgagccaggagttcaaggctgcagtgagctgtgatcacaccactgcacttcagcctaggcaaccaagcaagacgctgtctctaaaaaatgaaaagtaaaccagatccagggtttaaaataaaatatttcccctctttacacattttctgtttcaaagtgtctacaaggggcctttaattacttgttgctttgttgaaaagtcagccatattatcagaaatcaaacatactacttaaaggtcaacataagtggcatttcaaatacatgacttagagaagtggcatattagatccatcctgacatgtagccacctggtctggttgttttcagcaccaggagggctggacaagtgcattcattggctttcctcgggaagagcatccctggggttcagagtcccctcgctccacacggaggcagccgtggcccgggaggacagttgctcacacccgggcgggactggcgcctggccttcctgcgtgttttgctgagctcctatccagtgctctctccccatcattccaggacctggtgctcgagaagctgaagagccagcagctcagcagtgagctggacaagctgagccaggaactggagaaggtcggcctcaacagggagctgctgttgcaggaggacgacagcggcagtgacacgtgagggcctcttctccctctccccatcgtgggagcacttcctccactgttcagtctgcaggctcctcaccctcccctgagacctccatgaactctctactgccgagggctgtgacctcacgcggttccttgaacccaaagttccttggtcgtttctgttccagctcttgttccttgaggttctcagataggtgtggaaggagattttgtctgatgaaaaagcttcttaatttttttttttttttttttgagacagggtctggctctgttgtccaggctggagtgtagtattatgatttcggcttacctccatgtccacctcccgggttcaagcgatcctccagccctagctggagaccactacctagctgggaccacaggcatgcaccgccacacctggctaatccttgtatgttttgtatagagggggtttcgccatattagccaggctggtcttgaactcctgagctcaaagcgatctgcccacctcagcctcccaaaatgct

SEQ ID NO: 77515 - DNA, 1930 bp, Homo sapiens
ctccaggcagagggatcagcatgtgcaaagtgttcacagtcagctgggctaggagcagtgagcaggaggtggagagtagtgtaagcagaggctgcagaggtgggcagggcccggctaccagagaccaagagaaaccgctgaaacttaagtgagggagagagatgtatttacattttaaaatcatcctggctgctctgagtgtattctgacttgaaccatctaagtggtggtgtctgtgcccactcacctgtgtctgtcaagcctctggggaacgcacaggcagtgtctgagcacaggtaggacagccgttcaaggccttctctctcccatccccagtgtgagcccatgtcactgaaataggttcctgcagcagcctgggttgtgcctgttgtgttttcccgtagatcaaggaccttgagcaggaaaaggaccacctcaaccgagccatgtggtcgctgcgggagaggtcgcaggtcagcagtgaggcccgcatgaaagacgtggagaaggagaacaaagccctccaccagacggtgacggaggccaatggcaagctcagccagttggagtttgagaagcggcagctgcacagggacttggagcaggccaaggagaagggggagcgggcagagaagctggagagggagctacagcgactccaggaggagaacgggaggctggccaggaaggtgacctccctggagacagccaccgagaaagtcgaggccctggagcatgagagccagggcctgcagctggagaaccggactctgaggaagtctctggacaccttgcagaacgtgtccctgcagcttgagggcctggagcgtgacaacaagcagctggacgcagagaacctggagctgcgcaggctggtggagaccatgcgcttcaccagcaccaagctggcacagatggagagggagaaccagcagctggagcgtgagaaggaggagctgaggaagaacgtggatctgctcaaggcgctgggcaagaagtcagagcgcctggagctcagctaccagagcgtgagcgctgagaacctccggctgcagcagagcctggagagcagcagccacaagacgcagaccttggagagtgagctgggcgagctggaggctgagcgccaggcgctgcggcgggacctggaggccctccggctggccaatgcacagttggagggggccgagaaggacaggaaggccctggagcaggaggtggcccagctcgagaaggataagaagctgctggagaaggaggccaagcggctgtggcagcaggtggagctcaaggatgcagtcttggacgatagcactgccaaactgtccgccgttgagaaggagagccgcgcgctggacaaggagctggcccgctgcagggacgcagccggcaagctgaaggagctggagaaggacaaccgggacctcaccaagcaagtcaccgtgcatgcaaggacactgacaactctgagggaggtgagcaaacacaggcggcgcctgtaaggggattggcagatggtggtagtgggttctgtggtgcatggtttcaggagagaaataagactctgtgtcctccttaaatgctttatctaattctaaacagcaatacctaaaggtctaagaacccagtgaataccacgtattacaatcttacaacccagagataacgcttctcatagtttgagttgtttcgtttcatcattttccctcgtgtgtacagacacatgcttgatgtcatacttacacacaggtgagctgttgtggtttttattaattatgttgtggtttttgttattttagatttcaaagccacaatttcccaatggccgtaagatatttgtttgtttgtttatgtatttatttatttatttttgagacggagtctcactgtcgtccaggctggagtgttgttgcgtgatctcggctcactg

SEQ ID NO: 77516 - DNA, 3499 bp, Homo sapiens
tgtcttggaagaagggtctttgccagtgttgatggtgtggggtgagctgtgatttgttagcctgttaacagctttagaggcctgttagggcttcgctagagccacagagctgcccatcactgcacacttgctttaaagccctgtgcagtatgtcactttgttcagacagcattcagttagggaccccggccgggtctgtcttcataacctaggtagccaggtcagggtacctttgagtggctttccctctcatagcagggccctgtgttgggatgtttctgtgcagctctgtttatttggaagtgagccagtacatcttcatccacagcacatgacggtagctatacaggggctgaggcttgtccagggggatctccagctgtgcagcctcacttcttgcctcttcttgcttgccccaggaccgggacacagataagaaacgaattgaggagctgctggaagaaaacatggtccttgagattgcacagaagcagagcatgaacgaatctgcccaccttggctgggagctggagcagctgtccaagaacgcagacttgtcagacggtaggtagcgcctggtgccggggagccagcctggccgtggccgccgctgcctccagggagctgagtcctgggctctgaatctgccatgttagcccatccattcatcccaggcaaacatgatttccttcaagctccacttggaactgtttcattacagttctccccagggaagacacgaggggtctggcagccttgatgtcaggacgcaaaacacaaattaagtgttgccagttttccgaattcccatatggacattcccgggagcttccagattatagtgcactgacacccagaggctctctgaggccatctgtggatggctgaaagccctggatggcaggagccatcaccagtggccacgaatccctgctataaatgtacccagggcgtcatttcctccattcatttgcataattgggcaagatggaggcagcctgttttctctctcctgggtggggagggtgctgagtggctgctgccccggagacccaggttcttagcgcctctgccaggcctctccctttccctcttccctcctgggcttgctctgctgcccactgccccgcgccccgagaggaggtgtcggtcatgggaagcgtgggcggggccgcactcagccccctgcgcaggaagcctcagccccggcaaacaatgagccagttcctgtgtttgaaaatagcacacgctcaccgttcccgtgcacgtgatcgtgcaagttcatagttacttagactttccagggtgtgatggggcttttggcttgtttagtgggtggctttaaaaaattctgatagacatctaagcattctggaaaggttattggaaacaggtgaatatttcttgcatttgggggttcctatcagttccgaacctaaaaccagtttcactgtgaatctgtgtgagaagttagctgtctgtgctttgatatctgtgcgtagttctggggcctgagggctgcacaagggggttcccccaaatcccttgcctctggaagtccaagttgggggcgccccctggtggagcagagaggtggtacaagcagctaggatggtctctcatcaactaaatatttgttagagaccatggtggctggtgagaaggcctcaccgatttagaccattttctataatgtgtgagctctttaaagttaataccgtgatttattcttagtgttgtcaactcctagtgcctagctaggagctggcatcattctagtgtttgctagaatgatggcatcgtgcaagcaaagcctgagtgtatggggcagtggcttcgagagccagaaagacctggcataaagccttggcttctctgctggttagctgggtgacctagggcaagtacttaacctcttaaaactttagtttccttacctgcaaaataggggtaatgaacctgcctcacaagatgactgtgaggatgagtgagagaaaacagtgaagcaggaaccccggctctggcccttggtgtgttctgtagagggcagctcttcttgtctgtcttactaagacatacccagttactctggttgctggggggtgctgacgagatttgcactagtaaagaaacactgggccgggcaaagtggctcatgcctgtattcccagcactttgggagattaaggcgggcagatcacttgaggtcaggagttcaagaccagcctggccaacatggagaaaccccgcctctactaaaagtacaaaaattagtcaggcgtggtggtgcacacctgtaatcccagctactcaggaggctgaggccggagaatcgcttgaacctgagaggtggaggttgcagcgagccaagatcacaccactgcactccagcctgggtgagagagtgagattctgtctcaaaaaaaaaaaaaaaaaaagagaaacactggcgttttagtagtaaaccattgtgtcgttttaatagtcttcaaggcactgactttaatggaagaggaaatgaaacatcgattccattgtttaactcacagaaccttaaaaattaatctctgtggtcagtttgggaaggtgaaaagggatggtggtgatggttgcagaaaagtgtgcttgtacctaatgccacagatccaaacactttaaaatggctaaaatggtactttttaaatatatttttctgtaattttaaaaatgggttcacccccatgaattctgcagagacactgtccagatgaccacaggttttgaaataatggagtcttatttgaggcttggtgttgaagttaggttagtttcatttacagcttatttgggatggagccctccaagcgtccttgtatgtggagtgtgtgtgtgtttatgtgtgtgtcagtgctgggctggggccaggtacacaccatcccctccacttctcgcctgctgttggtttgggtctttagggcgttctggcctgttgggtggtccatgtcgttatccttggtagaggatgaagactcagagggaaacgagatgctgttcagtctttatgatcacccggggaatctgaaccacacacatttccagatttatgtgtttgctgtgaaagccatcacccccctgtacccacagcccctggggtgaagaggtagggggaggaatcgctgtattagcaacagtgtggaaaggccccaagagatgaggacgtggcactgggttgggtaaatgaaggggggaagaaccgggctcctttcttaagagggcttttgcatacctttttttttcccctccccaaaacaaccccatgacttacctaaaatcatgcacctgcttgtggcaggagggggccaggaactcccattcctgactcaagactcttcccttctccatttgcacctgagctgtttaaaagcagagtagatagtctgccttttactatttttagcttatttttcatctcatttagaattttaaaagtaatttgcatacactatcacagttttcttca

SEQ ID NO: 77517 - DNA, 1027 bp, Homo sapiens
aaggaaatgggctcagggtccccttgtccgtccagatgagattaggcatgtcaaagccttggcactattcccagcctatcttgattcatggatttttttttcttatagcagagaaagtccattgtccttgcccgattaaaaagggtgaagatgggctgggcacagtggctcatgcccgtaatcccagaactttaggaggccgaggcaggtggatcacctgaggtcaggaattcgagaccagcctggataacatgatgaaacctcgtctctactaaagatacaaaaattagccgggcgcgatagcaggcgcctgtaattgcagctacttgggaggctaaggcaggagaattgctgaacctaggaggtggaggttgcagtgagctgagatcgcgccactgcaccccagcctgggcgacagagtgacattccgtctcaaaaaaaaggtgaagatgataaaaaaaaaagtagaggaaaaacttcctgcctcggacttccctctagattgtttgcttgggtccagatgcctgaaagagttttggttttagaattccatcctaatgacccaggtgcctttatctgatggttctcatgtatgtttttgctaaccaggagctgagagaagataatatcattttaattgaaaccaaggccatgctggaggaacagctgactgctgctcgggcccggggcgataaagtccatgagctggaaaaggagaacctgcagctgaaatccaagcttcacgacctggaattggtactgcaggctgtgttgttactacattgaaaacagattgggctcgggcacagtggctcatgcctgtaatcccagcactttgggaggctaaggtgggaggatcccttgagcgcaggagttctaaccctggcaacctagcgaggccccatctctacgaaaactaaataattgggcatggtggtgtgagcctgtagttccatctacttgggagagactgaggcaggagggttgcttgagcctgggaggttgaggctgcagtgagccgtgatca

SEQ ID NO: 77518 - DNA, 1064 bp, Homo sapiens
tatctgtggagctttccccacctgctgggaatgatgtcaggccctaactgcatccatgcactgaagcctcatggtggccctgcaggtttagcagccactggcagttcctcccctcttttcagatgaggaaactgacaattgattaattaataacttgcccagcatggcagttgctaagcagggggacctgggatgggaatgactgtctgcctccagaccttgatgcttgcctgtgaatgacttgatgcttgcctgtgaatgaacgtgagcttcagccttcacaggaaggaagaaataaagggggtgtgggaagtgctgcaagaggggtactcctaggagaggtgaggggctgccactgtctcagaggccgtggaggcctgaggaagggccccagcctccagcagctcacgttagggctgacatgtcacatcatacttaatcagggaatgtcaagattcagggcacttactaaggacaccctgaacacagggaagtcttctgttcccacctggaactttgtgtctcccttgttccttaataactgctgaggagttgtgatgaggttcagcacactaagacgttgaataggacagacctgccgtttggtttaaggtttaagtcccccatgcttctcaaagtgggtgaagtttaaaaacaggcaggtcttcggtgaagttcaagggatgtccatgaagctggatgagcaggtagggttcagagcgggggtgatgtttcctgggtgggtaggatgtctgcctgccctgagtcagctgacccagaccctccccactgaggatgccctgggccagcctcctgctgctatggcccccttagggaaccatacggcatcgtggttgctacagagctccctggcggaagactgcctgtttgtttgattccgcaccccctctggtgctgtgtgctcctcaggggtcaggaggcaccctagaagccagttttttctgttaacatgataggtgctccgtggggagtgctgggggtgctctgtcggtgtgagttggtggtgatggcggctggcgagtttgtaggtctcaggcgctgcg

SEQ ID NO: 77519 - DNA, 1027 bp, Homo sapiens
agtgagacaaacgtgggtttgcagacactgagccgccaacgcaggtgatgaattgggcatggttgattaagtccaggccactgctgagaggagtgagctgtactcccttcggatgcccatagtgtcaggaattagataaatggtggaggacacctgttctcagattggaatagttacaacagcctagcaaaccgtcttcagtcctcataggatgcttagaacaatttgggattccctcccttgtccctcttccagacttgaaacctttccgattgtgagtgactttgccttcttcatgcggtgacattaattgagcagcatggatatagtcatggaagagacagctggacccacagggcttagcctctggggagggaagcaggcaggcagcacatggttaggatgcaacaccatcagtgctgtgctgggggtcacagaggagggcgcctcacccaaacatggctggggccagggggtgggggtgctgttgaaagtgaggcctgaaatagctaggagttaaccaagcagggagagccaggcagaggcaggagcaaaggcctggaagcccgagaaagcagcgtgcaggagagacacctgaggtcagggccacaaggtcctggtgtgtctgggtggacggtgagaggtgaggctggaggggctctcagggcccagccatggaaggtgtgcagcgtgcatcgtgcccatcaagcattttcacgaggcgggtggcgtggggtgtttcagaacatttaagcactcaggctacgtggccccaagtctgcctgatgcacgagccctgctttctaccactgctttcctgagtcccaccggatgaggaaccctggcccaggagtttggtttgtgtcttcatgggcatgttctcagcatgtagagcagttctggcccctgggaggtgttggagagacgcttgctgagtgaatctggagctggctttggacagtgctgcatttgcagagctggtggctgctctgctgcattggagaccccaccttctcagatacctgca

SEQ ID NO: 77520 - DNA, 1173 bp, Homo sapiens
ggccctcctccttcgtacactcccttttgtttcactaaatatttcacctcttttcaaaacccatgccagccttttcccaccttcctcctcgtttcttagtctccgctgaaatatctgtcttttggcggtttcttcaccctgttcaagctcaggcgttgtgctggttaaccccgtttgttctcctccatccccctctctgcccggctgcagctgatcgtggacctcactcaggaacgggactacctgcaggcacagcatccacccagccccatcaagtcctccagcgccgactccactcccagccccaccagcagcctctctagcgaagacaagcagcacctggccgtagagctggccgacaccaaggccaggctgcggcgcgtcaggcaggagctgtgagtccccggctgcttctcctacctttgtgtgtgttgcagacatgtttctggtgtggtgtcgactcacatgtgtggtgctgccaatggcacagctctgacgtgtgccccggagtcagctggggtctgccctgagcttactctttgacctcggactagctgcctccccttctgaggcctgcacagggatgggggcggggattcttcccggtcttcagggtttcctcccgtccagacggtgcaagttgtccacagaagcagcctccagtccacgctcagctccagcttggggccgggacgaccacacctgatgtgttttcttggctggagggatgaggtgcccctccttccctccaatctggtgagcctgttctcccaggtttcctgcagctgatggatgtcacctgtggagcctggctgtggggtggtacagctgccgctggggtctccttacctgccccacacacagggagggagacctgagtggcggatggacatagtttaagggccggtgttgcaaacttatgaaaagaaaagaattttgagtcagtaacatttttgcaggccccataagcagatcgcctccccaccgcccaaatcccgagtcctttccttttcccacaggttttaggaagtggcagcctgctcccagggctgcttgttgaggaagctgcctcccacactctttctccttactgcctctgcagggaggataagacagagcagcttgtggacaccagacatgaggtggaccagctggtgctggaactgcagaaag

SEQ ID NO: 77521 - DNA, 1029 bp, Homo sapiens
tttacatattgtctgtggctggtttgccactacagcgacagagctgagtagttgtgacagaggccaaatggcccacagagtctaaaatatttaccatctggctttttacacatgaagtttgccccaccctggcctaaaccaggtgtcccccgtctttctgtacttaagaatcaccgggagagcttgtttaaaatgaagcgttctgtgttccaccctggtcttttcaatctgggtgggggcttacggatgggagttttaagaacaagctccccaggtgattctgatgtaagtggtcctggcaaccactagagacacatcagtgtaaggctggtaggaggacaagagcgttcttagttatgaaggagaagcccggggtgggtggttccttttgaaactgtcattctgtggctgtggtggactcagcttcaccctcacttgaacagcgcttccattaacacatgtaaccctccgcagtgtgagaggaaagaggagttcattgaaagaatcaaacagctggacattgagacccaggctggcatcgtggcccatatccaggaggtaggtgcgtggcctcgtggtgggctcagctgtggactgctgctcctgtggtggccgggaggcaaaacttctctatgagtggaaacgtttgaagaatacatcacccattacgattttgctaatcttaggtttcagacaccacagacacattgattctatttggaaagatagccatcaatcagccagctaaaataaaatgagggtaaaaataaaaattaaaaaaaaaaaacacctcaatcaagtcatcttttgtctccttctttttgccttatatggactcagactatttttaagagctgtcaactggttgaggcccagagtttgatttacaggccctgaaaatgtattctggcaaatgtcaccctgctttgaacagttgatctttatagaatagagagattctctgcttctgtcagtgacatggcagagacaagctgacaccacttgggaatcaaaaccagcgagtcccag

SEQ ID NO: 77522 - DNA, 1033 bp, Homo sapiens
tatacccagggatctgaaatgaaccgcagcattggttctcaggacggcggtttggttttttcatcccggcagtctttgacactttgggacactgtagcccagtgtgtgagttggttaagtcttttaagagaagaaagctatttctggcatgtcctttcttcctcaatacaataggatataacgaaaaagaacacatagatttttttttttttgaacctgaaagggaaccctgcacattacccaggccattttatagatgtggaaactgaggcttggagacagagtatggcttgtctgggacacacagttcctgggtgaccaagcccatcgtctaggcgcaggtgttctgctgctgtttaagtgtttgagatagataaacaggtgaagatgcattcagccccaagcacaatcaaagagacacagctcagaatgacgaaacaggatttttggcctgattgacaaagttgggaaagtggtgaggtaaatgttgatcaagggtaggaaaatgggaatcaccacacatttcccagggtgaaatggcagagcctgtctgcagggcagtttgtcaatatgaaaagcttaaaaagggaatgcataaagaattagctaccatgatattctttataacattgtttagattgaaatattttaaggccgggcacggctgctcacgtctgtaatcccagcactttgggaggccgaggcgagcagatcacgaggtcaggagttcaagaccagccaggccaacatggtgaaacccccgtctctactaaaaattcaaaaatagcagagcgtggtggcgagcgcctgtaatcccagctccttgggaggctgaggcaggagaatcgcttgaacccaggagacagaggtggaagtgagccaaaattgtgccactgcactccagcctgggtgacagagtgagactctgtctcaaaaaaaaaaaaaaaaaaaatatatatatatatatatatatataaattgaacctctggaaggggtattggttaaataagttactggccttgatttacaaag

SEQ ID NO: 77523 - DNA, 1274 bp, Homo sapiens
gagccgaaattgtgccactgcactccaacctgggtgacagagtgagactctgtctccaaaaaaaaaaaaaagtgtcttctgaacatgtgcatgactacagcttaaagaaccagagtggagtcaaaaaggactatacacattatgtaccagtcatggaaggaagataggttttgttccatgtgttaacttccattaactggtagtctgtggagggctgtgttcagaaggattctgaggcctagttccaccctaagtcagaaagtgctgtgattgactaatcatgtctgccatggactcagagttagcaagtcggggaattttcaaaccttgatataatgcacattttagaggatggtgtattttaattgtgcaactacttttctatcctcacctctgcccttagaaacgtgtgctatcaggcagtttcccttttgttttggaagcttatgactgttaacgtctgcagctttctatatagcttatgttggcctgcctgcattgcatttctgctaagaaaggctggggtgaatttctttgtgtcaagactccaggaagcaggtagtaaggtaaggtttttcttagactcagctattgactcaggccgtcctgggattcccccaggggttctcctattctcaacagagtgtagttgtgttaagtgtggagtgtgtccggtctgatgtttctcgatccccgcccgcagtggttgcttgtgacttttttggtgtagaaattcacgtcgttttataacctgcccccgtttctccctctgaacagcagctcgagtaagtgtaaccataaagcacttatactttgacaagcagcgtgctctcttacctcttggccttcgcatgtgctgttccctgggcctggaaagcccacacttgcctacccgataagtctgtctcctccttatctgtggaactcagctcaaaggttattccctttagagtccttgccctgggccttgctgcaaattagaagttcctttcccgggttcccatagcatttatcagctttctgattgctggtttggctcccagcacatagtaggtacttggcagggagctgtctgtaggtttgtttgatcttggcctgcttgactgtgtcactgagccagtcttactggcaaggacccaggagggaatcttctgctgtgttttgaaactattcaaaacccacaatctggtagatttatggaaatagcggtttttcttatgactgaaatcctgaaagaaattgggcatcggcttctcatgagaaatgaggaaact

SEQ ID NO: 77524 - DNA, 1926 bp, Homo sapiens
agacctcctgaaactccttggaatttaatatttaaccctctcagtattgatttgctctcctgccagtgtgtccttggagtgcttttcagatcccatggaaacctctctctcgtagcccacacggcacagccctgccttccttcgggggccccggggaacttgtgagggctgggtgtgccccaggcttactgacctccatcctggcaacccaggcacaggctcagagtccggcttgtgaggaacagtcctcctgctgcagagatggtgcttttaaaaatcaaaagccctgtcttcctggccctgcggccctcccagtcctgcccctggctccatgcctgctcaccgtgtggtgtggaggctgagggtcggccactcaggcttcatgagccattcttgtgttcttttcccctacccctgttgtttttattttatttctcctggccataattctctaatcctgtgtataagtgtatatgtgtgtgtgtatatatatataattttcatatttgcaaaacgttttgggcgtttgaatgggagggaagaaataagaaaaagctaatcttgcaggcattttgattgttctaaaatttcctctttcatccttgagagagaaggttcagaaaagcaaccaaatgctgttttaaactaccccgtttctatcctgcttctttgcttctgtgctgcttgttggatccggaaatgagggctccagtccacgtgcggtgctggggcacttaagccaggagccgaggctttcctttcctaggaaggtgcagagtttggctgacaccaagcccagccgagcgtcacagtgcggcccacacgccggcctccaagcacccgcggatctgcctggagaccagactttgttagtaaacttcctagcgatggcccaggcacacagagaacgccgctggctgcaacagccacaccatggcttccagcagccctactctctgtggccaccgccgtctgcggaggagggaagagatgctatttgtcaaaggtctttatgtttgagttttccacgtggtggttgggagggaccctttcccagagcgtcccctgcctgccctagctcctcgccccttcccagggcaaacttgagtctcaagctgcaggcttgtggctgattctgcttttctggtcttcagttgtttggtgctgggaaatgaattcgctctcagcttctgcaggcgtggcaggcaggtggggtaggaggtcatttttggggtgagggtgctccgaggggctgatatttcaaagtgttctacatgacctgggggtagctgtcgtctgttgtgcgtggtggtgctggggtatctgtgggggtgggactgacttgacatgggcagcagagagacactagagtaaagggccactagtcagagtgcccccgggaggctcctgcaccattccacacaggcatgcagcttagcgcctgccagagtccacgtttgataaatatgtgtgcctggttatgttaatgccggggggtgggggcacgtggtgacatgaggattccacaggggccgctccccagaatgtgagcccgtgcgtagaggtgcctgcctccttccccatgggtggggacacatatgatggagcatccccatgtgcccacccacggggaactctccaccttgagtattcctcggcagtgcctaggaagtaccccaactgttaaaataataataaacagctcttctcgttgtaagctgagccctcaggagggccctcagagccgtgcccatgtgagtgagtgttggggtgtgcccgtgtactgaggagagacaacagggtcgtgttcagtgcactgctgttttcaaatcactgtgacagcctcgtgagcatccttatgaaataactggtttttaagtacaaaaccagggaaagcagttagtggttcacaccagcatgtaagcc

SEQ ID NO: 77525 - DNA, 1064 bp, Homo sapiens
tccctgaaaaccgccttcaccatcttgccagctgcacagctattaaatatctttcgcggttactggtgagtgttttctacaagaagcctgtgagaagcaagagctcacgtctgtgctgtgagggaggatgctggatggagctagaccagctccggggtccctccagctctggcttctcagcatcttgctcagcagccaggcctgtcactgtgccacacgcacaagaaaagactagatttgtctgacgggaagccagggtgttagcaaattactttctgcgatgaatcacaggacagttgcactggaagaaagcattgttttttcttccagggtttgtatccaagtatagtagtggtttccagacttacacatggccgatcccaccgaagccatttagaatggaagggaacgagccatttaggtgtagaagcccagcccagagagcggaggagctcattcagaggcacacagcatggaggtccccataggcgcaagacagatttcacaccataaattgcacagatggttacttttgtggacagtaagccactggttccaagcaagagggttactgtcactggtctgccctgatgtttcttacattctaaatgccaagcaggattcctggaagccctggaggggctgcgactgcatatgcacaccctacagggtcctgtctgaatgcccctggaacctttgagaagagccttggggtttcattaattgccgttcagcggcctggccctctgtcctatgttttctctctcttatgatggttacagagggtgcgcattccagcagcagaggaagcaccctgaagagacaaggttctgtgcgcacaaaatgctgtgaccgaccttccttctcagctgagtgcagaactctatctactgcaccggctgaggaagccagaaggcccgacttctgacctccccaaataaaagactggagtaccttttcatccttcctcatcttagctggctgcccctcagccagaggctcacaaaaggagctcagcccaagcccctcctttagctcccctctgctggtgagatgaacaggcc

SEQ ID NO: 77526 - DNA, 1078 bp, Homo sapiens
atggatcagctggtcccagctctgaaggtggagttggagaaactggacagtgagggctgggaaagtgaaggacgggaataactctacccatcaccgagggctcagagggccccgggcctcgctgactgacatgctagacggtggcctcggcaggctgcacacagagggcaacgtgtcagggctgggggacggggagctgggtgcacggatgagtaggtttgacaggggtcccatggtgctctgagagcagaggaggctggcagcggacatccaccagcaggaagatgcagacaccagtgctaggggcagagggatgtatttatgaaatagcattttcagttttaaattgtaaaaatagatgtgtgaagctcttttcgtttctttttaaacaaagaacaaagttggtgtttttttaatttgtatggttgcccggggtggggcatgtgtgtgctttttgactaaatctatccccgtcgtgtgtgaggggcttgctttgtactctttttgatggatgctaacactgtactgttatttataacgttttatagtttggggtaacttttctgttttgggcacatagcatcacaagctcccagattccagatcccaacagagcatctggtccacccactgttccccaacacaatgatactaaaagaccctgagagtctacgcatttgtcccctttctctgacctaaaaaagggaggtgccacaacttacagtttttctgtatgtctcacttaaccccccacacccatcagacagaagggtgttcactctcttcctatcctgggtggaagtcaaggacagtgcagtaactatgaaacagtacttcgtatactgaaaattgcttttgaaatctctcctcagcatctgcccgtcccggcccaaactcctcactcccttacgctgtgtctgccctgggaccgtctctggatttctgctctgatggtgctgtggttttgcagctcactctcagctgcacccacgcccccggggaggggagggtctgtctggtgcctcactgctgtagtctctgcttctccgagcacggcctgggctctggctggaccctg

SEQ ID NO: 77527 - DNA, 1791 bp, Homo sapiens
tcctggcctcaagctatcctcttgcctcagccacccaaagcgttgagactacaggcattaaccactgcgcctggcctccttattttttaattgcacaagccatacaataaaaataagggtatcttttaaaaaagaaacatcatactgctgtcctagcatgtcatctattgcctttttttccaagacctctctacctatgcagacataactttagctttcattttattttttaaatatgctttttcttttttcataaccccattaaatctcttgtaggcatactttttatttgctaacaatcaagacagaaatacagttaggctttggctttcgtgtttgtttgcatcttacgtgctccttgctgtcattttagctccttcgtagtcaccacgggatggctgtgcacccgtccgggggcttcattacttgtaatttacttaatccctctttatttttgtttccggttcttaatggtatcttttccccctttgtttctgcaggaagttctccagcagctgattgtaatgaatttgcccaatgttttgatgattggcagagacccactgtctggtgagtgaaagccgctcccttctcccctgtggtgcccagccagaggcatggcgttgggcagctgctggccatcgagctccggctgccagcttgggccagcacagtgaaaacacgtgatcgttttggtgagattttaaagagtgggttcattaccctgaggcattcagccaagggcacatttcttccttaagaatgaagcctcccaggccgggcgcggtggctcacgcctgtaatcccagcactttgggaggcccaggcggccggatcatgaagtcaggagatcgagaccatcctggctaacaaggtgaaaccccatctctactaaaaatacaaagaattagttgggcatggtagtcccagctactcgggaggctgaggcaggagaatggcccggagcttgcagtgagctgagattgtgccactgcactccagcctgggcacagagcaagactgtgtctcaaaaaaaaaaaaaaaaaaaaaagaatgaagcctcccaaccgctcagatgtgtgtgcagaggccagtgaggccaccgccttgttcctcctgggaagatgagtttgggtttaggtgcctgagtcataccatctggtggactcacctcctcagtaagtgtggaatcagctgacaccatcagggagtgtggtaccttagacaagagagtaagaatctctttagagaactgacatctgtcactggggtcctgcgaggttcatgctcggtgacggagctcattgatctgtcttatgtctccctgttggactcagctctcctggcaggcacgcgttctaggtccccgcagtctctgacgctcagtgtgagtttgaaagactcaatgaggccgagcgcagtggctcactcctataaccccaaaactttgggaggccgaggcaggaggatcgcttgagcccaagagtttaagaccagcctgggcaacatagtgagatctcatctctaattataaaatgaaaaaaagaaagaccaaattaaatgtcctcctggcatcttacagaaagtcagaacttaatctctgcctgtcagataacttccttggtgcattaaatggagtaatgccttgcgtccctttcacctgtgtgtgtttacctgcacccatagctggtggacagaagtcgcaggccccagggacagagttactcgctggctaggacttcccttgttctgatggagaccttgtcatcattttgaaaccttaggtctggg

SEQ ID NO: 77528 - DNA, 1072 bp, Homo sapiens
gtcactccctaaccaggcgccgctacgatctgatgtcgtcctcccctgtcagagcttcattgcctatgaagcctggagtgggacacctgtatcctgtgttttggggatggtcccgatttctcaacaagtacattgatgtttgtccccagcaggttctaatagaatcagctttctctttggttctgttcttagaactctacgcctgtgaccttggaaagccaccgctacaggccttgagatgcagcatgctctgggccaccttcagtttgcttcctgtgatctgggttgggagctgggaatggaggcttgttgacaccgtgtgcagacacaactgctgcccctgccaccttcctgccggggtgacaaatgcttcctgagggggtcctggcccaccccaaccctcccccttggggtgactgataagagcctagattttagatttgaggccagggtgttgtcaggtgggtgggccctctccccttgtgagattacaaagcgcttttcagccttgctctcccccaacccctagggacaccagtggcccctgcagtatccaaaacacaaatgcacctgcctctgaccctttgttcattgacttcttttggtttgtttaaagcatttaattggccgaggagtcattccaggatgcagttgaaaagcaagtcatttatgaaaagcaaaatcttattttaggatccgaaagcaaacctaaaggagaagtggggaggagtgcaatctaccctggattgcaatgccacacccctaccatgtgctctgcggaagggggttcccttggagggccatgtgccaagcctgaccctcttcttccctgtccatcagaccacaaggaccggtgacaagacagaggcctcagcgaggctggtgtgtgtcccttgtccctcaagcttgccttggcacttgtttctgccattgcaaagactagagtggcacaaggagggctcactggcaaatgtgggggcctgtccagagcaccactgggcttgcactctccagcctggtgtggtcctgcctcacaggtggctggctggggtgtgaccaggtgccctggcag

SEQ ID NO: 77529 - DNA, 1061 bp, Homo sapiens
ttctacttacacaagttctaatggaaaattctaaaacaaattcgaagctttttttccctctgaaatgtttttaacttttgttaacagctacaggctgtgaatcttaaggaatatggtgtcagattttccaggtttcaaggcacaggaattagcagagaaaccaccctcattgcagtgatagagcagaacagtaggttttcagatcttggttcccttgtcaacatggaagagacagagaagacacctcctccacaaaagaggtttttaaaaactgtgtactcaatatatattttgaggaatattttctgatttaattttcccaactgtcactattagcagctttttgccacttcggagtggggagttgattgacatggcacagtgtagaaagtgccgcagaagggggctgaggaagcattaggagttcaggggagaaaaaaatcatccggcatcaggtggctgcctagaggagggggcgttttagctgagctttggagggcgagtagggtctggcaggtggtaatctggtggtaatggggctgtgggaggaagggcaccctcgtgggaagcgcagagagtgttggtagttcagtttgatgctcagggtaaccgaagggttgacttgctgcccacacttagcagttaatacatttcctggctctgtccctcacgtgtcagactcctaagcattctctacagcccagctcagaagctgtctcctctgggaagccttcccagacttgtctgggcagtttggcagtactccctgtgctgtgctgccactgtctacctccctcccagacaggccgagagttctctgctcgctgcaaggtgtacacagtacgtgtcttctgaatatctgaaccccagagcagacctaaaggtgtagaaaatgccccggctttgggcaccagggaagacggtgtctagaggtgtgctgggtgcacctgcgaagccgacgtcactcatgcttctgctatttcagtcttgactgttagcgtgtgtgggtcaacagcggcattctttgtggttttgctttggctgtgtggaaggctctcttt

SEQ ID NO: 77530 - DNA, 2052 bp, Homo sapiens
cctctgttagggtgccagacttgctggtgggatttgctggtgggatcaggctgtgagctccccaggacagggcctggccctatagcaaacaccctgggcccctcactgtcccccatcccacaggctttgtcctccttgtctttgtttcctggctttgagggtagcagtcttggcttcataccctccacctcccaactggcatgccatcagacacccagcaggtgcccgggaagtgtggcataaatgagagagggaatggctgcccttcctcaaggagctctccctgccctccagatgcctgccctgggacactggacaaggaggcctggtcactcgggagtgctggtaccccttgtgctgtggtgctcgtaccctgaggcctgggctcaggttggggcgtgaggttgggggctggctgcccccactgcctgcctttcccaccctcacaggtcccagcaggctggggtggtctgggctgccatctaccgctggaggctcctaggtgccctccaccatcctgctccgacttgtgcctgggagtgaagcggcattgtcaggccaccgggtgagggctgccagggtgtggcgtggccccagccctgccctggcataggtgcctgtgggcctgggtgggtgagcggtggagtgggacatgggacactgtgtgggcaggcgccacgttcccccagcccagctacttgctgggacgaggaaggccttgcttctgctgagctagggagggtgtgcccaggacagataggtgcctgcccaggaaatcagctagagccacccctgactggagggtgtgggaggcagtcttggtcccagtctgtgactccacaggctcctcgggaccaagactgtggtcttggtctgtgctgtactcctgccaccgccggcctctgtactcctgccaccggcgggtgaggttggctgggcctggacagcacatggctcctcccatgggaccactacactcattctggctgggggggtcatgcctgtcccagcccaccctgcatgcataccgtagtttcctctggccacactttctctgcccctttcttgcttatccatcagcagaactactgacttttccatccatcagcaaaaatactgactttgccaagaagcttaaaaaaaaaaagtactctaccaccatgaagtcacagtcatacgatccctcacggccataaaatcagggcccttatatcaactccaagcactggagcaccgatgctgtcgttttagccaggaggggtggacttagggacagaggaaagggcagcccagaactgctgcaggtgctgtcctgtggggaaagggtcctgctctctccatccttagcctaatccttgaagtccttctgcctcaccccaaacacacacctcagggcatggcatgcactcagcagacaccgctgagtggatacaagcttcttggtatggcataaggagccctagggcggagtgcaaggagacctgggtttccagacctgaatgtggggctacgcctctgtcattttttgctccggacctcagtttcctgactctatggataatcttgatggctcttttggttttaaaatgcagattctcagcatccctctgctgttggggtctgtatgcacggatgtgtccacctactgacccgccttcccctcccccaccatccgcacctgtggttgccgaggcatcactgcagcaggtcgttcctaaagcccgatgcagagacccggcttgcattcctcttgtaaaatggttcctgaactactgtttatgggcagaggttctcttccaaggagtcgaatgccgtgtcctgcccgtgtttctggggctgccccccgcccccttctttggctcaggggctcagaacaggcccttcctggcatcagataagacaggtctgcccacagagcaatccagggcatcacccagccctaaagggaaggtggcaggagctcctggggttacttgaaacatcctctggttccctccctgccgggttccctgagttcttctggacgcgtgggcacttgcctgctggtgagag

SEQ ID NO: 77531 - DNA, 1039 bp, Homo sapiens
ggaatggcctcaaaggtcggttgggccaccccaggctctgtgctcagcaggactgcacggcctgttctggctgtaaccccttgcccctggctgttccctctgcctgggattctccagttccacccgtccacctggctcacaccctccctacactcgcattttgttcagctgacgattcatcgagggccctctttgaccacctgtctgtaagagctatgttttctgtcacttcctcctatgttcctttattttgcttcttaacacacacatgtgacatatatttacctctttagccctctcatttactccaatattccaagcaatgaaaaatacctattgatcaaatggaccttgcattagcagatacctggtggacttaaccctgctactgcctgcaagagttaggatgagaggtaatagacacagtgtgtctagccaagctcctggtttatgcagcatgctgatttattgctgttcgaaataaagtgttctttacactgtagatgggggagggtgcgtttagttggaggtcccaaaaagcctctgttctcaccagagccttcctccccgcagccagttccatttagccagcagctggcaggcatctgctgtgggccacactgtgcagagccctggggggattcagaggtgagcatgttccagcatctgccctggggaccctgaggatctcagttccctgtgtgggactcaggcagggacacgagagaggggcctgggggcactgattgctgaggaagtgatcattgccggcggaggggtttgaggaaggcattggaggcaagtgtggctggacagagaggattttgtcaggtgcgggtgggcaggggaccggctgggctgccaggtcacctccaacccctgcccaccccccaacttggacagctgctgcaaagttgataacatcttttgagattttcacttcctgccgagatattagtcattagaaacttgtcacttctgaaccttcctcctccccggcttttcaactgtgtcccgatatgccctcccccagtttcct

SEQ ID NO: 77532 - DNA, 1089 bp, Homo sapiens
tccccagctttggtggttgtgtatttctccgtcttctctgggtcatctctgcctcacctgctagatggtgtctgtaggacccatgtcctgtagaacaaagggaaacacgctgagctggagatggaacagctttcttagggacctgactttgaagaacctttcagggtctgttattcctgacaaagaaggccaatttagagtccagataagctggggaaagattgtgttctcatgttttgcataatctccaaggtgctgtgtcatggggcccgccatgttgaaagggtctctggaaaccacctggtccagggagtggcagataggtttaatcttgagttgattggttgtggctgcccagagggctgtgttgagaaggattatgaggcctctgcgttgagatttgtggaaaagagtgcttcatcaattagtgatgtctgctgtgggggcaggaggtggacagtagcgctccatacacagtgtttgctatctctcatcttacagatgagaaaaccagggcccagagaaattgtgacttgtctctgtatttaatggcgggtctgaaacttaaacctaaggctgctgagatccaacccagtgctctttctacttccctgacattacagaacctatcctagtagaggatgagtcaaagtgtgaaacaatgaagacaagatgtcgtgataaaatgggctgttcagaaaatacaccgtggaaggcatcaagaaggaggcagggaggtgggctcggactggagagaggagtgagctgagtctcgcaagaaagggccggttttttgttgtttttgtttttcgagacagagtcttgctccgttgccctggctggcacgatcttggctcaccgcaacctctgcctcctgggttcaagcgattctcctgcctcagcctcccaagtacctggaattacatgcacgcgccaccatgcccagataattgtttgtatttttagtagagacggggtttcaccaagttggccagggtggtctcgaactcctgacttcaattgatccacccaacttggcctcccaaagtgctaggattacaggcatgagccaccgcacccggccaaaag

SEQ ID NO: 77533 - DNA, 1027 bp, Homo sapiens
ttttgcagcctaaaataaaaatttcaaatacaaaaaaaaaaaaaaaagagagatgggggtctcgctatgttgatcaggctggtctcgaactcctagactcaaacgatcctcccacctcagcctcccaaagtgctaggattacagatgtgagccaccacgcctagcctccacctgagagtttttggataatcttcatggcttggatgttgacgcattggcttttgcacctcggtctaattggatgcaccagtcctcttggtacccagatgtggtgccctaggaacatcttcccgggatgcaccagtgtgccgtggtacccaggtgtggcactccagaaggctgtgccctcacactgcctgcagaatgggtgtttatagtagtaacagagggaggctgctttctgcaggtgtcacagcatcacccattactggaaaagtttacatacagataaatttgtttctgcctcacagtgagaaagaagcctcttctcttctggggctatcaccttccagtgctaggtcctcttcattggagacccctccctgtcacagcacaatgtgggtaataaaatggtttgtgacctgcgggagtccttgtgtcttttcccagtgcttgctttccccaggaatggggctgttcccaggggtgtctggtttccaactggccattcatccggtccccacactattaagcagcaagaactggttttgcaaagtaaaccgatacctcgtggagtatcctcagccagcaaggatgagacagtttaataagtgcctggcgacctccgaggaggcagagtgtccctggctccccactttctccacccccttcctcctggctcccggacatctgagtgcccaagcagaaagagggaggggctttctcattccttggtgctggggaggaggccttgatcaaagtagtggtgtttggtggaaacaacgacagtctttcttgggggttctgttcatggccccctgagattcctggctgggccccccacggcagcatggccagcctgggcttt

SEQ ID NO: 77534 - DNA, 1027 bp, Homo sapiens
ttgaaacagagtctcaccctgtcgcccaggctggagtgcagtggcacaatctcggctcactgcaagctccgcctcccgggttcacgccattctcctgcctcagcctcccgaggagctgggactacaggcgcccgccaccacgcccagctaattttttgtatttttagtagagatggggtttcaccgtgttagccaggatggtctccatctcctgaccttgtgatccgcccgcctcggcctcccaaagtgctgggattacaggcgtgagccaccgcgcctggccaagaaaaagcttttctcctctttttttttctttctttcgttctttttctttctttttttttttttattttttaaatagagccagggtcttgctgtgttgcccaggctagtctggaactcctgggttcaagtgatcctcctgcctcggcctcccaaagtgctgggattacagatgtgagccaccacgcccagccaaaaatcttttttcacttggagtcagcatagaggtttttccacatcaaagcaattcctcttaagccccagcagccaaggtactcctgttgatgatggatagtcctaggatagcaaagctttttagaagctcatgcttaaatcaagcaggactaaactgtcagacacggaagcatccctttctacttgaaacctttggggtcagtgaccttgactttgaacttggaatcacatcttcaagagcagttgttgacttttcccctggggaagccgggaaggccaggaggaggatggagcagaggtcagggcccatgaccctcttttctcttaacgtttggactcggaggaagcctggatggagccattttccctcctcaccgtacctgtccctccctggtttgtaaactacccccactccacttgaccagtagctgctgaggccataagggccaggcaggtcttcagatgaactaattggctcctcattcaggtgggggacaggagtgtctctgtgtacttcagtttcccttgaacctcatgttgggctggcgtg

SEQ ID NO: 77535 - DNA, 1018 bp, Homo sapiens
aatgtatttaatgccactgaactgtacacttaaaacttaaccattttaagcttttttttaggttatgcatattttaccacaattaaaaacgggcacccagtgggtttttttttttgttttgttttgtttttagcaggaagagagtttgtactgtgaggatgatggtaaactaaaagaactgtgttctgcattccctgggtccagcatgaggctcaacacacaggtgccagtgaatgggcaagcttctcaggcttctagaacattctggtgtgtggctgccattgtgttaagcgcttggtgttgaaggcagtgggtgttaggactgctgctaagaatccttacttccttcccatttcagtcttcaccttcactaggtggcatttattctcatctcaaagatgaggagacagaagttcagagaaaccaaggaccctgggaaccttgtcccagagcccaagaccttaaaacaaggaagtggtgagcctgaggaccgaatccatgttcttcctttctggagacccctgtcctctgcgctctctggttctgataggtgatgggagaccaggtaaaggaagtggggtgcttccaccccattctctgggctttggaatctgttgtttgggtttttttttctttgtaactcccttaggctctgggaatcctgtaataggatgggaccagccactggcttttcgcatgtgtacctggaaggcgactttggtatggccactggccactgggaaggtgcagtgggctggccatggactttgcctcctggtgacccacaacactgacttggaacagttagttagaaaacccagaggctggaggggtgagggccctgtggcagcctgtgcgtcactgccccagtgttctctgtgatgggaggctttaatgaacaggagcgcctctgagatgccagcttggtttttcttcatttagcacagagcacggggcatactttcggtgttgcactgagtgagaagagtccccaccctctccagtctgataacgaggt

SEQ ID NO: 77536 - DNA, 1038 bp, Homo sapiens
tctgagagagccagtgagcgattggtgcctgggaaatgcccagcccagtgcccaggggccgtttccgggagcggactccggtactgtctctccctctcccgctgcctcacacgtcctgtccttgcagtttctccttccccagcacctttcctttttcgctatgtgaggccttgaggactctctggaatttaacatcattatcgccgtcatcacacccctggccctgacttgttttctctgtgtcccaccctacattgcagactcactcagggcggggactccggcagcctctgcctctcccaggaagtgcagtgagggggctcagtgagagtgaggggtgcagtgagagtgaggggcgcggtgagagtgaggggcgtggtgagagtgagggggctcagtgaggggttgcagtgaggggccgcccttgctggggtccctggtgctgccttcaagaactccaaagggccaggtcctcgggctgggctgggctttaaaatgttccttcttttatgcatcgctggtatggaaaccctgggttattatcggctctgggtttaaaagatgaggtaaattgatttctaaaggcaaagccactttgacaagccttttgatctcattccttttgaacagaaaggaattggaaatgtgaccagctgaagcctctctcgtttctctttccccttgaaaaggttctcctcctctagccctaattaaggtgtccttccctgctctgggtggttgaagccagcccctcggagctccatgtccaccgactcccacctctaggtttcctggatagggatttttgttgttgcttttgttttgttttggcagggttgggggtggcatgtaggaaagggtgatctgaagccagagtttatagagcatgttaagttctgggtctgtttgaactcctcctaggtacaggttcaggaagggagagctggaacctctggaggtggccgtgttcgtgggaacagggtcagtgggagcagctgtcatggtggccatgggagctgctaccctggaggccccaga

SEQ ID NO: 77537 - DNA, 1676 bp, Homo sapiens
gagtgtgcacgtgtgcctgtctctagccctgcacgtttttctcctgtatgatcgttttattttaagctgagtgacttacacatattatctcatcaaaggaagcctcatgattttatccctcaccagcaatagaattccttaaaagcaggcactgaatctttctgtttgtctgtcacaccagcatggaaatgtgtctgccgtcagtcagcatgtgttaatgacaagatacataacaacggaggccaccattcagtggagtaaataattcagagaataagtcattacaatcagggagcacggtgtcacaccaggcctgggccgggaatcctgtctctaggttaaaatgaccctgcaaagtgcccccgacctgctgccctttctagactgttgaataattagaggatggggcctgccttgttcctctgtgtccctgacacatggcagggacccagaccctgactgtttagagggtaaacaggggtaaaccggtatggaggtgcaatgcagtgagggggctgggctggagcttagggctcccctactgttttcacgcagacctgtaggcttttcatgtggtgtttgctttgttgatggaaatgccatatgtcaggtactgggaggctcagtccctggggggtggaaattaaattgattgttttcaactttgtctagccagcttggctcccctgagcattctaaggtttaggctgaatgactttaaaattttaagactaaaatttttgcctcctttccaaaccttagtaaccagacaggctcaccttctgcccagcaagtcagatttacgtgcctttaaagtgtggaattgtggctacttaaaggacagaaactccggagcagctggcactttttgtgctcaattggtcttctagcaccctgtttttagggtgagaatttgtggcattcagattttacggagtagagctcatgaagttgatttcttttttttgagacggagtctcgctctgtcgcccaggctggagtgcagtggtgcgatctcggctcactgcaacctctgtctcccaggttcaagcaattctcctgcctcagcctcctgagtaactgggattacaggcatgggccaccatgcccggctaatttggtattttttagtagagatggggtttcaccatgttggacaggctgggaagttgaatatttcaggtggaaatggactaagttgcagaggcgagtatcccaagcttagatgccagaagaaggaagcgttggtggtttctgagaactctgggctattttgataaccacctggggcagttaatccaaaacaggtagtccagaccttcagaggaagccagatcggggctgaggtgtgggccgtctgggagggcgcttctgtctgtaccccttctcctaccttgcccttgtttcttccttcgggaggtagaattcgctcaggttgcctctgcctcatctgcccctctgcctgcagggctgggggtttagggggtgggggggctcccatcctacttgcggacagaatagctggcacctggacctgtcatctcccagctcagcctctcccggggcagctcctcttgtcctccagggctgccctgacactggtgtgacctggggcaagcggcccaacccctcctagcctgttcctcttttgtcagatgggggtgatgactgcactc

SEQ ID NO: 77538 - DNA, 1050 bp, Homo sapiens
agttgtttcttaattcatggccatttatttacagagatgtgtgtttatgagcccatcttggggagcacaaagtaagcaacaaagcttctgggagtggaagctgagtgatcccctgatcggagggcaaggggtctgaatttgtgcttccggaaaaattatggctgaaacgatgaatgttaagcttgcagaagccgcgagtgagctgtgcttggtgttcccggtgcttgtcgggctcattcttagttagctctcgttcagctccgattgaaagctgcacttgtgggtgatgagtgttgtgggaatcgagtgatgcgggcgtgaatgaaggttggaaacacagctcactttatggacataccctaaacgccaaagtgggaggaagtggcaggaggaaccagttccttttgtgacagaaaggagagaaatggatttctcaagtcgttaaaaagaaaaaacagaggtttctcctttgccttgggtttggtgttagatgccaggatcagcatgtttgatgttctcactggtttgtcaaaaggagtttctgaagaagaacttgcccaggcaggctctgcctctccgtgaagccggctgcgtggctcacctccagggctcgtaacagtttttgttattcagctcttctttggggaatggcagagattctctgctgcttcgccttggcatccagggccccttgatccttcgagatgtaattgtcgcgatataattgtcgtcttatttttctagtaatgagaggaatgtcgagggaaggaggatgaggaagtgctggtcttaaattggtggtttcagccagtactgtaaaagttgaaggggccgcactctgtacccccagttctgagttggtggtatttaggggggaggcagagatttcagataaagagtcaaggctgccacgttccactgggagggttctattggtttgggattgggtttcggggaggctaagggttgaggggtggtaattctacatgtaggggtgttctgtaggggaagagatggggcacactgcagctctagggagaagcctctggt

SEQ ID NO: 77539 - DNA, 1381 bp, Homo sapiens
ctccagtctgggcaaaagagcaagactccgtctcaaaaaaaaaaaaaaagaaatgtaccgttttaggctgggcacagtggctcacacctgtcatcccagtgttttgggggtctgaggcaggaggatggcttgaggagttcgagaccagcctgggcaacatagtgagaccctgtctctataaaaaaaattaaaaaaaaattagctgggcctgtagtcctagctgcctgggaggctgagacaggaagatcccttgagctcaggagttcgaggctgtagtgatctgtgatggtgccactgcatgccagactgggtgacagagtgagacctgtctctatttaaaaaaaaaaaaaaactaccatttttctccttctgtctttcttgatatttcacatatttttctttgttcagcttttaattcttttaatcttgaaatatatttggctgggttggttttatacagtataacatttggggtctgcactgatatgtggttggtttttgtgggtgctaggaacggtgggaatggaaacagcactgactgagggcctgcggtgggccaggtgctcgggtcagggagcagaaaggcgatgtggcccacctgaggtcctggcttagcagtggcaggattgggatttgacttgaaccacaactgccacagcacagcctcatggtcacctagggactggaggacaagatgctgggtcgtggctgggaaaggaagtgtggcagctgctgggagatgcaatttccattctcgtgtttcttcccctagagatcccaggcccacaaatcaacgcatcaataagcacgtcaacaatgatgtgaaccttcgcattcagaatttgaccatcttggtgagaaacattaagacctactaccaggtaagggcagttctgctgtcgggaattctgatgtgtgtccatcagtatcgtcactgtcacggttttcccacaggaggccgggaggaaacggtgcttatgtttaggcctctacttgttgacagttggtctgctttcatgtgaaccctttgttggggcatgtgtgaggatgagatggtgcgttgatttcctttgtttggtgaatgttctttgagctgtgtgtagcatcgtgctatatgctgtgaaggtcccagagaggagcctcagtttgcagcctctgccccgagaatgcagttgagtggggactggctggaatgggcttcctgaaggtgaccctgaggtggttatccgcagcccctggctcagtggctctttatacaggagccattcaagggttgagggagaggaggaaccactggagggttatgaagatgggaccaagaatgtgattaacccacctctagctgcaagcaggagcactgggcttagggagcgtctgtctt

SEQ ID NO: 77540 - DNA, 1066 bp, Homo sapiens
cgggtcccagtggtcactcctgtccctggggtttagccactcccgaaaaggaccccattcttcccaaccaaatatctcatgtagtttttctgaatccctgagaccagccggtggatggcggtgacgggtggggaatggggggcgccgaatgggaaagcgaacagactggggtgggcgcactgatttacaatggatttgagacgtgagacatttattgaaaagtcctttttatttttatttcttccgctctggaacgcgggagaaaagtggcgaggaagtttttcctcctgtctcgtgtctgttgccccgcgcggggaggggagacaggccctaggagaaggccgggcttggtgcctgctgaagggtggtgtgggcgtgggtgacccccttctgctcacactgacccgtccagtctctgcctgggagagctttggaccgtttgtgcgcacggggtgacttcctgtctttctctcctcgtccccctccccgcaggtgaaaacttttggcccgtttggaagcggcagccaggacaacctgactatgtacatggatttagtggacggcatctttttgaaccaaattatgctgcaaatgtaagttaccttcttctcggaggaaggaaagaatggtgcgttagaaagtttgagagtagaaatggagtggaaggttgcatggcggggtgtgtgtggggtggggggtagttctctgaaggtggagacgctggtatctcagtattaacgtgcctgttggacattcgtaggtgtttgaagaactccaggacagtgggtctggcagttggtttgatgaaggaaatttggaattgaatgactgtcatttacgtggtgtagatagtgcaattgacttcagactcaaggacttaattgtggtttgagcaatgaaatgaaaaagtccccttttggagggcaaggaactgtaacggagagtgtctggttacaggaagtgtcggggtgggcccaggcatccgagggttactgtaaagtttcattttagatgagggtgtctgtgtttctgagctcctttacatttcatcttcctttttcagttg

SEQ ID NO: 77541 - DNA, 2225 bp, Homo sapiens
cccagcactttgggagtccaaggtaggtggatcgcctgaggtcaggagttcaagaccaggctggccaacatgacaaaaccctgtctctagtaaaaatacaaaaattacccaggcgtggtggcgggcgcctgtaatcacagctactcggcaggctgaggcagggagaattgcttgaacctgggaggtggaggttgcagtgagccgagatcgcaccactgcactccagcctgggtgacatagcgagactccgacttggaaaaaaaaaatttttgctttaattctaattaactcaaagttttcccttattgtaaaaaagtatgcatgtttattacaggaaatttagaaaatatgtaaacataatgaattgaagtttaacacagtcccaccacccagaaataaccaccgttactatgttggtaggatctattttctttctccagccagaaaacaccagtgtttttatatgttttattttctgttctttaaataatccttatttcttaacagggaggcctcgtgggtctggtagattatcctgatgatgatgaagatgatgatgaggatgaagataaggaagatacgttaccattgtcaaagaaagcaaaatttgattcataataatggcaacggcctaggatcagtacctgttgaaaaaaactggttctccacccctcccccatacaaaatccacaacaaagcgcagtggtctcttgtgaatgactgacacagatcagcctcttacacttgacttctgctcatcaagtgccaattcaatggagcaggaggaggggatatcatatatttaggggaaagacttaagcctttgagctctccagcttggaccacacattgcccttttctcagggaaggaaatggaaacaaaaagccaacagggcaggggttttgtaagtggaactctggattgactggtcagttgctacaatcagaatatgctttcttggaccatgtttgagactcagaagaatgggcctttctgccataattcttcactagtcaagaatgccagcagtttctttgtataaagagacctgcctttaaaatcatacattctgaacattttagtcaagctacaacaggtttggaaaacctctgtgggggaggggcgagtataaagttttcctcttttttaactgttccctttgcccttcaaactgcagatatttttttttttaagtggggacttctccctacttgattaaagattgagtggaattctagatgtggtcatttgtgtcataatttttttgttttattttgtttttgattttttttttcctcccctgagtgtatgcttagttgttgagtatatatatttgggaccattaaaactttttttgatgtaatataacctaacgttgtgctggtacctgttttaccatgtgtaatttttgttctacatcacagttcttaatttgtttagagttttatgaaagatggtatagtttttattgacaaaagcaaagtaatcttacaactatgtgcatacaaaagcaatactattttgtgactaaatattttatattaaaatttacatcagcaactgtcttgagaattcagggaaatagaatggaatttaaaacttcaacagttttgttaaatctagaaacatgaaattagtattccaaagagattctgaaatttcttttcttggggaaatgacggtacattaaatcaaaattgaggatggatgatttaaaaacatttgacttttgaataataaaaagaaaagtgaagagtaagagaaattgtattagttgtatgtttcttgtttttgtttttaactactccctttggaataccagtttgacttgtaagtggtggtttctaaataaatacctggccagaggaccatcacctgtcaccttattaaaacagtatttttaaataggttctttttgttgtcttagatgtgatcaaattatttcaaggaaaatgaaaataattctacttaccctcactttttaaagtgaagagtttagaacttaagaatatattttcaaatgtgaataaaacttcatatccaggaaaggatgctattttaagtatcatatactttaagagtatctagcaagcgctgtgtgcttctctgtcttgtcttgtttattcctcagtaaattacaatggtggtaccaaaaacaagactatactgcatagttggatagaaaaccagaaagtgtcaacttgctacagtcattaaaagtttt

SEQ ID NO: 77542 - DNA, 2287 bp, Homo sapiens
ctttgggaggccgaggcaggcagatcacctgaggtcgggagttcgagaccagcctgaccaacacggagacaccccatctctactaaaaatacaaaattagccaggcgtggtggtgcatgcatgtaatcccagctactctggaggctgagccaggagaatcgcttaaatccaggaggcagaggttgcagtgagccgagatcatgccattgcactccagcctgggcagtaagagcaaaactccatctcaaaaaaaaaagacccatagataaattggggactactatagtagccagtgtacgttattcccattttttattgtttggttatctctaagattatgtagttttattaaattaagctatttttggtgggtatgaattgattaaattaagcctcatcttgctaaaatgacattttcctatcattttttcattactattcttttctgtaggaagatataaaatcattaactgctcatgtaattgaaaattactggaaagcactggaagatgtagattatgtacagacatttaaaggattaaaactgagatttgaacaacaaagagaaaggcaagataatcccaaacttgacaggtaaattaccatatatttaaacctattcgttcagcatcaagtcgtatggtagtggctttattgtttatttgatattatttggcttgacaaggaacagggaaatcagcagatagcaaatagaaattgtagcttcctgtaagggtcaacataaatgtttccctgaagattaggctggttattagtataatacctcaggcatgtatcaggctagataagggaaaaaaaaaaaaaaagaccaaacagtggaagtgaggcttcatgtgttccaaataaaatcagaggattatattacttgctttgaatttacaagttactaaggttacaaattattatttaaaattttgtacattaatctaaatacctggatttacattgatactttaatatttgtaaatttcatgttaattccctatgttaacaagtttaataagtcatctgtaacagtacaattaagtccatatatgattgtatttactctttcttccctactcatagtatgcgttccattttgaggaatcacagatatcgaagagatgccagaacactagaagatgaagaagagatgtggtttaacacagatgaagatgacatggaagatggagaagctgtagtgtctccatctgacaaaactaaaaatgatgatgatattatggatccaataagtaaattcatggaaaggaagaaatgtatgttggaaaaaaatgggcaagagaaaattaaggctttcttactctagatttattcttatttcttgacaaaatgattatttgcttggaaggtgtgatggcatacggtttaaagactctattgctttatgggatgtgactgaatagcagtgttgtgtaggcataaacttaagttttcttaatttgagttgaataaggaatatactatttcaggaagggtagggatactaaatatgattctgaaggtttcaattcttctctggggtaagatccaatgaatggaattgtggttagtattttggtaagcttcttttataaattgaacttcaatgtttctacccagcgtagtaagctagttaaatgtgttttagtgttacctcatttggggaaatttaaaaaagaagtatgggggacgactattgacagtattctcatttttagtaaaagaaagtgaggaaaaggaagtgcttctgaaaacaaacctttctggacggcagagcccaagtttcaagctttccctgtccagtggaacgaagactaacctcaccagccagtcatctacaacaaatctgcctggttctccgggatcacctggatccccaggatctccaggctctcctggatccgtacctaaaaatacatctcagacggcagctattactacaaaggtacattcttgactcccattttgcccccttttttcccaattgaagctttctcaacaataattttgactaagattccctttggttactgccacctagaactgatttaacatccctgaactagaggatgagtcccccccaccgcttgaacttatataaaggttgagaaatttctgaaagttttttttatgaccaatgcaagtctgcatatagtgtgaattctcacttgggtattttggattttagaactgaaacttcaaatttgtatgtcaaaacatttacagaaatgttcaaggttttcagttattcttgaataaatgttcctaactaatacccagataa

SEQ ID NO: 77543 - DNA, 2022 bp, Homo sapiens
cagtaagttcctttgtcaaataaccttaaaaatacaaactgaaaatattgttttgggaaaataaacccttgttaggctttgacttatcacacagaaagatgcctcttagtgtttaaaatgtcttagttcaccatgagtatgtttttaaaaatattcagtagtttaaaaaataaaatgcaattattattctataaactatttagaaactccctgcccagagtgtttcttaagaaagatacactcttaaataagttgcattgttaaggcagttaataatcaactgtacctaattgggcattcacttgtggacctcttttctgccaactaaagaaaaattgagctgctttactcctctgccttcccacccagaaaccgtgtcagcatggttgcctggctacctgctcatgaaggacttgattaatagcaaattggcaatttaacgagccacttccatgatctccaaagaaaccaaaatacaaacacaatatttaatcttgccaaccgaagacgatgtgactgcatgaagtgagtatgcttttttgcactgtttacaataactggggcattaacttactgataattccatttaggtaaagagggctttgttgaagtctagctgtctgagtatatttgtgtcttgatgaatggtgacttaagtaactccccatacctcaagatgtaaatataccttttaatctgtaagttaaagcctaattaattatgaaaatgaaaactagaaaaaaattaaaaagcatactcgctacaataagcatagaggaccacattttaaataacatcctctaaatttatttttaaactatggcaaggcaaattttgggtcatgcagatttttgtgggttgatggcctttctacagccacatccacaaataaataaaattccatgaactacaatgcaaaataataagagtgtccaaaaatattgaagatcaaattatacagtggattgccctaataaaacactggttttttctattaaggtggatataaaaggtcatgttgaattttttcatcttaagtagtgtgataggttcattcatttgtcttagctcttattttagatgtaaattacattttggtcattagtaactggtttattttcaggatttttctggctttctaagacttgtgttctatgatgacatatactacttttagaagacatttttctgataacattttcataatccttatctttaggttcacagttccggaagtgcaaacatcataaataattattgatatgtgttaaacagttttttttggtttgatggttatttttgtttggtaagtctaaagtatggaagagtggtatgtgatttaaacaaccatgcctctgtgtttcaggtgcccttcgttttaaaagaaagattattggattaaaagatgagttttacaaccgctacataatgaaaagttttttgtttgaaccagtagtgaaagcatttctcaacaatggatcccgctacaatctgatgaactctgccataatagagatgtttgaatttattagagtggtaggttctgtatttttaattagaattttcattttaattgtttgagaaaattgaatatgcattacctagtattttggcttgagatgataatatttggagagatttaaaaaaaaaaaaaagtactaaaagcctgtgagagatttgagtcaagctacatcttacctctcagcagctacaaatctgttatagcaggggtcctcaaccccttggccgcggaccggtccatagcctgttaggaaccaggctgcacagcaggaggtaagctgctggcaagcaggcattattactgcctgagctctacctcctatcagatcagcagcagcattatattctcctaggagcatgaaccctttggttaactgtgaggtggaacaatttcatcctgaaactgtgctcccccactcccaccccagttggtggaaaaattgtctttcatgaaaccaaaaaggttagggactgctgctttgtaggatggtcacagtaatc

SEQ ID NO: 77544 - DNA, 1966 bp, Homo sapiens
aaaatttcacacaattggtaacttgagttgtgtcttggtcatgggagagtattgcattcttggttgaatacatagttaagatgttaattgggtaaaaaaaaaaagtgtggcatgtggacaaagtatacttggtcttttttttcttttttccttttttttttttttttttttttgagacggagtctcactctgtcgccttggctggagtgcagtggtacgatctcggctcactgcacctccacctcctgggttcaagcaattctcctgcctcagcctcctgagtagctgggattacaggagcgcaccactacacccagctaatttttgtattttagtagagatggggtttcaccatgttggtcaggctggtctcaaattcttgacctcgtgatccgcctgcctcggcctcccaaagtgctgggattcaggcgtgagccatggcgcccagcctacttggtcatttttaaagagagtcaggacaatgcagctgaaagcaaaggacttttctttagttcagttcatcatttcattattttgcttgcagtattgcaaagaaaatttctcataatctaatgagaactttggagagaatcttttaagtaaatgaaagtttattgttggaaactaagtatgttagcaaaatcttagttatgtttcattgttgatattttccaaactgagtcaggttatcattaaacctaactctttgaaaggacctcttggtgtacctctcttcccagggttgaggatatataagtatcttcctaacaaagatgtctgtcattaggaacaagctttttagaactggctttgtagtatgcaataggagtttttatcaaagatatctaagaactaaaataaatttgaggaaatttaagatacttgtggttcttctgaaaaaaagtgtacattgaagtattaggtatagtattttttaaaggagggtttattgatatttaagtttaggtgcacatatataaatgcagacagtaatgagcaattaaatgtaacagtttggggatttagggagcttttaatttttttatatttgctgctgcttaattattatactttgtcatctttaaagacaactagttaagtatgtaggtgtgtctagcaatcgtttctaaactcggtctttataggctagatatcacatctatcaatttccttggccttattaagttccttggatcttacattgtagccctttagctcatacttttatgttgtttgagagtgttttgttgttaaaaacatggaaatcttaaaaaggagtgaaataaagctttattatagaggcatttattcaattatcattagttacaaggtaaaaagtcacaaatttattacatgaaattcacgttttataaagtacagataaataatgttttttagagatgattgaaactaagcacaagaggttcctggaaatgttaatgaaggttagagatgtgagtggaagcagaatgtgctttacattgaaaatccaatggcagtgccaacttggcctatcctaaaagctttctccactctactttgagtgacttgacttcctagatcttactggtaaaattttgaaagcagctttttactcaacagcaaagaatagtggttggatgtttttgatgcaggtttcttttaagggatggatttgagtggtaataatacaaagttcttgatataaaatgtaagagcaaatggaaataaggaccaaaacaaaaagaccactagaacctccttctatctaccccagcagtttctggatagaagtgctctggaagaagtgcagtggtgccatctacattcccttgtcttagtgaatttcaggaaaggagtttttcactcacctaggaactatagtcagacaagaggggtgtgtgtgtgtgtgtgtgtgtgttatggtaggacacaagtctccacaaagcccgcaaagttggagtacaaattcttaaaatagtaatac

SEQ ID NO: 77545 - DNA, 1280 bp, Homo sapiens
tttgggaggctgaggcaggcggatcacctgaggtagggagttcaagactagcctgacgatcatggagaaaccccgtctctactaaaaatacaaaattagccgggcatggtggtgcatgcctgtaatcccagctactagggaggctgaggcaggagaatcgcttgaacccgggaggtggaggttagtaagacgagatcgtgccattgcactccagcctgggcaacaagaggcaaactccgtctcaaaaaaataaaataaaaataaaagcaacgaaagtattatgatgttctaaatcctacctaaatattcttactcttaaagctatggtcataaaacccactggctttcttcaaaaggtagattacattattagaaagttgtaaagatatattatcaccaaactaaaactttgcttttgctttattcagaggaatttaaagataatagacaagaaatttctatttagggctatgtccctgtaccacactttagggaatgaaacactgtcatatgtcctgtcagataactgagttaaacatttcactttgcagttaacaaaacagctagagcctaggtataatgctgtggtatgtgtcttagtttttgctttttccgttctctcataataagtgatcctgagtatgtctatttttctctccaggatattttgctcatcaacctcattatagaacatatgatttgtgatacagatcctgaacttggaggagcagtccagcttatgggcctgcttcgaactttagttgacccagagaacatgctagccactgccaatgtaagccatgagcatttcccctctttttcatagctagtatattgtgtattgctggtaggaaccagtgtggttaaagttcatggaattgttcttgtttccttagaaaacagaaaagactgaatttctgggtttcttctacaagcactgtatgcatgttctcactgctcctttactagcaaatacaacagaagacaaacctagtaaaggtaagataattcaggttggtagttaagttctctgttcttgaatgctgaattcaaagttggtgttaagtcagtctttttaggaggcagttagtgggaggtagaggctgggaggacacaccttttaaaaagtagtagtctttaaaagttcaaaccatcaggttaacatagaggtcttaataatttggttggttggttggttggttggttgtttttatcaaaagcaacctggagaattaatgatgtattttgaaaagaaaggttcatgacaaaaatgtccctaa

SEQ ID NO: 77546 - DNA, 1155 bp, Homo sapiens
taggttccgtatttttataaatacaggaaaaataaatgttttttgtctgcagggcatggatgatacacaggtgcgaagtgctgctactgatatattctcatacttggttgaatataatccatccatggtacgagagtttgtcatgcaggaggcacaacagaatgatgatgtaagtaagaagttaacagagcaaaaaataaccagcaaggtaaatattatttgtactaatagtaagtatttatacataggaagctataactgtttttattattcacttttaagatttaattgttgctgtttgggaaaagtgtagccataatatcagacagcttattgttcccctaaattggttcctgtctcagtttatcaatttgtcctacagcaactatttatgttcatttaaattgccttttaaaatattcatgtcagtttttttttgttttgttttgttttaattctgaagtcaacttgctatattgtgttttttaaatcatttagtcaatcaattcttgtatctggggaattaagagtaagttacctaggaaaacattgactttagggtagattctcaaaatcgccaagaatgaagaaatgtagcacagtcccttaaaatatgaagggtgctgtttctttactgcctagccatagagaacaagctgttacgttgttcacaaacactcacgttagcatctgagatataccagattttaaagtagtagagaatatatcctggtaatgtgaagggtgcgcctggatcacatagtgcgtgacatgtgagagcactaaatgtgtgtgctctcctttattttaaaataattgaaccaatgattctgattttttcctgcttcccccataacaatttggaagcaactttttacgtaagaatgagtaagaaggacctgctctcaggtccttcttaagggaggaggggaataaagatcccctaaggaaaaaaaaaaaatctgtttagaattccagcctgtggtatttttacgaaataggaaaatagactgtcttactttttgaaaagatcctatttaatgtattgtgatgtcaaaaggaaatggaatgccatgtaactgctatgtttaagtttttatttttatagtgcaggataggtgcaaaaaagcaccagtttgaactgttgtgtcatgt

SEQ ID NO: 77547 - DNA, 1830 bp, Homo sapiens
tttctacaatcaattgatgttaaatattttcctttttgcttataattatatatattttctgtgatcataacattatgatatttggtgtttatttggtcttcacctcagagttaaatattgaagagtttggtggtggcagtgtcctttagcacagtcctaggactgtttctgagacttgccttggtctgctggaaaagagggccagggatatgagatgttagtggctgttttagcatcaggcttctatgttgtgggtctgcagagggctgtttcgtaacagtctcacttagtttagcctgtcctagaaagttgttcttgccagcagacctcatactttatagggaagctcattctgtttttgaactttgactaacttccttaaaattgaaagtatacatatttggagaaatgtaatgtagaaaagtaggcagttttgtcttgaaaatgaccattataggtttcttacaacatttctagtattcatcttagagtagcatttaggtttgctggtcacctgttatctattttgtcagcaattaaattttttttcataggttcaaggaaaggacccttccgtggacatcactcaggaccttgtggatgaatctgaagaggagcgttttgatgatatgtcatcgccaggcttagaattgccatcttgtgaattaagtcgccttgaagaaattgcagaacttgtggcatcatctttaccttcacctcttcgtcgtgaaaaacttgcactggcactagaaaatgagggttatattaaaaagctcctggagctttttcatgtgtgtgaagatttggaaaatattgaaggactgcaccacttgtatgaaattatcaaaggcatctttctcttgaatcgaactgctctttttgaagttatgttctctgaagaatgtataatggacgtcattggatgtttagaatatgatcctgctttatcacaaccacgaaaacacagggaatttctaacaaaaacagccaagtttaaagaagtgattcccatatcagatcctgagctgaaacaaaaaattcatcagacatacagagttcagtatatacaagatatggttctaccaactccttcggtctttgaagaaaacatgttatcaacacttcactcttttatctttttcaataaggtagagattgttggcatgttgcaggtgagttagatcattccttttttcatatttcaagagatgcagcgaaaacaatttgctccttttaaatacatacattgagttttaattttgttaatgtataaagttaagtattgtgagttattttaagagattataatatacaataataatacgagaccagaaggttactctatctggggtaggagaggtaagtgtgacaaatgtagtttgaagaaatggtatgaggggatgattttttggatacagggtcttgctctgtcacccaggctgtagggcaataatgcagtctcagcgactgcaacctccaccttcgcttccctggctgaaacaatcctcccactgcagcctcctgagtagctgggaccacaggtgtgcaccaccacccccagccaatttttgtattttttgtagagatggagtttgtcatactgcccaggctggcctcaaacctctgagctcaagcaatctgcctgccctggcctcccaaagtgctgggattacaggtgtgagccactgggcccagcctgatttttttttttttaagttgaggtcttgctctgttgcccaggctggagtgcagtggcacagccatagcttattgcaaccttgaactcctgggcttgagccgtcctcccacctcagccttccaattagctaa

SEQ ID NO: 77548 - DNA, 1001 bp, Homo sapiens
ctcatctttctgaatcaaacacttccactctggatacagtcttcctttatgccaatgtgtaactcaaacctgaactcactttgtcattgtcatgcctggctctcctttaatattgtctgatctttacctttgtttggtctttaatatcataaagtttttcatcatcttaataattttatcactagctgctttaatattcttttctgatactccctttcaacttttatatagtttatgttcaaggtgtcatttctcagtcactctttttatgggttctgtctgaacttctcaatcattttctagatccaagaaagtcattacattttgctctctgagatattaaatgtttttctatttcttgaaccatgttcaccaatttgctcaactcaaaaagatggcattcttaatataataagggcactcctctcttttcatttggtttgctaatcaaaatctaacatttttctgtggataaagtcatagtttgggtatcaggaacttaaaactataatgagagcttacataattaacaaattcagagccagtgtgagaccatgcaggtacaagccatgaatgtgacttgcctcctttcagtgctgctgtccacttggttgaggtcaagaccatatcaccttgcagcacatttcaagaaaagtattccaggtcgtcatcttttctagtatctatcagtgcatctgttcattacgctaagcaatttaagtttcttggcttttccatataaggtctaatttttttcattgctttaccattctacttggccttctacttgctttagtgttcactgtcccaaattctagggccaagataacaaaatttgtttcatttcaaagtttatccttgaccttttgttaccaaaaaaaatgccttactttaaaatgtagtcaatataagttacctttttataataagagcccctccagtggcataaaattaggttttatgacagattttcaggctcctagagggatcatgaaggctac

SEQ ID NO: 77549 - DNA, 1404 bp, Homo sapiens
ggattacaggcgtgagccaccacgcccagccaaatatttttattataccatgcatattgtagaatatatgctcttggtactatgaggaatataaaatggtctcagtaagtattgtatgtgcagtgtcttgctgagattacatcttaataaaaactgttgaactgttcattaaattttcattaaagttctgtctagatggccaggcactgtggctcatgcctgtaatcccagtgctttgggaggccaaggcgggagggcccaaggccaggagttcaagaccagcctaggcaacatgacaagacctccatctctacaaaaaatgaaactaagaagttctgaataggaatgaaagggtggtaggtgctaggagtttgctgcttcttgaaccatagcactttgctaagtttaaaaaaaaaaacaaaaaaacctatgtataggtaaatgctcacgtactacaaatgtagccaataatttcaagggcttcatggacctcagaggcccctggtgaaaaacacctgctgacaatagagggaagagagaaggagttttattaaccctatcgtcctaacatgccctagctattttatgcttagatttcctctttggacattttaatgacagcataaaatgtaagtcagtatgctcggatagcgttggtataattggtataatgttttgtttttatcttttgcaatgcatgaaaagaatatatttcatatattggtttaagttgtccttaaggaaacattatttttgttttatagattgggggaagtgaagtgtaaaaagtcattgttttgaaaaagaaagacattgataattgccagtattagtgttgcaaaaagtaaaaatgagcacagttttatttccttttgtttgttcattttcgtttgtgatagtgtatgttaatcattcagactccttttatgtctccaaaggacactctgattgtgtggtctgaagcagaaaattatgacttggcccttagctttcaagaaaaagctggatgtgatgaaatttgggagaaaatatgtcaggtaattttttaaataaaaaaatcaacatgctttctttaagtgtttagttttttgccatgctttcaactaatgcccaagagtttaaataaatttcaaattgatcttttaaattcactgctgtctttgaacttgatttaaaggaaggtgtaatttattgacactaaactctctagctcatacctttgctgaactccagtgttttatatccacctgcctttttgaaactttctcttttcatgttcactagcatctcaaatttagtactccaaaaccaaacataatcttctcacatatatctatcccatctccttctaagtgccatgcagttgctgaaatcagaaacttgtggatcttgtttatccttcca

SEQ ID NO: 77550 - DNA, 1047 bp, Homo sapiens
agatggggtttaaccatgttggccaggctggtctcaaactcctgacctcaagcgatctgcccacctcagccttccaaaatgctgggattacaggcgtgagccaccacgcccagcctactttttcttatttttattttattttattgttattttatgtttgcagaggcaaggtcctgctttattggccaaattgttctcaaactcctggcctcaggcgatcctcccacctcagcttcccaaagtgctgggttataggtgtgagccaccgcacctggccacctgctgctttttcttgttatgaatgtatcactagcacagctcttaataaccaaaataaaatcctgaaaattgagcgtaaagagaattgaaggggcactggaaaatgtgttttgattaatctggcaaaagttggataaagaggaagaagattaaaacagtattttctccaaaatgtgagaatgcttatctgagcgtcctaagccaaaaccagtttttgtaaagaaaaaaagcccaaagaaatggggtttgtggggaatacaggtgggaaaaaataatatggtgaatgtttagttaccttaagcactcaaaggataagaaagagattttggattaattaggtcacctgtcctagacatagttgggagggttggtgtgaagtggaaagctgttcatgtgcataagacatatacaaattgagttatcataacttggttaatttactgtgttcggtattacttggtactgttctgagcacacagtagtgaatggtcattaaatcattaatactggacagcattcataaaacaaatgaactttgatgtaaaagcaaactaaatttggaaatgttaagagcactcttagccatctaaccactatttggaatgggtaaagcaattgttaagtgtaatagaagaaatgaaagctccgtatgagagacagttgcagagaaaactgctttttctcaaatattttgggccagagtttgtcttcaggtagtacttgcaggtataaactagaactggttgataagaggagaggggtatggga

SEQ ID NO: 77551 - DNA, 1024 bp, Homo sapiens
ttaccattttggaaatagccacaaatctctcttcctccattttgcaggttggaggttaaatgactaaaacaaaatgactttaatttttatctagcagggagagcttaactaaattactgatgtgcccttgtaaatttaggctgtaaggaaaactgaatgcaaagaatggacttaggctgggtgcggtggctcacgcctataatcccagcattttgggatgcccaggccgacggattgtgtgggctcgggagttcaagaccagcctgggcaacatggcgaaaccccatctctacaaaacatacaaacattagctggtgcggtggcacgggcctgtagtcctatctgctctggaggctgaggtgggagggtcacttgagcctaggaggtggaggctgcagtgagctgtgatcatgccactgcactgggtgacagagggagaccctgtcacacacaaacacacatacacacacaccatggacttagaaaaaattccaggatacttgtgaaatactgtcagtaatctttagtcgatgattaacatttcttgtcacatctaaatagggataataagtcaaaatttactgactacctactatgtgccaaactcttttagcagtttacttatattgacttacgtaattcttacaacagtgtctgatttagtgctattaaccatattaaactcccatgttactgtctacttgcatttgctgctttattagcctgaaggtttatttcaaagaaaatgaaaattacttttagcctaaagatattttcggccgggcacaatggctcatgcctgtaatcccatcacttagggaggccaaggcgggcagatcacaaggtcaggagatcgagaccatcctggctaatatggtgaaaccctgtctctactaaaaacatacaaaaatgtagccaggtgtggtggcgggcgcctgtagtcccagctgctcaggaggctgaggcaggagaatggtgtgaacacaggaggcggagcttgcagtgagccaagatcagcaccact

SEQ ID NO: 77552 - DNA, 1649 bp, Homo sapiens
cggggcaccgggcatgtgtcgtctggctacgtggagcggctgaagggcatgtccctgcttgtcagggctgagagcgacggtaagtgaagccccgcgcggcgggaccctcgcagcccccacggccctgggccgcctccctggttcttgcggggcatggcgctcgctccacgagaacagagggacggctggggagggcggccacctcgggggaggacgggccccaggtaccccagtcttgcgggagctccccggagagcgcttgaaatgtttcctttctctgagtgcctggtggcattttgggtacgaggagagccaagcgtgtttgagctgtgccgccctggagtgtggagaggtcgaggacctgagatagggagtccggagtgtgctgttcttttgcactagagtgaccttgagaaagacactgattaatccgatctgctgccttagttcacccatctgtaaagcaggcatgaaactttgcttggagctaagaaagttcttggacctttcacactttgaagaacgttttgctgtgctttttttgtttttctttttaaacatctttttgctacatgtttctgatcgtgttgaagcttggcaacactgtatctggcaactctacactaagagaaaacgctttcccttgcgaagattttcgttcaccagtgttggttgtcttttttatagtaatgcagaattttgtgtgtagcttactatataaacatcttgcaaagttggaatcatatgagctttttttgattgcttaaatgggtgttcataatttggttaacaggtgcagagaagttggcagataatttttaaaacctttcggatcttccctagtgtttatgcttcacaaattttgaaacagccctcaaggttcaaagactaagttgtttgaaaataagtgtttcacgttttttcttttttccacatgtgctgtttcatattttaaaaggcttattctctgtagggattgccactgtttttggcgatatacagtgaatttcacttaaaatactcaagtggggtaaaactattctcaaattgttacttccaaacgtgaaagtaagttatcttccacttctttttgtacattagtttatattttgcagttgctaacgatgccagtttattatgattgtagcgattctgtatctgaattattgcaaactaatttcaaggaattttcttcaattggactctccccagaactccaattccatgaaaaaccaacaagactagcccttctgtaattgaagactctgggaatattgatgttctatttaaattgaaagtggtaatctggagtatattgcccacaggttataaggttacccaaagtaacttaaatctggagagaaattattttcttttggaggcatttaaaaatttttgaatgttgggtgtatttttctgggcctgagttattggcttcttaaaatacaatttgaatgtcaagtgttagtgtaattttgtatgtgactcacataataacctactctagatctttcacacatttggaaaactttacatagtatgttggaaggtatggactttttgtatcagcttcttatgagatgaaagtatccgtagatttctttttaattttttactttcaaaaaaataaaaacaggattttgccctgt

SEQ ID NO: 77553 - DNA, 1025 bp, Homo sapiens
cccgggaaaacgctctcggaagcgggtaggggcccaggcccacgctgcccggcgtccgcaggccaggggcaggggcagaggcagggacggggcaggaacaagggaaggtggcggcgggcggaggcgaggccgaagcgccggggcccgcgggcagaggccgcaaacgtatccacgcccctcgtgcatcctggagcggggctgatgacgaacacagggcgcgacggacgcacacaccgcccagcgctcgcacgacggtgcgtgcaaggaggcgggagggagcctcgggctgtcaccggcgcaatctgcgtcccgcctcctccgctccctgcgctcccgccacctcggcaactccgcgcccgcctcccgcctccgtcggaagcctccgccgcagtaaggctcccggtctcgctgctgtctctttaaatggtggggctacgagccgcccctgcagctgctccctgggtggccccgcgcgccgcttttgaggggcgaaccaagatggcggcggttttggctgtgtgaggaagacggaagagacggcggcggagggaaaccgacttccactagtccgggtcgcttgggcggccgggggccctcagagtctcccgggcagtggtagcagttgcagcaggatcaggcgcctgtcggcttctgacgtttaaaacagggggagcggaagggagccactggccgcggtggcagggccaggtataaggaaggaaaatatggcggcggcggcggcggcctgaggaggcggcggcggcgcgggaagctgcttcgcggagatcatggcggaggcgggagcagggcagtgacgggagccccgagttcctagcgctgcggggcgggaggctacgaagcgctgcgcggccccctcggggctgccgggcgccgggctcgccaggcctggacaatagcgccggggagccggaggcgaggaaaggcggcggcccagagctcggtccctggagcgggccatgcaggcggcggcgcggccccgcggcgcccagcggcggcagtgaggc

SEQ ID NO: 77554 - DNA, 1057 bp, Homo sapiens
aggttaagacgtggttccagaaccagagaatgaaatctaagaggtggcaggaaaacaactggccaaagaatagcaatggtgtgactcagaaggcctcagcacctacctaccccagcctctactcttcctaccactggggatgcctggtgaacatgactgggaactttccaatgtggagcaaccagacctggaacaattcaacctggagcaaccagacccagaacatccagtcctggagcaaccactcctggaacactcagacctggtgcacccagtcctggaacaatcaggcctggaacagtcccttctataactatggagaggaatctctgcagtcctccatgcagttccagccaaattctcctgccagtgacttggaggctgccttggaagctgctggggaaggccataatgtaatacagcagaccactaggtattttagtactccacaagctgtggatttattcctaaactactccacgaacatgcaacctgaagatgtgtgaagaagagtgcaattgacattaatcaatttcagtctgggcactggctgaatccttcctctcccctcctcccatccctcataggatttttcttgtttggaaaccacatgttctggtttccattatgcctatccagtcaatgtgatggagggtggggtatggttggagtctaatcagagagatttctttcttttttcctgttggatcttcctggagaaaagacaggcatgtgcctgtagtcccagctactcaggaggctgaggctggagaatcactggagttcaggaagtggagattgcagtgagctgagattgcaccattgcagtccagcctgggtgacagagtgagactccataaaagaaagaaagaaagaagagagagagagagagacagacagagagggagggagggagggagagagagacaaaaaaaaaaaaaatagatgaagttcttgaatagacatttctccagacaaggtgatatggtttggatctgtgtccccaccaaatctcatgtcgaattgtaatccccagtgttagaggtgaggcctcatg

SEQ ID NO: 77555 - DNA, 1049 bp, Homo sapiens
gtcgaagctctgtaagaagaaaacactttgtgggccaggttagtaggagtttttatccttccttatatttttctatgcatttaaacagtcagttaacaaagggaatacaggataatattaaagtcaaatagagtacagttcttcagcatcataaatcaaaattcaattgctacaaaaatcgaaacttgtcagactttttgctttaatacaaatagttggaatttctgagcaatcaggtttatctttaaatatgtttttttctgagcttttttacttcaaaaacgatgagaattatcaatttttcagtactactgacttgttccttgtggaaggagggaacattaagtatttaaatcaatttcttaagtcttcgagtatcaaatttattttgtttaatctttgatttaatgtttaacatgggcactttttatattctcttacctgagttagttttgaattcctagaacatgtccattttaacagtggttgtgatattatttagttaatactactgtctggattattttaaaatcttggtacaatttgtataaaacaacataacacttgttaacttgccagtcctctaggaacttgtttcctttccttactctgaatagactagtggtagctgtccattatcttttaccttaattacgattgtttgaaccacatttaaattccaaaatctatattattggtttaaaagcttcaacttgacaagatattattaacagtctacatgaaatcctcaaattatatatgaattttcaaacattgatatcagctccttgatttactttttaatatatatttttacgtaaaatactaattaaaatgttgttttatcatttattatttggaaaagagcttgaatttaagaattcatataaccagcataattttgaagaccattaagcctttatgaagtcaattcagttaaagttttcgtatatcatcgagcctcaacttaacggtatgaatggaataggaaatttacttgagatgattttcatgataacatttgtggtgattccattctcttggctaag

SEQ ID NO: 77556 - DNA, 1017 bp, Homo sapiens
agattccagaagtgtttggtaagacccaagagtagtttatgtgtcaggaatttcttctaaaatggttaaataaatatcaaagtatgctaggtttagattattatatgtaacctatattcatatttgtgactttttttttcttttatatgcagtttctgtggaaagagattttaaagcagcagtcccaaatagtcaaaatgctactatctctgtacctccattgacttctgtttctgtaaagcctcagcttggctgtactgaggattatttgctttccaaattaccatctgatggcaaagaagtaccatttgtggtgcccaagtttaagttatcttacattcaacccaggacacaagaaactccttcacatctggaagaacttgaaggtaaacaataaaatagcagtatttaaaaatcgatatgtagcatttaagtgctattattttacttttatatttttaatacaaaattcatataaaatttttttattttactttttatattttgctctttctgtagaagaacttaatgtacagtagttttgaaaggtcccattttgaaatctgatcataatacaataatttgtatgtagaattggccttttttcaagaaataatatgtaattggccctccatatctttgggttccacatctgtggatttaaccaactgcacctcaaaaatattcagaaaaaaaaaaagaatgattgcatctgtactgaacatgtgcagacttttttcttgtcattttttccctgaacaatacaatatgacaactatctcagtagcatttacattgcgttaggtattataagtaatcaagagatgatttaaagcatatgggaggatgtgcataggttatgtgcaaatactacaccatttatataagggacttgagcatccatggattttggtatccatagagggctggaaccaatcccccacatatactgagggataactgtaattagaatacctcagttatccgtcacatgtctagaatgaaaaagtaaaggag

SEQ ID NO: 77557 - DNA, 1042 bp, Homo sapiens
tttacttcttaaatgagaaattatttcatatgtgcaaaatagtacttttgacacatctacagattcagagaatacaaataaaataaatagccccgtgcctatgtattgcttaagaaatatacataaccaacattttttgaagccaacctgtgtattctccctgattatatctttttctttccactctccttgattctctatatggttttaccacatgtctatgcattccaaacactgtgttgtttagtctactttggaactctgtataaatgatattctactatgtgaatcctatggctttgcttttgcacattctgtgagattccttcatgctgatgtgttgtagtttgttcactttttattgccgcgcataatttcattgtgtgactttaccattctttatccattatcctgcggatggatatttaggatgttttcagtctttttttttatttttttgcttttaaatttaatttttacttttttccattaaaatctgtttttaagtgacccttctaactcatgtctctttgtgttcatggttttaaaaaccttcagttttgctggaaaacaccggattgttttataaagtggctgtaccagtttatagcctcacaagcgggatgtaagtgttcattttgttccctttttcagcaacatgtaagacacttctacattcgtaattacctgaattttttttcttttagacaatcgggtgagaaatggtatcccattgggggtttaatttaaatttccttaattactgatgatgttgaacctttcattgtttatgttttgtgggtgtttatgtctttggccatttttttgttgttgtttttttactttaaaacatagattttttttttttttgagacggagttttgctcttattgcccatgctggagtgcaatggcatgatcctggctcactgcaacttctgcctcccgggttcaagcgattctcctgtctcagcctcctgagtagctgggattataggtgcatgccgccatgcctggctaattttttgtatttttagtagaga

SEQ ID NO: 77558 - DNA, 1486 bp, Homo sapiens
agtaatgttgcttgcctttgagagctgggatatttgctttttatcatctcttttgtattttgtaatttttgctaatgaatatgagttaccttcataactgaggaagaggccataatacaaatttattctttgtttaacccttcatgaaaaatttaagtatatcttgtattttattgacttcatatgaattataattgtgcatttacgaataaaactaatattgagagattaattcaggtggagagaaaatgagtttgagattctggcgggacatctggcatagctgtctagtggatatataccaatagatatattggtatcaggttttctgaagtcaagatcagacttacaaatgttggaagcagcagtggatttgtggtggttaatcctgtaagggtgtaagaaatcattcaagtaagtatagtgtaagaagagggcaagaccaaggatggggaacaccagcattaagcgatgggtagagacagccaaggagtctgaggaagagcatcaggaaaggaggaaatctagggggcagtggtctcatagaagccaggagaggagagttttaacaaggagagaagtctatctgggagtcaagaactgattacgtgcctattgtctttggaagttaggatgggggctttaacctcagcagacataatttaagtacagtgtaagggtagaagccaagtttgaatgaatctgaggagagaatagtgattctgcactcacaagtaaatgtgagtttagaatccgtattttgagaaacaaaggttagaaggagaggcgatccattgattagggagatgattaaaaaaagaaaagaaaagaaaaaagagaaataaggatgatagactacctttgtgttatccataataattacaaattttaaaaacgaagtgcatcatttcataacattgttcctctctcatggttaagtagcagaagctgagagcaagaagctgagcatgttgaaaagaactattcgtggtaaagtagttatgccccgccccatccaaattatgaacacaattttagtggtgttttgtttggtgtattgagttcaggtgttatagtgtttaagtcacacatataaactgtgttggactctattttacctgagttccaatatgttgatgttctcaacttgcttttaagttatgcggttcttttacgtatgtcccaatggttcttctaaaaatcttatgtagaaatcaggtgttgggactaaagcagaatctgtgaggcatacatcatttagggcctttgcttcaattattattatgcattcaggggaaaaagctcttagattaaaatttctgtataatgagtttcacttcagtcttcgttgaaagtttgatttttttttgttgctcaagagttcagacaaatcattttatgagtattttccttaggaatatgaaaagaatagttaaaatggaaaaggctggcaaccaagtgttgatgaggatgtggagcaactgga

SEQ ID NO: 77559 - DNA, 1231 bp, Homo sapiens
ggcacgtgcctgtaatcccagctactcgggaggctgaggtagaagcattgcttgaacctgggaggtgggggttgcattaagccgagatcgcgccattgcactccagcctgggtgatagagggagactctttatcccaaaaaaaagatgaaaaaaaagaggatctgagcggttttaaccagcctttttttttttttttccttcagagggtattgtacatcattggcctctggtccttttgcaagataatcagtatgtcttcattttttcttagatgcggatcttgagtgcttctagtggctcatatgatggcaatactggagggatcatggcttttaaagttgacagcatgattcgagtactgattttgaccctttctgtgtgacctgtcacagaattaccttgactatgggtcttatttttctcgtctctgcaatgagctgacacctacctagtaaatcccatggggttgttaggatcaaatgacacattcatttgcaatgtttattaacgaataaatgtgccacttacagaaatgccttctaaagtccaaaattctatgcagatgttaaaagtttatcactgtcgaagggtagataagaatgtcagggagttactgaagccaagagttctttccaaaaggtaaggagaggtcaatgcatgaagtgcctgctgctgcgagggctggagaggtaagttttaagaagactgtacggactcgaggaccagaaggtggttgttgcctttgactagatccgtgtagatgcagtggtaggaacaaagcctcattgttgagtgggcagggagcaagtggagatagtgtttgtaggcaactctgctgagaaaccagattgcagagggggaagagggcatgagtaggagaggcaagtgggggtggaaggagagttgtttgaagcttagagacttgagcttatggtaaattcttatggtgaggacatgattagatggagaggctgaagagagtatacagagaagagttcctgagaaagggaaacaggatcggagcacagttttgaagggattggccttagatgggaaggacccctttattggggctggcactatggaagagaggggagatgtagatgtggggggatttgggtgggagaagttgcgggaatttttctctgcagttgaaggggagcttatctgctaaaaacaaggggagtagggcttggggcttgagaaattcacaggagggagagacagaca

SEQ ID NO: 77560 - DNA, 1027 bp, Homo sapiens
tcatctaactactgaatttaattttagcataatactggatcaaattgtttgaattttcattcctgtcatttttgatttttaaaaaatgaaacaaaactaaacaacaaaaccctaggaaaagaatggcttctttccaactagtcaattaaaacgtccagtatctccccaaataaagccttaggtttcttttaacctcttaatggttaattgaaaagagtacagaaactatcaaaatacttatccaatcaatggggggaaaagctatgtcttcagggacagtagagtgatgagaattttttagaaaacactattatccatcaaacttaaaagcatttggacctgatatttaaagataatgaagttttccacatattgaagtattcaagacatcttccatccacaaaaatttatctttaagttttgtaaatatcaagtaagtatagatgatatttattttatatattcctatggaaaaaatgctactttaatgttctgacatttgtgattatttgccagtctttactttttaacttattaaaaagttaaatacttattaaggtttctctatgtaaaacaatttaaattgtcttttgatttttagggaaatatctaaacgtgggaaatttccaacgcaaccttaatattaggttgtgttatttatagagctaaagttaatgcatttttgaatttctcaggagcactgcaaggcaaaaaaatactccaaataaaaatgatatatgtaagttggcaatgtcttcagtcacaataaaaaaaatttttagcaaacagctgctgactttttctttagaaatgatttacacatgttgtttgtagcagtagttgattaactactgaagctactgtctttattcaccggatgtctgctattaggatactatttgagccttggaaattttaagcatgaacaatttaaaagatgcttgagattatgtatgaatatgaaaagaagattttcatacataatctcaagcataacctcgtctctacaaaaatacaaaaattagcc

SEQ ID NO: 77561 - DNA, 1041 bp, Homo sapiens
tgttcctttttattgttgagcatatagtgcagatatatcacttagttttaacagctaaggtatctatttaaagataccatcttaaaactaaatgttacacaaattcatgcaactttcatataagcattaaaccatacagctgcatctacgtaagtataattagcaaaatcactgaacatgccacttcctgcctccgtctgcggtgttgacatatgaggtacagcaatccgagagtcaactgttatcacggtggccactgagggcagtgaaatcactttgatagcaccagtacccagatgtttgaaacttaagaaagtatttctttaatttttcataaacccatcataaaaaaaaaatcccgacttgaaacttaactgtatctggatgttcatatttttattagttgttgaagttgtacatttaaaaagatatttcttgcaaattttgtaaatttctatatgcttttaaaatagaaacatttgtataacaaggaaggatgaaaataaaacaaattcaaatatgtgaatagtcctggctgaggccagaactaaatttggttatttgcaagttttactgtgattaactgtactttctaatgtatttggaagactggaagtcttaattccatgttgatgggtgaaacttgtttttctgaaaaatgaagtaactgaaaatgctgcttcagaatgtcttgtatctccttagataactaatttatattgccattctttatttactatactttaaaggaagttgtcatgcaagttctatattagaactgtcaaactgcctcttggtttttgcctattattatttctctgtgagttgttactccttggtttttatatgctcctaacaaagatactttcactgactatcctacattatttgctgcttgccattgaaatttcatttcagtgtggagaaatgaaatactagtttctaagttaaaaaagacacatggtcctttatttttaagaaatagaatatgtaaaaagttttctcttttaatttgaaaaagagatgcatggttggtattta

SEQ ID NO: 77562 - DNA, 1342 bp, Homo sapiens
gtgttattaccgtcaagggagaatttttaagttgataagtgatacattgattatttttatttatctatgctaatcaatttaacaatattacacagataactttatgctattacattcagagttatttcattttgacttctttgtgaaagataggagactaaatccatattttattctttagatacagcagaatccaggtctggtagaagaacagatgtaaatccgtttttggctcctcgctcggcagctgtacctcttattaacccagctggacttggacctggtgggcccgggcatcttcttctgaaacccatctcagatgttttgcccacatttacacctttgccagcgttacctgacaacagtgctggggttgtgctgaaagaccttttaaagcaatagatgattctcaagccagagacaatctagcactttaaagaaaccatgaacactatatgtatgtactttatcacaaagtggcctttggggagaaagtcatgtatttgttcgcaattatgctttctctgaatttaataaaaatattcctaatgcttttagaaactgcaggtgtcaggagcaagtgtttgctatataatctgctttattccttctgatttgacctaatttaagctaggaacatttaatttatcttttaccttaatttacaaaaatacagacagacaaaaatactagtagctatatggcagctttttatttccttttgtgatttccaagctcatttaagctagagattgtggtttatcaagagagtgttttttttttttaaacgaagaataaaaaaatactagtagtggcttctctgcatagtgcagaaagttgatttgaagcatatattgatcatctttagaggactttgtggagacaggccaacaagattgttgctggaaggtcataggttccctgaggtgaagtatgtatttggtcctgtgcaatattatcatgtgtgtagattctttttttgtttgttttaaatagagatggggtctcactatgttgccaggctggcctcaaactcctgggctcaagtgatcctcccacctcagcctcccaaagtgctgggattaaggcatgagccactgcgcctggccctgtgtgtaaattcatgtgactaccaccacaggcaagacacggaagacttccattacaagcatccccctgtgttgccctctcataatcattgccacctctctccctggccctctccttaatccctgacaaccacttactgttctccatctcagtcattttgttattttgagaatgttatataaatggaatcaatatataccctcttgagactggctttttttcactcagcata

SEQ ID NO: 77563 - DNA, 1007 bp, Homo sapiens
gatattaactaaatttttagtatttttggaaatgtgtaatcaggacttccagaattccaataaggcatcaggcttttccaataaggcatcaggcttttgcttcatatattcttgtagcaatctgatatttaattgacttagattaatttaaatggtaagaaatatattccctttgtatatcagaataattcttctctgtctgcctaaccagctatgaattattcctctggaagtgatggggaattggttacatctttcttggccacctgctttgctttctcactaatggtggttcttgctaatccgagttagatgtgtagtttatagtttgagaagggtttttctcctttgaaaatttaagtgctacactcagtaaccaaacattggcatgttaatatatataagcgcagtttaacaaactgacttgagactccaagaatgtagaaagcactcttttatgttgaaagatctgcctagagcggacggttggtggtggttaacgtgtacatatttttctgtctcactaaattgtaagggttttatttatgttcatatcatatatactggcacgcaagaaaatttatcaattgaaattgaattataatctgttggactataaacaaattctttattggaagagctcttctgaaatcttcatattttaatagactaatatgtttactaattggactgtaaaggtatatgttatatactcatatcacacatcagatgcttaaatttggataaaataataaagaatttatattctgaaatttttgaaacttctgtcgtttagacaaatatttctatttttctgaacttgtataggaagggaaagtagtaaaatttatcagtcctttaggtagtaagtagttttgcctgctaaattttgtgaaaagtcataactttatctaagaggtgtaggctatactgaaaacagtttttcttttacactaggttgtagcatcttgaaacagattcccaaattcattatggcaggctctttc

SEQ ID NO: 77564 - DNA, 1051 bp, Homo sapiens
gaaatgtaaaattatgatgtgccaatttgttgcaatcaattacattttatgttcaatttttattttaaaccaaatgttgaagaccatggcaccatgtctaggtgttccagagaagagactctgatatggcaagttttactatgtcacagatgtagagtaactctttctccaaactagactaaatctcagttgctttattgctgaacttttaaagttcccccctccacctttttttttttttaacttccaaaaaattattttggcatgtgagattatttcacagaaatattttatttggcttaaaactcatttctgaataaccatattttccctgcccatataaatacagttctgatttcaaattgtggtttgaattagggttcagtttttgtagagaaatattcagaatctctgatgggaggaaaataagggtgcttgaagaaaaagaggcatctgtagggacctttgtagtaggtgtttgactttcttttcctttccaaacccctcatagttaataccatccttctagcaccgtcccttaaattctgagtttttccccctagactcaaatatcagagtacattctaactactgcttgagtttgcaacagccctttgcattccacatcacattagctcagggacaaactgtatgttctgatagtgagtttaggaaattttaaccctgtcattttcgccttaaggatgttttgactctacctttctgaatacagagactttaataaaaaccataccaatcttagtaagttttcatcaagaaagtatttttgatttggacttctacgcagtttgatttcttgatcagtttttcatagagcaaagttaaaattttctactttattttactaaaatttttatcaggctcagctctgctttgtgaattttactctgaagatgtctgtcatttcactttctctctctctctctcttttttttttttttttggagacagggtctcgctctgttgtccaggccggagtgcagtggcacaatctgaggtcactgcaatatctgcctcctgggctcaggcg

SEQ ID NO: 77565 - DNA, 1097 bp, Homo sapiens
cttgggcaatgtatgcaaagaggttttcacagaaggacagatccagcttgccctgtaaacatgaaaagtaatgctcaaattcactagtagtggtcagggaaataaaatttaaagtaacaaagtcataatcaacatcactttattagactttcaaaaatgaaaaagagaacatttgttgctatatttctggacttcctgtatctttgtttttttgtagtttatgttgttacttttttttttttttttttttacttctgtcatcatgttgtctttcagtggcatctgctctttttatttagttcctctaaatgaggcagtattgtattgaaaagaatgtgggttctgcctttgatacttattggttggatacatttgcccaaggtcatagaggtgcagcttcaccagctgaaatgtagaggttgactctaagatgtctctcagccttatagtttgtgaaataatttttgcatacttttttttaataaagttttctttctcaggaatgtttggatgaagcaaatgctgcattggattcagcatcaagacttacagaacagttagatgtaaaagaagaacaaattgaagaacttaaaagacaaagtaggtttttttcttttcatttttcccccactacaatactgatattaaatcaaatgtagtcttctgtcataaattggcatagttgagtgagaccaacttcattgatgtgtgacttccatttgtatcttccctgactgacttgcttcaatttaagtatggtcctagtgaaaccagagtcattaagttggccctggctgtccagttagttttcctggatgttgaggcaatgccattgcattggctgtcaccctgttgaccatcagaggggttgattggactgatttgactttttatggatatgatttctcccttatcagttcacgtgcatcttgcctaaggccatctgatctgttagagaaggcagaattctcaaataaaagagcaactttctgtagaatgaatgtctgggtatagctagatttttatgattgtagatggtgttttaccacaggtgcatcatgtattttttgatgtttataaggtgcctcatatgccct

SEQ ID NO: 77566 - DNA, 1042 bp, Homo sapiens
atttaagctttaataacttcataagtacaaatggtgtgggttaaaaaaatcatttgaaagtttacatttccttcacactaaatttagttttgtggatttttgaatagtaaatattttatttaaaattttcaatttcattccctctatatatcaatcaggtttcagcccctaaaagcaggatcagtagggtgtgtatgtatatgtgtcaaatttatatattgatatatatggatacacacatgcaatttattacaaggaattggctacaagattgcagccgctggataagcaagtctgaaatttgtagggttggcagtcaagatgggaagcccacatcaaaggcaggctggaactcagcaggcatgggccaaagctgttgtccacaggcagccaggaaaggaaagtcacaagcaggatggaactccataggcataggcggaacctgcggtccaaagaaggaatttcttcttttttagggggaaggctaaaccctggcttttaagaactttaaaactggttcagtcgggcccacccaaattatccagaataatgtgcctttcttaaattcaactgattaaggactttgattacatttgcagaataccttcacagcaacatctagatcatatttgattgaataactggggactgtgacctatccaggatgacacagtaaaaaggctatcacactgattgaagatggcaaaacttgaccttaaatttacatgggagaatacttgagaatagccaagaaaattatgagaaataatgcagtgaggagagacctgcctactagatgtcataatagagccataaatcgatacaatattgactagattagtggattaaggagaatccagaaatagagcccaggatatatttgagaatttgaaactaaaacctaaactaatttaatgagaaaaaggatagcttatctaattaatgatgttgataaaaccagctgtccataggaaggaaggaaaaaaaaacaacagaccctcaccttacatcataaacaaaagtaaagtctaattgtattaaa

SEQ ID NO: 77567 - DNA, 1054 bp, Homo sapiens
cctggaggaggaggttgcagtgagtgagccgagatgacaccactgcactccagcctgggtgacagagtgagactctgtctcaaaaaaaaaaaaaaaaaaaagtttttgaggtctactttacagtataatgtaattattagagtgggtatgtatacaaagcagtgtggaactgagactgtagagaaagtgttgccaaagaggaaatatttgagaagagttacgaagggagagaagaatctgcaagatagacaagatggagaagtgtttaggcagaggaaagtgatctcattagtttagtaccgcttaacattatcactaaggcatatattcttttctgtttgagacatttgaactgttttcgttggattattaaaatttaaaatggcttaacattctaacttaacacacgattgcaaaatactaatgttaactttcttttctctttagaggaaaaagctatgtattctgctgaactcgaaaagcaaaaacagcttatagctgaatggaagaaaaacgcagaaaatctggaaggaaaagtgatatcattacaggtaggacaaaatagttttctcttgtaggttttattattcatggaacagttacttgtagagtctttgtcttggaaataatctcctaaactgttcatttagtaaattttctaccctgaatccagccctctgctgtagcctgacagtgaacaagatacccaggatttccctaaggtgtcatagtttagagtagacacggcaaatgtaagatgacaggacatttaaatttttttggcacatagaggtattttagaggtctccggggaaaaaacacccaaattaatctataatttaactttataattttctctctttttttttttttttttttttttgagaccgagtttcactcttgttacccaggctggagtgcaatggcgtgatctcgacccaccgcaacctctgccttccgggttcaagcaattctcctgcctcagcctcccaagtagctgggattacaggcgtgcaccatcatacccagctaattttgtatttttaatagagat

SEQ ID NO: 77568 - DNA, 1259 bp, Homo sapiens
atttttgtgttgatgacagattatatccttagggtaagttttgagaaacggaacttctagatcaagaagcattttaaaacttctgagattatactgccaaattatttcacaaaaaattgtgtccatttgtattcctattagttgtatatgcatctttgtatttatctttttactatttatgacacaaagggagataaaatgagataatcatttctatctgtctgcaaataaattataggctagtagagacaatattcctgcgaattaacccctaccccacctttgcagagtatattattataccttcagactcagctggaaaacttgtttaaaacggggattaaaacaatgagtgatcatttggctatatgtttcagtttggcagaaatgctgtaacattctgtattctcactctttttttgcacttttcaagcccttattttctcttaattaaaatagtttctagtctctgcacttttcatttatttttcataataactttgagaataaccttccttacatagaggtgtgatctttttactccttttttcaaaaactggtcttgactcaaggatggtcccaggctcctaccaccttagccttatttcatgttatcagctacatccagccaaactgtattactcactttctcagagccactgttttcctgtttctttttcttctgctttttcttttcatatgccttcttctgcctgaagggtgaacctgatcccctgcaagttgttctatgaatcttgcctattcttcaattccattttcttcctaaagggtgctttatttagcaccccacttgtcatatccaaaaacaaatcttcctggtgtgatgtttttcctttgaacttgcataatatttagtttgagtcttatagtttgagggcacttatattttaatttagggtacaggtaattgtcgacgtgtcctatactgcctcccacccaatgaaatgtaaagtcactgggaggtaggaatgggctcattcattttctacctatcacatagcatatattacacagagtttaatagctattcagtaaatacttgttgtatgagtaactcagatctacaaaccggattatggtggtgtgagcccttacttaacaatagtaacacctggtatttattaacttctagagtgccatcatagctcatttcattcctacaatcacccactgagtgattgctaaccaacaaagttgaacaaggtccagagatatttgggagctgaatttagatcttc

SEQ ID NO: 77569 - DNA, 1047 bp, Homo sapiens
tataaaacaggagttcatagcagttatatggatagtgccagtagcttttgataatatttaaatttttatatgcaattcattttagtaagaattattgaggatttcctgttacactgtatactatactgtactatatgatagtatagtgtagggcttgtttggcagtgtatagggtgctgtgtagggtttgtttagtagtgcctttttactgtgatttctatgcttttagtagcagaaattttgaaaagagatgataggcaaaacaataaaatattcaactagcacttcttgagcattacttgctgccaggcataagatacaaagtgattcaacttcatttgccagttaggttccctcttagagtcttggattaaagttgtgaaaacttcattttttcctttgtcatctgatgaagtaggcacactgattatcagtgttaaggtgttcttctgagataacttcttagctttaatggtactggtctataattgatgtgaagagagtcctagaggctagagcttcctattgttcactagcccaaattggctctagcttcttaaggttataagagtagaacagaggaataaagtacaatgatgtcttctgtcatttatagatattttggagttttagcgttttgtacaatttagttctatttcattgacctttgcagatctaaagtgtgcagatattattaacactctcctcacttttaggaagcttccctaagttagctaagtggtacttaactattgtattacttgagggtaattagtgtaaactaatttcttccaatactctgtatataatataaaagtacctttagattatatcttgaatataatgagtaacatctttttttagggagaaaaggatgttctcaataggagatattcagatctatttaatttctcaagcatttgctctttctttgtagtgtgaaaaaaaaaaaaaactgaaaaactatttggaaaatattggcctccctatccagaagtgttaatattaaaggaacagattgttttatattttggttataatgattta

SEQ ID NO: 77570 - DNA, 3217 bp, Homo sapiens
gcagagaattgcttgaacccaggaggcagaggttacagtgagccgagatcatgccactgcactccagcctgggcaacagagcgactctgtctcaaaaaaaaaaaaaatactatttaccatctttggttttaaattcttatccctaaaatgctttaagaaatgacaagatggggccaggcacagtggctcatgcctgtaatcccaacactttgggaggctgaggcaggcagatcacccgaggttggaagtttgagaccagcctgaccaacatggagaaaccccatctctactaaaaatacaaaattagccgggtgtggtggcgcatgcctgtaatcccagctactcgggaggttgaggcaggagaattgcttgaacctgggaggttcaagaggtggaggcggaggttgcggtgagccgagattgcgccgagccgagattgtgccattgcactccagcctgggcaacaagagcgaaactccgtctcaaaaaacaaaaaagacaagatgggtttgctgtaaaataataataagtaattttgtagtgggtgtttttgatagaaaaacaatgtttttaagaaggattagaaatatttgaggattattttctattatgtatgagattttataaaattttctttgagtactaaaatgagaacatgttgtaaagtcaccatgcaaatttttctttcagcacatgattttgataaaagatcagctatcaaaacaacaaaatgaaggagatagcatcatcagtaaactgaaacaagatctaaatgatgaaaaaaagagagttcatcaacttgaagatgataaaatggacattactaaagagttagatgtacagaaagaaaagctaattcaaagtgaagtggccctaaatgatttacatttaaccaagcagaaacttgaggacaaagtagaaaatttagtagatcagctaaataaatcacaagaaagtaatgtaagcatccagaaggagaatttagaacttaaggagcatattagacaaaatgaggaggagctttctagaataaggaatgagttaatgcagtctctaaatcaagactctaatagtaattttaaggataccttacttaaagaaagagaagctgaagttagaaacttaaagcaaaatctttcagaattagaacagctcaatgaaaatttaaagaaagttgcttttgatgtcaaaatggaaaatgaaaagttagttttagcatgtgaagatgtgaggcatcagttagaagaatgtcttgctggtaacaatcagctttctctggaaaaaaacactattgtggagactctaaaaatggaaaaaggagagatagaggcagaattgtgttgggctaaaaagaggctgttggaagaagcaaacaagtatgagaaaaccattgaagaactgtcaaatgcacgtaatttgaatacctctgccttacagctggaacatgagcatttaattaaactcaatcaaaagaaagacatggaaatagcagaactcaaaaagaatattgaacaaatggatactgaccataaagaaactaaggacgttttgtcatctagtttagaagagcagaagcagttgacacaacttataaacaagaaagaaatttttattgaaaagcttaaagaaagaagttcaaagctgcaggaggaattggataaatattctcaggccttaagaaaaaatgaaattttaagacagaccatagaggaaaaagaccgaagtcttggatccatgaaagaggaaaataatcatctgcaagaagaattggaacgactcagggaagagcagagtcgaaccgcacctgtggctgaccctaaaacccttgatagtgttactgaactagcatctgaggtatctcaactgaacacgatcaaggaacatcttgaagaggaaattaaacatcatcaaaagataattgaagatcaaaaccagagtaagatgcaactacttcagtctttacaagagcaaaagaaggaaatggatgagtttagataccagcatgagcaaatgaacgccacacacacccagctctttttagagaaggatgaggaaattaagagtttgcaaaaaacaattgaacaaatcaaaacccagttgcatgaagaaagacaggacattcaaacagataactctgatatttttcaagaaacaaaagttcagagccttaatatagaaaatggaagtgaaaagcatgatttatctaaagctgaaacggaaagattagtgaaaggaataaaagagcgagaactggagattaaacttctaaatgaaaagaatatatctttaactaaacagattgatcagttgtccaaagatgaagttggtaaactaactcagattattcagcagaaagatttggagatacaagctcttcatgctagaatttcttcaacttcccatactcaagatgttgtttaccttcaacagcaactgcaggcttatgctatggaaagagaaaaggtatttgctgttttgaatgagaagactagggaaaatagccatctaaaaacagaatatcacaaaatgatggatattgttgctgccaaggaagcagctcttatcaaactgcaagatgaaaataaaaaattgtccactagatttgaaagtagtggccaagatatgtttagagaaactattcagaatttatcacgtatcattcgagaaaaagacatcgaaatagatgcactaagtcagaaatgtcagactttattggcagttttacaaacatccagcactggtaatgaggctggaggtgttaatagtaatcaatttgaggagcttctacaggaacgtgacaagttaaaacagcaagtaaagaaaatggaagagtggaagcagcaggtgatgaccacagtacaaaatatgcaacacgagtcagcccagcttcaggaagagcttcaccaacttcaagcacaggttttggttgacagtgataataattctaaattacaagtggactatactggcctgatccaaagttatgagcagaatgaaaccaaactcaaaaattttgggcaggaattagcacaagttcagcacagcattgggcagctttgcaataccaaggatcttcttttaggaaaacttgatattatttcaccccagctgtcttctgcatcattgcttactccccagtctgcagagtgtcttagagcaagtaagtctgaagtattgagtgaatcttctgaattgcttcagcaagagttagaagagc

SEQ ID NO: 77571 - DNA, 2989 bp, Homo sapiens
tcctgacagcaggaacatacacaggtaggtcaggaggtctggagtagcatactgtaataactgtatatgctgcttgtgtgcttcagaatgtgtccattttggtggacagtactttcttagtggtgaggcataaagagcaacagtttcagtggtagaaagaagttctatttttttttttaatgagatggagtttcgctcttgttgcccaggctgtagtgcagtggcgcaatctcgggtcaccgcaacctccgcctcccgggttcaagcgattctcctgcctcaacctcctgagttgctgggattacaggcgccagccaccacacccagctaattttgtatttttagtggagacggggtttctccatgttggtcagggtggtctcaaactcccgacctcaggtgatctgcccacctcggcctcccaaagtgttgagattataggcgtgagccaccacgcctggtgaaagaaggtctttataggggtacagagcaacagtttcagtggtagaaagaagggctttattgtatgtattcatagcaaggaaggaataagattctgaaagggaaaggtatttagaagtatttttatgtttgaaccactttggggaaatttcttggctaaggcaggtgcttaaatataggagagttgtaagctagtattattaagttaaaggccagtgtcttaatttaaattcctaattttaaaaagtgatgcatattttctgatatatgtgttcagaaaacatacatactgaaaaccttcggatagtacaagtagagtatcttttgtacctctgtggcttggcctctttcccagaggcagtctctgttaccaatttctagtgtttctttctggactatgtctatgcatgtatgattgtatgtatcagtagctttaaaaaatacaaatgtcagcatattataaatatcctttttacataccatatttccaacatctttccacattagtatatatgcagtgtttctcaaagggactgctattggcatttaagcaggaaaattcttagttgtgggcactacactgtgtattgtgggattcttgctgccactctttctacccactatgtgccagcagtatctcccagtcgttttaaaaattactatattatatatattttatctttcctgtttttgctcccattgtattctgctctttacctgactgacctagtcgtttgtagtttgcagaactctctgcacttacctggcagggcctgtaaccttttcatgatgtgtttggtttctgtagcttgtcctgatagctgtttctcctttcttttgatgttaaagtagtccattgtaactcttccttgagttgtgtctgcttactgattaagaataccaaaagtgcctatgagggccgagtgtggtggctcacgctgtaatctcagcactttgggaggccaaggtgggatgattgctcaaggccaggagttcgagaccagcctgggcaacatagtgagacaccatatctacaaaaaaacactaaataatttttttaaaaagtacctatgaggctgtgtgtgcttttaagatctacctaaagaaaatgtctgtgattctcctaatttgaacagataactttagaaagacttaagagaatgctgtttccatctttcagctgtagttagaataaatttttgaattagaaggaaataagaattgtgatacagatactctagtatagcttttatcggatctctgttttttcaaccaactctccatagcaatgttgagtttcttttataaggtttatattaggctgtttctttgaaggaatttgagattcttatttttttaattttattttttagagagagagagtcttgctgtattgcccaggttagagtgctgtggctgatcatggcatgatcatagtgcactacagccttgaactccttggctcaagtaatccttctgcctcagccacctaagtagcctcctgggactatagataaatgccatcatgcctggttcaatactctatttaaagtagattccatatgggtttgatttttaaaaatctgtcaatgaaagaaggctttaatatatagtttattacaaacatcataactagagactgaaataatgttgaagcatagagaactgtcccacttctgagattttggagaaagcattaaataccaggtagtagactataaaatgtatatatactatctttaggaatgtcaggtgtgacagaggggaacctagtctggttaaaaggtaaaggaaggaaggaggattctttctagggtcaagaaaaagttccatgttctaacagaagcaaaagtaataagggaaattcctttagtaagagaaaagaaaccttttattttctaattagagaggctaaacatttgggtgaaggagtgttgattttttatatttttatttagtctgaggctgttgatgactggatgttagagaatggaagtgaggaaggcagaaagacttgcggacattttggaaagtatgtatgtatggtaggtggggccaggggatggataaagggtagccacggtggagcaggataggagaggctctcaaatgggaacgttttttataaagaagaacttggtgctagaggacaaacttacagtcgctgcatctgtctagggttatagaaatgttttgcttgaagctacaagtaaaattgcacatgaatgaaggatgtggtttgttgaatttcacatacaattattgaggtattgttcaatattatttccaatatagagcacttaaatagaatcccaagttttgcttctatgtatgtttttaatcttttggtgtctccaattgaaagtatgtgttgcttttttccttttatcatttcaggaagaacttcagatgtcacttttaaaattgaacaatgaatatgaagtaattaaaagtacagctacaagagacataagtttggattcagaattacatgacttaagacttaatttggaggcaaaggaacaag

SEQ ID NO: 77572 - DNA, 1076 bp, Homo sapiens
tctgtgaaaatggaaatgtcctttttacctttgtggtaaatagttataatttatagatttctttgcattgtttggtgatgatactttggtaataaatgattagagatattatcactttctttcaaactaagatacataggcctttatgtagttgattcaaatattttcccccaacttatttattttaaaacacttagtttattatagtaatttaacttttaagctttccaaattctgaactgtcttatatctcttagttgtatatagcaaaccgtttatttcttggtacttgacatttgatgtcattgttttgtgtttatgttctaggtggctctggagttatagaaactgatctctctaaaatctatgagatgcaaaaaactattcaagttctacaaatagaaaaagtggagtctaccaaaaaaatggaacaacttgaggataaaataaaagatataaataaaaaattatcttctgcagaaaatgacagagatattttgaggagagaacaagaacagctaaatgtggaaaagagacaaataatggaagaatgtgaaaacttgaaattggaatgtagtaaattgcagccttctgctgtgaagcaaagtgatactatgacagaaaaggaaagaattcttgcccagagtgcatcagtggaagaagtgttcagactacaacaagcactgtctggtatacagtctttggaacttatttcagattgctgtttcattgcatagtagttgtttttagagacagatgcttcactaactgaatacttagtggaaatggcatattcctggaaatgactgtgtgtcatttgggtagaattgtgtggtttggattcagtgtaagagttaatagattgcaaataggaatttcctattaaaaaggattaggtattgctatactttctgtaactcatcacagcccacatcctccagttagggaatacagcctttcttcttcaaagtcagttgttacctgtttgaaacgatctcctatatccaagcaaagccctgagtgcttagagccataggtcttccaccattttctatgctcatgatgatatttagtta

SEQ ID NO: 77573 - DNA, 1011 bp, Homo sapiens
gctgagtgagaggatggaagtagtggaacagcaggtacagattggtcagaggggtgacactggtattggcagaaagtgtcattaggaaaaggagaagttcatggtcacagatattaaggaaaagacatttttacttatcgtttgttttagccttttcttgctgatgttccctcattagaagtagaaaaactgtttttgagacctaagaaaggaaagggtgaagttgttcagaatagtcctaattttgggtctgtgtttaaattcttttcagccttaacatgttctgagaattctttttaataatgcacacttttggacaacagttaaatatatagcttacataaatttattgattataaatgtgaataactttgtttttattttttaaggaactaaaacagaaccgaagtcaggaaattgatgaccatcaacatgaaatgtcagtactgcagaatgcacaccaacagaaattgacagaaataagtcgacgacatcgagaagaattaagtgactatgaagaacgaattgaagaacttgaaaatctgttacaacaaggttattagttttatttctttattattattattttttttgagatggagtctccatctgttgcccaggctggagtgcactggcgcgatctcggctcactgcaacctccgccccccgggttcaagcgattctcctgcatcagcctcccaagtagctggattacaggtgcctgccaccatgcccagctaatttttgtatttttagtagcaatagggtttcgccatattggccaggctggtcccaaactcgtgatctcgggtggtccacccacctcggcctcccaaagtgctaggattacaggcatgagccactgcacctggccagttgatagttttattaatttaacatattagatgacataactaaatgatagacctagcattctaagaccaggacagtgctgtaaacttgccctaagttataaggaagtgtaaatgactagttctgcttatctgccag

SEQ ID NO: 77574 - DNA, 1050 bp, Homo sapiens
acctaactcagccgaacacccctctcaggtttgttttctctaaaataaacctgtcttaactggcaagccaccctttgtgtttctctcctctttctttaattcttacagttagaaataaggcctaaagccccagttgagtaagcttcatctaaaattatagcagcattagcccacagagaaatagttttaatttctaaagcttaatttcccacaacaaaattctaatgaacatttctaaggggtaaaggtagacatcctaagatacagggcataggcaaaaagaatgacttttatgacaatgaagaacattagtgtcagtgaaaagttgttatggaaataaagcgatttgtttcttctgaatgctttcatatcagcctactattctgtgtaaactcagtgaaatatattttcttgaaaatacctatttattacttcatatggtattgattaaatattcaatatttgttatttctcttgtagcagaattacctgattctaggacaaaggaaattgaagccattcatgcaatcttgagatcagaggtaagaaaaatcaaagactacttagatttttcttttttgaagtcatgaaggttactcaaacattactttgatcctttctttttaaatgtactgcttagcactttttttctcttcttgtttaattttgattgttttttgagcttttatcaaccttctgtagatgaaaaatatatttacctgttactgcagtttgctattctttaatattcccatctctatttctgtataagtaggaaaactgccaaatgtagaaataatagtatcaataatttatcataatccagagtttactgtgttctaacagcatactaaattgcagtggcacatttatttaagaataattttttttttttttttttgaaacggggtctcactctgtcacccaggctggagtgcagtggcactatcttggctcactacaacctccacctcctgggttcaagcaattcttctgcctcagccccccgagtagctgggactacaggtgcacgctaccacacccagctaa

SEQ ID NO: 77575 - DNA, 1321 bp, Homo sapiens
ggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttctatttccttttgaatttgtgtttattgttaattcatagctattcaaagtgtgattagagctgggcttggtggcttgcatctacagttccagctacccaggaggcagaagcaggaggattgcttgagcctaggagttcgaggctgcagtgagctatgatcctgccactgaattctagcctgggcgacaaaacaggaaaaaagtatggatggaggaccagcagcatctgtatcacctgtgagtctttcagaaatgcagagtttcaggctacactcggacctactgaatcagaacttgcactttttacaagatccc

SEQ ID NO: 77576 - DNA, 4198 bp, Homo sapiens
gcaaaagagtacacgaaacctctcttaaatatctttacaacttcctttgaattgacagtttttcaaaatagaaagttgggtttttgtaaatacatgaattgttgatatacacaacaaatctcaaatgcattatgctacgtgaaagaagccatattcaaaaggctacatacctactgatgccttttatatgacgtgcaggaaaagataaaactgtaggacagagaatatactggtggctatctgggattaggaaatggggatcgaccacaaaggggcagcatgggggaattttctggggcaatggaatggttgtgtatcttgatggtgtatttgtcaaaatatatagaactataaaagtaaattttgctttatatgtattaaatcaaaaaaagaaactcgtgctcaaatagaaatacattttctgagaacttgccttttgatgactttgagaattttctggaaattttaaagaaatgtggttttgtttcccaacaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctact

SEQ ID NO: 77577 - DNA, 1061 bp, Homo sapiens
ttcaagtgattctcctgcctcagcctcccaaagtagctgggattacaggtgcctgccaccacgcctggctaatttttgtatttttagtagagatggggtttcaccgtgttgtccaggctcgtgtcaaacttctgacctcaagccatccacccgcctcggcctcccaaagtgctgggattacaggtgtgagccaccactcctggccatgataggttattttgtgatgaaaatacctacctcttaatttgtctgataaatttaaattttatgtctagatttcctaagatcagcacttccatattttaaagtaatctgtatcagactaactgctcttgcattcttttaataccagtgactactttgattcgtgaaacaatgtattttccttatgaatagtttttctcatggtgtatttattcttttaagttttgttttttaaatatacttcacttttgaatgtttcagacagcagcaaaagcagcaacagcagcagcagcagcagcagcagggggacctatcaggacagagttcacatccatgtgaaaggccagccaccagttcaggagcacttgggagtgatctaggtaaggcctgctcaccattcatcatgttcgctaccttcacactttatctgacatacgagctccatgtgatttttgctttacattattcttcattccctctttaatcatattaagaatcttaagtaaatttgtaatctactaaatttccctggattaaggagcagttaccaaaagaaaaaaaaaaaaaaaagctagatgtggtggctcacatctgtaatcccagcactttgggaaaccaaggcaggagaggattgctagaacatttaatgaatactttaacataataatttaaacttcacagtaatttgtacagtctccaaaaattccttagacatcatggatatttttctttttttgagatggagtcttgctctgtcacccaggctggagtgcagtgtcgcgatctcggctcactgcaagctctgcttcctgggttcatggcattctcctgcctcagcctcctgagtagctgggact

SEQ ID NO: 77578 - DNA, 1789 bp, Homo sapiens
caatctgccagcctgggtctcccaacatgctgggattacaggcatgagccactgcactcggcctgaactttttatagtagtaacgataattcagtaatgtccaataatgactaagtaagttataacaagtacaatgtcagcaataactagtgctttttagtaaacagggtcaggcaaccttgtacccttttaaaaatgttcgaatatcgatatacctccttcctacttggtggaggattgattgaggaggaaagtgtgcagtgatggttaccagcttcagcctcttggcttgactttgcaaatactggtgagaatttggaaagagcttgagaatatcttacatagtcacatgttgctgagaagagttaagaactaacttcttgatgttcatttttaacaatggcttgcattcaaaaccttgtagagctcattagtaggagctaagaagctaatatttgcctttcactaaaattcctgattacttagcctaggtagttcgttgtctctctaggttctgtctttgggagcttgggtctaaggttatcaagctaactctttcttccctctcacccttcccaaattgaccctggtgctgatttgttattcatacgattttctagtttttcttttccctttttgagtatttgaagcttcatactgaatatagtaatcatagtattcatgcataaagaaaatcataaagtaattgcataaatgcataaagtaatcatagttttcatgcattaaaaaaactagttttggctgggcgctatggctcacgcttgtaatcccagcactttcggaggccaaggcaggcgaatcatctgaggtcaggagttcgagactagcctggccaacatggcgaaacctcttctctactaaaaatacaaaaaaattagccgagtatggtggcgggcgcctgtaatcctagctatttggcaggctgaggcaggagaatcacttgaacctgggaggcagaggttgcagtgagccgaggttgtgccattgcactacagcctaggcgacaagagcaagactccatctcaaaaaaaaaaaaaaaaaaaaaaaaactccctattacagattcataatttatgagtcattaaataatattttcaagccatgacattttttccagcagtagtctctaaatctgttttaccatcataaaaccccaagcaaaactctactacatcagctgtgtcactgtaaaacctgccttaactcacagaagcatgaaattaagcaatgtgtgtgaaactattttataaactgtaaagtattccatacatacatgttggcagttattaatgtcttctctaggtgtggctttgaaatggatgcagatgctttctgttacaaaaaacataagttgcaaatgttctataacaaggagagacacaaatatcttcatggacatggattgctatgagtgtttgattgcctaatacttgagccaccacttcagtgatatggtataatttatcaaacagtgttgagaaacagaaactactggggatgttttaaagaggaaaatacttaatatagaaattaggggtttacataatcttaagaaaggatgaaggtgcagctcttagccaggcctccacagtaccacaaaccaacttgcaggaagagctgtaaccactgccccagttgggacaatgggtaatgaggatattaaatttaagaacatactgctatagcaatgatccttggcatagaaagctgccaccacaattgcctagagatgggaacatgaagtctggcccccattgcaacagcagtg

SEQ ID NO: 77579 - DNA, 1374 bp, Homo sapiens
aataatcagacccactgatcctaggtcagaaaacagagtcatagctcaatctgacttactatttgctgtatttcatccattctgagatgcacatagtttcacatttcaatgtctctgaaattgagaagcatcttacagtcataattgacagtatattagcagcacctataaatattggctcattttacatttgatggtataatgaagaaaatatttacctttttttctgttttgtttttaagtcacaactcagaagtagatgaaggaaaattctgatcagctgacatcctcttaatgtgagatatttctagtctttattcagtatagattaatggctaattatatgttaaatttcaaagtagtgcttattagtgctttttacttttaagtttcaaaattaacttttttattataataaactccaaatttatacaaaagtagaaaaactagcatactcctgtttatgacccagattcaacaaatactagcacacggccaatcttgcttttttttttttttttttttgagatggagtcttgctctgttgcccaggctggagtgcaatggcacaatttctgctcactgcaacctctgcctcctgagttcaagcgattctcccacttcagcctcccaagtagctgggattacaggtacacaccaccatgcctggctaattcttgtatttttagtagacacgggatttcaccatgtcgtccaggctggccttaaactcctgacctcaagtgatccacctgcctcggcctcccagagtgctgggattacaggcatgagccactgagcccggcccaatctcgttttataatactcccatctcccattctttccactgtcccacctgcaagtttggattattttgtaacaaatctcaatcatcatattattctataaccattttaatatgtgtctctaaaatatattagctttatttttaacatagttaaatgctattgtcataaaataataatcataataattaattgtaattctatatcatcaattatctagttaatgtaaaaaataaatctaaggccaggcgcggtggctcacacctgtaatcccagcactttgggaggctgaggtgggcagatcacctgagatcaggagttcaagaccagcctgaccaacatggagaaaccccatctctactaaaaatacaaaaaattagccaggcgtggtggcgcatgcttgtaatcccagctacttgagaggctgaggcaggagaatcacttgaacccgggaggcgaggttgcggtgagccgagatcgtgccattgcactctagcctgggcaaaaagagtgaaactccatctcaaataaataaataaataaataataaaaaataacttaaatctac

SEQ ID NO: 77580 - DNA, 2193 bp, Homo sapiens
aggaagccagtccaagtcccaaaacctcaaaagtagggaagctgacagtgcagccttcagtctgtggcaaaaggcctgagagcccctggcaaaccactggtgtaagttcaagagtccaaaagatgaagaacttggagtctgatgtttgagggcaggaagcatccagcatgggagaaagatgaaggctcagcaagtctagtacttccacactcttatttctgcctgctttattctagctgagctggcagctgattagatggtgaccacccagtttgagggtgggtctacctctcccagttcactggcttaaatgttaatctcctttggcaacaccctcgcagacacacccagaaacaataatttgtagccttcaatccaatcaagttgataatattaaccatcacaggaaggtactagtatcatatgtttaacagtagaaaccaagacaaatgcagctaggaagtgggagaactgggatcagatgcaggcagtctgattctaaatcagttgctgttacccactctgacaacagtaagtgagtagcctgctcagtcaagtactatattagtagggccctttacagacatatttatttctcacagtcactcaatgagacggctcttccagtcttacaatggagaaagtgaggctcagagactttaagtaacttaccttagacgactttactagtaagtataagaatcattatttggactaaagtctttctgaatcctcagcttgtatttttttccagtgttctgtgctgcctttttatctactagtgttttacatcaattttgaatctctttactaactggttaggttgatttttgccttttttttttaggttattctatatttgtcgttaagggtgatctgccagattgcgaagctgaccaactcctgcagatgattagggtccaacagatgcatcgaccaaaacttattggagaagaattagcacaactaaaagagcaaaggtaaaaatgaggcctgcagtatggaatatatggtagtatttcattatgagaattaaattttcatgcttagattgaatatgtggtccttgtgttgttggcgactctattttggaccttatattttagtgaagtttattagtttaaacttgaatcaactctttgaaatacttaaatatattaacttagttagctggtatggtatattcctagcacttcgggaggctgaggcaggctgattgcttcaacccaggagttcgagaccagcctgggcaacatggcaaaacctcatctctacaaatagtacaaaaattagccagatgtggtggtgtatgcctatagtcccagctacttgggaggcagaggaagaaggatcacctgaaactggggaggtagagactacagtgagccataatcacactaccgcactccagcctggtcgagagagtcagaccctgtctcaaaaaaaaaaaaaaaaagaaacggaaaaaaaaaacttagttggattcaaattgcaacacaatcattatattactagagcttatttgccagaaaacattttaagttttgacttacttaaagcctttacattacaaatgcctttatgttatgtctaaaatagaagattggttgcagttattaccagtgcttttgttctttagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtaaagacattctgatgtgtgttgtattcattgctgaagaattgattccaattattcttagatttcatggaagttaatgtactcttagaggtgttttgacaattactgcagaagcaatagctatatagtgggctttccctttagatttcttataatggaaatcactttttacaacctatattttattaggagtagttatatttttactcctggttattttatttggtttcaacactgtactaacacaatagtaaattgtggttttaatctttgtgggtatcagttgacccttatccaaatcagctgttacataaatatgtgccattagacactatggaagggcctggacagggaatataaactgattttacaaaaacccaacattta

SEQ ID NO: 77581 - DNA, 1129 bp, Homo sapiens
cttaaatgatctatccatccattcacccatccatctatcaaagtgactaggcctatttctgaagcccaggctggagtgcagcagcataatcacagctcattgcagctccaaactcctgggctcaagtgattctcttgccttagcctgttgagtagctgggactacaggcttgtgctaccacacctagctaaggttttactttaaatttattataatcacaaaattcagatgagcctttagtgctgtctgatatttctactatgttttcttagtgatgtaccaccctccaaggtgtttataaaaaattatgtaccactctccaagaagtttataaaaaataatgtgccaccctccaaggtgactaatttcacagcttatgtctttaaacctttaagcactttcctctcccttacacaccttccttgtggctttccgttacattctgctgagaacatagaagcaattaaaattatgttctttctaccagcaaatttatcaatttgcttatatcttcacctgtgctttgagcctatttaaatagatgaatggtcccctacctctaaccaaaaccagtccctcacttgtgggctggatcccagctcttctcacctactcaagatgttcctgctttcatctctccactctcttatataatcagttccccccccctttttttgtaatattcctataagcagtaaaataagctttttatttccattgattaaaaataaaaatcctctcttaattccatgaaactccagctgcctccccatttttattttttccttaggattgtctctagtgtgccttctccttttcttgaactctgcctcctgggttcaagcgattctcctgcctcaacctcccgagtagctgggattacaggcgtgcaccaccatgaccggctaattttttttttttttttttgagatggagtttccctcttgttgctccggctggagtgcaatggcgtgatctcggctcaccgtaacttctgcctcctgggttcaagcgattttcttgcctcagcctcccgagtagctggatttacaggcatgtgccaccatgcctggctaattttgtattttagtagagatggaaggggtttctccatgtttgttaggctggt

SEQ ID NO: 77582 - DNA, 1112 bp, Homo sapiens
cttgggaggctgaggcaggagaatcacttgaacctgggaggcagaggttgcagtgatccgagatcatgccactgcactccagcctgggttacagagtgagactcttctcaaaaaaaaaaaaaagtatttaatagtgataaatctgcagtattctcttgtagtttttaagatcatattattcagtcaaagaaaagagctcaacttgaaatatttccagagtttaaacaatcttactaagctttgatgggttgtatctattcttaacatgtgaaacttccttattacctataatatacactaacttaaatattgacaatttttttccagtggtttaacttgaattctctcttgacgggtccagaattaatatcagatacatatcttgcacttttcttggctcaattacaacaggaaggtaagtaacggctgaacattttgtaatgttacctttcgaagtagttaaataaccaggcacattagatgacagtgtgataaaactgtttttctggcagtggcagtgaaacaatctttagttttgacgtggtgataggctgtgatttgggtgacgctgttcagttagagttctcactgacacctggcccttcctcttctgaggatgctgctttctttgcagcccttctaagtaatggctttttcttttatacatcacatatcacacggctgagaggagggatagatgtttttcttctttgcctcttctaggccactgttcttccttataaactccagtttctttgaaatacatgcccctaacggctgggcacggtggctcacgcctgtaatcccagcactttgggaggctgaggcaggcggatcacgatgtcaggagatcgagaccatcctggctaacacggtgaaatcctgtctctactaaaaataacaaaaaattagccggggtgtggtggcggacgcctgtagtccgagctactcgggaggctgaggcaggagaatggcgtgaacccaggaggcggagcttgcagtgagctgagatcgcgccactgccctccagcctgggcgacagagcgagactccgtctcaaaaaaaaaaagaaaagaaaaaaaaaagaaatacatgcccctagattaaactat

SEQ ID NO: 77583 - DNA, 1024 bp, Homo sapiens
atccaggagtttgagaccagcctgtacaacatagtgtaagaccccttctccacacaaaaaaattagaaaatttgtcaagcatcttggtgcacacctgtagtcccagctgcttgggaggatgaagcgagagaatcacttaagcccaggtgttcgaggctgcagtgagctatgattgcaccactgcactccagactagatgaccatctcttttaaaaaaatgtgtttatatgttatatgtgatagtgctttttaaaaacatttttaaattatagagacagggtctcactatgttacagcccaggctggtctcaaattcctgggctcaagcaatcctcccaccttagctaacctcccaaagtgctcggattataggcatgagctgcatgcccagctaatttagtgatttttaaaaactgagctggtaattataaattctcttcctggaacttctgactttctcacaattggaatcttttgacaaaaattatcagtaatgggaaaactttgtgtagttgtcatttttcctcccatcagtgtgatagatatgattggagttatgttggactgatattttgaaaaaagatttaattatagctattaataaagacatttaaactactgactatgcatttttattcttttgggagggtttaatgtttatagtttaaagcaaactgttgtttttaaaaaagtatctaacagggccgggcgcggtggctcacacctgtaatcccagcactttgggaggcctaggcgggcggatcacaaggtcaagagatcaagaccatcctggctaacatggtgaaaccctgtctctactaaaaatacaaaaaaatagctgggtgtggcggcgtgcgcctgtagtcccagctactcgggaggctgaggcaggaggatggcatgaacccgggaggcggagcttgcagtgagccgagatcgcgccactgcactccagcctgggcgacagagcaatactctgtctaaaaaaaaaaaaaaaaaaaaaaaaagagtatttagcagaggc

SEQ ID NO: 77584 - DNA, 1680 bp, Homo sapiens
gcagttttatttaggaattgtgtggttttctggaacatctcagagacctggtatgaaaagcactcttctaatatatatgtgtttttttttatggatttagtgatatatctatacacacacactttttaaaacctatagccggctgggcgtggtggctcatgcctgtaatcccagtactttgggaggcccaggcgggtggatcacaaggtcaggagattgagaccagcctggccaacaaggtgaaaccctgtctctactaaaaatacaaaaatagctgggtgtggtggcgtgtgcttgtaatcccagctactcgggagcctcaggaggagaatcgcttgaacctgggaggcggaggttgcagcgagccgagatcgtgccactatactccagcctgggcgacagagcaagactctgtcacaaaaaaaaaaaaaaaaacctatagccttctagagaaatttatatatgaagtacacaactaacatagctacacttcctaaatttggaatggagtggtttagcttatgaaaagttgctatttttcttaacaggttataagcaatgccttgaaagtttggggtttagaactaatcctgttcaacagtccagagtatcagaggctcaggatcgatcctatgtaagattctgttttgcatttcatacatttcttttcccaaatttgatttttaaagttgtaatttcttaaagaagagaaatacattttgaatacttttgttttgatgttccctgtttcattcactcagactttcctatttcacctttgtgatgtccatgagcatctgccctgtagccttcctggcaccccagtgtctgtggcagcacagagctgaccccataagtggtgcatgaggccatcttgtggcacagcatcactaagctgctgcagagacgttcatatggttgtgtgatcttttaaaaacatcagtgacacttaactataaatataatcttaaattatcacaaattttatataatatttgccagtagacaacataaatatgaattcaatatttcaagttaatattgtctgttttcttttttagaaatgaaagatcatttatatgcaattataaggaacactggtttacagttagaaaattaggaaaacaggtaacatttcttacccttccttgtctttttttcttatattgtaccccatttaaaactaaaatgtgggccaggtgtggtggctcatgccaacagtttgggaggctgaggtggggggatcacttgaagccaggagtttgagaccagcctgggcaacaaagggaggtcctgtctcttaaaaaaaaaataaaaataaaaataaaaataaataaaaaaaaaaacaaagagccaggcatggtggctcacatctgtaattccagcttacttggaaggctgagtcagaaggatcacttgagctcaggagtttgaggctgcagtgaactatgattttgtcactgtaccccagcctgggtgacagagtaagactgttctataaaacataaaaataaaaaaaatatatttaaaaattaaaaaaaaaaaaggattgctgactttaaaattaggaaactgaccagtaatgtgtgtgtgtgtagcatggtttatccttcttgatagatagaaattgtcattttaaaagataatatcagttttccttataaatttatttgtgacaag

SEQ ID NO: 77585 - DNA, 1012 bp, Homo sapiens
tctctattcaggtaagtagtcacaagcatgtactatgtgttgcttacatcccaggcaccgtttcacagcctttcaatagtcactgtaacaaggcgaccttcggaagttcttctgtctacagagtatagattatactctagagtactagattttttttttcttgagacagagtctcgttctgtcacctaggctggagtgcagtggcgtgatcttggctcactgtagcctctgcctcccgggttcaagcgatcctcctgcctcagcctcccaagtagctgggattacaggcacccgccaccacaccagttaatatttgtatttttagtagagatagtggggtttcaccgtgttggccagtctggtctccaactcctgacctcagcctcccaaagtgctgggattacaggtgtgagccactgcacctggccaactagagtactagatttttatatagataaacatgaaaggattgtagaatcttcatattagagtggggcatttaaaaattccttcttgagaaagattaatttgcatctggatgctaataataaccttaattctggccgggcgcggtggctcacacctgtaatcccagcactttggggaggccgaggtgggcggatcacgaggtcaggagattgagaccatcctggctaacatggtgaaaccccgtctctactaaaaatacaaaaattagctggacgtggtgacacgtgcctgtaatcccagctactcgggaggctgaggcaggagaatcgcttgaaccagggagtcgtaggttgcagtgagccaagatcgcgccactgcactctagcctggtgacagagcgagactccatctcaaagaaaaaaagaaatccttaattctaataagtcacaatgtctcaaacttaccatctgttgggtaaatttgagaaaatgcaataccttgctaccatccttttaaatcagcctaccagactggatttccttattatggtttgtggcttttgattttttttttttaatgtata

SEQ ID NO: 77586 - DNA, 3693 bp, Homo sapiens
tttcctgtagcaatacagtttttctttgatgaagtttgatttcaagtacttatttttcataatttaaagctattttttatagagagaattttaatcaaatatttggatgtcactattgctatatatggtattaagtatggtgaccatagtttgtaaactccaaactgacagcaagacaggaaatttgtgttagcaaaggcttttttcttactgtttgaattttttaaaaattagatacaatacagagaggagcacacaaatcattaagagtacagctcagcgaattttcacacagtgaacatgtgtaaacagcaagtaacaaaagatttacctgcatcctataacctcccattattcccttttctaggtactgtctctccactgcattcccaccaaatataaccactatgctgaattctgacatcataaatgagttttgcctgattttgagcttttgtgactggaagtgtacagtgtatataccctttcgattctgtcctctttagtttaccattgtttgagaaatttatccatactgttccagaattaactactgttaattattgttaattaactactgttgtagttaattcatcctcattgttatctagtattcttttgtgagtaaacacaatttccattctactgtgatcccagctatccatttgggtcgtttccagtttggggtccattacaaatagtaatgctatctgtaatgctattttgtattactacaaatagtaatgctatttgtggcacaaaaatactgcttttgtgaacattcttatacatgtcttttgatgaatgtatgtttgcattgctgttgtttacattatgtacctagtaatggaattgctagatcataggagatgtatatattaagctttagtggatgcattacataattattagttattattggttataccaatttatcctctcatcagtagtatacaacagtttctgtatctctaatctccaacattttagccattttagagtttgtgtactaacacattgtggttttaatttacatttccctgatgactaataaagttgagtacctcttttgtgttctttatagccatttgactgtcttgtgaagtgcttgtttgtcttgcctatttttcttttctttctttctttttcttccttccttcctttctttctttcttctttctttccttccttcttttctttctttctgtctttctttcttgtctttcttgtctttctgtctttcttggtcttgccctgtcacccatgctggagtgcagtggtgcagtctcagcttactgtagcctcgacctttttggggctcaagttatcctcctttctcagcctcccaagaagctggactacaagcacgcaccaccatgctcagttaattttttattttttgtagaaatggggtttcaccatgttgtccaggctggtctcaaacttctgggctcaagtaatcctcctgccttggcctcccaaaatgctgggattacaggcatgagccaccgcagccagccttggctatttttcaaaaggatataagtagaacatctgtatatcccttcaatttgcatattattcagtaagagttgcactctggtagtagaaatatataaggaggagaaagaagtggaaacaaaaagtctattctcatgagaagacttgggggatagtgttctctctagctccaagctacttattccttacgaaaagttgaagataaacttatctcagactgaggctgtctcaatgttgtcttcctattccattatacacatataacccatatttttttcaccagctgaattttgctcctagaaaattgattcatcaggaaaaatatccgtcttgcaaggtggttctctttagagtctgctgtgtgacatagctcaggacaaattgtgtgatgtcagataggttgggttaaggaatagaccttattggggaaagagagaacttggagggccaaggttagcaggagaaggaaatgttctctcatctgccgtcaattcagggaggggcaaacctggtgtctgtgttcacagggagggatccatccatctgtgattctcccttcttatcaggtagcatgggaaagctacactgttgcggggaggagggtcacacgcaggctacttagtaccaggcaccctggacttggattcaggttgccagttgtgtgagaaactgcccagcacctgaaggccctgaacccatgagaagttgtacctacctcccatgaggaggaatcctgtcatcccatgggagctgagcttgggtgcagtccctcttgctggcttgtccaggagtgagctccagggttgtttgggacagttctgctcattgctttacactgtgtatacattatctgtagagttccatgaagagaacttcagcactgtaactgcaagttttaacatggaacagaatttttctcacctgtattaattcttaagatttgaagttctatcaacaagcatttagattgtgtggagatttttttatttttatttttggagacagagtcttgctctgttacccagactggagtggcagtggcatggtcttggctcactgcaggctctacttcctgggttcaagcgattctcatgcctcagtgtcctgattagctaggactacaggtacacaccaccatgctggctaatttttgtatttttagtagagacgaggtttcaccgtattggtcaggctggtctcgaactcccagcctcaagcagtccacccacctcggcctcccaaactgctgggattacaggtgtgagccaccatgcttgactgacatcatcatgttaaaagaataaatgttctagggagctgggcacagtgtcatgtttctgtagttctagctgctcgggaggctgaggcaggaagatcccttgagccctggagttcaagtccagcctgggcaacatagtgagatctctttttttaaataaataaataactgttctagggactaaaatttcctttcaccattagtaatttactgtagaatctccaagaatgaacttattttaggtactgaaaatgagggagactaaatgttttatacagtagtttttagtaaaatatgagatttgatgcatttgatagatgatgtttgtttaaaataattcttaaatttttgatcatgtaattatagtttcattaatggtagatttgtaaaataaatgttaccaaatgaaaatgcatgtacctatgttaattatccttatctaaagctgaaagttcagttcaactatgttaaaacatagtaggggcctggcagggtggctcttgcctgtaatcccagaacttagggaggccaaggtgggcagatcacgaggtcaggagatcgagaccatcctggctaacattgtgaaaccgtatcgctactaaaaatacaaaaaattagccgggcatggcggtgggcacctgtagtcgcagctacttggtaggctgaggcaggagaatggcgtgaactcaggaggcagagcttacagtgagccgagatcatgccactgcactccaggctgggtgacagagcaagactccatctcaaaaaaaaaaaaaaagttggccaggtgtggcggctcacacctgtaatcccagcacttttggaggccgaggcaggcggatcacaagatcaggagtttgagaccagcctggctaacagagtgaaaccctgta

SEQ ID NO: 77587 - DNA, 1036 bp, Homo sapiens
ccaaattctgtataaatgacttgaagtgctaatagcacaggttttgaaacctctgcctgggtttgagtctcagctctgccttttactacctgtgtgatcctgagcaagttacttagtatccctgtcctctagtttcctcctctgtagtgtggggataataacatagacataacctgagagttagagtgtagagaaggctccctggcagatagtgctgtagaagtactggccattgccattactcaggtgcttgtgtttgctgaacctcatagtaagggctcggagagcactaagaggaggtgagaaatgctgctagattgacagcttgtccccagatagcccattcccgagagcaccttaggtttatacctgatttgtgttgtagttagtagtgtctctggtaatttgaactagtttcaggttggtcttgaaaacctggggaggttgggggtaaatgatttggtagcagttctcttttgtgattttatacattatctttgtagaactgcagtttgctaattctctgagcccaacacaatgaagtctgggcctaaaatcatagaatttcttttatttttttttttgtttttaatttatttattccctccctccctcctttcttcctttcttccttttctttctttctttccttccttccttccttctttcttttctttctttcttttctttctttggagtctcactctgtcaccaggctggagtgcagtggcacgaactttcttcagagtctcactttgtcaccaggctggagtgcagtggcgcgaactcagctcactgcaacctccgtctcctgagttcaagagattctcctgcctcagcctcccgagtagctgggactataggcatgtgccaccatgcccagctaattttcttatttttagtagagacgaggtttcaccatgttggccaggatggtcttgatctcttgacctcgtgatccacctgcctcagcctcccaaagtgcggggattacaggcgtgagctaccacgcccagcctattttttattttttgag

SEQ ID NO: 77588 - DNA, 1055 bp, Homo sapiens
tttaacatctattacatctatgtctatcatcttcttgtttcagatgcaatttatttattttattgagatggagtcttgctctgtcgcccaggctgaagtacagtggcacgatcttggctcactgcaacctccgcctcctgggttcaagcaattctcctgcctcagcctctccagtagctgggataacagacgcgcaccaccacacccggctaatttttgtgcttttagtagaaatggggttttgccatgttggccaggctggtctcgaactcctaatctcaagtgatctgcccacctcagcatcccaaagtgctaggattacaggcatgaaccaccgcacctggcccagatgcaatttaaaagctatttcaaaaaaaaaacaaagcagttgtatttctgataatttttttttcttttagctatcatggtgaacttacttcagattgtgcgggaccactgggttcatgttcttgtccctatgggatttgtcattggatgttatttagacagaaagagtgatgaacggctaactgccttccggaacaagagtatgttatttaaaaggttagtctgcatttttttaaaccagcaattggccaaatttggggaatattctttttgatatgtgccaaaaataaacagaaggggtaatttttcccccttgaggacttagattcaaatgatactgtttttagtcttgtttgttattgaatccttggataaaacagtatgattacctctagaatttaaagtcttcatttaatgaataggctgtttcaggtctttgaaagtatcgtctttttttaattcaaagtgcattttaatatagaaacagtttaaaagtagctggccaaaacctagcttatatacagcttccacatatattgtcatatattatcttacttaagacatgctatagctgagataaatagtaataacagcagctaggtgctgtgttcttagcagcactacctgagagctttagacctggtggtagagtgatagcaactggcagctgcctggtcccattgtgcctctagagatggctcctctgg

SEQ ID NO: 77589 - DNA, 1013 bp, Homo sapiens
gcccgcacggagcagaggggtgacgccagcaaatcatactactttttcctcctcagggttgactcctctcattttttttttttttagcttccaaacattaccaataatttctgaataaaatttcgctccagacagacgaggcgtgcaggcgtgaccgccgtcgccttccgacagcaccgtgcccaccccccggagatggtctcgccctggttcctcctcgtctccgccgctagtctccagctccaaaatggcggctgccactgtggggcttctgccggccggtagtccctggcgctgctgacccagcatcggcttttctacgtcttgaacctggattcgcctaggggttgggaagggctgtggacggcgttgggggaggcctgacgaggcaagtgagggcgggagaaaggagcgagcctcgggctggggaaggcggcgtcattggccctccgggagcacggggccccgactccgacccggtctcccccgaggactcgcccccgccgcttcggctgcgactgtcccggtcgttcccggcagaagtggtcagcgagggaaagagaagtgacttctccatgggtttcaagctcccagctgttttgcggcagcccgtacggttccctcccgggatcttcttccctcctttctgcttccctctgcttcccctttcatctcttggcgctggaagagttaaaccgacgccagctttagctccttggcttcgtggctacggcgttcttagcctcccctgctcgggctcttcccgtcgttttgggttgagagaccacgaggttgctaagctctggacaccgcttaggcgtccttttagttcttcgactccagagacctttcggttgtttgtaccacactgtactaaaagggtcttgggccttcgcgccctcccgccatcgccctccagcgcttccactatcactgcgaagttctaattcttttttgacttcgtactattttacgtgctctttagaaaagaagaggtcagattgaaccccggc

SEQ ID NO: 77590 - DNA, 1720 bp, Homo sapiens
gtgttgagattaaaggcgcaagccactgcgcccggcaacatgcacgattattattaagagggcaagtaactgtgagatatttgcgatgaagtagtatctgtcaaaaccagtgctctgaaggaatttatgatatgatgaggcttcattccttcttgcagtacccatttatgctgccttgaccactgaagttggtattggatatacaaagatgatcacttttactcctctatacattgaacatccattcaacaaatactttatgtgcctcctttataacaaaataactaactttgcctagggcaacaaaaaggctttataaaggagtaaatatgtgagctgggtcatatagcatcaaaaggaatttgctgagctcaaaaggagaaggtaatttcgggattcagtacaggaatacagagctttgagaagctttagcatacttagggagagtgggataatcaacctgcctgagcatttagtgcacgagtgattggtgaagcaagaggtaggttaagatcagcttgtgaaggatcttggtttccaatagggagtttagatttttttcagtagttaccaggaatccagtggatattttgtgcaaggagtgagcaggaggatatttgtttttttaggatggtctctgacagctatatggaggatcaactgggaacagaaaaactagatgaaaggaaatgggcaatcattcaggtaaggcaatgagggcctccatggaggcaggacataaaggaggtcagagagacactaagtaaatgtcaaatgggattcacctgctgactgctaagttaatggtaagaaggtgacttgagtttttagtctgggagagtaaatggttggcaatactattaaaacttagtctgagacatgtacataaacataggatggtgccaacctgcactttaggggtgacaacatgatgctctatagtgtaaagcattggtttttatggtctggagtctagatctgcactgttatggtagtcactagccacatgtagctattgagcacttcagatgtcgttagtctatttgaaatgtgctgtaaatataaaatacacagtggattttgaagatttaatatgaaaatgtaaaatattcaacatgattacatgttgaaataatattttggttctattgggttaaataaaattcattaaaattcacccgtttctttttcacttttccatgtggccatgaagaaattaaaaagtacatttgtggcacgcattatatgtctgttgacagagctgttctagtctagactagatgtgggaatttgtaaggaggtggaacatgagctgggcctgaagacattgagcagtgatgtcagggtggcttcctggcaacctccattgccagttaaggcatttggtttgtcttttctcaagcagtaagaagccttcagagatttctgagcaaggggtaataggtgcagggtatttctgaagatgaatctggtagcaatgtttaggttggatgaagggaggaaatactggaggcagagaaactgagaaacccaaacataaggtagtgaggcccttcctgtattagggtactggcagtgggatagaaagggaatgatgtgcaaagcgttcctgagggaagaataatcaggaactggtaataatagactgtcccagaagtgaagaatcagcatgtagcatttcaaaccttggttacttagataacaactaatatattcatgt

SEQ ID NO: 77591 - DNA, 2292 bp, Homo sapiens
tattctgttagtttagacgttagcaaaaatggaaacatttggtaactgtatatacaaaatacacattaaaatttgctagttcatactaaataatttaatagtgtactagcttttaaatctaatctctagccttgtacttataagcacaaataactctacaagattacataatatagtaacaagaatgtttgcctctagtgagggagtggagtaggtgggggacaggagagtgaagcctgctttcactatatgcatttttacttttgaaatttgtattattgcatatacagtattacctattaaaatattatagttgagaaataaataacctttctttagggttgtaaaagaaatctgagtattgttatcttgttgacataggtaaaggacatggcctgtctatcacacctctgccagctggtcatatgataggtggaacaatatggaaaatagtcaaagatggagaagaagaaattgtttatgcagttgacttcaaccacaagagggagatgtaggtatatcaagagaaaagctaaaggcaatgcaattggtattattttattctttggagaaaaaataagaaacacagtttttgttttggttaccagaaatttagagcaacttaaaaccgtcaaatagggagtgttttcaaaattaattatttgcatagtaagggggaaagtatggtataagacataagagattttaaaaatttataggttaagtatacactctacaaaacgggtatctccctggagatgttgcaaaggagatgaattttttacgtatcaaattacatgttcttgacctgctatttaacacaactttgtggatgggttgttcttttgttttgtaacgtgatatggtttggctctgtgtccccacccaaatctcatcttatagctcccataattcccacatgttgtgggtgggacccggtgggagatgattgaattatgaggttgggtctttcccgtgctgttcttgtgatagtgaatgggtttcacgagatctgatagttttagaaacaggagttgccttgcacataatgtaattaccatctaatataactgccctgtatgtttaaagttagtccctttgaaagggaactcaattctagttatgattttacacacttcatgtggcactcagagcattactatataatattttggtgtttagtctcttacaggctcgttttgttttatctgtacattaagttcatagctattttgtgttacattacaatagtctcaggatctttatattaagaaatatttaagacaaatagactgaattttagacacttataaccatagattaatgaggaaaggatggctatgttgcagggcaaaagagtgagggtcgtgatcaactcagtataccactggaggctatatgagtaaacagcaaactgttcgcataaacgcagaaaattggcaaactgacaaactgtgtctgccacccagaaggaatgctgagggcagtcaggcctcaggtgcaggtgtttcttgtgattagacacatctgaagcctgttagcagtaatgtgaacctgtgatcaattaagcagctgaccaattgttacctcgtcctccctgctctttctacccaataaatatgaagggctgtagaagctgaaggcagctccctttgctcactagaagcagggagctctcttcttcttctcctgaccccttcctttaaaatagttacttttgttttaagttttcatttctgcattcgtcctccttcgttcagtctcgtagtaaccgtggcaaactgcagcatggctatttgagtaaatggtattgaaggattcaaccattttggaaaaaaatcaatttgtgtccttttaattatataacaaaagaaatttcagatggattagaactaaatagaaatgaagcaatattggtgagtctgatctctgatttggaaaagactttgtaagcataaaaataatgaaccaagttacaaagtaaaagtttgatagatttgatgacatacaggttcaaatgtctgaaacaacaaataaaaaaaaaaatcaaagtaggaaaatatttgcagcaagttgcccaaaaacttacaacatatatataagatcaagtattaatttattaataaaaatataccagttgcaagatggacaaaagttataaagtcaaaagagaaaatttaaatgatctttttttgttagataccattaaaattattattattcttatttatatttttatgtatttttttgaaacagagtctcactctgtcaccgaggctggaggcacaatca

SEQ ID NO: 77592 - DNA, 2092 bp, Homo sapiens
cccggggccagtacccatgggtactgagggatggctgtatatataattatgtgagtgtatatatgtatgtatataaatttgggaattcatcataacggagttcactggggtggataggcgagaccagggtagcccggaaacaccaggctggttacatttggcctggtcatacaattttctcagtgatacacacaccattttctatgtgtattatgatgtataaagtgttgaggactactgatttataattttttaatgaagaaagattgagagttaatgacactgaatatatgaagagatattcaacagaatcaaaagcagttgtaatgacctgaacaaaattccttcattttgtacttggcctagtagttgcttatttgtaaattatagtctttctaataaaaacagggagataaaattatctttaattttgtagcatagtattgttacgttctatggggattttacattcttgttttctagcaaatgtcctggaaacacttcgaggtgatggaaatgtgttaatagcagtggacacagcaggcagagttttggaacttgctcaacttcttgatcagatttggaggactaaagatgcaggattgggtgtttactcattggcactcctaaataatgtcagttacaatgtggtggagttttctaagtcccaggtttgttctcatgttgtcacttgtaataagtttgctacagtgattgggtctgtggaagtgggcgtcttaaatgttttttggattttatttttctcttgaagagattgttaataagatgataacttggcattaaccatttactgtcctgtgtgctttaaatgtattatttaatttaatccctatttattctattaagtagtttccattgtgtccctgttttaaagattaggcaaattgcttcccttctaactcttagtatcccagtctgtaaaatggggacaaaaatagaacctacctcatagcattggcatgttagaattcattgttctttcttttaaataagctttttgccttgaaatagcaatctttgggagtaagattttcatttagaacatataccttgccttttcaaaaagatttaaggtgatttatatgtgaaatataatgcaaaattggttttctttgggatgaaagtgagggtgggataatctaatgggaaatggaagcagaaaataagctgcttgtcaaaacagtacaaatttaagcaaccagtgggggtaaaagatagaacttgaattccttgactattagagaatatattgaagttataatatagtatttctaattcttgtcatctttccccccatgttaggtagaatggatgagtgataaattgatgagatgttttgaagacaaaagaaataatccgtttcagtttcgccatctctctttatgtcatggtctttctgacttggcccgtgtacctagccctaaagttgtacttgccagccaacctgacctggaatgcggattttcaagggatctctttattcagtggtgtcaggaccctaaaaactcaatcattctaacctacagaactactcctgggactttagcacgtttcctaattgataatccttctgaaaaaattacagaaatagaggtaagcacttgtatgtgaactttatcttaaaactgtttgggggatacattgtgcatgatgtaaaaaaatagtgaccaaaaataaaacttgaaattgttttaggatttttatcagaattactcttgagagccaggagtggtggtgtgtgctgtagtgccagctactcgggaggctgaggcggaaggaccactcgagcccaggaatttgaggtcagcctgggcaacatgccaagacccaccccccatctcttaaaaaaaaactactgtggaagagagcctttaatagcacaaatttcagagttccttaactggaggttctcattcttctttgagatggggtcttgctttgttacctagtctagagtgcagtggtgctatcatagttccgtgcagcctcaaactcctgggcttaaaggatcctcctccctcagcctcctaagtagctggaaccatagacatgtgccaccatgcctggctat

SEQ ID NO: 77593 - DNA, 1024 bp, Homo sapiens
ccgaccttaggtgatctgcccgcctcgacctcccacagtgctgggattacaggtgtgagccgtcgcgcccggcctattattattattaatttatttatttttgagctggagtctcactctgttgtccaagctggagtgtaatggtgcgattatggctcactgcagtttccgcctcccaggttccagcgattctcctgcctcagcttcctgggtaactgggattacaggcatgtgccaccatgcctggctactttttatatttatagtagagacggggtttcaccatgttggccaggctggtctcggactcctgaccttaggtgatctgcctgcctcgacctcccaaagtactaggattacaggtataagccaccatgccctgctggttttattattttttaaatgaacagataaatattttaaaaattgctcagttttaatttctgataaggtagacattgataaatataacccacaaaaacaaaaagctctttggggttctctaatttttaggagtctaaggtagtcctgagataaatatatgagaactactgatttaatcattccattttgatggattttaaaattttgtccagttttttactactataagcattgctgcaatgtacgaatgtactttttttttacacatttgtgattgtttcagtaggataaattcctagaagtagaaatactgtgtcaaatgtcaaattttatttttagatgttagcaaattgccttttaacatagttgcactaattttccaacagataatggaagaaggtactctttccccatgtatggcattgccaatctcatagatgaaaacaattatgttttttatattttgtgcttttcaaaaattagtaaaattaaggatcttttcatggccagtagttatttgtctttcttattttgtaaattgcctttttaagtatcttgtgctttttcatgtgttgatcatccttttcttaactaatttggaagagctcttaggaaaaaatcatttttattggtcgtagtg

SEQ ID NO: 77594 - DNA, 1050 bp, Homo sapiens
tgtaatcccagcactttgggaggccgaggcaggtggatcatgaggtcaggagttcaggaccagcctggccaagatggtgaaaccacatctccactaaaaatacaaaaaaattagccgggcgtgatggcaggcacctgtaatcctagctactctgggggctgaggcagagaattgcttgaacagggaggcggaggttgcagtgagccgagatggcgccaccacactccagcctgggtgacagagggagactctacctcaaaaaaaaccaaaaaacgcaatacatacagccatctggtaattgatatgaaattgcatcagctttggatgaaatgtatatttaaatcttgagatatgtgaggactccaaaaattatgccacctactagtcatatatgttatgtagtattagcttgctttttactgcttctaattagagacttattatttagaccagaggatttcttagtgccagagcttcaagctactgaagaagaaaaaagcaaattagaatctggtttgacaaatggagatgaacctatggatcaggatttatctgatgttcctactaaatgtatttctacaacagagtctattgaaataaagtaagtgcttttgtgacattttgaaaatagattataagataaaatttcaagcatttgaattatataatttacattatgtcaagcaaaatttctgaatattctttagtaagtttgtgcttttaaaatttatttttgtatgaagagacttgtgaagtatggtggcatgatattttctcttcattaatggtatttgaatgccaaagtaattgaattggtggtggtggggggtgcttaaattgtaacattaaattgtacatttatatgaagaaaaattatttttggcctttttattctgtaagcaggtgaaagggaataatgtgactcacagtttaatttttctgagtaactgcttgtttcataaaatatactccttaacttaaacatctctaagaccctaatgtctggaaaatactgttgtgatctgaagtagttagaaaccttttttctcc

SEQ ID NO: 77595 - DNA, 1742 bp, Homo sapiens
gtgccactgagagaagaagtacaggatgctatgagagtatcaagaggggaaaccacccacatttagaggtttagaaaaggtttcctacaggaagtgataactaatcctaactgatgtttagatgggttgtcaggacagacagagtaggaaagggggggaagagcgttctaggcagagggaaccatatttgcaaaagtacagaggtgaggaaaatgattaagaattcaaaagttttagaagaattcccggatatcaaggttctactcctaattggaacaaatggagatggataccaaatataggactagcacagtagagagataaattttgtctggtaatgggagatggtgtcagtttaaggccagagtgatgtctatatctggaagaaatggatgtgcacataccaggcaggaaatttattctgggcagagtaagaagaagcaaccttccaagaatatggagatgtgaaattctgtggtatattcaggaaaggacaagcagttcagtacctactgaagtatgccaagtactagaggatgggagtgatcagtggttctcaaccttgactgcacataagaatcatctggggagcttcgtgagggtcagagggactcagtttttctggtcttaatcttaccagttatgttagaaacactggatatgacgctctgatatactttttgttttaattgccatgtgattccattttgtagtcagggttaagaatctctattttggaaagtaggcaggggcccaatgatctgcaggtaatgaggtcattgcaggtcattgtgggactcagatgagtgaaagattttccaattttaacatattaccagaggtagaaaatgataataggttatatttaatttgttaatatgtattctgtgggttttatttctctccccctcctttgcatgtctaggtgaggttaaaagactcacttgtcagctctcttcagttttgtaaggcaaaagatgctgaattagcttggatagatggtgtcttagatatgagagtttccaaagtggacacaggggttattttagaagaaggagaactaaaggatgatggagaagactcagagatgcaagtggaagctccctcagattctagcgttatagcacaacaaaaggccatgaaaagtctgttcggagatgatgaaaaagaaacaggtgaagaaagtgagatcattcctactttggaacccttgccacctcatgaggtaaaaaaagcatgtgcttttttgatttcttcctgaatttgtcatccttctagttttcatgtcttttggtttttttccccccttctaaaactaagtgggtctgtggaaccttttatatttttaaccatttaaaatatatgtcagctgggggcagtgactcacgcctgtaatcccagcactttgggaggctgaggtgggagaattgcttgaggccaggagctctacatcagcctgattatagggacaccctgtcagaaacctagtcggcatggtggcatgcacctgtaatctcagcttagaaggctgaggcaggaggattgcttgagctcaggagttcgagactacagtgagccacaattgtgccactgcatctagcctatatgatagagtgagaccctgtcttgaacataaaatatgtctcacatttgggctgattttggagtttttaaaaaagagaacttgtgacatgcttctgtgtgtatgtctctgtgtatatattaattctatatagctaagg

SEQ ID NO: 77596 - DNA, 2935 bp, Homo sapiens
ttgagaggtatctagttaactagcaagattctaggtaattaaacttggaaaaatattaaaactatgaatcctacatgcatgtcaagtgatgtcttcagccctactatgaaattaagaatagagagacagcctctgttgttggattcccttctagtacaaccctcaaaattgggaggaggaataagaatatttttttcttctgtgctaaagctaatgctcttcaaagtaatgtcaaagcagaaagcagcagcattaggcaagaaccactttcgttactgattgtagaacctatggcatccattacatttgctctgaggaaggagggacagggaaaatgggattggggaggaaacgtcttttgaagtaagcaaatgactgggatctagaaaatgaatttttggttcagtcctgcccatggcacgctagttgaccccattatgcaagtgggtgagtgaagagcctaacattaccaaacgtctctgttatgatgaggcatgactaacaaaactgattgtgaaacagaaaatgtgaagggctttgttaaataatgttaaataatggggtaaaatttagaataacaacttggaatgtgatttacagtcttgaaatgatctgtcaaaggacttcagggaataatagaaaatctcttagagataatgtagtattttactttattcagtacagttgtatgtctggtgttttacttgaagttattctttcccctttgaccttatctaaggttcctggacatcagtcagtttttatgaatgaaccaaggctgtcagacttcaagcaagttctcttacgggaggggattcaagctgaatttgtaggaggtgtacttgtttgcaacaatcaagtagcagtccgcagagtaagtgtgttttcaataagggctgaattgaacacatacgtctgatgttttgtcattttgaaattctgtaattcttgtttggtattttcacaaaactgaagatcagtaatttatattcatgatcatgacctcaaaggcttacagaagtcttattgacttgaaggcttatgaaagactcttgaagaaatgatatataattttattgtaaattttaattatttgaatcttctgacatttatgtctatgtaaaattcatgacttcaatattatatccatatgctgtgaatcagagcaacccatgtcctgaccaatcataaagtaatctatttcatatatttcggttattatgtctgcatattaatgaatagaaaatgtactaaagaattttttttatttggtttctagacggaaactggacgcattggattagaaggctgcctttgtcaagatttttataggataagagaccttttatatgaacaatatgccattgtataaaggacatgatgtcaagaagtatctgcttgacctttctaagaaaaagggattcttatcttactctgagcttttgatgttttgttttgtaacatacaaaaagaatctgccagaaaaacttacatgtatcagatttttaaaaatataaatagagaacattttgcaaatgctcaaatgagcattctatcttttggctttcagagtgatagagctcctaacaggtgtacaggcccaagagttgaaggtgattggttttctttacagactccttgttctctagaagggctttttacttgaataaaacaatgcaacttagcaaaccaatttatggccttagagaaacatttttgcatgagttcttacaaactgtttgttatattttctggaatgataagtgagaattatttagaaaagacatgctccaaaaaaaaaacaaaactgataaaacagtttttcgaaacttacttttaaaagcatacgtgctatgactctctccagtttgaatatgcaattgttttcacaggcaggatgtctgttttctgcctgtatttcccagtgatttactctagggtaaggtagtacacatttggttcagaaattaatttttatttctcctatatcttgttttatcaagattttgttgtggcatttcaatgtaaattataacaccatcatttgagtatacataattcaaaagaactacttgatgcagtatagtcttaagggttctgcatacattttagaaacatcttagccgtaagttaggtcctgtgttaaactgtttagtgctctgtttttaagaaaacaaatgttgaacctcacacttttatgtggtgacagtgtaatttaattaaaaggtgtaaatgttttcatctcttaggcttgctgtctcctaaggtcacccaagcagtggttggattttatacacattactactaaaataatactgaagttggataaggttatcctttctgtatttgcgtctttcttgtgactaaccaccctgatatagtattaaccactgtgttcaagagtaaaaacaatatatgcaattttcattgaacttaaagagtgaaaaccatgtaaactattgaaactattgtaatccattaatgcttttttagaatggcagaccttgatgtttatttctcaaatggttaagccctcttctttactcttaatttttttttgagacagagtcacccaggctggagtgcagtggtgagattttggctcactataacctcttcctccagggttcaagtgattctcccacctcagcctcccaagtagctgggactacgggcacatgccactgcacctggctaatttttatatttttggtagagacagggtttcaccatgttggccaggctggtctcaaactcctgacctcaagcgatccacccacctaggcctcccaaagtgctgggattacaggcatgaatcaccacaactagcctacccttagatttttggaaggatcgatcttatttaactatgtgtggaacaacccagtaatatcagactcgaattactatttcattctatttcaaatgcttataa

SEQ ID NO: 77597 - DNA, 1028 bp, Homo sapiens
cgatctcggctcaccgcaacctctgcctcctgggttcaagcgattctcctgcctcagcatctcgagtagctgggattacaggcatgcaccaccacgcccagctaattttgtatttttagtagagacggggtttctccatgttggttaggctggcctcaaactcccgacctcaggtgatccgcccgcctgggcctcccaaagtgctgggattacaggcgtgagccactgctcctggcccaagatctgatggttttgtaagggaattttccccctttgcttggcacttcttcctgctgccatgtgaagaaggatgtgtttgcttccccttccaccatgattgtaagtttcatgaggcctccccagcctgtgggactgtgagtcaattaaacgtgtttactttataaattacccagtctcaggcaattctttatagcagtgtgagaacagactaatatgaataccaatactgaaaaattgtttcttgcctcaccttgtcctatgaacaggaattaaattttaaagtattgccttaagatggctgtgctaaataataatcattgcaagagcaatacttttacctgtttctagatgacaatattactaaaatttctcaaatgaagactttgttttagcttcaattacttcagaaaatataaattttaaagatgactatgagataaatcatgaactcagtggaattttcagatgagatggggcgcgttcagggtggtatgactgtagacggaattttcagatctttgttatttagaagcaagtataggtataacgtggactatcaactgatatctgcaaataatttggttaaaatgaaatttgattgtagtatttgttgctgtaggattataaatgtcaaatatcattgtaaacatttctatatttttagaaatatcttgggtggcctgaaacagaagtgaggaaatcaattttttaaggtgagccatttggcttttttaaaaaattgagattcaacttacataccataaagttcactcttctaaagtgtacaa

SEQ ID NO: 77598 - DNA, 1126 bp, Homo sapiens
tttacagagttgtacaactattaccactatataatcccagaacactttcatcactccaaaaagaaacaccatacccactaccagtcactcctcatgcccccttcctatgacccctggcagccattaatctactttctgtctccttgaatttggattttctggacacttcataaaaattgaataatacaatatatgaacttttatgtttgacttctttcacttagcataatgttttcagagtgcatcactgttgtaacatgtatcagtaccctttttgtgactgaatattattccaccgaatggatataccacattttacttatccattcaaccgttgatgtacatttgagttgattccaaattttggctattaagaatgctgctctgaacattcatgtgcaagtttttttttttttgtatgtacatatgttttcaattttcttggatatatatctaagaattagaattgctggatcatacagtaattctgcttaaccttttgaggagctgccaggctgttttccaaagtggctacaacattttgcatttccaccagcatgtgtttgagggttccattttctcctcattcttgacaacatttattactccctttttaaattttagtcatcatagtgtgggtgaagaagtgtctcactgaggttttgatttgcatttccttaatgactgatgatgtggagcctctttccatgtgtttattgactttttatatattttggagtaatatctgttcatatcctttgtccattttcaatttgtttatgttcatatcctttgtccattttcaatttgtttatctttactgttgagatgtaagagtttttttatatattttctggatactaaaccattatatattgatttgcaagtattttattccattctgtggcttgtcttttcactttcttcgtagtgtagtttgaagcacaaaagtttttaattttgataaagtccagtttgtttttttcccttcagttctttgtgcttggttttatatctttttttttttttttttttttttttgagatggagtcttgctttgtcacccaggctggagtgcagtggcgcggtctcagctcactgcaacctctgcctcccagattaaagg
